United States Patent 8,067,671 (METHODS FOR GENETIC CONTROL OF PLANT PEST INFESTATION AND COMPOSITIONS THEREOF) - sequence listing, part 38

SEQ ID NO: 73432 - DNA, 1442 bp, Heterodera glycines
  Genomic contig location: Contig_ID=SeqID_10274; Location=380..1821; Strand=+
  SCN-specific regions: Sequence locations=1-388,413-551,602-805,827 -1442
atggatttccatgtaattctattccctagtcataagaaatttctatcaattctcaaaaattcgaaatatgtaatacaatgaaaatacatatgtaccaaaaaagtcaatggaccttttattttattacgccgacctttgggaaataatagtccaattaaagtataattgttcgcgaatgatgtcctagtggcaaaaattgtcaaattctcattaaattacttagtcttgttaatgtcatccaaattatccaataaaataattttcctttttcttttctaaatttattaatttcaatttttataggacttcctattagaaaatttttatggagaagcagcttccattcctgaagctcaaaaaaaattctagatttccggccgaaaaacaccaaatttaaaattgcattttatctgcaacagattttgtgcaataattgctttaattacttttagaatgtaagccatataaaattaaaaagattgacttcatagcgacaattaggcatctgaatttgtttgctgtgcattgtcggaggatccattcttaagaagaaaaaaaaatttttaaataataaaaatggataaaaaaaaataaaatatttcaagaattaatacagttttacaatttccaatgagcaacacctgactgtgaatggcttctccaactcgtgctccatttccatgtaaaagcatcgcaaatcgtaaaccctgtccaatttggagaggtattgggcatgaaaggcgaccaccaaacgcacactgaggaaaacgccccggggataatcctcctaaattctaaaattgacaaaaaaaaaataataataaaaccaaaacagctaatttgtttattgtccactttaaatgaccctttttgtgtgctttatgccgcacgtgccaaaggacagtcggatttgcgcattccgtgccgccccgcgtccaatggcactctcatcgacaaacgcggaacgacagcgcggctctttgaattgaccttcaacaaacacaacgccaacgaagggattgcgagtgtcaaaacgctgaataaagtgcgttttgactatacgtgagaagtagagaccggacaactgaggtcagcggaatcccgaccgaatcgcgatcccgaatcggagtcccgtccagatcaatatcgatcccgaggcttttttcggcatccagcgggattataaggatttgcttaaactcaattttctttcagttttgtgccaaaatttatagtggctcaatcccgcgggattggcgtgaaatggtcgggagggatcccgactcgggatccgaggaaataccgttgctaattattcccgatgaaatttgaaaaagctcaggacggattccaatgatgacatatatataagaatgcgaacattggttgtttataaagccaattatgactaatttaattatatatcgatgatttgcagaaaa

SEQ ID NO: 73433 - DNA, 972 bp, Heterodera glycines
  Genomic contig location: Contig_ID=SeqID_10274; Location=1021..1992; Strand=-
  SCN-specific regions: Sequence locations=1-81,130-154,179-787,809-972
atggcatcatcggcgaaccattcgtcgactgtggtggaaattttattgaagtggcaagtttattaatattaaaaagcaccgtaatttatatattaaataaataattatttaaaagtttctatttattttcatcatgttgttaaccactttcatcgtattttatttctttatttttctgcaaatcatcgatatataattaaattagtcataattggctttataaacaaccaatgttcgcattcttatatatatgtcatcattggaatccgtcctgagctttttcaaatttcatcgggaataattagcaacggtatttcctcggatcccgagtcgggatccctcccgaccatttcacgccaatcccgcgggattgagccactataaattttggcacaaaactgaaagaaaattgagtttaagcaaatccttataatcccgctggatgccgaaaaaagcctcgggatcgatattgatctggacgggactccgattcgggatcgcgattcggtcgggattccgctgacctcagttgtccggtctctacttctcacgtatagtcaaaacgcactttattcagcgttttgacactcgcaatcccttcgttggcgttgtgtttgttgaaggtcaattcaaagagccgcgctgtcgttccgcgtttgtcgatgagagtgccattggacgcggggcggcacggaatgcgcaaatccgactgtcctttggcacgtgcggcataaagcacacaaaaagggtcatttaaagtggacaataaacaaattagctgttttggttttattattattttttttttgtcaattttagaatttaggaggattatccccggggcgttttcctcagtgtgcgtttggtggtcgcctttcatgcccaatacctctccaaattggacagggtttacgatttgcgatgcttttacatggaaatggagcacgagttggagaagccattcacagtcag

SEQ ID NO: 73434 - DNA, 1446 bp, Heterodera glycines
  Genomic contig location: Contig_ID=SeqID_10274; Location=2597..4042; Strand=-
  SCN-specific regions: Sequence locations=1-417,439-882,907-969,992 -1205,1227-1354,1381-1446
atgttgacaaacccgcaaaagtacaaaatcgaatccaggcctgggtttttccttagtccggtttcaggtccaggccatttttcggaaacctggggttttcctggacctggactttggtccaagaaacacaggcccaggcatgtttcaatctaatatttattaataaacacaaaaatatgtttttagaagaattcaaaaatttttttccatggaaattcgcccaaataataacgattgtctcaaggagcgattcattcgattaacgcgttacgttgcgtacctccttttcgatctgatggaggcaaacgaagtcagttttggggtgactgtgcattaaagtaaacgaaacttaccaattcacatcttcattatttgtttttttagctattttcagggtttccaaaaatggattagtgattctgaaaaacagcattatttttgggatataaatgcaacaatttatgataaaatcccgtcaaatgggtcaacctgagaattgagtcgtgtgaatttgcgtgcttttttgttcatttttttaaattttcgtttgcgatttcaaaataaggaatagcctatttttctccttttttaaatttttttgtccttttagacaacgtcccttcgcctgtccgccttttccgcactgctcagtcagcagcatatttttgacgacgacgaaaccgatgccaacggttggctggcgccgtcgcgggcgaatgcgactcgcagacgcaaacggacgggcaaattggtggcgcaattggttggcattgtgtccaccttcctcgacgcccaatttgagttggcttactgtaagtggtcgattcgtaatttgtaaattttagcgaaacaaaaataatttggaaatgtattggacttttcaaaaaaaaaaaaaattttttttttgaatttgtagaaagttgacgggtcgttttgcattcgaattccgtcgctccctccctccaacctcaactgcttcttcgtcatgtttcatttggtgtgtttcagtgtccgatgtcaacgattatgtcattcggctgcgcgagtggtcggcgtcgtgcagcgaatcgcaactgtccgccgagggccgtgccgacccgacaaacgcgtggtcccattgccaggccattctgttcctcaaccgaattgggatgcatttaattgacgagaaaacgagcgacgaattgagcgccgcgattggacggaacggcgcggaggaaaacgaagtgcaatgcccatttgaacagctcgacgaagacgacgagtgaatgtgatgggaggattgcgccatgactgaccactaacccctcggggttatatccctccgttaaatgaattcgtgaccaaattagaccattttattcattgttttgtttattaccaatcccatgcttatataagctattcgtcttatctataccaatgttattccactcattaaataaa

SEQ ID NO: 73435 - DNA, 1411 bp, Heterodera glycines
  Genomic contig location: Contig_ID=SeqID_10275; Location=637..2047; Strand=-
  SCN-specific regions: Sequence locations=1-87,181-326,348-582,630 -908,930-1045,1067-1069,1091-1330,1366-1411
atgccgaaacaggcggaagagaccaaaatgttgttggagcggaaaatgcgcgagactgaaatggccgcacaacgaatggctgcgcttcagcaccaacaacagcaaaaacagcagcaacagaatggcatcacaacgcccgggacggcaacagttgcgcagcaacaacaacagcagcaacaggtgttttttgtggttgggcacaaattgcaaagcaaattagccacaattaatgacccctcaaactgaatttgatcaattaaacgtggtctatcggaatcttcacagatgcagcagccacctccgtaccaagaagtggtcgagaatcggcaacaaacgcagcagcagcaaatgccattggccaatggtgtcggcgccgcagcagtgccattgaacagaccgacgacggcacaatcgccgaagaacaacggcgggacaaccacacccaataacaacaacaacaacaacttggtaaatacttttcacatcataataataaaagcggcggactcgcctgcttttctgcattggccaaaaagtgccatttttaaatcgaaatttgggtatttatcattgtgaaattgcaaaaaaaaaaataaatctaaattatatttaatttataattttttatagcggtcaaaattcgttaagttcatattttctcagattgtcgtcacttcgcctcagcaaatggcgcctttgtatttcggcggctgtcaatatgaaatggccacgacaatgtccgactcgcgcacttccgtcgccgccgaattgcagcacattttcgctgagctggaaatgtccaggtggggaacataaaagttactgtggtatactataacagtaacaaactgtttttgcactttaaatcaaaattttgtaatcattttttacttaccgtaaaaattggcaaattttaaaattaaaaaaaacatttgacctttttgagtaacggatcattggcattgagtgagtgtattgatttaagtcgttttctcacaaagtgtaaaaaccgttgggaaaacatgaatatttagtcaaatataaaattctcataataattttaatttttgtttggctattttttgccaggagtgagtacaacgagcggaatcagtcgctgcgagaccgtttggccaatttccgtgccgagttggactcgctgaagcgcgagggcaccgacacggaaaatgatcggctgttcgcccaaaaagtgatggccggcgacgcattcgacaaattttccacgctgcgaaaggtgggctcactttgtgcaattaaatcctccgattgattgggccatcggtgttaattttgagtttgacccatcggcaaatttttaatttaaaattattgaatttttaaattcagtcgaattcggccgtttggctgagaacatttcgccaaaattaaa

SEQ ID NO: 73436 - DNA, 517 bp, Heterodera glycines
  Genomic contig location: Contig_ID=SeqID_10276; Location=790..1306; Strand=-
  SCN-specific regions: Sequence locations=1-91,113-517
  Gene Ontology: Mol. function=protein binding; Cellular component =adherens junction; Biological process=cell-cell signaling
atgtttcagtcacttctcgacctctgtgtgggcacgcataacctttacctgcgcagacgacagcccgacctgctcgaggtgcaacagatgaagcagcaggcagacgagcagcgaaggcgcagaatggtaaagacaaaactgatcagagaacagtcgatcagcaaaaagtgacagtgggaaatgacaaataaaaaacactaatcatttattgattggtttagtggtcatttggatttggaattttattaatgattagctattgctaacaaataagcgattattgtacaagcaataaaaatgatatagcagaaactcataaaacaaaaagttccctgattaaatccgggttttttaattttttttgtatgacttttttaaacctttgcaggaggagcaggtgcggttgcaccgcgagcgtgagcagcgcgcgcaggcggagcaggagagggaccgctaccgcgcagaactgaaccatctgtcggaacagttgagcgccatgcaggtgatcgagctttaa

SEQ ID NO: 73437 - DNA, 902 bp, Heterodera glycines
  Genomic contig location: Contig_ID=SeqID_10279; Location=940..1841; Strand=+
  SCN-specific regions: Sequence locations=1-224,405-469,647-902
  Gene Ontology: Cellular component=secretory vesicle; Biological process=cell proliferation
caaaaccaaaattttgctattctgtttttacacagtacgagttgggtaatttagtagtgctgttcgagaacgaaaatttcccgagactcgagaccaagacttgaccccgagactcgagacccaaaaaacccgagactcgagaccaagacttggccccgagactcgagacccaaaaaacccaagactcgagaccaagacttggccccgagactcgagacccaaaaaacccgagactcgagaccaagacttgaccccgagactcgagacccaaaaaacccgagactcgagaccaagacttgaccccgagactcgagacccaaaaaacccgagactcgagaccaagacttgaccccgagactcgagacccaaaaaacccgagactcgagaccaagacttgaccccgagactcgagacccaaaaaacccgagactcgagaccaagacttggccccgagactcgagacccaaaaaacccgagactcgagaccaagacttgaccccgagactcgagacccaaaaaacccgagactcgagaccaagacttgaccccgagactcgagacccaaaaaacccgagactcgagaccaagacttgaccccgagactcgagaccaaaaaaacccgagactcgagacccaaaaaacccgagactcaagaccacgacttggccccgagactcgagacccaaaaaacccgagactcgagaccaagacttgaccccgagactcgagacccaaaaaacccgagactcgagaccaagacttgaccccgagactcgagaccacaaaaacccgagactcgagacccagacttgcccacaatcactcaacaccacttgaacccgagactcgagacccagacttgaccacaatactcaagaccactagaacccgagactcgagac

SEQ ID NO: 73438 - DNA, 764 bp, Heterodera glycines
  Genomic contig location: Contig_ID=SeqID_10281; Location=59..822; Strand=+
  SCN-specific regions: Sequence locations=1-185,235-276,307-370,403 -530,552-712,751-764
  Gene Ontology: Mol. function=extracellular matrix structural constituent; Cellular component=membrane; Biological process =extracellular matrix organization and biogenesis
gcattcccggcacaacgggacaccttggcgagtccggctaccctggtcaacccggctttcccggcgagaagggcattcaaggcttgcccggccttcccgggctggagggcatgccaggatcgtctggtccgccaggtctacctggcttgccaggcccagccggaccaagcttcagagacggtaagtaaaattttaatattttcgttgaaaaataactttaaaaaaattttatatcgtaatcaaatgccaactaaaaattcaaagaatttgacagtttttgaaatcaaaataaaatattctaaaaaattcattgagaatcattagtaggtcaattatttttaaaacttttttggatcaaattttttcctacaaatttttttaaaataaattttaaaataaattcatctattattgtcattttgtaaggttttatcattgtcacccactcacaaactgctcaagtaccgcaatgtccacaagacacaacaaaactgtgggacggatattcactgctgtatttggaagggaacgaaaaggcccacaaccaagacttgggtatgataattaagaaataagcaattccctttaaatattaattaaacgaattaaggtcatgccggctcatgtttggcccgcttctccacaatgccattcctgttttgtgatttcaacgatgtttgcaagtgaacaaaagaaaattcttgaattttccaaaatttatatattatttaaattaaaaattaaaattatccagtaataattaa

SEQ ID NO: 73439 - DNA, 980 bp, Heterodera glycines
  Genomic contig location: Contig_ID=SeqID_10282; Location=1752..2731; Strand=-
  SCN-specific regions: Sequence locations=1-125,164-288,310-468,511 -624,647-655,677-729,752-811,837-859,881-980
atggtctattgtgagcctggtgatatggtgcaaggtgaagtgtatttgctcgctactcttatcgtggttatttttactttggctacaactgtaatttatattatcatggctattatgctaaagggtaaatttaattacataattaaaatacataaatttaaatgactattttacaattgattattaaaacaatagcttttcatttctcagtgatcagaagtgatcagaacaacagcaacaattcttcacagtcccaaattgaaatcactcgtcgcattttcaaatcattggctgtgatcatggcagtgatcttttgcctttggttcaccagttgtctggtggttaacattgtggggcgcggactgatcacaagtgatccgtcatctcaatttctgatcacacgattagtggtacaaatggtcacaattgcaggggcgatcaatgcaccaatcctatatatttgcaggcaaatttagaattaataataaaatcttttttttaataaataaaggttttttagcaaagaatatcgtgatatcttgaagagtgagttcggttgggtcattaaattgtggtcaattcgaattcaaatttcatttgcccatccaaaaaccaatcaaaatgcttctgctgctgttattgttgtgtcaagaactttgaaaaattcaaacgaaaatcgagtgcatatccgatgaaaaaaagaaaatgttttaatagcaaataattgagccatatttttacaaaattagattaatttatgcctttttagaactgaccatctaaccaattaattcttgtaactccgaaaaacaattttaataaaattattatttttaggatatttttcaacagctgccatttccatgctcttttccacagtcaagtcgtccacaaggcatcccatccacagacaactcatccacatttttctcggataaaaattaaaattaaatgggtgcaaaatgccgatgaaaaataaa

SEQ ID NO: 73440 - DNA, 376 bp, Heterodera glycines
  Genomic contig location: Contig_ID=SeqID_10282; Location=1..376; Strand=+
  SCN-specific regions: Sequence locations=1-110,133-212,250-376
  Gene Ontology: Mol. function=extracellular matrix structural constituent; Cellular component=collagen type IV; Biological process= extracellular matrix organization and biogenesis
taattttataatttactaaatttagctctcccggctctcgtttggaagatttccgaacaactccgttcattgagtgcaatggtgcccggggatcatggtgctagactttaaatttatcttatcattttttgaaaaattttcagccatttcttcgccaacaaattcagtttctggctgacaaccattgaggaccagcaacagtttactgtaaagctactgtatttttaaaaaattaccatttaatttattcgtaatttacggtttatccaccaaaattcctttaagatcccacaaagtcaaacactgaaggcgggcaatcaacgttctcggatttcgcgctgccaagtttgtaccaaaacaactcgataaacgccgt

SEQ ID NO: 73441 - DNA, 146 bp, Heterodera glycines
  Genomic contig location: Contig_ID=SeqID_10282; Location=2951..3096; Strand=-
  SCN-specific regions: Sequence locations=1-58,80-146
tcctcatttttcttcgcaaacggattcctctgttgacttgtgtttatgcacaattctttgcaccactttcatctttaaattctgcactaaatctgttttggataagcattgatcgttttgtggcattggcattccccgttttgtaa

SEQ ID NO: 73442 - DNA, 1374 bp, Heterodera glycines
  Genomic contig location: Contig_ID=SeqID_1418; Location=3053..4426; Strand=+
  SCN-specific regions: Sequence locations=1-97,121-246,268-1170,1210 -1222,1244-1374
atgaggctgttaatctgtgacgaggagctgagtttgttcaacctgaacaacagtttgaccgttgcactgctcgacactttgtggcgtgtttccacgtaattttgtttttccataattttaattaattgttcatttacctatcattttccgagtcgtttatcgtgggttagttatgtaattagccatgaaaatgctacttaatgagctaatcccaaaaacaatgcgtgggagggagtgggtgttaaatgtaatttattttgttattttaaaggcatcccaattccgatgaattcattaaaaccaaaagaataataattatggggccataaaaaatctaaaaaatgccggctaaatttaatttaattggtgccatgccattcattgcgcccgcccttttcagcctgtacaacaaagtgcactgttggcttggcctgttcatctgcgtgttcggctcgttggccaactgtgtgcacatttttgtgctgtcccggcccgccatgcaaaagtgtgcggtcaaccgactgttggccatcatcgcattgtgcgacatcgccacaatggcctcctacacagtgtttgttgtacgctttgagtttgccgtggacaacgaagagccaccgctgggctacgacttcttttggtccgcaaattatatatttttttgtataaataaggaccatacaaatagtcaaggacatttggactagaattaagtttgtgagaacatgcgtgcttaaatgtggaaaatccagggatattcaaggacaaataaatgctcagaaaaatttcacggcttaaattatttaagagcattttcaaatcgagatcaatctaattgatgaagttatttttaagaataaggacacaaaaaacccataaaataccttaatgagattatttatgatcgatttatcgatagctttattcgaatttatccaagtttatttgatcagccctgcttttacattcggctgatcaatttgatcaaattcaggattgtcttcctgttggcccatgttgtctgttcaatcgcgcttcacacaatcaccgtgtacttgactgtgatcacagcattgatccgctacaaaacgctgaagcgtgtcagctctttgtggaaccatgagaacattgcttggtaaaccaaaaatgcttggcattatgtgtctaactttttattcaatttttaaatttaagtccaattttcgtcgctgtcgctgtcctgacagtgttcttgtgcattcccacttttctgatccattccatcattcccgtgtctgccgctgatccgatcacccaccaaaatctcactttgtacactgtgggactggccgagttcaagcagttcgacacatgcttgttcttcaagctcaacct

SEQ ID NO: 73443 - DNA, 1695 bp, Heterodera glycines
  Genomic contig location: Contig_ID=SeqID_1419; Location=1..1695; Strand=+
  SCN-specific regions: Sequence locations=1-329,351-709,731-757,791 -856,879-1062,1109-1396,1419-1695
gtgggactggccgagttcaagcagttcgacacatgcctgttctttaagctcaacctgtggctgaccggcataattttcaaggtgggctacactatttcgaattatagaatggatactaagacttacaatttccgtttataatttaaatcccatttatttttttatgtttttttttttgcttttcttggcacattaaatattcaccccatacaatttcgaagtgccgaattaaatacagtattaattaaattacagacttaattacctcaattaacattctccaaaaattcaagcttttcttttgattaaaagatttttttcgatttcgaaccctttaatttttaatttaacttccttctaaatttgatttgcgtcatttcgcgcacgcgttttagagcaaccctataaaaatttactggcttatttgtgtttttttattgctttgtgtgcggacatgtgccaacggcggaatggcgtgtttgctaagtcccaaaatctaatattgctaatccggcaccgaaatgccaaaagctttttccgtttccgattaaacagtaattatttgggctgcccaaggccgattatgactaattgacgtaattatttttgttattattttcggtgccacgacatgccgataccaaaataattgtgttgagcatttagcggatgaatggataaaaaatggattttgacgtggataatagcaacactaattaaagcaaataaatagaataacagaaatttaaatgagtagaaattaattttaattttttgaattatttattatgttgtccttatatgtaaaaaaagaaaaagaaaatttattactattcataattaatttctgtattaattaaaaaggctttgatttaaaaggatttggatgtttaagttttgctctttggtcaccaaaagggcataagataattatagtttagatcaaaagctttagagataagtacttctggcaataattagttgacaattatttgaaacatcattaaacattgaacggcttctccttcttccattatgtcatttattcgttttcaaaacgtcataaaataaaaatataattaaattttaattttagaaattttttaatcccggatttttcaaggtgatcccatgtgttctgctactgttgttcacattggcactgctgtacgagctggagaagaacagccggaagcggaaatcgatgtgttccggcacaacattggcataccgacggcattcagcccaatctgatcggactacaaaaattttgttgatccttctgatcgtctttttttgcaccgaatttcctcaaggtgtgataaaagcataaaacaatcctagtatttgagaaattattcatttttttatcatgaattgtgccttgtttattggccacttttgaaatttcaaagcctttttatcccgtcattttttaaggcattttggcaattctgaacgggctgttccccaacgacatccatcagttcgtctacctttcctttggtgaactgcttgatctcctttcgctgatcaactgcaacacatgcttcattgtctacccgctgatctcctcccaatatcgggcaacgctgcgcaacttggccgattgcattcgacagattgcgcagggccggggatggcaagcggcgaccgcaaatctcaggtagcaaatttaataattgcagcagatat

SEQ ID NO: 73444 - DNA, 298 bp, Heterodera glycines
  Genomic contig location: Contig_ID=SeqID_1420; Location=621..918; Strand=-
  SCN-specific regions: Sequence locations=1-260,282-298
atgaagctcatctcaatgttcatctttgctgtcttgttggttggcgttatggtcgaagttagtgaagcacaattttacggcggctattggccatcactttacggcggactgtacggatatggatcatatgggtcatcatggagtacgttttgaaatttaatgcattttaaacatgctgaaattgtttaaaaatttttttaaaatcaatttaggctggccctactatggctacggtttctatggaaaacgatcggctggatttggacctgatgaattgaaaaacgagaagccacaatga

SEQ ID NO: 73445 - DNA, 724 bp, Heterodera glycines
  Genomic contig location: Contig_ID=SeqID_1421; Location=298..1021; Strand=+
  SCN-specific regions: Sequence locations=1-90,112-150,332-557,612-724
atgatgcttaattacccatttaaccggcggattggtccgatcggaaaggaaaagcttcaccttttgattaagcatatgtttattcatcggatttatttaggtatattttttctcgccgagttgtaaaaatgtttctataagaaaaggatgataaaataataaaaataattcttttaaaatatattctggatttttcattccaaaaatattaaaatcttttatttaaaatctttttttttacgttttttgttttttgtatagataaaaaattttataattttttttattcatatcttctttttcaaattttttattcttttctttttaataagcccttgctaattttagccattggccttggaatttgttttttttttgtttgctttgccccttccgtttcggccctctctaaaatgcttttcacagaatttggcggaaatgttcatacgtagtttggagaaagcacccatcattttgtgttcagaaggactaattgatttgaagatgaatggagaattttaaagaatttggagctcttgaattttgatgaattaatcaaataaaaatcaaaatgcatacaaatcaaattaaattaaaaaaaaaataaaaatttaacaatcatatgcaaattttaggaaaatgtacatatgatgcgttgctttttcaagatcgtcttggcaattttgacgaatttgtaacccgcattggaatattaccacattaa

SEQ ID NO: 73446 - DNA, 1141 bp, Heterodera glycines
  Genomic contig location: Contig_ID=SeqID_1421; Location=1630..2770; Strand=+
  SCN-specific regions: Sequence locations=1-92,115-485,507-751,773 -930,968-981,1010-1141
atgaaattcgccgttgtctccctgctgttcgtcatggcattcttcgtcggcattgccgtcattgaacagtgtgaagcacaaatgtacggctacggcatgtatggcggctggccctactcctcatacatgtgtatgtctttatgttccaaatttactaatttcagcttaattataacagaaaactgatacaaaacatacgccgttaattatttcgtaaaagcaaaaaatttcggaaaaaattgctacgacttttcataaaagaaatcaaatttacttttttttcgtatcattcagtacggtaaagctaaaagtacggtaacccagctctgaaattcttcctatttttggaaaattatttttttcttcttctcagacccctactacatgtacggcggcattggcaagcgtgaagccggctttggcggcccaagcgggcgactgccgctgttggcacgaaagcccaattagatcagttgcttaaagggcaaaatatgtgatgaaaatgatcggcttacatttgcccaactgaaatgtcgcattcatcagaaaaaattttaaatgcataaaatgtttttaaaattatgaaaaatgaccccatcccaatgaccattttataatgagcgcgggggcgggggttgggaccatggggagggtggaacggtaatgcacaccatggttagtgctaggtcatattatttttttaatttccaggttttaatctattttcgggtttagatcgctatgatgattggtcggtctgtttaagttgatgaaaaaaaaaattttacgatacaaaatagctttagcagaataatctgcgttcatcttggcataagagtaagcaaactattatcggcagagattcggtttaaacataaaaatttttttgtttctatatttttgcacctgactgtactttgttaaagaatcaaaaaattataaattaaattaattttaattttaaaatgattaacaatccgtcctgtccctccctccctcttcacccgtttgtacaaccattctgttgttgctttgcctaatccaaattcaaaatcaaatttttgtcattaatgccctttttgggtcacaaatttacctcggaccaaaaaaagagaaaatgacgtagagaattttggatgaa

SEQ ID NO: 73447 - DNA, 932 bp, Heterodera glycines
  Genomic contig location: Contig_ID=SeqID_1421; Location=3914..4845; Strand=-
  SCN-specific regions: Sequence locations=1-120,143-515,537-760,783-932
atggcgatatggatcgtgcatgaacaccttcggcaaaccgtccggacgaggcgtaaaaagccatttggcctaggcttggtcatccaatgcattggcactttcgtcgggtggaaattcgggaagagaaaatacagaaagaaagcggagcgatggacaattggacagaatggacggggaaaatcgacgcaaattgcatatttcaattatcatcatattccaaatgttgtcgttgagcattggccaaatattgagcaaaatgaattgcataaaatggtcagaacggtgtctgtgttcaaacattagcaaaaaaatttggccagcgtttaaaagtggacacaaatggtgcagaaaagtgctaacattaaggtcgaagtaactgaaaaaagggaagatacaacctctagtgcactttatgagtacaatcttcagtttatttggccataacttttttcttacttcttgttaaccaatacctaaattcttagtattaaaagaaagttttaagtctgtagcattttctgtaaatttaaattctcggctaaaagcaacagacaaaaaattattcatgaatatactcgaaaaatgctgaatttctttttaccattgcacatttttgatgaatttgtttgctcttttcttgtatttatgaattcccagtacttttagctttcgttcgataccaacaaagtaggcattggccaagttcgaaaaaagttatggccaaagaaattgaagattagactcataaaagtagattggactttataatagagatttattttcggtttttactcaatggtaatgcttctgaaccatccgaattgttcaatggcacttcatttaggccgtcagacattttttttattggccaccaattaaacggcaattatattttgagataaaattgtcaactaaatattccacacaataaa

SEQ ID NO: 73448 - DNA, 524 bp, Heterodera glycines
  Genomic contig location: Contig_ID=SeqID_1421; Location=4864..5387; Strand=+
  SCN-specific regions: Sequence locations=1-466,488-524
atgatcgaaggaattcaagcggtgattaaattctaattttgaaaatttgaactttcgactttttgttcgaatccgggtccgcggttcggaattcagaactttcttatagaatttccttttttatactgcaatacttaatactacaaaactttatttaaaaacatttgtatcactcacgctttttccactgacgcattttccgccgcttattttacattttcagccatttctcagcgcttcatcgcctgtcaacttcatcattaccttttgcgttatagttcaaccgtttgttgctttgaccgtgccctatgaattgatcaacgaattcactggggagcgattggaactgattaaactaaatgagcatggcagtcatatggtgatgatccgttctccgatttcacgtgataagccaaatggacgcaatgggaagaggaggccattgaatgggaatctctgactgagtggaacaacattgaagtggaatttggtgatgacgacgtcggcgatgggtaaagcaatta

SEQ ID NO: 73449 - DNA, 789 bp, Heterodera glycines
  Genomic contig location: Contig_ID=SeqID_10283; Location=83..871; Strand=-
  SCN-specific regions: Sequence locations=1-37,59-356,401-768
atgtcttcggttcatcttcttttggttctgttactgctccaagcagtcctttcacttccgtcatttacatatggcaaaaagaagaagaaaattgaaaaaataattacaaaattcaatttcgacggggcggtaattggcgcgacaaatcaattcgaagtgcaaattgactatgacgacggcattccaaaggcgaaggaaacggtgacgagaggggaggacggctctttcaccgtcgaattgccattggaacgcagtgacaccgtagaaaaacttaccgtaaccgtcacgtccacagacaaattaggcggactgaaaagggtgagcaaaattcaacaacactaatttaagggaatttctttaaaaattaaatttatttagtgaaaaacatttaaattaattacaatctaaatttgttatttcagagaaaaaaatgggaaattaattggcctgatccgagcaaacatttcgtgtttttcatgggcgaattcgaacccgaaaaccgtgcgccgctgttccttcgcgcactttttacaagggaattaccaaataaaggcgaaagcattgtttatttgctaaggtgcgcatttgttgcatgaaaaaaggcaccaaagcattagacgagagacgttcctaattagctcctaattataaatttgtcgagattcgggattgcttctcgttcccggttcatggcgtctcattctccactctcgtgatcaattctcaggcttgagtctcgagactgggaaaatttattctcagtcagcctataattattaaaataataaa

SEQ ID NO: 73450 - DNA, 1584 bp, Heterodera glycines; identical to SEQ ID NO: 10283
  misc_feature (13)..(13): n is a, c, g, or t
  misc_feature (38)..(38): n is a, c, g, or t
  misc_feature (1465)..(1465): n is a, c, g, or t
  misc_feature (1502)..(1502): n is a, c, g, or t
  Genomic contig location: Contig_ID=SeqID_10283; Location=1..1584; Strand=+
  SCN-specific regions: Sequence locations=1-82,104-471,516-813,835 -986,1008-1584

SEQ ID NO: 73451 - DNA, 260 bp, Heterodera glycines
  Genomic contig location: Contig_ID=SeqID_10284; Location=74..333; Strand=+
  SCN-specific regions: Sequence locations=1-218,246-260
atgagaaaaagcgattttttgacagttcaattcgggctcaccaaaggtgagggcttttaacacaattaattgttgaggggaaatgggcgaaatttcaaaatggaggtcttaaggctttttgaaggtttttcagacgtcgccgatttgtccatgcgccgattgtccaccattggatttatatggttgtctcaattattatttttggatactttgtaaaatttgtaaaatgagcaaatgtttaaaaaacgagagaggtaaaa

SEQ ID NO: 73452 - DNA, 1453 bp, Heterodera glycines
  Genomic contig location: Contig_ID=SeqID_10284; Location=1608..3060; Strand=+
  SCN-specific regions: Sequence locations=1-520,673-690,714-948,970 -985,1007-1162,1195-1244,1266-1453
  Gene Ontology: Mol. function=structural constituent of cuticle; Cellular component=extracellular; Biological process=cuticle biosynthesis (sensu Nematoda)
atgagcattgagttggaagggcgcaacagcgcttaccgtttcgtcgcttatgcggccgtttgcttctccgtggtggaggcgatcaatgagtgcgttacactgcccatggagtacaactacggacaccacgtgcggcgtaccatgcaggaagagattaattattgtaaggtgattcttagattttattcttttgtatgtgcggccaaatgccattggttggtcaaaattcccaacggagggacgaatagacatcatttgtatgattcgttaaatggccaaatgctggcgattcaaaagtggcatggtttggtattgaccaaatggataatagagaatggccaaatgttagccatttcgagttggggatgacaagcgggatgagtctcgttttcacttatctctttaacattgaaaattttgaagagctcggcccgtgacatttggatggaggtcaaccaaatccgcaacattccgtcagcgtttaacggcaatcggaccgcgcgtgcgtctggttatgctagcggaggcggcggaggcggtggcggatacgcttccagcggaggaagcgggggtggaggcggtggcggatacgcttccagcggaggaagcgggggtggagctggtggatatgcatcagcgacgagtggcaccagcggaggcggcggcggaggctgtcaaccgtgctgtaaccctggcccgccaggcccacctggcacgtctggacgaccgggacgccccggaaagcctggctcaaacggcatgccaggaggcccaggcaagccgccgtcccagccttgcgagtccgtcacgccggttcgttatgcgcgctttgattgcgtagcaaatgttattatgctttttcccatttagcctccttgtaagccttgcccaggtggacctcctgggccgccaggaccacccggacctcccggcgacggtggaggacccggacagcccggccagcctggcagtgactcgggtgcaggttctcctggcccaaagggcccgcctggcccacctggtcagcctggacagcccggctctcctggagagcccggccaacctgcgcagtcacagcccatcattcctggcccgccaggaccaccgggtaaccaaactatattttttgaatcatttattctaaatgctcttttaggtgattctggaccccctggacctcctggtcctcccggaaaccctggcactgatggaggcgctggtcagcctggccccaagggaccgcccggaccaccgggaccgcctggcaacgacggccaaccgggctcgcccggccagccgggacaaccgggcggacagggcgagaagggcatttgccccaaatactgtgccaacgatggcggcgtgttctttgaagacggcacacgacgagcataaaaagacgaaattcataaatgttaaatgaaaaaatgaagagaaaaatatgaaattggaa

SEQ ID NO: 73453 - DNA, 524 bp, Heterodera glycines
  Genomic contig location: Contig_ID=SeqID_10286; Location=147..670; Strand=-
  SCN-specific regions: Sequence locations=1-55,162-524
atgttcaggacgcgtacattcgctgtatggaattgttttacgcagggtgaaacgcttaaaataattaaaaaaatgaattatcaaaattataaaaataaattcttttttctaatttaaattaacatacaattcaaatattttttagaaaattattaaaatttctctgttcaattgtccttaatttatttttttcccatttagcaaatttctcaatcggattttggacctccataaagccgaccaaagcccaacgaccataacggagcagccaaagagtgagccgactgaacaatttggtgctgatctgacctgaaccgggaagtacaagcgggattggcccatttcagtctggtgagccccaaattaggaggggactcaatttgcattctctcatattacaaacatttaaatgattttatttgttgctaaatttttttttttttttgggctttttttggcttttatctaaaatagtcacataaaaaaatacttacctcaaaatgtgttttttaccttcaaataaa

SEQ ID NO: 73454 - DNA, 68 bp, Heterodera glycines
  Genomic contig location: Contig_ID=SeqID_10287; Location=519..586; Strand=-
  SCN-specific regions: Sequence locations=1-68
ttgttttgaagaaaggagctcaaaaaacgcatttctgcattaaaatttttcgattctaatgtcattat

SEQ ID NO: 73455 - DNA, 1287 bp, Heterodera glycines
  Genomic contig location: Contig_ID=SeqID_10291; Location=703..1989; Strand=-
  SCN-specific regions: Sequence locations=1-261,290-655,685-1003,1032 -1048,1071-1096,1136-1232,1262-1287
atgggcatgttgcagaatgtcaatgtgggttctacccaactaatgaaatcaaagcataatcccttagtcatttagggaatgcgatttttccgtaaaccgcacagttcagcaccgggctacaatattaataatatccagtcccaaaactcatttttttttaaacgaacaaatgccttgaaatttggcacgagcttttaagtgttgccagtaggcttacattggagacaaataaatcgaaatgcaaattgagtgggggatgccttatttttttaatttttaaaaattttaacgaattttcactttcggtttttttgcgcccattaatgaacacttttgcccgtttttgtagcacattgagtttgacaaaacgttggcccgactgagtacgaatggcgattatcgtaaggcgtttccgtccgctgccgacctgctcgcattcatcaccgtcaattgtccgaacatcaaggccatcaaagtgtccaagcaggatgtgcgtttttcggttggggtggcttgcgtccggcgagcatttattattaattttggatttcaatttcactaggaaaaataggaggatgaggaatttttgctcccagaattttagtggagcttccaatttaaacacaaaaaaaaaattggaaaaaattttccggcgattttttaaaattatttattaaattttttccatattccaacaggtggcactgttgtggagcgagcgcagtgacgagttggtgtcgctgctgttgcaacacgtgggcaaggtgatcctgaagaagagcgttggcaaggcctacgattactaggacatctcatcatcatcatagcgaacggcacattttgtttttggccatttttctttttcattgacactatttaaatgttttgttgcttctcattttgaccttttgtcgccttatatctctctctcattttcatcacagcacttcgtcccgtacattctatacacatttaatgcatttttgaatttaatttccatggattttcttttgttgttttgtctcattaaatgctaaattaaattaattctctctctctctctctctctcattaaaatatttgccatctttgcttctttttttttatttaaattaaaattggatttaaaaaattacgtaaacaaattggctcaaaatcacaaatttggtcatttatccctgcaaaatttggtgagcttctgatcaattacaaatcagttgtggaggatgatcaaatttttaaaaattaattaattaattttgaataactctttctatgattaataaa

SEQ ID NO: 73456 - DNA, 209 bp, Heterodera glycines
  Genomic contig location: Contig_ID=SeqID_10292; Location=474..682; Strand=-
  SCN-specific regions: Sequence locations=37-209
aggaggaggaatatgacgaagaggaggaggaggagggaccgatgatgatgatgacccagaaaaaggagggcgaggaggacaacgacggggagttggacgacggcgcccaccaccatgacacaacctcgccggaggagttgcaggacgaggagacggagcagttctaccagcaattgtccgtacttcctgctgtacaaataatgttgtag

SEQ ID NO: 73457 - DNA, 910 bp, Heterodera glycines
  Genomic contig location: Contig_ID=SeqID_10293; Location=302..1211; Strand=-
  SCN-specific regions: Sequence locations=1-910
  Gene Ontology: Mol. function=protein binding; Cellular component =nucleus; Biological process=regulation of transcription, DNA -dependent
ttgtacctcttctaatcacagttgtacctcttctactctagatgtacctcttctaatcactgatgtacctcttctactctcagttgtacctcttctaatcactgatgtacctcttctaatcacagttgtacctcttctaatcacagttgtacctctcctaatcactgatgtacctcttctaatcacagttgtacctcttctaatcactgatgtacctcttctaatcacagttgtacctcttctaatcactgatgtacctcttctaatcacagttgtacctcttctaatcacagttgtacctcttctaatcacagttgtacctcttctaatcactgatgtacctcttctaatcacagttgtacctcttctaatcaccgatgtacctcttctaatcactgatgtacctcttctaatcacagttgtacctcttctaatcactgatgtacctcttctaatcacttttgtacttcttctaatcacatttgtacctttttaatcaccgttgtacctcttctaacatttgttgtagctcttttaatcactgttgtacctcttctaacatttgttgtacctcttctaatcacttttgtacctcttttaatcaccgttgtacctcttttaatcacttttgtacctttttaatcactgttgtacctcttctaatcactgatgtacctcttaatcacagttgtacctcttctaatcactgatgtacctcttctaatcactgatgtacctcttctaatcacagttgtacctcttctaatcactgatgtacctcttctaatcacttttgtacttcttctaatcacatttgtacctttttaatcaccgttgtacctcttctaacatttgttgtagctcttttaatcactgttgtacctcttctaacatttgttgtacctcttct

SEQ ID NO: 73458 - DNA, 702 bp, Heterodera glycines
  Genomic contig location: Contig_ID=SeqID_10294; Location=3..704; Strand=-
  SCN-specific regions: Sequence locations=1-702
atgaaattatgtctattaatcttttcaattgtatttttaattgttaaaattgaaattggagcggaaaagaaaaaagcggaacaaaaaacatttgacaaaatatttggagaaaaatgggaagaaaaagaagaaaaacgaaatgatcaaaatgaaaatgatcagaaaaagcgggaaactgttacgaaattcaataaaataaaagagaaaatcttacaaaagggaagaaaatattcaaaaaatgaatggaataaacttgaagaaaaaatcggaaaaaaattgggaacaaatcgagacaaaatttaccaatggatcaaagaatttggtctccaaaaaaacaaatgttataaatcaaaaacggatgaacaaaaaattgaaattgtgcaaaaatttattgcaatgaaaaatgaatataaagaaaaaggaagaaaatattcgacaaaagaatggaagaaaaattatgccgaaattgggaagaaaattggagtaagtcatagagtaattggacaatggaagaaacaatttggattgagtggaaaaagaatatcggagaaagaaaaaatgaaaaaaatgaaaaaatattggcaaataaaaggagaaaatccaaaaatgagtgacgagaaaattgcaaaaatactgaaaattaatcaatcgaccttttcaaaatggaagaaacgatttggagaagaattaaatgagcattaa

SEQ ID NO: 73459 - DNA, 1484 bp, Heterodera glycines
  Genomic contig location: Contig_ID=SeqID_10294; Location=1385..2868; Strand=-
  SCN-specific regions: Sequence locations=1-328,385-673,696-1037,1111 -1174,1205-1352,1392-1484
atggaagaagcaatttttggtatatatgaaaaattaacggagaaagaaaaaattgaaaaatattggcaaatgaaaggagaaaaccaaaaaatgagtgacgcgaaaattgcagcattggattcggttccaaatttttttgttcaaaattccgggctttaaggtacatatatataaatactagagtgtcccaaaggtaatgaccgtttttagtagtttagatttgtcaaactgtgtctttccgtctaattagtcaatcaataagtttttggtgtcattttgcctggtttgtcgattcctaaaaagtgcaaaattcaaaaatctggttttcaaattttttttatcaatttttaaattataactatgttaaaatttaattaaattaaagcctaaattcgaattttcatcaaaatcgcaacgaaaaacatttaggcttcaaaacaaaagatgcagtaataaatctcagaataacttttttattcgtacaatcaatgcgtggaattgcttacccaaaacagctatggaaatcggaagtttagctaaatttaaaaatcttgtgaaagaatttttttcataaaataagtccagagtggtagttcatcccttttttattttattttatgtattttttcagtattgaccataacatatttttctaattgtattcattactgtgtaaaaaaataaataaattttttgtaatttgactatagtgcaccaggagaaatttgtatagaaaaagtgaaagcgtttatagagcaaaattgtataatacgtatgttttctgaatgtaattgttatgtctcttgcttacacaatttattaaaagcaaagacaaacagaaaaataaaatgataaataacaaataaataaatgacggaggaaagacaatcaataaatggaaatgaaggagagaacggcaagtgacccgaatgactgaacgggtccatttaaataaacatttccaattatgacacagggaatcgtgtcaatattaaaaacattcaaattgttcgatccttaacagtaataaacatgtcaataatttaattaaaataaagaatttataagcgaaaatataaaattcatttttaagaaatattaattattattcctttattttctgtaaaaccgaaatttttgcaaataaatgtcaacaatgaaattgtgcctattattcttttcaattgtatttttaattgctaaataaaaaagtttaatcagaaaagaaaaatttcagcaaaaaagatttgaccaaatatttggggaaaaatgggaagaaaaaagaaatgatcaaaatggaattggaataggttatggaacaattcaaaaatggaagaaacaatttggcatgagtcagagaataatgaaacaaattcattgcaaattaaaggagaaaatccaagcaattaagagaagaattaaatgaggatcaaaaaagtgataacttacgttccattgttacttttttctatatgaaaaataaa

SEQ ID NO: 73460 - DNA, 290 bp, Heterodera glycines
  Genomic contig location: Contig_ID=SeqID_10296; Location=66..355; Strand=-
  SCN-specific regions: Sequence locations=1-226
atgatcagtagcagcaaattttgcacaaactttgatcagctttttaaccatttgcgtttattgtgttcaaatgacgccggtgcagcgcattacggcaccgaactgatgccaattatgtaaagacaaattgggattttgcttaaaattttcatttttaaatctaaattttttagcaaagaaaatccctttttcggtgctttatgttcagtgatggcggaagagaagcaaaaaataagtaattttatttataaaatgaaattataaattattatttaattttaaaaaataaa

SEQ ID NO: 73461 - DNA, 510 bp, Heterodera glycines
  Genomic contig location: Contig_ID=SeqID_10297; Location=1804..2313; Strand=+
  SCN-specific regions: Sequence locations=1-113,163-210,232-325,385 -418,440-510
atgaacgactcgcgaataattcgtggcaaaaagtttaattgctcattaacatggcttttggagcgctacaaactttcagacaaatacgcaattaaagagaaaattgaagtctgttttttaatttatttttattatatttttattaattttaatcatttttatgtcaaataccatggccatcccaaatttgtgtttgtgacagccgccaatgacttttattatccttctcttcggacagtaattgcaaatgtaaaagaaacatttggatgcaaacaaaaaataatagcttatgatttgggaacgattactaaaaacaaagaatgggtaaaaatgtttattttattaaaattaaatcgtaaattatttattttaaaattaaatattggtgcttttcagttttgctcttacatctcaaaatttaagaaagcaaacaaaagggcgcgcggaaagccatttttaagcgcacaccgttattttgaggcattgaggaaagaaattttcacgatataa

SEQ ID NO: 73462 - DNA, 524 bp, Heterodera glycines
  misc_feature (136)..(136): n is a, c, g, or t
  Genomic contig location: Contig_ID=SeqID_10297; Location=2573..3096; Strand=+
  SCN-specific regions: Sequence locations=1-219,241-524
atgaattggattcggtgtgcaatttcgaatggcgaattttcgatttcggtcaaatggtggaaggacgggttcgccaccccaaaagttacgcgtggaaaatttttgtgtgggcggtaaattttttaaatttaaactnagagtagagcgggaccgggaattttgggcttaaccgggaccgggaccttttcgggttgaaaaaccgggaatttttggctgggaaaaccgggaaaaaacccgggactggtcccggtcccggtcaaaaccgggaccatggtactcagttggactcagttgtccgtgttttggtcccggtcccgctctactctaatttaaactattaattaaatgtgtaattcaaatgattaagcatgttttattggagtatgacactgtcgtttggattgacacttcagtggttttccataaaaatgatttcaaacgattttttgaaccgatgcaaaacggcaaaattggcactgtgcaaatcccaagctgtgagtgataagaatggagcacagcattaa

SEQ ID NO: 73463 - DNA, 887 bp, Heterodera glycines
  misc_feature (794)..(794): n is a, c, g, or t
  Genomic contig location: Contig_ID=SeqID_10298; Location=468..1354; Strand=+
  SCN-specific regions: Sequence locations=1-185,207-401,431-431,482 -547,578-648,681-717,739-887
atgttttattggagtatgacactgtcgtttggattgacacttcagtggttttccataaaaatgatttcaaacgattttttgaaccgatgcaaaacggcaaaattggcactgtgcaaatcccaagctgtgagtgaaaagaatggagcacagcattaattaaaccgtagtggggacatttgcggaccaacatttattgattgcctactttaaaaaaaattgaaaaaaattaacaaaataagtagagcggtaccgataattttcagtttaaccggtaccggtaaagatatagtgaaaatttaacgccaaatttttaccctattaacacacctaattaattttttctaatagctatattatggggttgggtcaagaaaattatcacattttacaccaaaattacttccataatcttttttcattttaattattcgaaatttttatttaaatgtatctatctttttcatttttttatttaataattcatcctgtaaattcggttcgcaaatgttgattacccaataaacgtttaattgtgaaaataaaaagcaaatttaatcaaaattttattattttatttctttagttgcattgcatgggatgaacgtttcgactcacccgggtaaaaacattttataattcaaatgaagcaaaaaaaattaacttttttaaaatttttaattgatacgacatttggttttgaaaaaaaaaattcttcattaatcttagaaaattctgaaagcgaatatattacagaattacaaaaaactcaaaaaaatatctgcaagacacataanaattccccggcactttaattcgcatttttccaggaatgtacgaatttttgcccatgtacaccaattttgagcctaacagaacatacacattga

SEQ ID NO: 73464 - DNA, 266 bp, Heterodera glycines
  Genomic contig location: Contig_ID=SeqID_10298; Location=1..266; Strand=-
  SCN-specific regions: Sequence locations=1-266
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcataaaaagagatagccatttttctgggatagagtataaatttaaaaattccctcaa

SEQ ID NO: 73465 - DNA, 1190 bp, Heterodera glycines
  Genomic contig location: Contig_ID=SeqID_10300; Location=29..1218; Strand=-
  SCN-specific regions: Sequence locations=1-285,308-404,426-1190
  Gene Ontology: Mol. function=malic enzyme activity; Cellular component=mitochondrion
aaatccggccaacacaaacgcaattaattgcgccaaatacgcggccagcaaaattccggctaagaattttaggtaaacctttcatggtttgtttgtaatttcctttcaattctaagtgccatgactcgtcttgaccacaacccgtgccatggcacaagtggcacaaaagtgcgcagatggaaccaccgttgggatggtgaaaaatgtgatcatttggggcaatcactcgagcactcagttcccggatattcgacatgccaaaattgccaaaggttttagcaatcaatctaaacagcaaaaaagcaacaacaatcaaatacctaatcaaaattacaggtggttccgaaactttggcctatgatgcggtcaaagacaccgcgtggattcaggaccaattcatcaaggtttttgatttttaaatcattttcaatccattttctccccaaaagaccgtacaaaagcgtggcgctgtgatcatcgaaaagcgcaaattgtccagcgcaatgtccgcatcaaaagccgcgtggtaagcgaaatgatgtggactgattatggaggaaatgcccttctgcatttctctctgattttttaaaccgtctttctgacagtgaccacatgcgcgattggtttttcggcactccgtccgacggtcgttgggtgtccatggctgtgccatcggacggctcttacggcatccccgagggattggtgttttccttccccgtcaccatcgatgcacagaaagagtggaaaattgtgcagggtctcgacctcgacgactttgccaaacagaagattgacatcactaagaaggtgggattgaaggaagtcgtaaagggaacaggatttggagccgttttgcaccaaaaataaaaaattttcggcattttgtggtcaaattttacaaaatatggtaaaatgcaggtccccgactgtgccgataggtcaccgctagggagatttttggaaaatttaatgatatttttatgaaaattgtgcaaactttcaagagaacttacacatcttttcttgaaggatttataaattttcatttcgtagagggagaggttagttcattggtgccaaatttattatgtcaattctttttcttcccaaagtgcccttttcccgcgcaggaattgttggccgagcgcgacgaagcactcgcagcatgcaagtaatggaaaagg

SEQ ID NO: 73466 - DNA, 929 bp, Heterodera glycines
  Genomic contig location: Contig_ID=SeqID_10301; Location=111..1039; Strand=-
  SCN-specific regions: Sequence locations=1-6,43-110,133-218,242 -810,833-929
  Gene Ontology: Mol. function=malic enzyme activity; Cellular component=mitochondrion
gttctgcaaatcgccaaaggggatgtttttggcaaagatcaggtgtgttgcttttggtatcttcggctgtaattgttttcccattttcgcccattgtcctcgtccttctcgacatccctccgcttactgaagtgctcaccggcgtccattacgaattggttgactgtgcgcttcccaacctcttcggtacgtacgtgggctaatcattcattcatttctttctgcttttgtgaatgggtgtcccttttcccatttcttccgactcattttttcctttttttaaggcgtcgaggcagtgaccacggaagaggcggccttcaaagacattgactacgcttttctggtcggagcgatgccccgcaaagaagggatggagcgaaaggaccttctcgcggccaatgtccgaattttcaaatcgcagggcgaagctttggccaaattttccaagccaacagtcaaagtgtgcatttgttggctaccgatgatttttcatcctaaaaataaacttttaggtgctcgtggtgggaaatccggccaacacaaacgcattaatttgcgccaaatacgcggccagcaaaattccggctaagaattttaggtaaacctttcatggtttgtttgtaatttcctttcaattctaagtgccatgactcgtcttgaccacaaccgtgccatggcacaagtggcacaaaagtgcgcagatggaaccaccgttgggatggtgaaaaatgtgatcatttggggcaatcactcgagcactcagttcccggatattcgacatgccaaaattgccaaaggttttagcaatcaatctaaacagcaaaaaagcaacaacaatcaaatacctaatcaaaattacaggtggttccgagactttggcctatgatgcggtcaaagacaccgcgtggattcaggaccaattcatcaag

SEQ ID NO: 73467 - DNA, 498 bp, Heterodera glycines
  Genomic contig location: Contig_ID=SeqID_10302; Location=170..667; Strand=+
  SCN-specific regions: Sequence locations=1-22,54-66,89-418,451-498
atgtttgatgcaatggtaatgcatatataataataaacatttaaaattttaaagtctttaaaatgaaatttaaccaaaattaattcatatttcgattgccctaagaattatctatttatatttaaaattttagaacatttcattgagtgtcagaaaagtaatgaacaaaaaatgcagacataagaactattgccattttgtgtccataactggcctcatactcaaagctgtatatagtagaggcacaagcatcatcaagtggtcattctttatagaaacgaacataaaatgaattttgaattttcaactttttgttagaattcgggtccgggattcgaaatggtcaaaatgaatgttggattcaggttcaccgaccctgaaaacccaccataatcatgttttcacgactttttagaacaaaaagaaattttttccaaaaagggggcccaccatctaaagtattaccatttattcaaatttaggcgaagacaaaattaa

SEQ ID NO: 73468 - DNA, 839 bp, Heterodera glycines
  Genomic contig location: Contig_ID=SeqID_10303; Location=83..921; Strand=-
  SCN-specific regions: Sequence locations=1-82,104-133,199-248,272 -277,299-379,410-542,575-746,768-776,799-815,837-839
atgtatggcattgggaagccattcggacgaaagccaattttcaaagagaatcaaaactgcgagaaaacaaaggcaattcatgagtcggaaggaaatgatgagattgaaaagcttttcccggtctatgccagccaaataaaatacattgtaaattcaaaattaatttaaattaaatttcaaataaattaaaaatttaatgcgtttagaattcgactgaaaagcaaaacgaaaccttttacttgagggcattttctccacctttttcttatgacaacccacaaaagttggcaatttcctgaatacattaaaaaacagtaaattttgttttaaggtatgccattccaaggatcaaagaaaaatacttgaaaatcgatgtaacatttttaaataatttatttatttattattagatttgaagggggctgcattccaatcgtttaaatattttgaaactcgacgaacggaaatccgtcaaatttttcggattggacaaaaactctgtaaaactgttgacgaatacaaaaaagaattgtttgggttggtattttaaacaaattttaattaaaaatttttagtcatgatcaatcacataaatattgtgtgtatactcgaagaggtgattttgctaattctgcttggggttccaataaagacttcactgagcagggcattgaattcggatttaaatatttgatggtaattaaatcatttaagtattaatggtaattaaatcaatttacgttttcaatatttttatttaaaattaagggatcatttaaaaacatttctgtcgtcttgttgggagaagacaaacaatttttgaaggatttaaaaataaa

SEQ ID NO: 73469 - DNA, 227 bp, Heterodera glycines
  Genomic contig location: Contig_ID=SeqID_10303; Location=1515..1741; Strand=-
  SCN-specific regions: Sequence locations=1-7,41-203,225-227
agaagagtgtcagtaaaaacatcgacgatctgaaggagggcgcagttgtcgcgcagaaattggtgaaggcgaagaatgcgtacgaggaaatggtagcgaaggcggaggcgttgctggccaaaacgaacaaatgacggatgaagaagacgcgtcaattgagatggaagtcatgtgatggaaattgtactgatttgttacaattaggtaaatgattttatttttctttc

SEQ ID NO: 73470 - DNA, 521 bp, Heterodera glycines
  Genomic contig location: Contig_ID=SeqID_10305; Location=497..1017; Strand=+
  SCN-specific regions: Sequence locations=1-66,98-248,270-273,295-521
atgatgtccaatattctttcgtccaaaatcccatgggagaaaatcaaatatttttttgctgctttgatatttatattaatattttacattatcaacaaaaacgaagaattttcatatgccggttcagctttattcaggttttttttgttttggaaccgctttaattaggctgccatcggctgggctaaaatttcaaagtgtataatatgtacgggagaaaaattgtgaaggggacagcaagggtcaggttgaaaatacaattcatgagaattcataaatataattttaaaaaaagcataaattatttctttttatccaactatattctttgaaaaaatgcttcaaattttcaaagcaaaaagatatgaaaaaagcacggcaattttgaaaaagtacaaatggcacccctgcttatatcaattaattaataatgtatgtctaaatgtttttttgaattttagactttcgcattcggagtcttgcaaagcaaatttaacggacgaagaatatgaaaggtgaaa

SEQ ID NO: 73471 - DNA, 4519 bp, Heterodera glycines
  misc_feature (4513)..(4513): n is a, c, g, or t
  Genomic contig location: Contig_ID=SeqID_10306; Location=730..5248; Strand=+
  SCN-specific regions: Sequence locations=1-85,108-1161,1183-1641,1663- 2476,2498-3208,3230-3807,3829-4519
aaaatcatcgaccgagacaatggcctgctacgagaatgttttgaccacattaagctgctaggcgacccgtttctgaagcaggcggaggaggacctcctggccgcactcccgaccttcgacgacgagcaagccgacccaaatgtcgaagaatggccagtcatcactcttctctctaaagcccagctcatcctcgacggcctccaagtctacatcgaggctcgattcgacacgacggacgccatctcttctcgcagcagcagtcgtgtttctgatcacggggccgacgacgaaaaccggatccaccgccaacggcaatccaccgacccaccgactcaggcacagccagcgaatgcacatcagccttccaattcggctagagccgatcaaaacctattcaaccagcgaaccccggcattcccgcttaatctcacatttccccgagcatcgaatcgccccacccatcgatcggaacctcaccatggccacttccgacagtcgaccagtgacgacgacgcacttcgggtcagccgaatcgaaatcccgaggttcagcggatcggcagaagaatgggtcacattttgggccgcctttgactttgccgtccactcacgccaataccccgccttccaaaagcacctcctcctcctacagtacctcgagaagggatcgccaccacgacggatggtcgaaggttacccaccgtcagacgccaattacagcacagtcgtgagcattctccgagatcgctacggcgacgtcggcaatcgacgagaccaactcaatgcccagcttctccatctcaaacccgcccggaacaacctcaaggagttgcgccagctacagcaggagatcgagcagatctgcactcaactctgcagtctcgagcccgagggggaactttcgccaattgccaatagctcactcgtcacaaacctcatcaaaagcaaactcccacccccggtactgcttgaactgatccgaatggagcgcgagagctacacctcttggacggctcgaaattggcgtgagggatttgcgacaatcgtcaccgacaaagagcaggtggacttgtgcgtccgcacattccaggacatggacatccagccccgcgaacgtcctcccgaacgggctccccctcgtccgggtggtcgttcttctcggccaacaccaccaccagcgccggagcgacgttatttggagaacactcgggcctttcctgctctcgcccaacccgtctctgccaatggcatcagttgctccctttgtgagcaggagggacaccgtccgagtgcgtgccagcgatacaccaccgtcattcaacgccggcgacgacttgaggaacaggggcgctgcctgcgttgcctccgtcaagaccacgtcactcgcgattgctctcgtcaagatcgatgttcgaaatgtcaggcgaacgaccatcacttcctcctctgcccgtcaatcgaccctccggggcgaaccaaccttcgacgagagaatcaagagcggaatggaaatgcgtcccgcaacgtcagtcgtgccacgggagccaacgccgaaccggtccgaccgagaacgactcccaccacaaccgcactgctcgtgtgcgacgagggcgaaaacattcccgaggcgttatgcgccgccgcctttgaccccctccccgtcgacagcggcagttttcccgtccccaaatcgacgagagtagctcatttgatgactcagacccttaaggcgtcatgccaagggggcccacccgacggaattcctgcttttgtcttccacgaccctggcagccagtccggctacataagccgggcaatgacagagaagctccgtccccctcgactctcagagcacctcctccgaattcacaccttcggagactcccgccctaagaccgtccgatcagcaaaattcgccattcaactgcagcgcctggacggaggctgggagaccctcgagctcaacgtaatcgacgagatcacgaccaaaatcaaggccctccaatgggacaccaccgatggacccctccccccgaatgccgtcctcaaggtcgtcgaaaaagcgccggacattttgatcggcatccgggaattttggcaattcttcattggccgttcaacgcttcactccgggcttcacctcatccaaacaattttcggcccaatggttggtggtgaagcggagtttcccgagaccccacggcacaccccgacaattgccatgctgacgtctcaccccagtaacgtcgagtcattcccctcgtcccgcacggtcaatgacttttggagtctcgaggcgattggaatcaccgacgaccccaatcagaacgacgaccaagttgccatgcagcaatttagcaataccgtccgccaattgccgtctggccgttactccgttcgcctcacttggcgggaacctcggcctcccctcccctcgaattgggccatcgcatatcgccggctcctctcaacgaccaagcgtctgcaatgctctcctgagcttctcgaccgttactccgccgaactgacacggcaaatggacgccgacattattgagctgaccgggcgagacaacgacgagcattttttgcctcaccacgccgtcatcaatccaaagaaactgcggatcgtcattgacgccagtgctcatgccaagggcaccccaagcctcaacgactgtcttcaccgcgggccagtgttgctccccgacctttgcgggattctcctccgcttccgttcagcgacaattcctgtgttggccgacgttcagggcgcctttcatgccatcgaagtcgaacccgaggacaggcgcttctgcaaaatgctttggctaaaaaatcctgcccgtcccgtctcaggcgacaatctcttgatctaccgctacaaacggctagttttcggcgcgacgtgctccccctttatccttgccgctgttctcctccaacacttcgacaagcacgagcacccattcgcccaagcgttggccgcgaatatgtacgtcgacaatctcctcatcgagtgtgagacggaagaggaggccatcgacaagtcgtccatcgccaaacaaatcctcaaagacgccgacatgaacctccgggagttcctcagccactccccaaacgtcatgggacgaatccccgaggacgaccgactcgacaaaacgccggccaaagttctgggactgacctgggacacccccagcgactgcatcaccttcagtctcccaaaagacacagacatcactgctacacggcgttcagtcttgagcatcatcgccagcactttcgaccctcttggactagtcgggccatgtcttctgcccgccaaacggctcttccaacgcctgtggggagaaggaaccgcctgggacacacccctccccgagaccgaggcggaaacttggaatcaaaccctgtccctatggcaaaaccaaacgattgtggtcccgcggcattccattctcggcgagcaaagccgcctgcaactccacgtgttttgcgacgcgtcggaacacacattcgccgccgccgtctacattcgaagcgagactgccgatggctctgaagcgaacctaatcttcgccaaaaaccgcctccggccacgaaccgcgaaccagcgcttcaccatccctcgactcgaactcctcgccattctcgtcggaattcgcgccatgcgcttcgccgagaaagagctccgacgtccgatcgacgagcggcacttatggtccgactcccaaattgccctctcatgggtgaagtccgacgaacccaaggcccaatttgaacagcgaagactcgtcgagatccgacaagggccgcccaccacttttcatttcatcagaaccgaccaaaatcccgccgacgtagccacgagaggctgcacaccggcggagctccgaactcgccacatttggtggaaagggcctgagtggctcacgagtccggaaacggaatggcccgacgagttaacgttcgcaacgccagccgactccccttccgccgatcccccgtttgaaaaatcggagaccaagaccctcatggccaaacaaagtccgctgccccctcccctcattgatccggctcgtttcggtactatgctgacccttctcggaacgaccattctcgtcctccaattcatcgggcgtcgtcgaccaaaatggctcaaaatcggcacctcgtcaatcccacggagtggccctccgacgggcgattcgttcagagcagccaggactttcctcatccgacaagaccaacgaagctcgctcgacggatacgacaaacaccccactgttttcaatgaggatggccttttgtgcctcaaaacccggctcttgcacgcgaacggtccgcccactctcgcctctcccgttcttctcgaccgccactcatctctgactcggctaattgtccaagaaatccacgccgacctcagacacgccggcgttgactggactctgactgagttccttggccgttattggatgcctcaagcacgacgaaccattcgtgtatccntccgag

SEQ ID NO: 73472 - DNA, 515 bp, Heterodera glycines
  Genomic contig location: Contig_ID=SeqID_10306; Location=4672..5186; Strand=-
  SCN-specific regions: Sequence locations=1-515
gtcagagtccagtcaacgccggcgtgtctgaggtcggcgtggatttcttggacaattagccgagtcagagatgagtggcggtcgagaagaacgggagaggcgagagtgggcggaccgttcgcgtgcaagagccgggttttgaggcacaaaaggccatcctcattgaaaacagtggggtgtttgtcgtatccgtcgagcgagcttcgttggtcttgtcggatgaggaaagtcctggctgctctgaacgaatcgcccgtcggagggccactccgtgggattgacgaggtgccgattttgagccattttggtcgacgacgcccgatgaattggaggacgagaatggtcgttccgagaagggtcagcatagtaccgaaacgagccggatcaatgaggggagggggcagcggactttgtttggccatgagggtcttggtctccgatttttcaaacgggggatcggcggaaggggagtcggctggcgttgcgaacgttaactcgtcgggccattccgtttc

SEQ ID NO: 73473 - DNA, 3214 bp, Heterodera glycines
  Genomic contig location: Contig_ID=SeqID_10307; Location=226..3439; Strand=+
  SCN-specific regions: Sequence locations=1-3,25-1242,1264-1521,1571 -2908,2930-3214
atgcccagaagaaatttctgctattatattaactgtcagaacgggcgacgactggaagacgtgttcggactgatgagcggtgcaaacattcgcaccgatttgagagaatatgacgcggttgtctatgtgccgattgtcgtggactattggaatcggaaatacgccaccgcaaatcagcgatttaaggtgttcatctttggcgctacaggcacctatcggccaaaatttcaatatgggccggacaacttcaacattgaaatcccgctctaccatcacaacgaccatttcgacggaattcgatgtggggtgggcaaagcggtgtttgggcgtgactactactgtttttcgtgcgaatgcccatatgataacgccaatgatcacacgctacaatgtaaagcaaagtgcataaactgcggtcgcataggagtggggcgaccgtgccgagcggatgacaacaattattacagagaatgtacagcatgcggcaaggatttcatgagccaagactgcttcaatcaccatttgtcgagcaatgtgtgccgacaattcaacaaatgcaaacagtgcggaattgtgtggaatatcagacaaaaccgacgaaaaggacgcagcggacacgtttgcggtgagaaattctgctacacctgtaaatgctaccataagccggagcggggctgcttcatacagcagttgaagacgcgccgccccacaaagtacagactgatcgcctttgactgtgaaacaacacagaatacacgaattgagggcagcggcgaccgccgacttcattccgtcaacttcatctcatgccacgtcgcctgcaccaagtgcataactgaaaattcgtggcgaaattctctacaagcgccatgtggcatttgcggtcggcagcgcaccgtcacattctcccaccgcgcctatgaacgcacacaaaccgatgcccaattcatcactccttgtccaatggcggcctttgctcaatggctgctcagcgaattcgatccgcgctatcccacaatgctcttcgcccatttcggtggtcgctttgacaacattatgctgtttcggcagttcttcctcaacgggttttgcccgcaaatgatccgtcgtggcaacaaattatacgaaatgaaaattgcgaggggtgaaaaaaacccggaaatcatcgtaagagacagctggaaccttatgccggtgccgctcggcgctctgcccggagcgtttggactcaatgtgcaggataaggagttcttccctcatttggcgaatgttgaggcgaattatgggcacattctgcagtcgctaccgccaaaagctgactacttatacggtggaatgacgcccgaccgacagcgcagatttgaccagtggtacgcggaacaccaccatcaacagttcgacctgtgtgaacagctcgcggcctactgcaccaacgacacgcacatactaattgaggcgttggttgcttttcgaacggagttcttggcgatcagcgatccactggagcgacatggatgcttggatgacgaggacgacgacgaggaggaggaggaagaagacaacgacaatgcattcgaagtgattggcggtggcattgacataacgtgggagccgatgaccatcgccagtgcctcaatgaggcactttcgactcaatcacctcaagcgagatcagctcgcgattgtgcccgagtgcggctacgacactacaaacacgcaaagccttgtagcgctcaaattcatggattggtacgccaaaaagaacggggtgagcattcagacggcacactcgcccggcggagagaaaaaaattggccagtacactgtggacggatacatcgcggcgaccgacaccgtgattgaggtcaacggctgccactggcacgctcacgaccacccgcgtcaccgttttcagccccaaacagtgatggcgaatgggaaaacggcgcagcggatacgggaggacgatgcgagacggatggccttcatcacatcccaggtgcaacaagtgctcgtattttgggagtgtgaaatcaacgcggagaagcgcgacaacgacgaaatgaagcgcacctttgcgcagtacaaggacagcggccctatccgtttgaaggactgctaccatggaggacgtgtgggtccacaacgactacactacgaggtgccggaggggtggaggatgaaatattacgacgttcgttcgctctacccccacacgaatgctgtgacagcataccccgtgggtcacccaacacgagtgaacatcattggtgaggcagagcaggcggttgactggcgacgcgccgaccaagtgccggtccgaggcattctcaaagtgttcgttgtgccgccccatcacattgatgtgcctgttctgcccgtgaaatttgatcagcggcttcttttcccgctgtgccgtacgtgcgctctgcaacacccgcatggagcggtcaatgaggactacgaatgcacgcatcgcgaagatgatgagcgggggtgggtgtccactgtgacgtcaatcgagttggaggaggcgcttcgcaacgggtatcggtgtacggcctattatcgctccgttgagtgggacgacacgcagtggagcgaccgcgtttttcgaggctacgttgcagaattcatggccatgaaaacgcatgccagcggcttcccggacgaaattggccaaaccgaggaagatcagcagcaattcatagaggaatgtgaggaaaaattcggaatccgaatcgagcgggaaaagatggtgcacaacaaggccaagcggaccatcgcaaaactgtgcaacaactccctgtgggggcgcttctctttacgcaatgggttgtccaaaacgattgtgaccgactcgcccgcggaactgcgcgctctgcttgacaacccagcggtggaggtcagctccattgaccaactcaccgacgaatgcgttctggtcacctatgcggccggaaacgaatgggtggaggaacacgagtgctcaaacattgtgctctctctttggacaacatcggtggcgcgcctacacttgttgcggctaatgcagaaggttgttcgcgcaccaaactctgtgctcatctacaccgacacggacagtgtgtgtttcgcccatcgtgaggcggacgggtgccctctggagacgggaccccacctaggcgacctttcggatgaatggccggaccacgaactcgtggaatttgtttctg

SEQ ID NO: 73474 - DNA, 1587 bp, Heterodera glycines
  Genomic contig location: Contig_ID=SeqID_126; Location=152..1738; Strand=+
  SCN-specific regions: Sequence locations=1-814,836-1503,1525-1587
atgaaagtgttttttgatgacttggcaaacgaacgtggccctttagaccctagacttgcatatagcggtggacgcacgggtccattacgactttttgctgaaccgtccgcggatgaaaagatttccgtcttcgacattgtctcgttatacccgtgggtcaactacgacacggcttatccaattggtgttcctaccattgttcgtcctagcgctgaggagatgattgtcaactggaccaaacctgagcatctaagctaccgtggtctttatcgtgtgcgtgtcatccctcctcgtggtctacgaataccagttctaccgatgaagattgatgagagactgctgttcagctgttgtcatcgatgtgcggctttgtttcgtaaaagtgtgacacgctgtgcacacaaatgcgaacattcggaacagcagagagccttcactggaaatttcactcatattgaattggaaaaagcgttggaaatgggctacgtcatcgatcgattttggagagcatggcattatgatgaatggagtgatcaggtgttcaaaggatatgttcgccaattcatcaggcttaaggttaatcgttccaggaaatatttcattccaaattattttgacaggtggaatcaagcggatttccagatggtgtggaaacgttagaagaaaagcatcaatatatccgcgagtaccggcgcatatacggagttgatttagaatttgggagtattaaaaagaatccaggactatgattcatcgcaaaattaatgcttaatagtctatggtcagtttaaaaaatttttgtttggcattttagcttatatttttcaggggaaaattcagcatgagaaatcagcttggctcgaacaaagtgataacgagaccgcaggagttttatgatctagtgctaaaccatagaatggtttggttttttctacatatattgagttatttttgaaaattaaggaaatatcgtcaataatccccatatccgatgcagctattcgagtgctgtataagccgaagaaaaacttcatcgtagaacatacatcaagcaatattgtcctaagcctttggacaacgagtcgagctaggctgaaactgcttgactatatgctgcaatgttataatacaccgggcaccgagttactatacactgacacagacagtgtaattgttcggcataagcgagaccttgttccagttcacacgggcgagtatttgggtcaaatgagcgaagaatacgccgattacgacattttaacttttgcatgtggcggagcgaaacaatatgcaatgaaaatggtgcataaacagacaaaagcagttaaatttgtgcagaagatccgaggcattactttcgacgtcaacaattctcaggagcttcagtttgatcattttgtacgcaaagtgatcaactacggaaaagaggaggagcaggaaaatgcagcaaccttcaattataataaaatacagccgacaaaggataatcgaattataactcggaaacaaaataaaaagtatttacctatctgccagaaaggcattattagtcaaacccttgaggttttaccatttggatatgaatga

SEQ ID NO: 73475 - DNA, 2992 bp, Heterodera glycines
  Genomic contig location: Contig_ID=SeqID_126; Location=5691..8682; Strand=-
  SCN-specific regions: Sequence locations=1-506,537-569,591-1167,1199 -1372,1395-1689,1715-1737,1759-1999,2021-2504,2527-2992
  Gene Ontology: Mol. function=myosin light chain kinase activity; Cellular component=microtubule associated complex; Biological process=mitotic chromosome condensation
atggacttagccaaacgagtaacggaacaatcgtggaaagagaccgttaaattggctgctaatgcagccgatatcgcggaaaaggctaaaacagccctcaaccgagctgaacaagcccgcaaacgggcacctaatgctccacatgtaaagaaatggttcgacagtctatcaaatatggagaataatttgcgtgaacttgtggaaaagatttcacaagagtcgaaaaaggcggccgaagcaaaacggaaattagatgtacattatgattccaagaacttgaatgaatgccgtaaacacgcagatatgtcaaaacaagctcttaaaaactcgaaaaactacattgctcagcttacacccatgtattttagcacagtacctgaggatcagcttggcgtgaatgagcttgcaaatcgtgtagtgacggcagtgaacaattttttaaatgcagaattaacggttccaaggccggtcgaagaccctcagctccctgccgggcaaccgaaacagcagcaagaaaaacaaatggaaaagctgaagccaaccgtagaaaaggaagttggaagcataatcaagccaccagttccaaaactgtctgatgaaactgaaacgaaacgcgaacctacaaagccaaccgtagaaaaagaaatggaacgagaaccagtaaaaccaccggaaaaagaattggagcctgaaagcccaaaaaaagcggacaaagagctggaacctatggtaaaacaacagtctacgcaagaagacaatttgttagaaaaagcaaaaaaagaaattgaccaaacagcacagaatgcagccttaaaagctgaatatattcgcacactagttgccaactcaaaacataatagaggcgttgcagaaggtaggcttaacacatattcaggtgtccctcaattctacgattggcttgaccaaattgttgaattagataagaagatagacgaattggcaaaaaaggtaggaaatgaaccgtcaaaggtaataaacgctaagcagcaatttgataaaccttatcgaatgaaaaatttgacagaagcgcgaaagctaatcgaagctgcaaaaaatgcgtttgaagttatactaaactattcactggaaataaaacagttgaataataaaatgcatgaattaaatgacaaattcactgttgcagtcaaagagaaggaagaagaagaagccaaaaaaggtgcggcgattaatatacaacaagaaaagaagctagtaaaggaaattcctcaagtcttaaaggaactggagcgggaaaaaagtcagcatgatattaacaccactgctgagaacacggaaaccgaatttccctcctccgaatatgaaattgacgacagctctgagaagcagccggaacgaacggaacaacaggcagaggtatcatatgtattgaagaaaaaggaaggaaaattggaagaagaaaaaattgaaaccaaggatgataccgccattaatgaatttccatctacagaatatggaatagaagagagtgaaacggaggagacagagaaatggtcgccggatcaagctaaacaaaaaatattgaaaggaaacgaggagccgtttgagcagcccgatggccaaaaagatgaagagacaattttggttatcgttaccgataaaaaaggggaagtatttccatctaaccaatatgagattgaagataattattcatcgtcatcatcatcatcatcatttattgcccaaaacgaaccatcggtaacgaccaaaggtgaagaaggattgttaacggtccaaattaaaaaactaccaatgacaggggataatgagcaaaaaacaatacaaatggtaccatcagattttccttcatataatgacgatgatagcagagatactattgtcaatgaattgtcagaagaacagcttgcttctactgttctcgaagaagatatgccgaaatcggagccttatgatgtagatgagctcccagatctgcctgatcctcaagcgctttctgccaaggggagaggaggtgataaaaaaggagtaacttctgtgtctgacaggatgaaaatgctcatgggtcatcagaaacagcaaaggaaagcagtagaatttcttttcaatgagataactcaaagattttacattaacataggtagtggagtacaacatgttgatgcgagtagccatcttgcatatgtactcggatttgagaacactcgattgtactataatcatccggccaaatacttaccagatctgtcgggtggtgtaaggcaattgtatgtttatgcaccaaagttggtggaagatacaattattggagaccgtatggctccattgttgcgcgttgtcaacgtgtcaggcacagttcctctggacgtgccagaggttatatataccaatgagttttttaaaccgatacagaacaaacgaatttccgaaatcaaaatcgaaattcaaacagcgtttggacgttacattaaatttaactggggtaattgcgttctaacacttcattttaaacgaaaactattttaaaatgactcatgtctttttcaaccctgactccattgaatggtcaacatttctagcctcgcagcaagaaggaagaggcgaacagcagtattttgttggtacacgttaccaacgcggaggcggtcttctgcaaaatgtagcccgatttttgatgccagtggcatcaaatctactctccagtgcttcgaaggagggaattgctgcaggaacacgcgttcttggcgatttgtcccaaggtaaagcattgaaagaatctcttgaaacgcatgctaagcaaggtttcgaaaacctggcaggaaaattacaacaatgtgggaaaggtggaaattatggtgccgatggtagaagaggacaacgagtgtcaaaggttaaaaaagctagtggcatcagctccagtgattctattattggcagaattgggactgttaaacgccgacggaacaaaatcatggatcagttaagctccccttga

SEQ ID NO: 73476 - DNA, 2290 bp, Heterodera glycines
  Genomic contig location: Contig_ID=SeqID_127; Location=2..2291; Strand=-
  SCN-specific regions: Sequence locations=1-332,363-395,417-997,1025 -1197,1219-1513,1538-1823,1845-2290
  Gene Ontology: Mol. function=myosin light chain kinase activity; Cellular component=microtubule associated complex; Biological process=mitotic chromosome condensation
atggagaataatttgcgtgaacttgtggaaaagattttcacagagtcgaaaaaggctgccgaagcaaaacggaaattagatgtacattatgattccaagaacttgaatgaatgccgtaaacatgcagatatgtcaaaacaagctcttaaaaactcgaaaaactacattgctcagcttacacccatgtattttagcacagtacctgaggatcagcttggcgtgaatgagcttgcaaatcgtgtagtgacagcagtgaacaattttttaaatgcagaattaacggttccaaggccggtcgaagaccctcagctccctgccgggcaaccgaaacagcagcaagaaaaacaaatggaaaagctgaagccaaccgtagaaaaggaagttggaagcataatcaagccaccagttccaaaactgtctgatgaaaaagaaacgaaacgcgaacctacaaagccaaccgtagaaaaagaaatggaacgagaaccagtaaaaccaccggaaaaggaattggagcgtgaaagcccaaaaaaagcggacaaagagctggaacctatggtaaaacaacagtcaacgcaagaagacaatttgttagaaaaagcaaaaaaggaaatagaccaaacagcacagaatgcagccctaaaagctgaatatattcgcacactagttgccaactcaaaacataatagaggcgttgcagaaggtaggcttaacacatattcaggtgtccctcaattcaacgaatggcttgaccaaattgttgaattagataagaagatagacgaattggcaaaaaaggtaggaaatgaaccgtcaaaggtaataaacgctaagcaacaatttgataaaccttatcgaatgaaaaatttgacagaagcgcgaaagctaatcgaagctgcaaaaaatgcgtttgaagttatactaaactattcactggaaataaaacagttgaataataaaatgcatgaattaaatgacaaattcactgttgcagtcaaagagaaggaagaagaagccaaagaaggtgcggcgattaatatacaacaagaaaagaagctagaaaaggaaattcctcaagtcttaaaggaactggagcgggaaaaaagtcagcatgatattaacaccactgctgagaacacggaaaccgaatttccctcctccgaatatgaaattgacgacagctctgagaagcagccggaacgagcggaacaacaggcagaggtatcatatgtattgaagaaaaaggaaggaaaattggaagaagaaaaaattgaaaccaaggatgataccaccattaatgaatttccaactacagaatatggaatagaagagagtgaaacggaggagacagagaaatggtcgccggatcaagccaaacaaaaaatattgaaagggaaagaggagccgtttgagcagcccgatgaccaaaaagatgaagagacaattttggttatcggtaccgataaaaaaggagaagaatttccatctaaccaatatgagattgaagataattatccatcgtcatcatcatcatcatcatttattgcccaaaacgaagcatcggtaacgaccaaagatgaagaaggattgttaacggtccaaattaaaaaactaccaatgacaggggataatgagcaaaaaaacaatacaaatggtaccatcagattttccttcatataatgacgatgatagcagagatactactgtcaatgaattgtcagaagaacagcttgcttatactgttcccgaagaagatatgccgaaatcggagccttatgatgtagatgagctcccagatctgcctgatcctcaagcgctttctgccaaggggagaggaggtgataaaaaaggagtaacttctgtgtctgacagggtgaaaatgcttatgggtcatcagaaacagcaaaggaaagcagtagaatttcttttcaatgagataactcaaagattttacattaacataggtagtggagtacaacatgttgatgcgagtagccatcttgcatatgtactcggatttgagaacactcgactgtactataatcatccggccaaatacttaccagatctgtcgggtggtgtaaggcaattgtatgtttatgcaccaaagttggtggaagatacaattattggagaccgtatggctccattgttgcgcgttgtgaacgtgtcaggcacagttcctctggacgtgccagaggttatatataccaatgagttttttaaaccgatacagaacaaacgaatttccgagaacaaaatcgaaattcaaacagcgttggacgttccataa

SEQ ID NO: 73477 - DNA, 2722 bp, Heterodera glycines
  Genomic contig location: Contig_ID=SeqID_127; Location=2343..5064; Strand=-
  SCN-specific regions: Sequence locations=1-1179,1201-1208,1230 -1620,1642-1721,1743-1833,1857-1944,1966-2722
atgaagcacacaaagaaaatggtcatggttccggaaaccgaatacattgcgcttatgaacatagtgaagagtatgggtagccgaggcgatcctatacaagatgaaaaaacatcattagactcaaatatacataaaaatttgaatgataaaacaatcggagctgatattaaaatgaaacgacactcttggctgtacaaacggagacgtcaactcaaagagctgatggaaaataaaccacagaaagtgatcatagaaggaaacccgagttctgcaataccaaacgttgctccatatatgggaattcataaaataccaaaaatagaaacagccgtagaacaagagaataagcgtcagccgttacgattaataagagcatcacgtaaaaagaaaagtgaaaacgtgtttgaatcatcggcagattattcttcggctacagaaggtagcagtagtacgccaatacgttcccaagacgtaaaattaagtcagaaaaatttttcaaaaattatgaatattattggaaaaaatccggacaaatttggaatcgatatgcaatcaggacaggttttgaccaattttaataagccagtcaccggatcgaattatactgaatcgctgaaattattatcaggtgaagatatttctccgcctcgaggtcatacattttttgttcaacgtttgaagagggaaccggaaattgcaaaatacttatttaatttacaacagggtaaaggaaagaagagaagaactaaaagaaaactagtccttgtccaggttaaccctataaaaacccaaggattaaatagagaaaaaccgccatttaaaccagtgttatgggcaaaactatagaaagtcaacttgaacaggtttattacaacctaaattcgccggccagctacgcaggaatgcaaaaggtgctagcagaagcgcgaaaacgtatccccaacctaaagcttcacgatgtacagaagtttcttcataaacaaaggacttacacacttttcaaacccaaaagaaacaaattcccacggttaaaaactgtcccaagtggtttgcatacggattggcagtgtgatctttgcattatggactcgctgaaggagcacaacgatggataccggtatattcttgtctgtattgatgttcttagtagacagatttatgtcgccgaagctgagtcgaagaagagtgagcatatgattgaagcgtttgaaaaagttttcaaaaaggcacaagtgctgcctaataaaatgtacagcgacagtggcctagaattccaagccaaacgaatgaatgagtactggctttcaaaagatatcattaaacatgtaatgtacagccctcatctacatgcaggtgttgtggagagagcaaatcgcacaattaaggaaagactttaccgttattttagcgaaaaaaacacacacagatgggtagacattattgataaaatagttaaaaacctgaacaattcggtgaaccgtacaacaggaatgcgtcctgttgatgtgaattttcgcaatgcaacagagctgagaaatcgtctatataaagacatggaacaacaaaagcgaatacaaaaattcaaaattggtgatatcgtaagaattaccaaagagaagggagacttctccaaaggatattttccaaattttactgacgaattattcaaaattgttcgggtaaacccgaccaatcctccgtcataccgaatcagtgatttagaaggtgaaaatataaaaggtattttttacgatcaggaactggtaaagactgttgctgctgaacagacaactcatcgagcagaaattttgaaatccagggtgcgaaacggtgttaagcaacattttgttcattggataggttattcagaaaatcacaataagtggattagggattcagatctcgttcgttaggcatggatgatttttatattgtactaccattaaatgttccctttccgggaaatacagcatcccattttaccgtaagactaccacacaccctagagctagactcaaactggtccgttgcactttcctccatcatctatccacactcgttcccttccgtaggggtggatgaggacgactttgtcaacataaaacttctcaatcccgactataaatcagacggtacaggtccgactactgtaactctgaaggtaaaaattccaggcatacagtttcacagcgtagagcatatgcaaaaatcattgaacagcattattcaatcggcctatgatgtaaagtttccaaaagaaaaaagggtaaaaagagcggcggctgcttctgcagacaaagaattggaaccagaaacgcgacgagaaccggataaggaactgtcacgtgaagtgccttcatctaaaacattggataaggaactgatacgtgaagcgcctttaccagcaacacatgacattgaactaccacgtggagatgagccaaaaccatcagagaaggaactaggacgtgaaacaggaccagcgcaactttctgacaaacaattgggtgaattagaaggtgaaaaaccgcaaaaggaacaactgccacccactcccattgttgatcatggtgaaatatctacgatataccaagagcgcatggacttagccaaacgagtaacggaacaatcgtggaaagagaccgttaaattggctgctaatgcagccgatatcgcggaaaaggctaaaacagccctcaaccgagctgaacaagcccgctaa

SEQ ID NO: 73478 - DNA, 348 bp, Heterodera glycines
  Genomic contig location: Contig_ID=SeqID_127; Location=6393..6740; Strand=-
  SCN-specific regions: Sequence locations=1-348
atggagagaagcatacaagtagcggttgataaagaactagagcatgaaacatcaccagcgccagacaaacagttggaacgtgaacaaccgctcaaactaccgaagaccgaattgtcaggtgaagatttcacacaagaaaaacctccaccaatacctactcatacctatgaaaacgaattgacaggcgagaaatccaaaacatataccaaaatatccgaatcagacccacagactctgcttaaaaaagccattttaacaacagagtgctcgtggaaggaaacagtagaattatctggcaattcgactgatttaacacaatggatcgaatacgtcatgaaagccgagtaa

SEQ ID NO: 73479 - DNA, 763 bp, Heterodera glycines
  Genomic contig location: Contig_ID=SeqID_1422; Location=27..789; Strand=-
  SCN-specific regions: Sequence locations=1-34,268-423,492-556,578 -649,697-763
atgccctcaatgaacaccagcgccgaaaatgcggtaaaataaataataataattaatatatataaaaatatttaataaatataaaaataatttataaaagaaatattgaagttaatacaaatattttttcttataaaaagaactttaaatttcatcataaaattattataaaattaattaaacattcaaataggaaaattcgaaatttattttataaaattattattaattaaattattttaataggtatttgaaaaaatttttattgttttcagctttatttggcctaccgttctgtcggcccgtccgccgatttgattgtgccggccgttgcgctcaatttggttgcattggttggtattatgttgaacggcacagttttagtggtcactgccagatccaagtaaatgccatggcattttcttattttatttataatgatttaaatgataaattaaattaaactttctatttttaattaatttaattttctcatttttcagttccctccgcggctccgccaattttctgatggcattgatttgtttttgtgaattggtccaccaaattgggcactcttttttcctggttgttgtcatttcgggcacaaattttgtcagtttgctcactgctgacttaattatgacggtaaattttgattttttcaaatttaattttaaatttcaaatttttttagccaatgatttttgctttgaattgtggcttaatggcaatgctttgtgctgcaattgaccgcctttaa

SEQ ID NO: 73480 - DNA, 742 bp, Heterodera glycines
  Genomic contig location: Contig_ID=SeqID_1423; Location=188..929; Strand=+
  SCN-specific regions: Sequence locations=1-72,114-181,203-375,417-742
atgatgttgaaattaaaattagctcttttttatgataggttagattaaaaaaaaatgttttcaaagattctaattaaattatttatttttgtattttcagtgtaattaaaattgtgacttttaaagttgaaacggaaattgtttgaatggaatatttttccgtttgttaaatatcaaacggaaattttaaatttgtatttgtcgagaaaatttaaatgagctaaatgatttaatttcttcacataaaactcaaattgtcaaatattttcgcatccgtttgatgagacggacgtcaactaaaaattaacattttcccacctatttaacatcaatgtaaatctaaaagttcactcaattaaattttccggcatattgttttaattaattaaataatattctaaattaaaatttaaaaaggacaaattccgagtcaaaatgtcggcataattctcctgacctcaattttatgggagcgggattcggcattggcatcaggctcaattatgattaccgggatttaaatcccggttttttcgggatatgaatcgcttcccgaaatttaaatcccggttttcggtccctatcccggcccttttttccaaaaagccggaaacggcatcgggatcccgggagaatcccggcgggatcccgaccccgtccggctctaatgtcaacctttgaactgaacccttttgggacaaaaaagtataattaattttttgacttttgttaatggcgtgaa

SEQ ID NO: 73481 - DNA, 56 bp, Heterodera glycines
  Genomic contig location: Contig_ID=SeqID_1423; Location=1533..1588; Strand=+
  SCN-specific regions: Sequence locations=1-56
tagaacataaaaggtaactcgctcggtgggactcgaacccacgaccccagcaatcc

SEQ ID NO: 73482 - DNA, 783 bp, Heterodera glycines
  Genomic contig location: Contig_ID=SeqID_1423; Location=1302..2084; Strand=-
  SCN-specific regions: Sequence locations=1-23,47-73,96-470,541 -597,633-783
ttttattttctgggatctattactaataatttatcattttcctgtcaatttgtaagtcatatagtcagttggtattttcctatatttttcatatttgaatacttcgcgcaaaattttagagaatccagtcgttacggagatcaggtgaaagtgggataaagctcttgagagatcctctaaaataggcgcctgtagttcatttggttagatctcggcacggaatgctggggtcgtgggttcgagtcccaccgtgacgagttaccttttatgttctacctggcgctcctgggtggatcccctccacactgccgggaccactggtccaaggagagtccaagtccgtcggtgaagggccaaggagagcccgagggaccggtcttccgagggaggcggaatgtgatgccagaaggaacggagtgtgggagaaagtgggataaaggacctgagagaacctctaaaagaggcgcccgtagctcagttggttagagcacggcacggattgctggggtcgtgggttcgagtcccaccgagcgagttaccttttatgttctacattaaaatagggaattcaattaaaaggtggacaaaaaaacaaacaaatattgtataaatgaattaattaaaattaataactagagctccgattttaggtgctaaaaactaggaaaatagttagtttttaggttctaaaaactcccaaaatagatgctaaaatgggaaaatagttgccaaaaactttcaaattaaaggggtgtaaaatgacaaaattttattcaaaataaa

SEQ ID NO: 73483 - DNA, 495 bp, Heterodera glycines
  Genomic contig location: Contig_ID=SeqID_1424; Location=1178..1672; Strand=+
  SCN-specific regions: Sequence locations=1-430,452-463,487-495
atgcaaccaaagcgccttgccaacatcaccccgccacagacaaaaaaacaacatctctctgataaactggcggcggcacaaacaatcatcggtggacttcaacctggacagtcggacggtgcacctcaatgggccaactccctccttggcttctgtgctgagatggtgggaatctgccgcgagcttctctccatggtcaaagagcagcagaatgacaacatggacacacgagagacttggaggaagaacgccgactccactctgtcgtggtcgtgaacctgccggaaagtgaagaaactgtgccctctgctcgtgtcaactccgattttgtgaatgctcaatcaatgctcgacacttgtgagatcgaatgccggccatgtcaggtttaccgaatgggaaagaagtccgaccgcccccgtctcatgaaaatcgaattccccaccaaaaaacacgcccaaaattttctgtggaacaagacaaaactcaaaaatcaca

SEQ ID NO: 73484 - DNA, 354 bp, Heterodera glycines
  Genomic contig location: Contig_ID=SeqID_1424; Location=304..657; Strand=+
  SCN-specific regions: Sequence locations=1-354
ttcattctctgttgaatttcgtttactgcgtttttgtgacttttcccactgcatttaattttaagaatgttcgtttcgaacagtgtttttctgcctgtctcccgctttttccattgtcgcgcgttgtccgctgtgaatttggtggttcatccgtttgtcgctaggaagtgcgcctttttgtctacaccatctttgtcttttccatttcggcgtcaatactcatcattggcatctgctacaacgacgggagcgagcaacgacaagctgaatgtggacaaactgttcgaaaaaataaactttgaagtgcgcggtcacgacttcacagtcctcaagtcgtattcgctttttgttatg

SEQ ID NO: 73485 - DNA, 2834 bp, Heterodera glycines
  Genomic contig location: Contig_ID=SeqID_1425; Location=305..3138; Strand=+
  SCN-specific regions: Sequence locations=1-114,136-352,374-521,544 -950,988-1032,1063-1108,1144-1240,1269-1697,1720-1838,1861-2082,2104 -2258,2280-2337,2360-2447,2469-2537,2560-2834
atgcgatccctaaataataagcttaacgaatttactgcgattatagccctaaaagattttgaattagtttttgtaactgaaacgtgggcaaaagaaaaaatacctttccaaccatttattactaacaattacaaaatatatgaagctagcagaagcggaaaaaatggtggtggagtaatgattttgacaaaaacgagcgtaaattcgttttctgtcttatcctgctctaaattcaattgtgaaatccaaattattcagataaatggagcaaaaaaattaagaatagtattactttacagaccaccgaacacttctgctaatttcacaaaaaagattctgaacctcattggtaactattttgaagaaaattttatattaatgggagactttaacctaaatgcaaaggacataacttggaccagtggaacgccttatgctaagtcggaaaaaggaaatattttttgtgaattttttaataagtatggcttattccttatgactaatggacccactcgtggtagtgcttggcttgatctgattctctcttctaaacctgattttgttaataatgttttaattgaggacatttttagttctgatcatctttccactaatttttcattgtcatttcctcagaataagagtaaggcaaatacatttacagtacgcaattataattctactaaacttaatctactaaatttaaacttatcttcaattttaccctacaaattactacaaaaatttaccattgaagataagtttaaccatttttaccttctttttagagaatatgtagaattatacttgcctaaaatcactgtcggtcaaaaatccagaaagcctaactacccattgagtcttaaactgtcaattaaggaaaaagccagactttataaactacaaaaaataaaccgtgataaatataggcatttgtatgatagcatttcattacatataaaaattcaaataaataactttgttactaaaaatgaaaataattttctgaataaaggaaaaaatgctatctacaaatatataaataaatttacaaaaaattttgaacaaatccactctcttagttacgagaaccaaattatttttgatgattatttaaaagcagaaacttttgcaaaaattttccaagaatccttttcaaattcagatgttccacaaattagcagttgtccttccaatcccaatggaccttctatttctgatgttgaatttaatgccgatgaaatttctaaaattttaaaaaatttaccgaatcgagaatccacatcccccgatgaaatttcctttagaatcttacgtaattgccaccttactctttctcctgtaatttccgaacttttcagaatatcaatggacacaggcaaaattcctgaaatttggaaaaaatctattgttatacctctctttaaaaaaggtgaccgaaatgatccacataattacagacccatttctcttacttgctgtctatgtagagttatggaaaaaataattgcaaaaagcatttataacttccttcatctgaataatttaatatccgaacatcagtttggttttgttaaacaccgatctactaatactcaactaattacagtattagaagattggtacgacagcatatacggtaagaaaaatattgactgtatctatgtggactttcggaaagcttttgattcccttcctattaatattttaataaataaacttcataacattggcattaggggaaaactgctaagttggttatctgaatttttaaaggatagattttacagagttaaaattaacaacaaattttctaatttatatccgattcagtctggtgttccacagggttctgttcttggccctctgttgtttttaatatacattaatgacctcccgcaggtaatccctccgggagttagcatcaagctttttgctgatgatgtcaaaatttatgtttcttacaaaactcgtgatgaaagaagcaaattaaatgttgctttagacaatattggaaaatgggctaatgcatttggtttaaacatctcccaaaataaaacatttatattatttctcggcaaaaataattcaaaacaacaatataaatttttgaacaatattattaatgaggttgaatctattagtgatttaggcattttaattgataataaattaagattttcaaatcattatactaaaattattaaagctgcttatttaaggattcgcaatattgccaaaattttaaaaacccgctctatacgtatttggaccaaagtattcaagacatacattcgtcctatttagaatatgcgcccgaaatttggaatccgacatacaaaaaagatataaataaattggaaagatgccaaaaatattttacaaaaattgctttatttaaatgtaggcttccgtatataccttacgaacaaagacttgatttattcaaacttcaaactttagaagaaaggagaaaaacaattgatttagttcaggcattcaaaatcatcaatggtctcactcatcttaaaaaagacatattcccacaattttctggtcacatcccttataatcttagacgtaaagttgtgttaaaaccacaatccagtaaaacttcaaattcttttatcaacagaacggccttaatatggtctaaactcaacaaagatataacagatgctccatctgttgacagtttcaaaaaacgaataaataaatggattgagttaaacaaaaatttagtctgtaaaagagctccttggacttgatattactttactaaaatctaacgtgtaagtggtcaccccttcgttggatatttttatttcttctga

SEQ ID NO: 73486 - DNA, 180 bp, Heterodera glycines
  Genomic contig location: Contig_ID=SeqID_1426; Location=110..289; Strand=+
  SCN-specific regions: Sequence locations=1-180
gggcataatttattggccgatcaatttggaagaattggcctaactcaaaacaatgcacaaacagaacagttaccggtcactgaaaagtcgagtcaaatggtaaccggaggagcgatggcagtgaaagaacagccgagacgaaatgggacaatggcaataagccaagaaaaagtgcagtga

SEQ ID NO: 73487 - DNA, 1206 bp, Heterodera glycines
  Genomic contig location: Contig_ID=SeqID_10308; Location=1716..2921; Strand=+
  SCN-specific regions: Sequence locations=1-183,205-772,887-1206
atgcgccaaattcgggaccgagttgtccacctattggttcaaaacggtctcgaaaggcgcgagtcactgaacgtcgtggaaaaggccatccacggaacttcggaaggtccattcgcagaaagaacggtgcgtcaattgcacgacttggaaggactgtttgcaaggctgaaggagcttggcatcaaagtgatttggcaacattcgcaccgaatgtgactgtttgttcacccacagattgccatttgcacagcggacagtcgggcgggaacgacgcgagttttgaagactctaaaagtcgaacaattcgtggatttgatcgtttgtggtgacgacaaaggatcagtgccgaaaccccagccggacaatgctctgttcatctgccgtcaattgggagtggaccctaaggtcgaatgccctttgatggcttatcgttaatgttgcttctcctcttcagaatgccatggtaatcggcgacactcctgccgatttgggaatgggacggtctgccaaactcggctcaatcgttggtgttctgtcggggattggagaacacaaagaactgaacgaagctgaccatttggtgagccataacacatcctttcgtctgattctttcgctgtttaggttgaacatgttgaagaacttcttcctctgattggctgagatttccacgttgtcgtgggactgcgcataacccaaagacggattgaatcaatcctttgttctgtcaatacgtcgtgcttttccctcccctcctattaatttgccattgtatttatatatatatatattttaattttttgatatagatttcattaaattattaaatcaatttttaaaattaatttggcatttgtattatatatgtatatatttttattttattgtaggtcaaccaaaccttgaggatgacaatttggacaacttttggagcatccattccccgtcaaccgatgaacaattgtacgacatgccgtcgccggaaaaacgcaatttttacacccatttttggcgcagcattgcccaacgcatgccgagctatcgcggcggaaacggccgcatctcgtcactggccgaggcatttttgggcgtggatttaagcatggaaaattgagaatcatccgacgaataattaagcgctaactttatggaatttaatcccaaagaatttgactcgagaaaagcccaaaaaaatttataaattaa

SEQ ID NO: 73488 - DNA, 1926 bp, Heterodera glycines
  Genomic contig location: Contig_ID=SeqID_10309; Location=518..2443; Strand=-
  SCN-specific regions: Sequence locations=1-286,315-586,608-713,735 -788,810-812,834-893,915-994,1017-1484,1506-1537,1680-1680,1702-1926
actttgaggacccaattttggccaatgtaaaacaaagccaaatgttgatccgacaaaaatccaagggcaccatggacttggaaatggacgaattcttaaaactgcacaagcaaattcaaggacctcggcaaaaattggtacgaatggaaagggaaaaaatgatcaaagaagcgaccgaaaaggcaaaagtggaccgaagaaatcgtatgttggaacgagaaaaaatgtggagcatgaagaaggctggtgttgctgcacatcaaccagcatcaccggcaattcgtggacgaacacagcagcaacaacagcagaagctgcaacttggtaaggataatttttagaaagaaaaatttgaatattaatttgtggttaattatttgtttgaattttaattaggagctaatcaaataatgtgtgattccttcctggattgattgaaatattcaaaaggtgctgggtcgtaacaaaaaaaatttgcatatgcgttattaagagagtgctgaaatccagtaccggtcatacaaatcatttttaattaaggagattagagaaaactaattaataagagagagttatgggaagatatttaaagacatagaagagagaatagaaacatacggatacttctgcgtctatgacaaaatgcttttatatgattagcataaatttcaaattaaatttacaggcctaaaaaacctgtatttcctgtattaattttaatcattatttttggcgaaatgtcttaaaaaggatggaaaaattcaaaaaaaatatcatttttatcagtgaaatgtgtcaaatttgaaaaatttattaatattttggcgaaatgttctggttcaaagaggacttggtcgttttggcgccagcccattgggctgtaactttttttattttcaaccaaatctaacgatcttggtatcattcgaatgcccttcaaatttcaatttggcgcatgttttaaataaaattgtattttcttatgagcaaaaactttttgttcaaaattcttttttgtaaaatctacaaattatccgatggcttctaaaatccttataaaaaaattggtggaaaatcgcaaaattttgtcttttttggacaaaatcttgttaacaaattgcatttaaaattacaaattttttcccggcggcgcctacctgcaccgccggaccaccgccccctcccctagttacccaaaaaattgttttttaaaaagcgcgcctttaaaaaaccaaaaaaagtcattataagggatgtcaaaattatgtacaaatatgtatgtaaataaaatatttaaattgttgttttttggaaaaaaaatttttcgtagagggtaagataggcacaaaatgtaacctaattaggcttataccgtacatccgctatttgaaggcccccctccaattaaaggcccctttttggaggggttgaacaatagaaggcctgtgccttcaaatagcggatttacggtaatcatcttttagtattttaaaaattaattttggtattttttattggtacattttcataaattctcaaaatatttaaaaaaatgaaaatatatacgaaaaaagtttaaatatattacaatatttattgtttaatatataataaataatttagtatttttgtgttaattttttaataaaaaaggtttttatcaaaaaaataaaaaaatacaggtacaggcctggatccaggcctcgagaagcctgtatttttcctgtacctgtattttcctgtacttttgtacaggaaatacaggtacaggccaatttggaaatacaggtacaggtacaggcttttttcaaaatgtcgatctctactaattgtagaataataattaaatttaaaagcaaaaaaaagtattagaaaaaacaataaaaatgaaaaaattcatgacaattttataggctgactttcgaa

SEQ ID NO: 73489 - DNA, 378 bp, Heterodera glycines
  Genomic contig location: Contig_ID=SeqID_10310; Location=100..477; Strand=+
  SCN-specific regions: Sequence locations=1-99,137-378
atggaatcgaggtccaggtccaggcttttttcaaaataccgagctctactagttagtcatgtacatttagcagaggggggctctttttgctttatattttttggtttctaattaaaatttttgaaaaaatatttctcccatcaggtccgtgccgaggacggttcggcgctggccgagtattggtcttgtccgttcgcggaatgctccgccaaatcggcacacaatgtgaacacagtgtttgcggagattgtgcgcgagattaattatgtgcaaagtgccaaggcgaagcagaggcacggctgttgttcagtgatctgattgatttgtcatcatttgcacccgccccaaaaaacacttggccagaaacacaaattaata

SEQ ID NO: 73490 - DNA, 913 bp, Heterodera glycines
  Genomic contig location: Contig_ID=SeqID_10310; Location=1502..2414; Strand=+
  SCN-specific regions: Sequence locations=1-255,277-367,389-455,485 -652,695-913
atgcgcaaatcgatccaattgcccattctaatcagtatgatcagtgtgtttgattttgtgattggaatggacgaattgaagcagccattgctgaaaaaagatgccactgatcagcagtcccaattcgaactgttcgtcgaagatggcacaacggaggaggaggacatggaaaaagcaatgaaaactggtaaaacattcttttggcgcgaaatggtgacaaattggcattgtaaaaatgggaaattgaaaaagcccgaagaaattggattcaaaaaatcttataaagaattgattgaattttgtgaacattggaaaatgatgacaaccgcagcgaatgcatttgtgaaaagttgggagaggtgcagaaatggacagaaaaatagacaaaaaattgacacatcaagttcaaggagttcgcggaaaaccagtaaattcggtgagagtgttaaggaatgaattaattttttaaaattaaaaaaaaattgtatttcaaagaaaatccattggaatgcctttgtctgaagccacattttcgtgtcggcgatcgcgaactccaaatgagctcagcaatgggagcaattaaagcagtttatcgtgacttgttcaaatggggcgatgggaaaagcatggaaattgaggtaaaataaatgtcaaaaaaattaaaaaatgtattttaaaaatttagtttaaattagcgaatgagaatccatggaaagtgatccaatttttagttgataattcaaatattgaagaaattaaagcatcattaacggaattggagaaatcaaccgctgttggcacgaaaaaatttgatgcttttatggcaaaaaattttccaaaaattaatttaaatgtcagatcgcgagacattttttcaagcaagttttttttcaataattttgcttcatattga

SEQ ID NO: 73491 - DNA, 592 bp, Heterodera glycines
  Genomic contig location: Contig_ID=SeqID_10310; Location=3512..4103; Strand=-
  SCN-specific regions: Sequence locations=1-36,107-386,408-592
atgcgcggaatttgggactccgcggtaatttttgactaaaatttttaaaaataaatttttttaaagcgattgttttataactaaatttatttaaaagtaaatttttgtttatgtaaaaagcaagagatttagaaattggattctcactaattcctccaaaaatgagaaatattcattaacttttctagacaattttcttctgtaatttaaaaccaaatgactcatgaaaaagactctatttggttttagtttgacaaaattgacaattcttcttatgccaaatgcaaggcatgcaattataaagttgacagagggcctagaaaacgaacatctgatttggaacgccatttaaaatctaagcatcctgaacattacaagcaaagggatgaagctttacgtaaaaagaaggaaaaaattgagaaatctgacaattctcaagtgcgccaccgggaagtgttgagtcggaacgccttttcagcagcgcaggatttattcttaatgatcttcgaaaaaacctatcgcatgaaaatctagaaaagcttatttttcttcatcataatctcatcctttaccattttgattattgattaaa

SEQ ID NO: 73492 - DNA, 817 bp, Heterodera glycines
  Genomic contig location: Contig_ID=SeqID_10312; Location=1446..2262; Strand=-
  SCN-specific regions: Sequence locations=1-406,490-817
atgttcagctcttccaatttgtctgctctctttttggcctcctccgttttggccgtgcttataattggcattaaaatggacggaccgacggaggcaaaaggcgccgcccctccaaacgccgcggggccaatgggacttttggttatgatttttaattgtaaaattaaacaattcaaaattcattcagcttttattgaatggcaaacaatcggcggctaatgaaaagggaaaagcgccctctggcgaaagtaagccaaatccggggcagaagccgagcggagaacggcgaaagagggacgttttggggcacgccggcggatacgtcggaggatgggaccatcccattgactcgacactgtaagagcataaatttaataaaaatggcatattcaaaaatgcaaaatacattttaaattaaataattattattaatttgagttattatttttaaaaagtttaaaaattaaaatatttcttttgaatttaattgtcctttattttagtgattgggcaaagagtcagtggaatgatgccaattggctcgccgatgttgtcaacagaaacggatgggaaaacaccggcactccaaccggcggacgatgaatcagtgaattgtgccgaccaaagaacgaaagacggcatttttgtttgggaatttaattgactttcggaatcaaacacactttcctttttagttgcctatttattctaaattagcgttttttctgttcattttctacgcataaatttgtgtgaataatattttttaaattttggctaattcaatgacatcattccaatgccatttgatattaaa

SEQ ID NO: 73493 - DNA, 708 bp, Heterodera glycines
  Genomic contig location: Contig_ID=SeqID_10313; Location=491..1198; Strand=+
  SCN-specific regions: Sequence locations=1-240,262-630,654-708
atgttactgaggcggcacgagttgagaaagccgaggttcagcagcagcgaagcggcaccagtgaatatgcacaaaaagaacattggcaagtcgcaactgagtaaaatgtcgaaaaataatggagaaacggtggagggagacaaaatgccaaaaagttagtggggaaaagtgccatttttaaaattcaaaaagggactatggcattttacagtcggcactgctgcttcttttgcagttttcttcctaaactttgcctttttgctctgctcatccgtcactaatttggccacaaaaaatgccaacgaacaaacgccaaacggacggacgatgttcccaaacgcgccgaatgctcgaaacagtcacaatgattacggtaattacggtatttacagtatttaccgtcaaacggaaagtgattggccgaacaatgctcatttaaacatcccgatttttttaaattgttcgtatttttggtagcaatagaaatgggcgggatgtaaaaatgggaccgagatcttgtctcgatttaaaaaaatatgaagattcataggtcgacggttccgttaggcaacgccggagaaaaaaaccggaaaatgaaatttttaattaattttgcaccaaaatgtaaagtttaatttaatttaatttaattttatcgagcaaaccaaaggcacattagtgctcttatatggtgccaaaaacaaacaa

SEQ ID NO: 73494 - DNA, 1827 bp, Heterodera glycines
  Genomic contig location: Contig_ID=SeqID_10314; Location=35..1861; Strand=-
  SCN-specific regions: Sequence locations=1-191,213-229,251-387,409 -469,495-783,918-936,958-1048,1070-1617,1641-1644,1666-1722,1758-1827
gactgatcattcggatgggctgattgatcagggtttcagggatgggacttccctgatggtgttggcacaacgtcagcagcaatttccctctccccaagggttttcaactgaaatcatgggcctagaatttgatgttattcaaaagccttaaaattcttattcaagaattttcccaaatattttgcagaggcaaaaatatataaatttttattgttgcattattagagatatgaatgaatgaagtgaatgggcgaggaatacattaagaggggcggggcagcaaagatcgaattaattgcagaaaaatgagaaataaagatatcgcacttcctttcgtccggacacaaagagcgatcaattttttatgaaattctatttaatttccaatttgtaaatttcatttgaattcgtagtaaaatttagaacgaatctatattagtattttagtaaaaaaatatggtttttattgattaaaaaacttttcaaaaaaccctgatccgtatacgggtccgtatttttccagcatacgtactatacggagtaagggtttttagtccgtaagtctgtagtccgtatggatgcctagtccgtagttctgatcctgatccgtatttttgccgaatgtcgccgctctctagaaaaaattatcaacatttcaaactttacatacaatttcctggcagatttaatacaatacttcaagaaatatcttattttttcttaccaaaaaagtcattcttaagggtgtaaatattttcgtctttttcgtccaattttgctctgacgaaaacgaaacacgaaacgaaaatccaaaatttaaaaaccgaaaacgaaacacgaaacgaaaaacaaaattttgaaaaccgaaaacgaaacgaaaaaactttggtagacgaaaacgaaaacgaaactaaaaaagtgccgaaaatgtaggacgaaacgaaaacgaaacgaaatttcgtccatccctgattgcgatgataagccaccgatttgactatttcgttgacgaacatttcaaaacgcgcaaatggacattgggcaaaataaaaattctaaatggggcaaaagaaatgaaaattgtcaattattccaattgggaatcgctgccgatcccacaaaatccgttgccgaacaaagtcatcggattcggaagcattgttatctagtgaaaaattaaatttatagatgattttaagcattacatttaactgatcttcagctacttcgaccaaaatgtgctcacttttgtccgccgtttttaccgtttcttcgcctcatgttcaacaacattgttcattcgcactgaaaatgtgcgaatttcggaattcattgtgctcaacatttggccaatgttcaaggacacgactattgtgttggattttgacggccgcaactttccgtcgaatgcgccaattggccccgtcaatgctcaacgaatgtccatcccttcatattattggtttcagttaagcattttgcccggattttcatctgacgacagtgccaatgcgtcgaatgaccaagtgtttccaggggttttcggggccgcgatcatggatggatacgaactcgatttgacgcatttcgaaccgctaatcagaaattctaacattttttgaaaattttgttttaaaaatcggttttaaatataccaaaatgcttgctccatgattatccgatgtgttgcttatattaattgttcagacgaagcattgatgcatttattaattttaatataaatattctttttttttgtagaaataattacagggctccagttggaagggacgattgagtcgtcgggctgcacctcattccaacgcg

SEQ ID NO: 73495 - DNA, 1917 bp, Heterodera glycines
  Genomic contig location: Contig_ID=SeqID_10315; Location=46..1962; Strand=+
  SCN-specific regions: Sequence locations=1-1345,1367-1451,1473 -1804,1826-1895
atggcattggggacaacaacagcaaaaatcattcgaacagatcaaaattatgctgtcgtcgaacgagctgttgcccattttgatcccaaaaagccactttatctggcaacagacgcatctgactatggagttggagcgatccttttccacaaagatggaaacacaggaaagtttggcgtgatcgcatacgcctcaagaacattgagcccagccgaaagaaattatgcgcagatcgaaaaagaaggacgcgcagtaatcttcggcgtggagaaattcaaccagtacttgtacggtagaaaattcattctacagacggatcacgagcctttaaaaaggatttttggaccaaaaggtgaattgcccgtggttacggcacgacgacttcatcgttggagtttgaagctcatgaattatgagttcgaaatcgaatattgttcgacaaaaaatttcggttacgccgatggattgtcgcggttgcctagtccagaaattgatcaggtctgtaaggaaagtctcgagctgaacaaaatctagcaggagagccaaaacgctttgccgatcactgcgaaggacattgcgaaagaaattggcaatgatccggtcttcgcaaaagtaaaaggttttgtgctcaatggatggccaacaaggatagaagacgagaaaatcgcccattttttctggtaaaagacgaattggagctgaataacggatgcctaatgttgggatgtcggacagtgattccgagcaaattccgtgagaatcttttgaaattgatccacgagacgcatccaggaatcgtccgaatgaaggcattggccaggcaaaaagtttggtggccgggcatcgacaaagacattgaaagcatgaaaaagaagtgcaaaatttgtcaaacgaatgcgccggaaatgaggaaagaattgtgtctgacaacgggccgcaattcgcgtcaaaggagtttgaagaattctgctccaaacgcggaattgaacgaacgctgacggcaccataccacccgcagagtaatggggaagccgagcgttttgtccaaacattcaagaaaggaatgttgttggttaaaaaagaaaccaactgggacaatgaattggccatgaaccaattcttactcaaataccgagtaactcctcattctgcaacaggacgatctcctgcaaaaatgatgttcggcagaaagctgcgaacactgctcgacctcgtgcgcccgtccgaatcgaccaaaattgaaggaggagaagagaaggcaaaagaaaatgctgaaaagcatggccaaaaatatttggctcgcgccaaaaagaactttgatcgacggacgtggaaacgatcgtttaaaactggacaaagaatctttgccaggaattacagagacggttcgaagtggatggcaggccaaatcatgagccaaataagcccatcactgtttcttgtccgaacagcccgtgtggtctggaagcggcacttagatcagctgaaatcggacgagacgaagcctgatctggagagcaacaccgacgtggactcaacatcgtccataggtgatcagacggaggatgaaaaggacggaggacagcagacggacgtggaagaagagccgaacgatccgccaaatttgcacgatccgccattgagaagatcggtgcgcgaacgaaggccacgacagatcttcgaccccagcgcgtgatcgctgacttcagctggtggggaggagatgttgtgttcgttaattatttgaattaacgccaaaagatgctcgtttatcgatcatccttttgacccttcgtgttgtccatttaaaccccccttttcccccattccgtgcatttctccctcattcatttgttgtttccatttaattgtgacccgctccctcccttcgctatttattatatttatttgtgtgga

SEQ ID NO: 73496 - DNA, 183 bp, Heterodera glycines
  Genomic contig location: Contig_ID=SeqID_10317; Location=288..470; Strand=-
  SCN-specific regions: Sequence locations=1-65,87-183
aaacaaatttaaaaaacggtcgcgaagcgcccgcccaagcccaacaaaatttgaaaaacgggcgtgaagcgcccgtctggccccaactaaatttaaaaaacgggcgcgaagcgcccgtctgagccgcgaagcggccgaatgttcttaataacattaaaaacgggcgcgaagcgaccgtcttga

SEQ ID NO: 73497 - DNA, 3086 bp, Heterodera glycines
  Genomic contig location: Contig_ID=SeqID_10318; Location=85..3170; Strand=-
  SCN-specific regions: Sequence locations=1-131,183-330,353-491,513 -535,557-627,664-898,920-1181,1221-1685,1708-1735,1774-1796,1818 -1827,1849-2146,2168-2219,2241-2318,2347-2999,3024-3086
atggtgcaaaataatccagacgtcgtcctcgagtctttttaccacatacaacaaagttttgccgaaatcgacctgttaaacgaggaaattacaataataatcacaacctactcagcccccacgggatccggtaaataaaaaatcatagattaaaaaaaatttttttaggttataatttaaatgtgtttaattttttcccgccaaaagagaacgggagattatctgtccaaaatacagataattattgtcttttttatagtataatattgagtaaattttatcaaataattggggcagaagagcaatttcggatatcatatgcacaattccgaaaaatctataataaccagaaaaggcaaaaaaattacgtcgatgaattaattcaaaacacaaaaattgatccaaacaaaacgtcctatggggtagaagatctttcaattgttcaagatttttttgatcgagaatttcccggaaattttttagtcgcagcattttcaaaggtaaaaaagaaaatttgagaaataacaatcaagtattttaggaaaatggtttaaaacccatatttaaaggacaaggaccaaaaaaatatataatttgtatttttctcgaaaatgggcactgggacggtaaattaatataaaaaatcgtttttaaaaaattttaggtttaaaaagcgttaaacaattttttaatattaaacactattattgtatatattgcgagcagacatttcgtgaaaaaattaaacattctgttaattgtgtaataaaatgtcaacgatgtggcggatggggtaatgaaaaaaaaaggaaaataaaatttacaaaaaattcaggtacaaaatttccatgtaaaaacgaaaaaatacagccaaaagaatgcttaatatgcaatagatattttttcaatgatttttgctatcaaaatcattttaaattggcctgcaaatactatagacggtgtatacaatgtgataacgattattgcataagggatatgcatatatgcggtattaacacacaatctaataatttgttatttcgatttttaggatcaaaattctgcagagtttgtaaaataagacaccccaaaacggaatgttgttacattaaaaaaattataataccaaaaagtttaccaaaatatagaattatatcctacgatattgagtgttcggtatgatatataaaatattataattttttgatatagaatatttacaggctgataatctggttgataaccaaaaaacagaattctatgaacataaagttgtttttttgtcagccaggtttacatgtagcgattgtgaaggcaaaatagaaaattgtgacatttgtgggccaggtggaattcggcaccacacttggtgtactgtaaacagagtaaatccagtttttgaatttttgaaatgggttctatcacttaaaaactatgagacctactgttatgctcattttgccggtaatatattttaatgtatctaatataaaaagatttttaaaggtcgatacgatacccattttatattaaggggtttaacggagttgggacacacaccagaattaataatttcagacttgaaaatttaccaaataaaaattgggcaaatctattttagagatttttggctaatggctcaaaataaattgtcacaccttccaaaaacgttcggtttagactgtacacctaaattgttttttcctcataaatacaattcagaaagaaattatggtaaattttttaattataattcttctataatttattttaggaaaattactcccgacccttccacctatggaagattattgccctgaaagcatgaaagatgacgaatttgaaagattcaaagaatggtaccaaaaaaacaaaaaaatcccctttttgttaggtactataaaataagcgaacttttgaaaaaatttaatttagaggaacaattacaaatttattgcggacaggatactgaaattttattaaaatcgatactgagtatgcgaaaaatttttattgaaataacaaaagactcggaaacccctaacggttatgatgtttttaaggtaatttacattttcagttatcatttatgccatattaaggacagtacgacaatcgcaggagcggcgataaaaatttacagggctaaatttttaaaggaaaaacacctagctatggtccctgagggagggtttgaaaaacataacacccaaagcatgattgcaataaaatactttgaatattatatgcataaacattgtgttaaagggagacacgcagctaacgggggggagattaatataggaggtcttagtaattaaaatcacaaaataattttaaaattaagagttcaaagttgattttatttgtgggaaattcaaaaccataatcgaattccaggttaataaatatattttatggaaaagaatgataattttagggatgtgcttttcacggtttgttatatcaaaatttttggtaaatatgtatattaaggatgtaaaaaatgtttcaaaccttttcaaattgggcccaatggtaaaactatggaagaaaattttgtaaggacaaaaaaccgaatgtttaaacttagaaaaatatgcaataattttggaatacgggtggaggaaatatgggtcagtacaaattaacgattttttgattaatatttcttaggaatgtgaggtcctacgaaagctcaatccacgtgataatgaaaattatgacatagaaatgaagaaatatttcgattctattcccgataagggtggggtaatcaaaacaaaaagcaatttagcaaatatttaggaccaatcgacccccgggatgcttttgcgggtgggcgaacgcaagcgttttgtttatattcaaagatttctgaaaacagtgaaataaatatagccgacatagtctcattatatccatcggtaatataacttaaaatctcttccaaattttaattctaggttaattatttcacaccgtacccggttaagacaccaaaaataataataccaaaatctcaagacgttctgtggcaatgtcccgaagacatcccttatgatggtattcataaccgtatgtaa

SEQ ID NO: 73498 - DNA, 473 bp, Heterodera glycines
  Genomic contig location: Contig_ID=SeqID_10318; Location=4015..4487; Strand=-
  SCN-specific regions: Sequence locations=1-293,316-437,459-473
atggcgccggttgcgccccagcattttgtcgccggaattggtcctggagcgccacagcattttgccgttgggatgcccccagccgcacccccaccacttgttgtgggaatggcgccgggggagcaccagcattttgcggtcggaatgccaccgatggcgccacagggagcaccgcgcccactcatgggtgaagtgaactacaggccattgagaggtgtttttgaagcgcatcgcgcccacccgcagcagcgtaacggtcgttggcctgtgcgtccgccaacccctggcggtgcgaaaaaatgtttaaaaaacactcatttttttcatttttagtggcactgagggacccgcgcctgaggcgtcgtcgtcaacttctcgaggtcgtcccagaggaagatgaacctgcggcgcacagatttcagaactgggaccacgacccaccacagccgccgccgccgggtgttggagcatga

SEQ ID NO: 73499 - DNA, 152 bp, Heterodera glycines
  Genomic contig location: Contig_ID=SeqID_10318; Location=4795..4946; Strand=-
  SCN-specific regions: Sequence locations=1-152
tgcctggcgccgtgattttatcggccaaaacgtagttgctgaatcacccgatgtcaaaattgagccgccggatgaggaattggtgcacgccgaccacccgatgccgggtaatcgtttaaaaatgttttaaattattaacgggcttaattaaa

SEQ ID NO: 73500 - DNA, 2761 bp, Heterodera glycines
  Genomic contig location: Contig_ID=SeqID_10320; Location=1193..3953; Strand=+
  SCN-specific regions: Sequence locations=1-289,312-371,427-509,531 -685,722-903,1000-1081,1173-1206,1228-1374,1427-1616,1679-1933,1963 -2302,2324-2562,2584-2692,2735-2761
  Gene Ontology: Mol. function=catalytic activity; Cellular component =brush border
atgatgttaattcaaaagttagccaagatccggcacagtggaaatccgtggcaacagcaacacgcggttatttgaaaatggggttgctccccgtccttcagggagagaaaattcggggatcggggcggacattccccgtcaaaaaatgccgggtatggcttgagaaatttcaaaaataccggagagcaacgctttttcgggaaggaaattttcataaaaaaatacgaattttatcgacgacattcgcaatcctccgaatcgggtcggggagcattcctaatttggggaaataatgtttaacatttaattcttttaataattgtttagttgcgaacttattccgatatcgtcatcttccttatttgtataggtaaaaaaagaaaaatatatataaaaatattttataaaatatttttaaaataaatactaaaaaggtaaaatctaagaatagaactaacttaaaaatattaataaagtttctcatcatatatttgccattttgaatgtaatttataatttgtcaatattctttatacagtctccatttccgcgcttcactgtacggtggtacggtaattcgaccactgttctttgaattcccatcggacaccaacacacacactttgaatttccaattcatgtggggcccagcaatggtcattgtgcctgtcgtgaatccggtgggatttatttttatttttattaattaaatttttttattcgagttggcatcgcctgtcaatagtaaaattaaaaggcccaaatttgaacccattttacataatgcattttatttaaagcttttttgcaatttaaatgcgataaaattaaaagaaaaatgataaatgaatgaaaaaatgagtcaaaagatgaacttattcaatatttagcttatgcaatcactaaaaaaatcaaaattattaaaaaatatatttcattttctgccaatattctaaaatgatttatttttatttcaagtaaattattattttttattatcacagtacatgaaaaatttgtattcaatttttttttgaatttaattagaaatttatattcttctggtttccaaataaattcgtatttatttgtaaaaaaatattttttttaaattaaattttttcttttatatatttttaaaattatatttaaattatttatttcttttttttccttttttaatggcttttaattaaaaattactctaaaaatttcatttttaagaatgttgattctgtccatggttatttgcctgtcaacgaaacttggtattcgatgagtgaagcacatgagtacagtgcgcgcattatgccaggattttcaacattcaaagcgccaagagacacgccgttgccaacctttttgaggggttggatatataaaaaaataatttatttttaaatgataaaatattttaaaatttttaggcggtcatattattccaagacaagagcccgatttgaccaccactgcttcacgcaaaaagccattccaacttctgatcgggttaagtaagtataaattcttccgataggtttaaacttctgaatgcactttggacatccaaatttttacatttttggtatcttccgatagctataagtattctcttatagaatataaaatttaaaattcaacaaatataaaaaattttatagttaaatttaaaaaaaaaattccttacgattttccgacattttcggcacccattcaaagcgccaattgcggcgcagacatttgaggcgtcctcctaattactgagcagaattaattggcctttaaattaaccgccttttattttcctttcaaaaaaaaggtgtcttttttcaacatttattattcgtgttataatttttttaaactattctattagataattctttgagatattgaaagtggcaagaatatgtaattttgtcgacagtcgctatggaaaaaaagaaataaaaaattaattaaattcagaatttaaataagaaatgaaaattggcatttcattccagagccacttgcttgcccgtgcaaattggtcgccgctggggaaatgttttgggatgacggcgaaacaattgtggacgatttcggcaaccattcgtactatcgttttgagtttagcaccaccgcaacgcacaattggacaacaattgttgtgaatcggacgcacaattcaagcgaagtaatttattaaaacgtgccaaattttgtggctttttcggttttattcttataggtgatttgggccaaattagtcactacagccaaaatttgtcacctctggctttaaatttttatttgttatttgtcaagtaaaattttaaaaatccaaggacccattgccaagcttggaccaaattgtcattcttggccacaattttacgcccaatttggacacggcaacattgaacggcatcccaatcaaactgtcggctgactttgtgccggaaaaaggtgctctccgagtggaaagtgccagactcatccgtctggacgatgccaacacggctgtatggacactcagctggcagaatggacacaaagatgatgatggcggacatgctgaaggcagtggtgccaaccgtgaattgtcatttatgatcgctatttatttggccgccacattcaccacggcattggcattaattggtcactggcagtaatggcatttctgatttagcagattaatacttctaagatttttttttattattatttatatgaaattgttttttattatcatttatgcaaaaaacggacgaagaaa

SEQ ID NO: 73501 - DNA, 1288 bp, Heterodera glycines
  Genomic contig location: Contig_ID=SeqID_10321; Location=218..1505; Strand=+
  SCN-specific regions: Sequence locations=1-65,89-400,423-627,664 -859,889-908,930-1288
atgccgaaaatgatgctgcaaaatgccgccgttgcctcggatttaaatgaagacaaaaatgacacaacaaaagcaaaacagcagcaagtgccacgcccgttcatcagcccggacctgcacttgaattacggcatcgcactttactacgcgtgggtatttttttcttggaatttatttataaaaaactaattatttgcaacaaaaaaaaaagatttctcgggggtgggaacgaagtgcatccttcaaattcactaaaaaattttgcgtctgttaggcatcgccggcaatttttttttttaatttttcaaacagaaggtttaaaaaaaagtcgatagaaaattttcagacttttttcacgcttaaaaaaaaattgtaatataagttaaaaaatcaaaaaacgtggttggttgggtgggggcgggggacgttcgaaactcgtcccattttttggcaaaaattttccgataccctttaaaaatgctgtatggtacatgtttcagtcaattttatgcaaaagcgttggcccagtttcgacgtgcgctggccattgagccccattttggacaggccaaacaccaattggacagtgcccgccaatttctgttcgccctgcgtgacggactgcacaaaaagggtaaaaattgtgaaaaatttaaaatttctcattcgaatttcccaagggacagactctgaaatttttatccccccccccccccaattttacaaaatttctaatttcggcgctataaaatttttttgcagttttattcaaaaaattttagcctaaaatgattaatttattaggaaatttttgtgtcatttttgaaaaagaattgtactcaaaaaaaaaatactttccaaaaaaaaaattattattttttattatttcacatgccattgaatgcgccaaattaattataattaattatgcctgacatttttttaaatgtggtacaattaagggaacatcgcaaagcgtcgcctgcgcactctcctcgacacattccctttaaaagcggcgactctgatggcggagcaacactttgtgatgcgtatgaagccggcacgggttgggttttcatagatttttttcaaaaaaaaaaattcgtaaaattgccagaccttggccatctgttcaacgcttgacgatttgattgccacctcttccaccgccaattacattggtctttcactgtctgcggttgcttccgccgcgcccgccattgtggcatcggtgaccgtccgttgtgtaggcgttgtgagcaatgaggaaaaaattccgaggcaa

SEQ ID NO: 73502 - DNA, 747 bp, Heterodera glycines
  Genomic contig location: Contig_ID=SeqID_10322; Location=103..849; Strand=+
  SCN-specific regions: Sequence locations=1-57,81-207,231-237,262 -397,459-493,543-747
atgaaggagtgcagcagaagcaaagatggaggaggagcaggagttgacaaaccagcagttgttgttgttgtttctgttgacggagacgacgtcgaagcgaaaagtgctgctgctgttgccaataaaaccgcggaaaatcaccaaaagaacgacgacgatgccgagcagtgtctgttgatgatccgtgtcatcaatccatcggtgaacaaattaataattaaaataaaaatggaaataatatatatatatatatatatatattgtctaaaatttttttgtgtttgtttccattggtttgtgagtgtctctcccaaacatggagaagttcaacccccccccccccgaaaaatttttttaaataagaaaaaccataaataatttagggtttacatactagaaaaaattttaattttttttttgattttgtttttattgcaatttaaataaataaataatttgaatttgttaaaatgtttgaaatacccagtttaacattataatataacaataaatttaatccaaatatttaaaaatgaatttttgttggagcgaatgggattaatgggcgccaccgctaattgactcccccgccccatctgatttaagcgccaactgctgaagaatgggaagccgctgagttcgttggactgcgcttttgcggcaatgtcaatcgaaacgcagcaaatgcaaatgggcagtcgcgcgagggccgaataaaatttcagaaaaaagaaaaatggcacaaaa

SEQ ID NO: 73503 - DNA, 351 bp, Heterodera glycines
  Genomic contig location: Contig_ID=SeqID_10324; Location=1557..1907; Strand=+
  SCN-specific regions: Sequence locations=1-351
atgcctccaaatgaaaattctgaccgtccctttcaacaacccgacaatgttcaaccaaatcaacaaccgcatcaacaacaaccagatgaagacaccgagttgcgtgcacaaattgaagacgcggaggaggatttgctcttgaattggtggcgtgaagacccaacaattgtaagctttttttttcaatttagcatagttttttttaatttcatcacatttttcagattcgttttctttttggacacagacgcgcccctgcaatcgaagctgcgcttcgtcaacgcgctgaacgtgaggccgagatcttgcgccaatatgccgagaatcagcaatgagaagtgaccgatcaaa

SEQ ID NO: 73504 - DNA, 564 bp, Heterodera glycines
  Genomic contig location: Contig_ID=SeqID_10325; Location=1059..1622; Strand=-
  SCN-specific regions: Sequence locations=1-306,328-370,393-564
atggttctcgtaagcgtattttgcggccagctgctcaaatgccctgtcaaattgttgcgagaccggctcaaccaccccgaggaccgggcgcttgtgctgaaacaccttattgggcgcaaagtgcgcaccacctacaatgaccgtaacgggctgaccaaaaccttcttcattgctgggatttcggcacaaggcgcagcgtttcttcccgcttatggccacttgcgcaacccgttcaacatcaatgtggcggcgcatttttacgcccgccacagaataaagcttcacctcccttatgtaccgtgcattgttgaacgcttttccgggggaggggaggaccgacactaccctatggagctgcttgagctgattgatgacaacatggacatcgacaacaacaattggttgggcaatcttttcaccgaaattgacaacaatgacaaacaatccgcttcaaactcatcgtcgcaccacacatcactgcgcctaatactggaggacgatgacatggacattgggcgtaatgagtgcagtcaagatgctgcaccatcatcatcctactggtga

SEQ ID NO: 73505 - DNA, 2635 bp, Heterodera glycines
  Genomic contig location: Contig_ID=SeqID_10326; Location=431..3065; Strand=-
  SCN-specific regions: Sequence locations=1-190,214-365,389-672,696 -1036,1058-1186,1208-1702,1731-1879,1902-2635
  Gene Ontology: Mol. function=GTPase activator activity; Biological process=signal transduction
atggccaaattgttatgcgaagaattgacggccgaacgtttctatcccatcgcttttccggggggaagtgagctgatcctccaattcgacgagcacgtgataagcaacacttacaaatttggtcagtccgtttatttaacactcaaaatagaatcactgatcaattagttgcccccctttcacaggtgcaatttaccaaaagtttgggcagaccaccgaggaggagctgttcagcaacgactcctccaactgcgcagccttcgacgaatttctctccatcatcggccaccgagttcagttgcgtcattttgacggttatcgtggcggactggacaccgttcatggacagacgggcaccgaggtacggtggggcagagtggggcgggcatacggtaccgtttgcttaatttcctttttcagtcggtgtacacacagtttcgccagaaggagatcatgtcagtttcaattaacaaataattagtattaaaaataggagagtgagaggaagccaataaatccattttattgtgtatttcaaccaaaaacttaattgtccctttaattcggacatcccattagcccaattagctcttccccggcttcttcaggttccatgtgtccacccttttgccgtttaccattggcgacgcgcaacaattgcagcgcaagcggcacattggcaacgacatcgtggccattgttttccaagagcagaacacacccttctgtccggacatgatcgcgagcaagtacaaaaaagggcaacattcagtgcctaatttaattattttctttttttctaaagctttctccacgcctatttggtggttcatcccattgagccgggcactgaccgcacgcgttaccgcgtgtcgatgacagcgcgagacgacgtgccgttctttggcccgacgcttccgcgctcttccataatttggaagtgccaactgcgcgactttttgctcaccaaactgatcaatgcggaaaacgcggcttataaggcggaaaaatttgccaaattggcggtattatggcaattttcattttctgaaaattaatcaaaagtttgttcaggaacgcactcgggcatcgctgctggatggactgtactcaaatttgaaagagcgggcccaattttacggcatggcatttttggattcggtggacagcgcgacgaaacagcagcaacaggagaagcaccaccaccaatggcaaaacaacgggcaaaaccatcaccagcacagccaacagcagcaactgatgaatggatcggtgaacggaggaacgaacccaatgggactgttccattcggtgaagaaagtattcagtgcgaggtgaggggcaggcagcaccacctgaccataatggacatcaattaggccgttaattagtcccattaatatgatcaccccaaaacaattcaacaaatcctcatgactttttgatggaacagtagactgatttagctaattggctaatgaatgcttgttcctattctttgaccttttcaatattcaaaggtcacgatcggtgtcacaagacgtgtcctcaaatggcactccgatgccatgtgccaatactttcaatgaaaaggtgccgcttggctgtcgtctgtccggtacgttgtgctccaccagcagctcgtccggctcctcctctcagtttggcacgccgccaatggccgacgcaatgcaacagcagagaagagcattgaccagagagagagggggttggccaatttgccattgatcagactgatcagccgatcactcattccccagcaggtcgaattatgtctttggtggcaccgatggaggactgtcgcctgtcctcttccgcctccacttcctcttcatccggacatcattttgacagaccatccgcagttgctcatccgtcccaaatgccatcacataattatcaccagcatcatcatcttttgagatggcgttcaaatgcgggaaaaatggcaaagacagcagcggaaaggaagtgagaagacgaggggggaaggagcagtactggacgaatcaattctgattacgggaaccttattatgtgtacaacccattgtataagtggctttaataactccgtcctaattactatcgcttaatgggggcttttaactaagagggaaatgcgggaatttgcagtataaaagttattttggatggtttccgtccatcatcatccacattcagcagcacttccgccatgttggaagcgtcgttcggctgcatcgaccagcacaaccatcaccaccgctccacgccctcttccccttacgccgcccaccaccaattgcctccgggcactgtcattccgtttcggtcgagcattcagcacctgaggcattggcacggaggaagcgatgccgaggatgatgacgacttggacgatgtggagatagaggtggaggaggtgctaaacgaagcggacgacgcactcagaggaggcgccggaggggggcacgactcggacaccggcatggagagcatgtcatcggccgacatccaaccgaacggcgcaccatcggttggccgacgatgtctcaacaacggcgcaggggacgcaaaaaatgggaaaaatgccgcaggggcactccaaaagcgcgagagaatagcaaagaaaa

SEQ ID NO: 73506 - DNA, 1584 bp, Heterodera glycines
  Genomic contig location: Contig_ID=SeqID_10327; Location=133..1716; Strand=-
  SCN-specific regions: Sequence locations=1-347,371-550,572-682,713 -966,988-999,1021-1088,1135-1155,1190-1402,1424-1584
atggccgtctccgtcgaattggtccgactccgtcgcatttccgaattgccctccgatttgggcggtgttcgattggttccgtcgcaacgactttctgtgcgacctctcacaatgttttctgaggagacaaagagatgggaggccgaaattggcgaacagtgccctccgcaacagcgacgttcggttgttgccaaaacggtgccactttcgcatgtgccatgccaatgcgctttgcctccgtcgtgtcccaccactgccgtccctccccttccgtccattcttcgacggcgcgttgccgtgccataccatcgaatggcaaaagaagagacaaaaattataaatgggggaaaagagacaaaaaagacaaattgggagaacattcaatcaaacgaagcgacaacagagacaaaggcaacagcagaaaaatgtgagaaaggagaaggagagaaacggcaccaaagggaagaacagcgaaatgtgccgaattgtcagcagttgtgctcgtgggaggaattcgaagaacgagtgcaagcggtcagactgaggccgaggggacggcggacgagcggcacaaactgttggggggcaacggggggagcgaccggcaacggatgccctggggccatcgaacggaagcgacagcacgaaaaggcacatggggaagacggaaggaccacaaatggaagaaaaatgggagacagagaagggagggaagcgcaaaacgaagtgctaaaacagcaaaaatgttggaagtgccaccagatggggcgaaaatgtgtgaattgcattttgacgattggcactggcgatcagcagcagcagcgactaatcaaccaaattggtcggagaatgccgatgagtgacacggaggaccatttggcagagacaaacgcggcaaaaagggaggagagcaaaaagcgacggagacactccgtcctgtcaattaagcctattttgcgcaaattgaccagcacggccagcaccagcggaaatgcggacgcagcagcaacaattacagcaacagaaccaacaacagcacgacgaaggtcattcttccggaagaatgccggagataaaagtcattcgccagaagcccagcggaggaagaacaaagaaggacaacaggccgaggggggacgggccccacttccttggtcatcatcatcatcatcatcgtcgtcgtcattattagcctcattagcgcagtgggcggactcatcgccccttaatgaacacactttacacccaacctcttcattaccgattgaccaacagcgtccaccgaggatgaaatcccttctcggccgactgttaagacgcaaccgtcgccaaaagcaaacggatgacgaggcgaatggagtcggaatcggcacgagcgaaacggaaccgaaacaacggaaccaacagcagcagcagctgacccgacctgagtcaccggcgagatcaagcagttcaaaggcggaatttgttgaatggcagtcaaaatacttgcgattgtcatggatggcgccgaaagggacgaaaaacaacgacagttatcaccggtacaaatgtgatcaattgggggcatcgacggaagaaaaa

SEQ ID NO: 73507 - DNA, 81 bp, Heterodera glycines
  Genomic contig location: Contig_ID=SeqID_1427; Location=154..234; Strand=-
  SCN-specific regions: Sequence locations=1-45,67-81
atggacaataaatgggaggggagcagtgatattttgtatacactcaaaagtaatataaaaacaaaggaaaatggaaaacaa

SEQ ID NO: 73508 - DNA, 1392 bp, Heterodera glycines
  Genomic contig location: Contig_ID=SeqID_1427; Location=379..1770; Strand=+
  SCN-specific regions: Sequence locations=1-321,488-533,555-584,606 -639,661-803,826-979,1001-1269,1291-1392
atggcccctttgaatgcgattccctccggtgacgcgtcgccgtcgcattccgccggcccagcggcgaatcatttggcacatgcgacaaatgaccggcggaggaggaggacaaacgcgagaaggacgcagaggaaatttttggtgtacccatctgaccaactcaaaatgttgaacaatggcacggaaagaggagcgaaggatggcaaaacgaacaaaaatggcacatgggggaggacaaaccacgacagggaggaggacggaattgggaagaacggactgatgaggactgaagcggacggggcggagaacagctggacgagagaaacggagagaaatggaattagcagaattggatttgaccggaccgaaatgaacggactgaggacgaaactgaacgggacagaacagaacggaacaaagactgaatcggacggaatgtcatttaatgggaagaggacggaacaaaacagaagggaaatgaacggaagaagaagcgaattggaagaattgatgacgaatgggacaggcaaattgggaggacaagaaaagaggcacggaaacggggcggaggagaaacaattttgggggatgaggatgaagacgaagtgggaagatgaggaggagcagcggaacggcatcaacaatgccatcaatggaattgacgaagtgtcgacggacggacagagcacggcacagaccgagacggagatgaagcagaacggcacggggtggggaccgcacagcgtaacggacggactgctgacggaagaggacgccgtcgagtcgggttggacgagctgaatttgacagatttgttgaaaaaggccaaagtttaagcgaccggtggtcaatcctcacaacttcttctcaacggacagcaatcacaacactttggccatgtcgctaaactgcacagtttttgggaagaaatgccaatttcatcgtcgtcacttttgtgcatggacgaggagcaggagacggaacagaaacagcagcaacaccaccgacgaccgaccactttgtcacctcgcgcagtccttgcggcgcacttgccaaaaacggtgccaaagtcaaacgattacgaggaagaaagccacgcgatcaaacgccagcggtgcactctccgggaacaattagtgggagtgccgtcggtggcggcgccgtgggaggcgatcgcagccgaaaggttgggcacccgcagatcaaaagtgatcatgctgggtgactcaggtgagcgatggaaagaaaatcagcagcgaatggatgactttccaatgttaaaggtgttggcaagacgagcattgtgttcagccacaaatacgggccgaaccccgcgctgctcaattcgccgtccaatgcgaccatcggcgcttcttacaccaattttgacat

SEQ ID NO: 73509 - DNA, 172 bp, Heterodera glycines
  Genomic contig location: Contig_ID=SeqID_1428; Location=352..523; Strand=+
  SCN-specific regions: Sequence locations=1-172
tttggattttggcacagaagtcctgcgttgtcccactgccctcgaagagccgatatttgtgctgatcggcaacaaggcggaccagcaggacgagaaccgcgaagtggccgaaggggagggcgtccaaaagggtgggcacttggccaatgattggtgtgatcaatggcaataa

SEQ ID NO: 73510 - DNA, 240 bp, Heterodera glycines
  Genomic contig location: Contig_ID=SeqID_1429; Location=1646..1885; Strand=+
  SCN-specific regions: Sequence locations=1-168,192-240
atgaaatcaccaaaatggaaaaataacaccgcacaaacggtcgaggccaatggcaatttgaagcgcaacggtaaaagcggagccaatgatgggaagaagctgaatggagaggcaaaagcggagggaaacgtagttgaagccgaagaggaagatgaagaatttgaaggtgaagccgagcagcaggaaggaggcggagaaggcgtacagagcgatcagaacattgcaatgggaatggagtga

SEQ ID NO: 73511 - DNA, 996 bp, Heterodera glycines
  Genomic contig location: Contig_ID=SeqID_1429; Location=2075..3070; Strand=-
  SCN-specific regions: Sequence locations=1-109,131-143,165-270,318-996
atggcacagcaaatgggcgaggcgacaaattcgttggcattggcaccgagcaaaggggcgacgaagccaatgaaaaggacatacgcattaattacaaaagaaacaaaatgcaattggcacattttaatgacatttaataggggcaaatggacaagttacaggtaaaattcacaaatcaattcaattaccaattatttgaattgagaaatcgcaacattaaaattaatatttttgcccatcatcagatgtcagatgaaaaagacccggtagaattaattgttttttaaattttatttactttattttattttaattttcagttttatgcgctttacaatggcgccggttttgtgccgggagaagtggccataaatgggtttattgcgttgatttgcttcgtgggaatggcactgaatgcttcattagttcatgttagcatcaaaacaaagtgagtaatcgagaataacatggcaaagactgaggggagtgccaaagaccgaaaatgacttggaaaatactgtcaagcggtgccaatgatcaagaataatgtgattcagcaatcatttttcgaaaaataatccaataagttccatttttgggtaaaaattacggaaaatgactttgcaagatcgggaagtgccaaagaccgagaggggttggccaagagaggggcaatgatcgggaatgagatgatcaagactgatgagaaagcgtttgtcaagaccgatctaaaggatttatcaagagcagaccgaccagagttgatcagtctgtcgtgcatagagcagggctggacataagagatttcagttaccgaaatccgtaattaagggctccaaaaaagccgtattttccctaatccatataatttcatgttttgactattttttgtcaattttttggaaccaagatgcaaatcagcaaatctcacgcccaatattttggggcatcggaatttcgggtcggctcggagttcggactatggtttttaataaa

SEQ ID NO: 73512 - DNA, 362 bp, Heterodera glycines
  Genomic contig location: Contig_ID=SeqID_1431; Location=5518..5879; Strand=+
  SCN-specific regions: Sequence locations=1-126,148-362
atgagcagagagaagggacagtttgagaagggctatttgccaaattatggcgacgaaatattggaggttgacgaggtgctgaaagcgattcgccccgttcggtacaagctacgggatgagcgcggagagaaattcaagggcagcttctatgagcaggagttggcgcgtgtaagaaaggatgcagagacaagctaccgtattgaaaaggtgtacagaaagagaaagagggcggatgggtccactgagatgcttgtcaagttcataggataccccgagcgcgaatgggttcacgaatcacaatttgttgtataaaagccccacccatataacaacatatcacattttcataaattttacgtgaa

SEQ ID NO: 73513 - DNA, 2026 bp, Heterodera glycines
  Genomic contig location: Contig_ID=SeqID_1431; Location=1..2026; Strand=+
  SCN-specific regions: Sequence locations=1-1264,1286-1338,1360 -1599,1621-2026
  Gene Ontology: Mol. function=insulin-like growth factor binding; Cellular component=soluble fraction; Biological process=signal transduction
cggcaatttgctgcgggggccgagggcactcaaagaattgcaattggacggcaatcggctgtcagcgggacaactgaaccaactgctggccgaggttggcacactgaaaaggctcgaggcgaaccattgcgggctaaacgatgccgaagtgttggcactgaatttgagcaaagtgccgcaattggaacgcattggactggcggggaataatctcagcgaagtgccgagcagcacactgaggcaagcagaaacagaaaggcgcaattagcggtgctaattgggcaaaattggccattttggaatttgaaggaacactttttgtcgaaataagcacagttcagggcacttgcgctgctccgtaccgtcgatttgtcccacaatttgctccgttcccttggcccctgcgccttttgcggctccaacatttcccgcgtgtttctctcccacaatttgctgggcattggcggcgatttgcgccccattcaccgcgaagcgttcgcagagacgcgcattttggagttggacctgtcgttcaaccaattggacgctgtgcgcttcagctccgaaatgctgcaggatgcgcaagagtcgctggaagtgttgcacatcagcggaaatggccgtgtggcgttggacgcgccgcaactcatcggaaccctcccgcgcctgcgggcactgcacgtggcggacagtgcgctgggtacagtgccctacagtctgccgaaggcgtacggtcagctgacgctgctgaatctgtctgggaacggattggaccatttgccacccaacctgggctcaatgctgcctcatttgcaagtgattgatttgtcgcgcaatcatttcaggtaaatggtatttggccggaaattttcgtgccgtttgccagttcaattctatgctttcagcagttttccccactctttggtcactttcattcatcggctgagaatggtctttttgcacaatgtaaaaaatacatttaaaaaatcgtttaaaatttggttaattatgcattaattaattaattgcccatttcgccgttcgttcagtgcccttgggattgccaatgcgctgctcaaccactccaattgcacatgctccgccgattggaccacaaggaaatgttgcgatatgacgagacactttgtgctgagccgccaatgctccggggacagccattgcatcgcgtgcaaaagatcaacgactgtgccattctgttcggggccaactacggcatcagtcaggtcgggaaaacgaaaaagcattttttgtgggagggagggaatgttcatttgagcaatgctttacctttccccctctttggcactttcttcagtttttctcactttttcttctgattttgcttaattttcgcctttctcagaacactgaactgttgctgatcctcggtgcccttctgctcgccgcacttttcctttctgcctttttggctttgctgctttattttggccgagaaagcacacaaaagggcacttatgtgacgggcgaaggcgtgggggaggaggacggaaagagggcacggctaattggggggatgagcaaaagcatgacgatgaccagcagcggaagcaacggaacggcaggcggagggggcggaggaagagcaatgatcgatttgggtgggaaagcgatcactgatcagattggagtgacttaatgatgggccaattcgtcctttaaagatgcgatggcaatgaacggaagtgccattggcgggagagagtgccggcaaaaaagcgccgactgtgagtcgcctctgctgctcagcaacagtttggagcagctgcagcaacggagcagaacgaacagacaaaacggcacgccagcgacaacggcgacgacagcaaagagttctttggccgcattggccgtccaaaacctgcatttcgccgcgtcaacagcgccgcttttcgccccgtccgcgtctttggccacggatcgcctgaaggagccgcttttgctgcccaattcgccactttcgtatagctcaagcaacaccggcagc

SEQ ID NO: 73514 - DNA, 402 bp, Heterodera glycines
  Genomic contig location: Contig_ID=SeqID_10329; Location=223..624; Strand=-
  SCN-specific regions: Sequence locations=1-117,139-197,221-402
atgcgcgaaaaactcatttttagcccagacattctcattttaatagtattgttcgtaattaggaatcattaattatttttagagatcgacattttgaaaaaagcctggacctggattccatgttggacctggacctggatttcctggacaaaaatctaggaaaatccaggtccaggaaaaatccaggctcctcgagacctggatccaggcatggacctggattttttaaaatttgttttaaaaaacaaacaaatgcttgaaaaaatcaattaattgcttgggaacgtctaaaaatatctaatttataataagaatgtattttaaaaccaatttaagcattttttgaaaacttgaaaaaacatcggtcagttgaaataatagatttaatcacaccaaaataaa

SEQ ID NO: 73515 - DNA, 1841 bp, Heterodera glycines
  Genomic contig location: Contig_ID=SeqID_10330; Location=548..2388; Strand=-
  SCN-specific regions: Sequence locations=1-509,531-611,633-1043,1066 -1796,1824-1841
acgaatcgaaatttgtcgcaagaacagtgttactgcggcggaggcggcaccagaattatcggtgtttatcgacgctgccaattctatgccatttccattgcccgaccgtccgttgcccagcaaaattcgttttaagcgccttcgagttgagtaattaaaaatcagtgctatcgcaataaaagcattcattcattccattttcacagttacattgatcactccgtcatcgcttttcttcgttcaaatcacaaaattttcgacaaaagtggcaccaagttgcgtatggggatgctttactcagatatggcggatgaccggcagccgatttgggacgtttttgttcgtgaaatatggccaatttttgcatcaaacattcgccacttggactttatcgatgctgatcatttggacaatttgcgtcgtcgcacttcgcccacaattctcactgatctcaatcagttgagttcaatcgattccgttctattgctgcccgatgcaattggtgatgattttgatgggccaaatgcaactgctggccaagcgttgaacaaatggttgcactctccgagaaaagatggccaacccaagcgattccgtttcattgatattaatgaacaagtgagcctccatttggtcaacactttcaaggaggtgcggccccacattttcggcaaatcgctgatttttggaattgtttaggaatttatgcgtgccaccaccatttcttccgtcagctacgaaattcatttttctgttcatgtgccgacaatgactattgtgccgtttgaattggtgaacgaacgaacgcaagaaaagctgacattggccaaagcaaatgaattggacaacatttggataatgaaacgatgcaaaattggggaggccgcggcggttcagcagcagaagaaagatgaaaattggaactatgtgtacttttggctttatagtggaaccaattgcatcgggtaagcaattaaataagggatttcattttttaaataattcaaattgcgcttaaggccattgtctccgccaccaccagcaaaagaagaagataaagcgagataattcattagtgttaaattaacgaagaaaacactcaaatatgatgatcagagaccggacttttaggcacgcaaatttctcaaataggcacgaaaaatgtgaaaaaaggcataaaaaatgaacaaaagcgtcaaaaaaggcacgaaaaattggcagcaaaaatcaacatttttgtagcaaaaaattttccaacagaccttttttttttttgcttaaccggagcgaaaaaaaagaatttttagctccgaaaaaatgacaaattttttggcgtccggcggtgccgataggcgccgctgggaaaaatattttttggaaattgtaaaagaaaaattgcaaaaagttatctatttttgttccaaaaatcctgaaaaaggcatgaaaaaggcaccaaaattatgtggcgggcataaggcaccaaaatcgcaaaaaaggcacaaaaaagttcaagctagaagcttcaaaccaagttaaaaactcgtttttcgtgcgtattaggccatagcaagttagcaaaaaaagcatatgcctcaaaatccggtctctaatgatgatgcagaatttattttagaaaataagacccagttgtgtaagtagtacagacagggctgccaagttttttttcaaaataaggacaaacgaggctaaaacgaagattttgacaccaaaaataagattttcagaaagcggctttttacagagtagaaacagttaaaaaagcattatcaaccgatgaaagtgagaaagaaagggaaggaagatccacatttggattggtg

SEQ ID NO: 73516 - DNA, 1176 bp, Heterodera glycines
  Genomic contig location: Contig_ID=SeqID_10333; Location=365..1540; Strand=+
  SCN-specific regions: Sequence locations=1-49,120-162,196-318,403 -441,464-468,515-797,819-929,951-1034,1065-1176
atggaaacagttggacttacaagtacccgaacatatggattcagtcagcatgaaaaaaaaactaaatttatacaaagtaagtaaaggaaaattcataaataaagaaataaattaataaaattaaaattgtacaacgaaccataaaaagcttaaaagcgactgaattatttaaatattaaaataaaataaaaaatacatgaggccaacaacttccttgacaaagcatatggtacacaatcagcagaagataacaagaatgaaattaaaatcatcaatgaatttaaatacccaaaacacacaatccataaataagaaatgatattaaaaaataataataatatacaaaatcgtggaatttaatcaaaaaaaaaataatttaataaaatgattattaataaaaatgaggtaatttgaaaaatctaaaaagcgcataaactgaagttaatggaaaaattttacaattttgtctttttattttaagagaattaaattaaataaaatttttgatttattagaatctatttatgacctaatggaatttgttttagtttcgaaccccgagactcgagaccgagacccaaaaccccgagaccgagaccaaaaaaacccgagacccgagacttttttcaaaaattttttcttacacacttaaaaattgaaaaaatcaattttttgaggttttttctcaaaaatttttgcttttttcattatttaatctaccatacatttttccttttcatatgattgacttttttacaccattttttgtggtgctctttttcaaaagaatttttcgggaacaggggtccggcggtgccgataggcgccgccgggaaaatttcttttaattttactgcaatttgttaacggattttgtccaaaaatgaccagattttgcgactttgagctactttttttaaataaaagtaagggtaaaattttaaatttttagtgcatttgagaatcccatgtagaacaagagcctatagaacaataaaagttggtacttgtctgttatctgtgtccagattttcaaattttttttttgaaaataaattttttttccgaaaattggcccaaatttgctgtaaatgaaaaattcttttttagaagattctttttttggcgattaattattttgagcatgtattagagaaaagcggattctaataatta

SEQ ID NO: 73517 - DNA, 2722 bp, Heterodera glycines
  Genomic contig location: Contig_ID=SeqID_10334; Location=1238..3959; Strand=-
  SCN-specific regions: Sequence locations=1-290,313-456,482-767,799 -1804,1826-2194,2216-2628,2651-2722
  Gene Ontology: Mol. function=anion exchanger activity; Cellular component=integral to plasma membrane; Biological process=anion transport
tccattgtttagcgtcgttttcatgttcttcgcctgtttcgtgccggccatttccttcggcggactgatgggcaaatacaccaacgagcacatcggcaccatcgaggcgctgtttgcccagtgcatttgcggcatcatttggggccttttctcggcacagccgttgatgatcagtgggtgaattggcccaataaatatgccttgtgtaactcattccttttgctttcaaagtgagtgccactgggcccgtgctcattttcgaaggcagtctttacacagtgagtgttttccccccaagtgattttgatatgaacggtccaaaagcttttaaccgtttttaaaatattctatcaaaaaatggtttagggatttttttgccattttaaacaatttttgggtcaaattttgaaaattttataggaatattgggtccgggcggtgccgataggtgccgccgtgggaaattttgagattttttgtcgaaatttcctaatagaatgttatacattttcaattcatcccttaattcactctccgtttttgtcccacagttttgcgaaactctgcagttggacttcctcaccattcgcttctacgccggtctcttcattatgctcatcgccatttgcatcgctgcggtggacggctcgcggctgttggtgtttgtgacgcgattcaccgaggacattttcgccggtttgatctcggccattttcattgcggaaagtctgcatttcatttggcacgtacgttattatttgcagaaaaatggatttttcattttaatttacttaatttattgtttgtactcctccgttcagacgttcaaagagaatccggtggaggattacagtttctacgagaagatccacgtgaactgtcgtcgtcacgtgcacaatcagtcggccgagcagcagccaaacaccgttccattgctttcgcttccgtttgatgttgaaggcattggcaattcaacacggaatcgaacggcggacgccgactcgagcagacgattggtcaacgcactcgccgagataaaagacccaatgggcgtccaccgtttcccctgcggggaggcggagccgaacacggcactgctcaccgccatcatcgtgttctccacgttcattttggcactgctgctgaagaaactgcgcgagagtttctacttgggcagacacgtgagcaaaaggcagagacattatttgataaaatacaaatgtatttaatagctgagaagggccatcggcgactttggcgtgctcatttccattagcgtcgtcactctcatcggtcggtctccccccctcacaattcttcaccatttcgcccattcattcagtccattggctcgtccccgacccgtacctgcaaaggctggacatgcctgaccacatcaactttacaaacccaacaagtgggttcaactcacaattatatttttcgatttcggtattaaatgctttttcagggcgaggccacggacttatcgtcacgccgactttgcccttttccgattggcatggcattgtcgtgtcgtttatcgccgctctgttggtgttcatccttttgtttgtggagaccgaaatcactgagtgagtgccttttttgtgtgtttaacctgaaaccgaaactgttcccctttctccgctttttaggcttctcctcagtcgcaaggagcgcggctgtaaaaagggcggtgggatgcattgggacctcgttctgatgggcatttgcgcctttctctgctccgtatgtaattgtttcgacctgtactcctttcccttgtccatttttgtgtatgtttcccttgtatttgaaggtgttcggtttgccgtggatgtgcgcagccgctgttcagtcattggctcactgttcatctttgacagtgatgaaaaagacggctcccggggcacgcccaggtgacacaattcaataatttcagtttaataaattcactttccgccaaattcttctccaacccctcccttcccccgttgatcattgtcagaagttgactgtgtcatcgagcaacggatcaccaccatcggagttgccctgctgatcggactgatcgccttcggcggcagttacctgcgccttccgctcgcttcactcttcggcgtgttcctttacttgggagtcatgaatttgtgcggcgtgcagctaatccaacgggtcgttctgttcttcatccccgagaagtacttccccgtcacaccgtacactgaacaggttagtgggtcgggtcgatcaaagtgtgatcaaaccggacaaatgatcaattagatgagcatttggaggatgcacctctacacgtggattcaactcatttgtgtgttcattgtgtacacggcaagtgtttgtccaggaaaagcgaaaatgaatgctcgtgtgtttattttgcaggtcaaatacttcaaaaagactgcgctggcttttcccttgtaggcactctttgctttttgttttttttcattttttaatccggttttaagtgttctgatgctgttcatcttcttccgacagatcattctgcccagaatcttcacggcaaaagagttgcaggcggtaagttctaaagggcctttcggttcaaactaaacagcgggacaattagggctttttgatgcccgcattttcttagatcgacggagatgaccattctgacactgacgaatggacttcacgggattactttgacaatccgccaataacagtt

SEQ ID NO: 73518 - DNA, 1421 bp, Heterodera glycines
  Genomic contig location: Contig_ID=SeqID_10334; Location=3704..5124; Strand=+
  SCN-specific regions: Sequence locations=1-509,543-782,804-931,957 -1421
atgagcacgggcccagtggcactcactttgaaagcaaaaggaatgagttacacaaggcatatttattgggccaattcacccactgatcatcaacggctgtgccgagaaaaggccccaaatgatgccgcaaatgcactgggcaaacagcgcctcgatggtgccgatgtgctcgttggtgtatttgcccatcagtccgccgaaggaaatggccggcacgaaacaggcgaagaacatgaaaacgacgctaaacaatggaaggaggaaccggtcagatccaagccatcgagtaaatggtggtcaattttcaaaactcccctcgtgagacattggaaattggcggcgtcacgaatgtcggacctgaaaacggaggagtatgccattacttatgagtcagttatccaaaattggccctaagttcttaattatgtcacactaatcgagtcaattactccaaatgggcccataattataattatgccttactaattgagccaagtagcccaaatgagccaaccattccctttccaaaatttgttttcccaactgaccaataaaaaggaagtcggttaacaaagtcagcttggagtcctttgaacagcggaaagcgtcgcttccgtttcgtccgttgcgcacttttcgtcccttcttttgtccaattttgttgcgtctgtttctgttcctcgccccctccctctttttgccattgtttttgctgttcctcttggccattgtcctcattttcgtccccatttgctgctaaatgcccttgttgtttctgctgattgttgttgttgttttggtaatgccgacttcccccgtcttcggccgtcgttttcaaattgcctccgtccgtttcgacttcgccgtcgtatcgatgccattcagcgtcaattgctgggaggtggggacccttctcccaactgcgacgaaaggtccttttctttctctctcttctgacattcgatttatcactccgatggaggaagagaaaattattggggatcaatttgcaaatcccttcacaattgacggggattaaaatgagtcaccgttcaattgaaaattaaacattttgcttacatttccttaaagttccaacatttcagttaagcggaacatcgcgccaagcggcaatgagtgccgcctcagtgcatgagcacagattcggggaggagacgcgtgacgacaaaagcggggaatactgcaaatgttgcacaatgtgtggatacgaaatgcgatacgaaaaaatgtgaaaaatgaccccgaaacttattcgcacttcggcgctatatgaaaagtggtctttttgaaaattttttcacttttttggtcaaaattttttgtttaaaaatcgtgaatatactttttattcaccataattgtgctattaatacttaatattcatcattatgtgtaaaaaa

SEQ ID NO: 73519 - DNA, 230 bp, Heterodera glycines
  Genomic contig location: Contig_ID=SeqID_10334; Location=293..522; Strand=-
  SCN-specific regions: Sequence locations=1-230
gtatttcagctaaacaggataattttgagagtatttctatttgctttcgcattcgccccctaaatgattttagtgagtttcgagtcataatattttacaactaaaaatggacgtggataggctctcccggggaaaaaataaataaaaaggaaataaacagtctgtttacagttacctcctcgtcaacgacgtcctcacttcttacattgtctaaaaaattgacccctttt

SEQ ID NO: 73520 - DNA, 1201 bp, Heterodera glycines
  Genomic contig location: Contig_ID=SeqID_10336; Location=1147..2347; Strand=-
  SCN-specific regions: Sequence locations=1-354,377-400,422-711,735 -741,763-782,804-1201
  Gene Ontology: Cellular component=Golgi trans face; Biological process=vesicle-mediated transport
atgtcaaacgatgtgaaggccaaggttgttcattgtcagcggattacccttttaagtacaatttactattttaggagaacaaatttcgcactgagattaaggttagaccctaccgtaataggaaaaaagtattaatttcaacttttaggaactcaaaacagagaaaaacgaattcgaaaagaatttgaaaaatgcgacggccgaaatggaaactttgcgctttgaaacggacaaaattatgaaggaaaagaaggaacaaaatgaccgccatttgattttcgaacagactgtacggcaaaaattggtggagaccgttcaggttgaaatggaaatttacaataaaatatcgaaatattttttgcccttatttccaaaatatttttaactttgtccataatttagctgaaagaagaaaacaaaaagctcgtggaaatgcttgaacagaccaacgccaaattcgcccaaactgaccatcaatttacacaaaaactcggaatgataaaccacgaattgatcaaagcgcgagaagagtgcgccaaacacaaaaattatacggacgcagtgactgcggaagcaatgaaaacgaagcaggaaacggaggaagcactgcgcaaagcgcacattaattttgaaggcactttgaaagcgcttcaagcggaactgaacgtttgtaattaacagaaaattaggcggagagggttaattaaggggtaattaaataataataatatttagaaggaaagggagcaacgaaaggcgcaggataaagagtgccaaatggcaaaaaacatggtggaccaaatgatgtcggacgtgtccaactcgcagaatcagcttaaggacgcgatggtatccaagtctgcgtacgacgacagaattcagacattgcaaaacgaattaaacgtaatttacgaacaattagtatcgtaaaatgacagacaattaacccattcagcgggaaaaggaccatcacatgaaagtgatggtgaacgcgcagaagcaagtcggagagttgagccaagagttggagaaagcattggtggcttatggcaatttggcaaaacagcagagcaatgacagcgcaaaatgtgtggaactgaacgcacggaaccaaaagatgggcgaggaaatcaggcagaaacattcatttgggacaacggcacaatgccttggatttgggatcatttggactgcgaattaa

SEQ ID NO: 73521 - DNA, 782 bp, Heterodera glycines
  Genomic contig location: Contig_ID=SeqID_10339; Location=1454..2235; Strand=+
  SCN-specific regions: Sequence locations=1-185,207-376,398-483,523 -644,666-782
atggggactcaggaacaaatgatgcgcgaaataaatatcggaggtttttaataaaaatagggtttcatgaagttcaaaaataaatagggccgcaaacgattgttgattggcgtaatttttttcgggacatatgcaccgaatttttcattaaccaccgtgaacgcatcggtggccaaggtttttttgtcgttgtcgtcgtcgtcatcgttatacatatagtagtttgtcttctcgtaggcatcgtcgttgaaattgacgagacgctcgcagtgaaacgcaaatatgagcgtggcagactcgttgtcaacgacgtttggatttaggcattttccaactccaattactttcctcccactttttgttcactttccgtcgtcttttccgttttgccatttgatctgatcagccaattgacaatatttcacagaacccaattcactttttgatcagagatggcgggctgatcagatgacgggtgaatagttttaaaaatttcataaaaattcttaaaattttcagcttcatctgcggcgactgttgccttttggtgttcggttttcttgcgccttctcagctcggcatcgaaattgcatttgatcagccgccgctttgaccacatcgtcgatgaacatttcaaaatatgcaaaaatggaattgaacaacaaattgctaattcaataggacatttgaagaaaatggcaccaaccaaatgcaaattgccaattccgcaaaatccgttgcccaacaaattcatcggattcggtggcgttcagatcatgtaa

SEQ ID NO: 73522 - DNA, 1303 bp, Heterodera glycines
  misc_feature (1284)..(1284): n is a, c, g, or t
  Genomic contig location: Contig_ID=SeqID_10340; Location=71..1373; Strand=-
  SCN-specific regions: Sequence locations=1-292,320-1124,1147-1303
atggcattgctttccgaccgtttcgatgttttggttgacacgcattttgatggaaaaagcgaattgacaatttggaaagcaatcgcaattcgcaaggacaaaggaccaaaagcgaaactgtctgaatggatcgatggcaaaagggtggaatttccattgccggaccgtccgctgcccaccaaaattcgctttaagagcctttggattaggtaaatcaaaaactatacagaaaaccaatcttcattttttcactttatcagctacattgaccattctgtgctcacatttctccgttccaacaagccaatttgggacagaagtggcatcaaattggaattgtctatatggtcaaacaaaactgaggatgatcagcgaatttgggatgtttttacccgcgaaatttggccactttttgcaacaaacattcggcatttgagctttcataatgccgatgctttggacaatttgcgtcgtcgcatttcacagacaattctcactgatcttgatcaattgatttcaattgattctggtgctctgttacgcgaaggaattgctgacgatggacccaatgcaactgctggccaagcgttgtccaaatggttgcacactccgacaaaaaatggccaaccgaagcaattgtatcgctataattattttgatccacggaatcccgaatgggtcaacgacttcaaagaggtggaccgccatattttcgttttattttaccaattttctttagacattccgtcgtgccaccacttctgtcagttaccatattcaattttatcttcgtgtggaaccaatgccaattgaaccatttgaattggtgaacgaagtgacaaatgagaagctgacattgaaacagagcaaagaatacaatttggttaattggctgttgcaacggtacccaattggggagacggcgccagttaagtggaaaatccgcgaaaatttgggtgccaatttatctatatcagttttgagctgtggcatgccaattattcgggtgccaatttgaacaatatccggtttgagttgttgcgtgtaactagttgcattgggtgagaagcaacagcaatttttgattgtcaaattaattaattttaggccattatcgccgccagcggaagaaaatgaagaagaagcggatcaaagcaatgaaaaataattataatttgagaaatgatcgatctcgccaataggaagctgatttgatgctctcgttttctcaaatgcttttgttgatttcttcattcgattaaaacatacattttatatcaattngaaactactaattaataaa

SEQ ID NO: 73523 - DNA, 2107 bp, Heterodera glycines
  Genomic contig location: Contig_ID=SeqID_10343; Location=1025..3131; Strand=+
  SCN-specific regions: Sequence locations=1-57,84-114,141-165,187 -195,219-515,548-552,574-790,837-872,903-1026,1048-1182,1211 -1282,1307-1426,1461-1573,1818-1818,1840-2074,2096-2107
  Gene Ontology: Mol. function=calmodulin binding; Cellular component =calcineurin complex; Biological process=signal transduction
ctggacagattcaaagagccgcccgcatttgggcccatgtgcgatttgctgtggtccgacccgctggaggactttggcaacgagcgcaactcggaatcattttcgcacaactccgtccgcggatgctcctacttttacaggtggtttaaatggcactaattaaccaattaaaattggttaattgtttttcggtcattaatgttaattaattaattagtattttttttcttgaagattattgttattattatctgaggcaatttgtcactctaaatacatcaaatctggcatttgcatattatcacgcaatttggcgtccctttgcgccaaattaggtcttcttaattgggcaattagcgtgtgttattcattgagtaattagcgtgtcaaattaacttccttaagaaaaagcgaaggtctttcaaaattttaaaagttcaacaagattagcaatctaaaaattgaaaaagcatcaaaaatttttaatttattttccctatttttaattttcgcgcatttatttttaattaaattttattttatttttgccgcttaaaatttcacttttctaattatgcctctgattttgttcagttatgctgcctgctgtgattttctacaacacaacaatcttttgtccatcattcgagcgcacgaagcgcaagacgcaggtcgaaaaatttgaaaaaatttttgaaaaatttcaaaaaattttccaaccctctaattaccccctgaaggctatcgaatgtatcggaaatcgcaggccaccggcttcccgtcactgatcacaattttcagtgctcccaactatttggacgtgtacaacaacaaaggtgcgtttctttgggggttggccaggcgcgccattgaaaattaaaaaatttttttttgaaatatttccttgaaaatttttcaaattgacatgtcttttttaatttttttctttttttcgcgtctctctctgatcgcttttattattttgatcattccaaacactgatcaaattgtgccaatatttgtcatttttgattaattatgcaccaatctcgagcattccattcaccagtcatttatttttattttttggaattccgagcatttattagttttattttttggcatttctcgcgcatcaatttacccaaacattgttttcggcatttctctagcattcacaatattttagttccatttttggcattctcacacacacaaatttctatttttcggcatttctcgtgcatttgttgttcgaaatttctcgcgcattaatttctagattacattgcttttggcatttctttattagtttcaatttttggcatttctcgcgcatcaatttgcccaaacattgttttcggcatttctcgccattaaatgtgatttttttgtgatttcattttttttcaaattttagctgcaattttaaaatatgaaaacaatgtgatgaacattcgccagttcaactgttctccccacccgtattggttgcccaatttcatggacgtgttcacctggtcattgccatttgtcggcgaaaaaggtgaccaaattaatggaataaatttcgattaattaataaaaacagatcaattcataatttcattaattaacaaaaacagacaaaaaaaaaattttttttttcatttattttaaattcaatcattttattaaattgattaatttaatttatatttaaattaataaataaattaatttttatttaatttatataattccttttttaagcaatttaattttttaaaataaatactttaaatttacatttaatttaatttaatcattaaatttaaatttcttttatgattaatttttgcttttcagtcaccgaaatgcttgtccacattttgaacatttgttccggtaagtggagtaacacattctcattcattttaccatttgttcgaatggttagacttgcattttttggagtttcggcaaaaaatcgaattaaaaaaaattgaaaattcaaattttggggatcagtcccattggccattgaaatttcacacaaattttgaatctttgttccaccgtttttcagatgacgaactgatggctgaaggcgacgacacttttgaag

SEQ ID NO: 73524 - DNA, 377 bp, Heterodera glycines
  Genomic contig location: Contig_ID=SeqID_10345; Location=737..1113; Strand=+
  SCN-specific regions: Sequence locations=1-209,231-377
atgggcaaaaaagtggcaatttggagagagaataacagctcaatcgaccaagcggcgcacatgaatgagcagaaagctgcgatgaaaaacagctgtcacagccaacccgacagcagaaaccggcccttcccgcccgaacatggtccgatggggacaaaaagtgcacgtgaatggagacaacatcaagcaatgcatgtgaatgttctgccgcaaatgaaggaagtcacagcgaagaaagaagagaaggaagagaaaaagacagcccatttgatcagcccatttctctaattaattgttttgtatgtaggcccaacccaaatgtgatcgtatttaagcccgatgaattgttcatttcattggctccgatcgcgcaccga

SEQ ID NO: 73525 - DNA, 902 bp, Heterodera glycines
  Genomic contig location: Contig_ID=SeqID_10346; Location=660..1561; Strand=+
  SCN-specific regions: Sequence locations=1-503,526-836,875-878
atgtttgacatggtcctcaaccgctggccgacattttcaccaacaaacgcgtccatggacttcgaacaggcgatggtcaacgcactccgtgcgaaacatccacaatgctcaatcaacttttgcctattccatttggtgcgcaacatgaaagcacgtcttaccgacgagcaaactcatgtaagaaattttattacttttcaaatgctcaagtttagcgtttcacaacggacgcagcctttgcacaagctgccaaaatgatcacttcattggcgtttgtgccgcttgaggaccttacaccggcgctggcagccctagaagatcatctgtcgggtgaacttgagggcgttctcgattggtttgttgagtttaattttttttcaatttcattattgactttaaaggttttaatcaactacgttgggcgacttcgcaacaatggcacacgcactcgtccattgtttcgtcctgaagaatggagtgtgtatgagcgcacaatgagcggcaccaaccgcacaaacaacttcgccgaagcgtaccatcgcacgttgcaagatgcgatcggacacggacacccaacaatatggaaattcatcaatattttgcgtgagcaccagaaagtaatcgacgttgacttcgaacatttccttgccggaaatgctccgccgccaaaagcaaagcgctaccgcgacacggacaaaagaattctgaggattttgcagcgctacaatgaggaaaaagcgcagccgcaaatcgaaaatgatcaccaatatggccaaaaccaaaataacccaaattcgattattgaaatgcttttcgagcaattatcaaatggattgttaattttatttgttaattttatttgttattatattttggataaaactgagatttttaaaaattaa

SEQ ID NO: 73526 - DNA, 1080 bp, Heterodera glycines
  Genomic contig location: Contig_ID=SeqID_10348; Location=86..1165; Strand=+
  SCN-specific regions: Sequence locations=1-143,165-428,466-896,918 -1080
ccccacttggcgctttttccctcctccattgtgcgagcagggcgccaacaaaagcaacagttggccaaattcacggaatcggaaatccatcggcgggatggctgcccatttgggagagacggaagagaattgggacaatcgcaacagaggtaaaagagaaggcggggcaaattggaggacgaaaaagcaaagttattgggctgtccattcagacgaagtgccaaagggatgaagccgagcgacgcaagaaacagtttgtatacacgaactcgaggaagtgagccatttaaggcatttgggcgaggggaggggggggggcatagaggctgaggaggtaaatgggtgccattgggggcaggggggaccttggtcaggaaacacggagcggcatcggcaactcattcattcactatcaccgccgatttttcaattttttatttaaaatttaaaataaaataaataaatgattttagagcgaacaaagaggcgcgaatggagcaggggccgcgcgaatatgaggtgagttgagaatgacaaaagtgaacgtaacgaatgaatgccacttgaactgattaattaagtcctgcaaagagattggcattgacttttgtgctcggaccacttcgcatggcattccctttgtcgggtgagaaaaggcattccgtcgtcactcattagcacttttgttgatcattaattatcccatttattaattgtctctttctcgccccagggctcattcgttcttcggtcgtcccttttgggcttgtgtcactaccatcgctttctgttccttcatcattcagacgtatttcacattgtccgattacctcgaatatcgaacaatcatcgaaatgcaactcaaatttgagccgggtttggcactttgcattccattaatttgcctaattttatttgattttcagcgcctttccccgccgcaacaatgtgaaaatgaaatgattttttatatttttaagggataattcctcatttttcagatgcaatttgaacgccttcaaattgagcgaagtgcgcaaattcgaagagattgagcagggcatcaaattgtgggagaag

SEQ ID NO: 73527 - DNA, 1398 bp, Heterodera glycines; identical to SEQ ID NO: 10349
  Genomic contig location: Contig_ID=SeqID_10349; Location=1..1398; Strand=+
  SCN-specific regions: Sequence locations=1-232,255-271,293-923,945 -1398
  Gene Ontology: Mol. function=amiloride-sensitive sodium channel activity; Cellular component=integral to membrane; Biological process=sodium ion transport

SEQ ID NO: 73528 - DNA, 359 bp, Heterodera glycines
  Genomic contig location: Contig_ID=SeqID_1433; Location=101..459; Strand=+
  SCN-specific regions: Sequence locations=1-29,51-59,81-273,296 -311,333-359
ggggcggcgaaaatccaggttgccgaaaaatggccaggacctggacctggatccaggaaaaatccaggcctggatccaggtccaggccgagctctagatggaagtgtaccgccgagagaaaaatttgaatatttaactgaatcatgttaagattttgcataataatcgcttcataaaactaaaatattgaaagtactagattctaagcctattttggtcctttttatggcattttgtgattagttcacttcttacgaagaatttttttgtttatacatatttttatttacataattcgcaaattttcttacataaaattagcagccctatttattattaatacactgtgttaatttaaa

SEQ ID NO: 73529 - DNA, 325 bp, Heterodera glycines
  Genomic contig location: Contig_ID=SeqID_1433; Location=912..1236; Strand=-
  SCN-specific regions: Sequence locations=1-185,217-297
attgatttgaagaaaggagctcaaaaaacgcatttctgcattaaaaattttcgattctgatgtcactatcggtcactagaaatcactattttggcgacttcgtcactaaaatagttaaaaatcactattttggcgttttgtcactattttttcactatttcgacattttttggaaaattctttaacaaaaatgcaataaaaccaaaaaatacacccctaagaatcgacaaaaaaaatttcaaaaagcactcctaagaaatgaaaaaaattttctcaaaaaggtattttcgtggcaagaattttaattttaaaaattattttttta

SEQ ID NO: 73530 - DNA, 150 bp, Heterodera glycines
  Genomic contig location: Contig_ID=SeqID_1434; Location=2832..2981; Strand=+
  SCN-specific regions: Sequence locations=1-150
atgttttggcgtctgaactgcttggccgccattctattcgcactgtgctgcacctccagcactttttggctcggctccgccactactgacgaacataacaaagcgccccatgttgatcaccataagctgacggaaacgcagcaatacgaa

SEQ ID NO: 73531 - DNA, 388 bp, Heterodera glycines
  Genomic contig location: Contig_ID=SeqID_1434; Location=1975..2362; Strand=+
  SCN-specific regions: Sequence locations=1-292,314-388
cggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatacacaaaaaaatcagagcaaaaaaagtttgaattactgggtttttgagttccttctggccataacttttttgaaacttaaccaaaatttttgagattttgcaaattaataataaacacatagagctatcgaacaacaccaacaattcttaatttaattgacagtgaacaaagttatggttcaaaaagtcttccgacgacgtttcggccgacgacgttttggggtgcaccgttt

SEQ ID NO: 73532 - DNA, 532 bp, Heterodera glycines
  Genomic contig location: Contig_ID=SeqID_10351; Location=1381..1912; Strand=-
  SCN-specific regions: Sequence locations=1-66,96-192,248-302,324 -395,417-423,471-532
atgggagaaaacgtacaagcaaagtgagtaaataatgggtggcataacgccagagaaatgaatgccaaattaaaaaaaataaacaaattttttttcagaatttttttacggaaaggtcccagttttggaggttgacgggaagccattgggacaaagtgctacgattttgcgctaccttgccgaaaaatttggtaaattaattataataattaattttatttgtttttaattataaatttaaatttaaggcttggccggcaaagatgaatgcgaaaaggcgaaggctaacgaaatcatcgactttcaaaaggatgctaacactgatttggccccctatttatacgtcaaaatgggattccgccaaggcgatttggtgaacaaataatgcaattatgaaaatttatttaatatgaggagtatttctaattaaattaattaataattcattaataagtatgatttttttaattcattcattaattgagtgagtttttggtgaaaacagtaaaaaaatcggcccaatataaataaa

SEQ ID NO: 73533 - DNA, 819 bp, Heterodera glycines
  Genomic contig location: Contig_ID=SeqID_10352; Location=717..1535; Strand=+
  SCN-specific regions: Sequence locations=1-2,154-204,226-227,249 -266,288-424,448-640,662-711,733-819
atgaaagagagaaatatcgagagggaaagaaaagaggagttagagagagaaagagtgagagatgaagaaagagtaagaaccaaagacagtgaaaaacaaagaaaaaagagagattggaagaaaaagagaaggagagtgaaaacagaaaaaaggtactaattgcttttgggtcctcttttttggtcgaaatttttcaaggcgtagccagacaggcagacagtgcactatttccttctttctttttctcaccccttccttttcccacacacacaatgctgctgcacagcagggatgggccgaggtttcgcttttcgcatttcgcctttcgcattattcgcattttttggcgtttcgcatttcgcttttcgcatttcgctttttggcgcgaaatgcgacttttacacccctaagaattggattaaagtcccataaaatttttcaaaattttacctataaattggctaattttcagtgaaaaactgtttataaatgatcaaaatttccaatttttttcccagcggcgcctatcggcaccgccgcgcccccaaaactcctatttgttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcgccgcctgcccccccttcccaaaaagtttttttggaaaaagcgcgcctcaaaaaagcgttttattgatttttaaatttgga

SEQ ID NO: 73534 - DNA, 289 bp, Heterodera glycines
  Genomic contig location: Contig_ID=SeqID_10352; Location=1000..1288; Strand=-
  SCN-specific regions: Sequence locations=1-125,149-289
attttctaagaacaaataggagttttgggggcgcggcggtgccgataggcgccgctgggaaaaaaattggaaattttgatcatttataaacagtttttcactgaaaattagccaatttataggtaaaattttgaaaaattttatgggactttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctgctg

SEQ ID NO: 73535 - DNA, 210 bp, Heterodera glycines
  Genomic contig location: Contig_ID=SeqID_10353; Location=570..779; Strand=+
  SCN-specific regions: Sequence locations=1-210
atgaaaagcgaaagaaaaggtggcctcgttccatcgttgtcgtccaagcgccaacagcaaagtgtccccagccattcggttccatccacggagccttcgcctttagcttctccgtcgttatttttggcatcgcaaaatgtcggagacaagggacatcaaccgccacaaaagcacgtctacagcgaattagccttgcgcaacaattaccaa

SEQ ID NO: 73536 - DNA, 2485 bp, Heterodera glycines
  Genomic contig location: Contig_ID=SeqID_10354; Location=895..3379; Strand=+
  SCN-specific regions: Sequence locations=1-294,318-421,443-493,535 -830,853-1016,1038-1121,1144-1230,1257-1347,1369-1702,1724-2005,2029 -2258,2280-2485
atgaaaagcgaaagaaaaggtggcctcgttccatcgttgtcgtccaagcgccaacagcaaagtgtccccagccattcggttccatccacggagccttcgcctttagcttctccgtcgttatttttggcatcgcaaaatgtcggagacaagggacatcaaccgccacaaaagcacgtctacagcgaattagccttgcgcaacaattaccaagtaaaccatgctaatgggttttttaaattctttcgacccttaattttgacatttgcggtttttagaacccagaaaatttggcatttattttcttttgtaaaaataaatcgtttatgggaaataaaatacagtgatcacgatttttcggaacctttgagcccgaattcgaacacttataaatgcgaataaagtggtaaaaaaactcgtcctttaaatattttcttcaagggaatcattcactatgagtttatgtttcaaatcgcctttttgttccctaaaatggattttaaaatttttaattaaaatattttttgatttaaaaatgagttacactatcgtagcgttctctggacccaaatccaattggatgagctaacacttgaaaatctaaatctggcagatgttggaacagagcaggacatgtcaagcggctgtcagcggaatcgccagtggcattttggggctgaccggcactttgggctttctgttctatttcctttgtgttttcttacaggtttgttttttagaacctatctttatatttcaacaaaaatattatgattttcgtccttttatctgtaaaaccgtcaaccatgaacataatgttgttcaaataataccaaaattattatttctactgcaaattcataaatttaatggtcccattaattaataatcatataattgtttcttaaatgtgtttcttttccaaggcttttgtctggcaatacaagacgggctttcgatggagtgcgtttttcacgagtcgttcgcttttcctcacccattcggtcgttagtggccttttcacttatgtccttttttgggtgtttgtctacggacttgtccatgtttattagctgttttgtaccaacagtatttaattttctttattcgataaaaatgtttcggtgtttttgattttccaaaggaataatttattcattaattattatctatcttttatttgttaatggatgctaattacgttttttaacaaggaatggaatgttctaattgctctcttttgagaagagattttgaggagcaaaagatacaaattgtccgatatgaggcgaagatcaaaggtaagtaatggttaatgaacgtagccaaatgccgtggacattccctcagatttggtaaatgcctacaaaagtctaacgactgagaagcaatcgttggaagttgcgctgagtttactttctgctgctggagaggagaattccgaaaagagcgaattggggaaatcgaatggcgaagagacgggagaaattgcgcaagggacggagaaacgggaaggggacgaggtgaaattgagggagaggggggaatggaccatccaatcggagagaatttaaagacgattttgggccaagtcttggccatttaagacattgttttgcgttttttaaatcacatttgatagttgtccgttgccgagcaaatagaagcactaaagcaggcgatttccacgctgacattggtcaataaacgtaaggagatggagttcaaaaaggacaggcggtcgcttttggtgcgtccgacggactgccgaccattgggtttttatccgcgcttttaggaaacaagagacgaatttcaaaaccgatgcagcgatttggagcagcaactcaaattgctgaaacagcagaacagaagccaacatacggtactcaccagggatgccatcaccgatttccgataccatccatttccaaaaatatcaccaaaagttactgttttcgaggcaaaaacactaggaacgaactcaaactcataacatcctcttttgattattttattttaatttaaaatgttgaagaaaatgaggcaagaatttgagcttgtgaatttaggacactctaaagagattttctccgggtgcagtcaatttcttccttttattcttttgtttttcaacagaagcaactccgcgcggatttggccgattcgaaagaggcatttgaaaaagcaatgacagaacacggaatggtattggccgaacttcagcagcagtacacgaaggagaagaaacatggcgaactgttggaaaaacaggtaaaaacgaaatgggaaaggaaaaagcgaatttggacaatttaaggtcaccgaaatgagtcaaaggttggcagaaaaggacgcgcagataaagcagacggaggggcgactgaagcaaattggcaatttggagaaggaaacggaaatgctgcgcaaaaaggcgcaactgactccgacagtccgagtgataaaagacgaattggccaatgtgaag

SEQ ID NO: 73537 - DNA, 639 bp, Heterodera glycines
  Genomic contig location: Contig_ID=SeqID_10357; Location=87..725; Strand=+
  SCN-specific regions: Sequence locations=1-73,95-180,223-639
atggaagtgcaacctgcagaaaatgatatcaaattgccccgtaagtggatgtgaaaaattgaaaatttggcaatttaaaggtcctttaaacagctgtcagctatatcgagtaagaaaaggccaaaagattactagccaaaaaatggaaaaatatggacaaagttttgggttttcgcaataaaacccgattaattttatatttaaatgcatatattgttatatagaatattgtaagagcttcagttgatccaaaccgggatcttattacaaatatagtgacagcgtatcatatgcattctttagtctgtcatttttaccgtatccccttctgggtacgatatatccccatatgtgcattcacttttggaattgtccggtcaaatctcgatgtgccacccacagcgttaattgattttagcgcactaattacattttgtatttccagcaaaaatcgtaaatgaccatgaaattcgtggtattgcgccggtcggagtgctgctcaacgcatttgagttgaatttgagtgcggtgccagacaaagtgttccagcacgaccttcgcttcgtggctgagtacacaaacacgaaagagggccaagcgaaactgcaggaattggcccgtgggcctcgcaatgagtga

SEQ ID NO: 73538 - DNA, 1215 bp, Heterodera glycines
  Genomic contig location: Contig_ID=SeqID_10358; Location=2911..4125; Strand=+
  SCN-specific regions: Sequence locations=1-287,309-740,762-948,970 -1215
atgcgtcatcatcacagtcgcggaactcgcaaattcggacgaaaaattgaagatgcggaattgacatggtacaacctgcttctgggtttctctttatatggtggataatattacgattaagcacaaaaatcaattttagtaatggacatttcttttttggccaattcgtttttatcccatcgtttttattatccgtattcgtttttgggccaaaacgcgaaactcgaggtcgaatatgacagacactcctaaatagaacgtagttttgtgaggaaaaaatggatatggtttaattttaaatttttgaacattatgccaaattattagaaagaacttggaattttaaaaaacgagtaaaaacgataaaaaggcgtgaaaagccgaaaaataaaaaatttcttttggaaacattttttatcaaaaaaaaacaaaaaaaaaatctctatttttattttcgcactgataaaccaaatacatttcaagattttctggagtgaattctggggccggaattccgctctctaagaataatttttggtctcgtaattccgaaaatttttgaatttttgaattccgatttccacattttcagccgaaacagttgccgaattttacaaaagttgtctgcttcaaccgcagacattggaaccatcatgagtacgatctcattgggaacatatacgttgcttaaattagaaatttccatctgttcgtttgttgtcagtgctgtgcacattgcaacagaagtgagtcaaaggcttatatgaaaatatgcggcacatctcagttgggctccagcaggtttttggactataacttttttttttctttgtcaactaaatctaacaatcttggtatcccttaagatgctctattagcatgcgaatttccaaataatttgggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataaaaaagttatgccacgcggcgccgaaaaagccaagaaaaagtaatttttgaggttttttggccataacttttttgtaaaactgacgaatttttttgaaatttacaggctaataaagaatctgaagagctatcgaatgataacaaaaatttttaa

SEQ ID NO: 73539 - DNA, 743 bp, Heterodera glycines
  Genomic contig location: Contig_ID=SeqID_10363; Location=612..1354; Strand=-
  SCN-specific regions: Sequence locations=1-183,205-449,478-743
atggccgactccatgttcaagtatgaccaggaggagcagcggatgatacgcaatgtgaagccatgggagcaggatccgcactatttcaaggtcttaaacaattcgaacaaaaaactaaaaatttcccattttcttcggggtagggattggtctgaaatgagtgtcggcttcgttaagggtccctctttggtctttaataagtttaaatgaacccattttactcgtccatgtttaaaatgaacacttcaaatcttttttttattttatttgtcatttgttacatggtaaaaatcttattagaagttggaaataccactaaaattgctaaaaaaaaaatttcggcgacgttttttgattttgatttaaaacgttcgattttgggaccaaaattagttaaaatgcatgtttgttttatgacaagcgagcccaaaactatgcaaaaaattgtttagaggactttttaaaacaaaatctttgccaaaaaggggccagtcaacggctttttatgaaaatctttttaatttagaggggtccaaataacttaatttctcaagcatttcacgctcatttcattaaaatggcttcccgctgtcttcaggaagtcaaaatttcggccttggcccttgtcaaaatggtgatgcacgcgcgcagcggggggaacatcgaaattatgggtttgatgcagggccgggtggacgccaacacaattattgtgctggacgcttttgcgctgccggtcgaag

SEQ ID NO: 73540 - DNA, 674 bp, Heterodera glycines
  Genomic contig location: Contig_ID=SeqID_10363; Location=3389..4062; Strand=-
  SCN-specific regions: Sequence locations=1-122,144-385,429-441,463 -497,519-674
atgggtgggaatattggcggtgcccttgccgttctccttattgtcctggtcgtgcgtgcgtccaaatcgaatggcatcaagaagctgatggagtacagtataaattgggcagggttacaaaagaacacaaccatccggctacatttggtgctgaattggtacaaataaattgcttctaagggtataagacaaagttggacagattcgagtatcagctgaaaggcttcgccaagaagcaaggagcgaatacccaacttcaaggcgaaatattgtcaatgacgtccgttcgaatttgcctcttaaagttcgagttgcgtctgcaccaggcccttcttgcatgagatggacatataattatcaccgccgaaaacaacaaatggcggtcaaaaaaataaaatatagaaaaaaattatttttattgtttatttgaggaaggcgacgctgggttggatgctgttccaacccgtgatattgtcattcccgatcagttggttgatcgagtcatctacaaccaaaatctccaaggaagccgaatgattattttctgttcacaatttgggattaacaccctccgggcctacagagacgaagtggcagttgatggaacgtttgaagttgttagaaaagtcggctgtcagataaatgtcgatttagacgagtccacgtggttttga

SEQ ID NO: 73541 - DNA, 1144 bp, Heterodera glycines
  Genomic contig location: Contig_ID=SeqID_10363; Location=5367..6510; Strand=-
  SCN-specific regions: Sequence locations=1-502,524-539,562-697,748 -826,848-1144
atgtcccacaatcctaatgaagcggagagagaaatggaaaaagcgatgtaatattctaaatttcaatttcaatgccaatcattttgctttttcagcttcatttctgccgattgttggcttgaagtgttcggtttgcttccacgctctcaacttggcctcggaattgcgatgatcagtcgccgatttgaccgccgcgtggacgaacatttcaaaacgcgcaaatggacattggagaaccaaattgttcaacgattgtcaatcccttcgtgtcgtcaatttctatgacggcatttgccccgaatttccgctcgacgacagtgccaatgcgtcggattgccaagcgttggcaaaatggctgttcacgccttgtcacgacaatttgatgaaacagctctttgtccgaattgacaattcaacagtggagcaacaatggttggaaacagtcgagcaaatcaaaacggtgaatagtgatttttccgacatgttttctttcattttttttgtcttctttttaggcattttccatcgcttcttcttctgttgcttttggcattttcgtcaactttcgtccgtcctctccgattgactccgttgtgttgcagcagacgatgatgaaaaatggcaaaatgcggtcatgaatgaattaactgatggaaacaaacaattagtgcttttcatcggagacagtggagtcgacaatgggtgaaaaattttaaaaatctcagcaaatttcttgtttaaattttgtttttgaagtcttctcgatgctgcctgcttccgctgggccgagtggtgatcagcagaaatgaatttgggtgattgatgcgattatgtgacctttattatatcggactttgctatttaagtgttgtgtttttgatttttgcttatattttaaaaaaagagcgctgctatacatacaatagtcgatgcatcatcacaacggtaatactggagaatcttgcggaccgggtcgactgggcgccgccgactgggcgacgccaactgggcgacgccaactgggcgccagctcaactgggcgccgccgactgggcgccaagacccactttcaaattccctttctttaggcacaaaaatcgcaaaataggtttaaatagacacaaattttcgaagaggcaataaa

SEQ ID NO: 73542 - DNA, 465 bp, Heterodera glycines
  misc_feature (451)..(451): n is a, c, g, or t
  Genomic contig location: Contig_ID=SeqID_10364; Location=16..480; Strand=-
  SCN-specific regions: Sequence locations=1-465
atgccaacaaatttggtggaattgagagagcgaatttgtgaggagatcggttacgaaaatggcacaatgaaactcatacacaaaggttaatgattaataatttaaaaaaatagcaagaaattgggctctagtgcactttatgagtccaccaatcaatgatttttatacaataactttgttcatgctcgaacaaaccctatcttttttggtatcattcgaaagtacaaagtctaagtaatgtaataatacgagaaaacaagaaaaatctaacatttcaagaaagttacaaacgaaaatattaagtatttacttaattaatcaaatttttttggtaattgcctgaacgctgcgattttatatattttagcttcgttagactttgtactttcgaatgataccaaaaagatagggtttgttcgaacatggaaaaagttattgtataaaaacccgnggattgtcaattga

SEQ ID NO: 73543 - DNA, 676 bp, Heterodera glycines
  Genomic contig location: Contig_ID=SeqID_10364; Location=582..1257; Strand=-
  SCN-specific regions: Sequence locations=1-138,166-337,427-440,463 -502,545-676
atgggagaaaaatttgaatttggagatgtgagtagataatattcccaatcaaattatcgattgattttcgcccgataatttgattggagatttttttctctgacatccccttccacaaacccaaacctattggatggggttgagaaagagaaaattctgtatttgctctaattatcccaccaatctccattaatccctcagtctctgaggagcttaaaaaataatcccccccccccccaaccccacgggggggggataattagatcatatacattagttagataaagagagaaaatagtgagggaggagagagtgtgcgatagaaaaataggaaagtgagagaggagcgagaaagagagagagagaatagtgagagagagtgtgcgagagaaagagaaaaaaagaaaagaattttgttaaagaaatagagaaaaatcggtagccattaaaaataaattaattgtgtcgatactatgattaataaattttgcagatttgaatgtttatatcatattataaaatatgtttaatttatttatattttcaggtaataaccataatttttggaaaaaaatttaagcgcataaacaagcgcaactttaccaatgcgtttgtggcgcggggcgccgtgtttgccaacgcgttggtttataaggtttgcaataattatcattaa

SEQ ID NO: 73544 - DNA, 535 bp, Heterodera glycines
  Genomic contig location: Contig_ID=SeqID_10366; Location=414..948; Strand=-
  SCN-specific regions: Sequence locations=1-104,133-184,210-213,236-535
atggtgttgctgctttttgagggttgcgtcgtttgcaaaaacgctaaaatgactgcatcgctgtcacttcgccaatacatgccacaggtactcaaaaacaaaacatttatttatctatttttataattttttcagggactgttgaaagagacgtgtgcagcatttgttaaacggccgacgtaaaaaataaacaaataaataaataaatatttgttttctttgttttttagcaaagcactggtgggagtgacggctgacagctttgcttacggtattacgctgatggaacggtacggtaattatgtgcagtaaagcacgcactattattgtaaaaattgatttttgtcacataaataacacaaaaaatttcaattggaaaaagaaaaaactgctgaacaaaaaaaatttttatttgccaaaaattcgtttttttagtctctgtgctgagaagaaaaccaccgaatccgagccaaaagagaacgcaaccacaccggcccccgtatatgacatggaaatgctcaagtaaaaaaataaa

SEQ ID NO: 73545 - DNA, 2190 bp, Heterodera glycines
  Genomic contig location: Contig_ID=SeqID_10367; Location=188..2377; Strand=-
  SCN-specific regions: Sequence locations=1-59,81-196,242-287,309 -335,360-434,456-530,552-578,600-847,877-881,1061-1219,1244-1636,1671- 1959,1982-1989,2024-2164
  Gene Ontology: Mol. function=structural constituent of epidermis; Cellular component=intermediate filament; Biological process =negative regulation of cell growth
atgaacaagtggtctgcacttgtgtaagttaattggagggaggggtggggcttgaaccatggccaaatattaactctctgtccactttcagtctgttgatcgcgctgatcagcgcgctggacagcgctgttgttcgacaacagcgcgccgccgacgctgacgcatcgaaaccggaaccgaacaacgaaaagccaggtaaataaaaatgaatataacaaaaaaaaaattaatttaataatttgatccaggaattttggactcggacaaagcaaaaccggacaaaagccagggaacagacacggaaggaaataacccggaaaagccaacggaaagccagaaagtggaagaggatggaccaaatccgaagaagccaaaggaaagccaggaagtggaagaggatgaaccaaatccgaagaagccaaaggaaagccaggaagtggaagaggatggaccaaatccgaagaagccaaaggaaagccaggaagtggaagaggatgaaccaaatccgaagaagccaaaggaaagccaggaagtggaagaggatggaccaaatccgaagaagccaaaggaaagccaggaagtggaagaggatggaccaaatccggacgaggaccagctcactgaaagccaggaaacggatgaggaaggacaggagaagccggagccaaacgatgttgaagaatcggcaccggaaggcccagaaccgccactgttgaagcacaaaacggatgcactggcgaaaggtgagcaatgccaatatgaactgtacataaatatgtggaggacataattcaatttttttttattaaggagagcccaactcacggcagaagcgccaaggaggaaatcctgctggaggaggcggtggagaaaagactgctggaggaggcggtggagaaaagactgctggaggaggcggtggagaaaagactgctggaggaggcggtggaggaaagactgctggaggaggcggtggaggaaagactgctggaggaggcggtggaggaaagactgctggaggaggcggtggaggaaagactgctggaggaggcggtggaggcaatgagacaggtaattggatgaattcaaaactgcacctctcctcccccttgccccgttcaatatgcccttttacggaagcacaaaatttttgaggctgcttcaaatgatccttcatgtaaaatatacgaaaaaaactcaatttgaaattggggaatttatgagtgatgagtgatggtggtggtgaatgaacggcccaccagcagcttggccctttgtttttgatagcacacacaatcactggtttaatcattgtgttaatttgcagtcccgggaccagcgagtgtcaatggaactggaactgaaacaataaaaccagacgtaccagtcgcaccaagcggtcaaccgggagttgcaccaagcggtcaaccgggagttgcaccaagcggtcaaccgggagttgcaaccggtgaaccgatacccgaaccgaccggtgaaccgaaaaaagacctgccgattccggataaatttgacctgacactgccaggtaaatgcataaaacattcattgttcgtcccgggttcgcattcaatcattttgacctttgcatgttcagggcatatttgcctctttttttgtctgtaaattatttattttttgttgtggttttgagtgaaccgggcaaaaaattttaaattttctatgcttacatatggaaaaagcaaatagcaatttttacccgtttcaaataaatgtgctatttttatgcgaattttgggttctcgaaatttttcatttttaaatgtttttctgtaaattttcagcagcttgaaggccctatatattttttaattggcatttttttagcatattttgccccaaaaacatgcaaatctttgaccatttttttttgtccttgtgtacacaatcgcaacttttgtgtactgtccaactttgtccaagaaatgtttgactttcttctccccccccaaatttaatattaaaacaataaaataaattaaaacaatttgaagaggtggacccgtcgaattcatcggccaacgcaacgagatatgttacacaaatcgaagggcgaaaaaatgtctccgatgccaaatttaacggaaagacagcagcgtgtactccagcaggggtgggcaaaaacaaattttattttaaataaataataaa

SEQ ID NO: 73546 - DNA, 714 bp, Heterodera glycines
  Genomic contig location: Contig_ID=SeqID_10367; Location=1306..2019; Strand=+
  SCN-specific regions: Sequence locations=1-12,192-196,226-473,495 -521,543-617,639-714
  Gene Ontology: Mol. function=small GTPase regulatory/interacting protein activity; Cellular component=actin cytoskeleton; Biological process=response to pathogenic bacteria
cctgtctcattgcctccaccgcctcctccagcagtctttcctccaccgcctcctccagcagtctttcctccaccgcctcctccagcagtctttcctccaccgcctcctccagcagtctttcctccaccgcctcctccagcagtcttttctccaccgcctcctccagcagtcttttctccaccgcctcctccagcagtcttttctccaccgcctcctccagcaggatttcctccttggcgcttctgccgtgagttgggctctccttaataaaaaaaaattgaattatgtcctccacatatttatgtacagttcatattggcattgctcacctttcgccagtgcatccgttttgtgcttcaacagtggcggttctgggccttccggtgccgattcttcaacatcgtttggctccggcttctcctgtccttcctcatccgtttcctggctttcagtgagctggtcctcgtccggatttggtccatcctcttccacttcctggctttcctttggcttcttcggatttggtccatcctcttccacttcctggctttcctttggcttcttcggatttggttcatcctcttccacttcctggctttcctttggcttcttcggatttggtccatcctcttccacttcctggctttcctttggcttcttcggatttggttcatcctcttccacttcctggctttcctttggcttcttcggatt

SEQ ID NO: 73547 - DNA, 2666 bp, Heterodera glycines
  Genomic contig location: Contig_ID=SeqID_10368; Location=435..3100; Strand=-
  SCN-specific regions: Sequence locations=1-66,90-147,170-215,258 -380,481-527,567-854,896-1005,1028-1100,1147-1195,1242-1432,1471 -1669,1691-1694,1724-2086,2134-2252,2301-2434,2461-2552,2574-2666
  Gene Ontology: Cellular component=basal cortex; Biological process =neurogenesis
caaaatcgataattacaaatgccctaaaaatgcaattttttttttcattctgttgcctttgtcggcatttttttttaattaaataaattgtttggcccgcttactttgtttgggttggcaaagtgttgtggatttttgagaatttttcattattcatttttattggattatactctaaaatctcgaattgttagttaaattccaatggttttggcttttttaaattgattttaaacaattttatacaatttttaaaagtatacgatatttacagtatctcggcgcttgtgaagtgtttgaatcgcgtggcatgtccgtgtgcgaaagtgcgcttcaacacctcagggttagagcataattaaattttttccaaaattggcaaatttaaaataaataattgaaatatcaaaaaaacaaaatttttttctcttttcaataaccatttaaaataatttaattcaaatattttattatttatttgtcttcttcgtaaattgcttatttcttttgggtctattttaattcagttttttaattatttaaaatataaactattttcaatttaacatggtcaaaattccaatctttgacaggcattttttgcgcctaaaatttgaagtttatggaataaagttaaaaaactgacaaattttcgaaaatcaaggacacttcggattttcaaggacgtccttgtcacacctatacatgacaacaacaatcagtgcctaattatgcaaaatcttaaggcccgaaagcgggtgaccaaggcattgttgtacatttccggggacggcatccgtgtggttgatcaagaacacaaccgaggactgatcgttgatcaggcaggcaccgacaattaaaaaatctaagaatattttatatttaaattttaaaagttttgcagacaatcgaaaaagtatcattttgtgcgccggatcgaagcaatgagaagggcttttcatacatttgccgggacggcgccacgcgccgttggatgtgccacggcttccatgccacaaaagattctgtaggtactatagtttatattgaaaaaaattattatttcataaaaaagcaataaagaaatgagaatgttttacaatttttaatgaaatatattttttatactaagtaattaaataatttcttctaaatatattgcaattttatgatgttaaattcagctatattagccataaaataataaataatatttttcattaattgttttattattaattcattccgccatagggcgaacgcttaagccatgcggttggctgcgcgttcactgtctgtcttgagaagaagcggaaacgggacgcagaaacggcggcataccgtactgcacaagcgcttgcgcatactgtggaattggactcgggcattgaggacaattgtggcggaggtggaggagaatttgcgaggcgggaaatttaaaaaatttataaattggaatataaaaattttcgaaaagttataaataaaatcgaaatgagacaggttaagaagactccaaggaaaaaattgtggttttttactgaaaatttccattttccttgttgttacccccttcaatacttattatacctaacaaaaaatttccgaaaaagatgcgcgaaatttttgcgaaaatccacgacaaattggcgcttcattaataatttttcaagaaatttttccaaccccctaggaattttttttttaattttaattttttttagttaaactcaaaaaattagagcctttaatatctcactattaaatttctcgtatttacagaaccaatcaagcctacgggtcgtttcgccaattgtcgatcagtgaacgccgatccgatccacagaaggcaattttggtggatggaaaagtgcagcaaacaaataattcggtgacagtgtctaacaggtacagttagtgcaatcattttttgaatttgcgggcaaattggcgaaatgtaattccttcaaatccgcaggcacagtatgccgtcaataccaacaatgcctacggtaacatcagtgttgaatgcttcgacaccacggccaagcggcaacccgagcttatttgaacgatcggtaaggtgtttttttgttttttaatgttttatatttttgtaaaaaaataaaatttgactaaaatttttgagagaattgtggaatcccaaaaatgcaatctatccaaaaaaaatttccttgaagattttgtctgaaatgctttccaaagttttttttttgggcactaagaaagtgatttttaaaaaacaaaattattcataataattcataatatatttaaaacgaacaagtttagaattttatgaaatttcaaaaaaaaaatcaaattttaagaaattctgataaaatgcaacccatttaaaaacttaacaaactttgacaatttagggctcattgcgtgcccctaactcttcttcaactgttgttgttgttgctgctgcaaatgccaatgataatgctgttgctgtcgaatcgcaacaacaacaatgccaacaacaaattgttgtttcccaatttgcccgtttttgttcattgcaaccaaaaaataatatggcaaaacggtttggcacaatgccaaggatgtcgctgcacaacgagccaatttgggagggcgacgtggaggaagaaattggcattggcactaccact

SEQ ID NO: 73548 - DNA, 679 bp, Heterodera glycines
  Genomic contig location: Contig_ID=SeqID_10369; Location=306..984; Strand=+
  SCN-specific regions: Sequence locations=1-162,184-226,300-354,377 -638,660-679
atgggtaataggggaggcaggaagagctggaaatagtaagttcgggaaatttaagggtaaagaattgggatttttcccacaaaattcgccactttggggcttttttgactaaaaattgttattacaaattttgtttttttctccattttttctgcttttaaagtatgtaaatttatgagggaatatgaaaacgcataaaattttttaattttcgtttttccattcgtttttttattaatttttttttagaaattcaatttatcgaaagattttaaaaatagttatgattttttaaaaatcgttggtccctttcgcgaagcaacttttccattaacttccagctataaaactgtgttaaaattcattttttccataaccgatgataatccatctatatcagacaattaaggaataattaatcaatccatgataattagcctagccagctaattaggtgtcaagctgggtggttaattgaacctgtaattgatgacacccgcttgagccgcctttacgaaatgaacgccgaatggagcgccgaattcggtccatgccacggtttaaaaaatgcctaaaatttgttgcgtaaaattaaatttagtcagattaatttttaaacattaattggaaggatatagattattttaaatattttaattcgaaaatttgcaaatttaaa

SEQ ID NO: 73549 - DNA, 858 bp, Heterodera glycines
  Genomic contig location: Contig_ID=SeqID_1436; Location=954..1811; Strand=-
  SCN-specific regions: Sequence locations=1-634,658-706,757-777,802 -813,848-858
cgaacattcaaatgaaatgcattgacagcactgaaaaaggtgccattctttgcaatatgatttatccattgtcaatatccaacagaaaattcatttggcggtggtgccgaattcggccattcccttttcgtttctggcattgaacagcgtttttcggtgttcgtttcgcccggcacggcctctctcacggcgccgtcccttttgaaactgtcgttagtccaaagttcagacggttctattgaatttttggtaaatacattataaaacaaattgtaacacaaaacctaaagaattttgacggaaattggaccaccgaagcgcaatttctaatccctccgcttgacgtggaggaaaagcatcgaattttggtacgaatgtgcaaaggaatcgaccgattggagacgtaccaatcggaacagaaaaacgaaggacaaatcgaagagaaatgcgaagtcatccgagttgcagagttaatttggtcactgatattttcagctcaaattcgaatggttcgctgcttctgattgcaaatctctgcttagcgatgattttctgatcatccgccgctcttttccgatcacttttcgcccgattatgcttctctcatggcgcacttcttttttgtccgatcgcactcttttccatgtggacatttctcgcaaggattgtggtgggcatatgcttttttgtcttcatttgcttgtcttctctctctcccccccctctctctctctctccccctctctcactctctcttacttgtctcgccgttcattttgccattccttcagtctctgctgctttcgctgtcgatgtgttccccacttttgtctctctcctttctcttaaaactgattg

SEQ ID NO: 73550 - DNA, 1406 bp, Heterodera glycines
  Genomic contig location: Contig_ID=SeqID_1439; Location=278..1683; Strand=+
  SCN-specific regions: Sequence locations=1-88,130-158,180-242,265 -625,650-1010,1032-1193,1285-1292,1317-1406
atgttcgggttagagattcggaattggtcgaaatggagtcccgattcgtgctcatttgtcagcgccttaaaacacccctagaaaagcgtttaaaaaatttttagaaaaaaataattaattaaaaaatttcgggaccaatgatcttcacaattgcccgctgcccctcccttcccctaaaatttaaattagaattgctgcaactgttgtctctgttcactcactattcattctagcaaaggaacaaaatgataaaggccattttggtgttcaataaccatggaaaaccacgactgctgaagttttacacacaatatgtatgtaattattctattcttcctcttttggacattgtgccgaaattgaacttttgcccattcagagcgaagaagaacagcagcaaattgtgcgggagactttccagcaagtgtcgaaacgtgacgacaacgtgtgcaactttttggagggcggaaaattaattggggggtcggactgcaaattgatttacaggtaaatggtcctgccgatggatggttgggttaattaggacatcctcaaccattttaaatgaaaataatttataaacgaattctccgcctataattttaaggcattacgcgacattgtactttgttttttgtgtggacagctccgaaagtgagttgggcattctcgacctgatccaagtgtttgtggagactttggaccgatgttttgaaaatgtgtgcgagttggatttgattttccatgtcgaaaaggttgccaatttctgcgttttcatccttcgatttttttccttttcggtccatcacattttaaacgaattggtaatgggcggcatggtgctggagacgaacatgaacgaaattctgctgaggatccaagagcaggacaaaattgagaggcaagaggtagcaagcaatttcataaagaaaacccggcaaaatgtcaacttttcttttcatttgccatttccttaggctggcatcgccgctgcccccgcccgcgctgtgtccgctgtgaagaacatgaacatttcgcaacaaattaaggacctgcaaattgccaggattgccctctaaaattgccaatttcaaaagcccattttgaaaattgctgcccttttccaattcatttgtctctctcccaacgtgacattggccgagttgatcgggtcttacaatggaataccgtacaataatttcttatttacttatgtaatttcaaaatttaattcattaagaaaaaaaatagttttttcagaattttagtttttaaattttataagcgaaaccttgtacaaatatcatgacaccagttgatcaccaagttcaaactgaaaaggtcaatttgatgaactgacggatcaactttaaccagttttcattttattttatttttgcaattta

SEQ ID NO: 73551 - DNA, 1790 bp, Heterodera glycines
  Genomic contig location: Contig_ID=SeqID_1440; Location=1396..3185; Strand=+
  SCN-specific regions: Sequence locations=1-41,97-106,128-180,202 -327,349-442,469-535,558-744,768-1164,1187-1253,1275-1790
atggtcaaatacgaacccaccgaagacccaaaacatccggtgagagagacagggcgaaggagagagagggggagggaaagaggaaggagagagagaatggtgcataagacagaggggtaagggtgaaatgagagacagtttgagaccgagacggggaagatagagaatgagagattttcagggatttggcgaccaacaatacattgcccgccgggctgaactgaatgcgttggccaatggttttcggcacggcgattccctccctttcatttgctataccgacgaagaaaatgtgaaattcaccccttaacgaactcacgaaacataaaacttcagaaaacttggcgagttgcctatgaacagcttaaggaattgcgcgagacgcacacatgcgaagaataccaaaggaacattagagaaatggaaagagaagagataatgtaaaagggggagggagagggggaaagacggaacattcgttcacagaacagccgaccgaattccgcagctgcgtccgctgagtctgtacatccaaagtgggcttccccacccactttttgctcatttgtcagtccaaattctgaagaaaggaccggcttcgaactccgtccctgcggcggtttgctctcggctcgcgactttctcgccagtttggccttccgcgtctttcaggcactcccccaacagaataacccataaaaaaatgttgccattcaggcgacgctttacgttcgccatgccaggtgctccccctccctctccttcctcatgccctacgcgccaatttctcccccccccccccgattaattcgaatgtaaagttttgttgagttcgccgcaccattgccctgagcccgatgtcatccacgaagtgctcgggcattgtccgatgtttgcggtattcgaaggcattgacactttgtgtttaattaaagctgcaaaaggacgaacatttggcgcaaatgtcgcaggaaatcggcctgctttccttaggcgccagcgacgagcaaatcgaacgattggccaccgtattaattaccgtattcactgccattctaattcccccccccccctcttcaggtgtattggttcatcgttgaatttgggctgtgccgacagaatggtaccgtaccataggaatgggcccttgaattggctttctgttcttaattcccaggacaactccgcgcaatcggtgccggccttctctccgcgtttggggaactgaaggcattgccaaccattagaccaattctttaattgttctgtttttgcagttcgcctgctccgatgggccgggccatgaacttttcgtggccgaattggccgcgcaacggttggccacagggaattggcattaattgcagcccaaaagggaggattacactaaattctctctgtttctcagttcgtacgtcgactcggactatcagcccgtctatttcgtggccgaatccatccgaaaagcgatggaaagcatacggtaaatgaaaaagagcgaacgcccccgcctcaccagccgaccaatgaatagtcggcgttaaagcattgcactaattaatgaggtgcttttcagggcctacgccctttcgatgcgtcctcagagaattaacatttaccacccattgccacgctccattcaaagcgttccaagccacgctctgatcggaaaaagaatgggccaattgcaaaaggaatgtacggaactaagccaattgatggacaaaatgaagacggaagaagagaagggaattataccggcggaagagagaagggcagtgattgactaa

SEQ ID NO: 73552 - DNA, 671 bp, Heterodera glycines
  Genomic contig location: Contig_ID=SeqID_1440; Location=3549..4219; Strand=-
  SCN-specific regions: Sequence locations=1-671
atgtcgcggttggcactttattcaatcaacggcgaattgctcggaatgcacagtgagcgccaacgcacaataacaaggtacagtttgcatgatacaaaaaacaaaggaaaactattaagcattgccataaccgatttgcctgaaggtaccgctgttaattgtgtggcaattggactccaatcggggatgatcaggtgggagagaacatggacgttcctaggttttggactggatatccagggctttttggctcgtatacaattcgtcaatgaacaaatccatagactgacggattgccatgaccccgtttcttgtttgtgtgagattgagtacaacaatggggaaataaatggtgatcggtcaatttaattttcaggctgatcgaaatgtggacaatgactgtagtccgtgacatttcatttcaatccttccattttcccgtcctcaggtggtcatttacttcccaatttggcatttgccttttcagtctcctttttgccaacgaatcgcgccgtctttacgccgcctttgccaattccaacgtcgttctgtgttggcaggtcccttcactttatggcgctgccagtgaagaaccaatgactgtgagcagagaacggccatgcttcaaagtgctcaacccttttaaatgcagcgactcttttcccttgtaa

SEQ ID NO: 73553 - DNA, 1223 bp, Heterodera glycines
  Genomic contig location: Contig_ID=SeqID_1441; Location=737..1959; Strand=+
  SCN-specific regions: Sequence locations=1-51,74-270,292-451,474 -601,624-633,655-1053,1076-1223
atgagcccgcagagacagacacagatggacgagggtccggacattttggcgttgtttgttggttttggcatttcggtgggttcaaatgcggaagatgaggcgaatcgaacaattgcaagggcatctgaccataagtccgaatctaaacaaaaaaatgcatctatttttattgtgccattgtgcaatttgttacttgccattgtctgaatcgcgcaaacaattaaagggtcgtctttgttgctttccacgaaatctcttcctcggtacgtctattttaaatgttaaaaaatactgattgtgaagaatattttgaacttaccgctggatggaaaacattcattgctcggacggcgttttcaccgttctgtttgaaaccaaatatcaaatcaatccaatggtgaagattggtcgtgacatgacggtctaaagggaagaaagaaaaagcatcgcttttccagagaattttctacacagaattaacgtactttcaagtgcgtgacgatggattagacaaaactgaaaatgcaaacatcaatttttaaaaccaattttagtataataaaacactaccaaacggtgatctccacgaggacaccaaggtggaacttgaacatggtcaactcggtccccagattgccgaactcccaattccaactcgtcgccatttcgtagcatttcatagaggtaaaagaactcagggatgagttcctaagcatttgttactttcttggataaaaaaattagtttcaacaccttaaaatctgtggtcgattctgagctggaaaggcgccaagtcgtgtccattgagctgaagagacggtcgggaatgtcgaagttattgtctggaatataaccaatcatttgacctattttgttaaacgattttactgctgaccttgatattcgagagcaacggaagtgtaaggagggacacggaccaaataatgggcaacaattccagtattagactgaaggacttattgaaataaccaagtgaacacccaggaaataacgaacgtaatgacttccgtaatgatacggcccaaaacgaacggttgaaaaaccactttttggggaagaaccgacagaatcggcactttggttgaatcggtcgtactcttccgccaaactctggtaattttgtgcataaactttctccatgtgcgcatcttgaattgccatcggctttgtcaaattcctaaattgttgacacttaattttta

SEQ ID NO: 73554 - DNA, 3998 bp, Heterodera glycines
  Genomic contig location: Contig_ID=SeqID_1441; Location=177..4174; Strand=-
  SCN-specific regions: Sequence locations=1-583,605-605,630-719,741 -834,864-1047,1072-1780,1802-1968,1990-2201,2226-2363,2386-2784,2806 -2815,2838-2965,2988-3147,3169-3365,3388-3556,3590-3998
  Gene Ontology: Mol. function=protein kinase binding; Cellular component=postsynaptic membrane; Biological process=signal transduction
atgtcaatgctcatggaattgaatttggtttgttttgcattacattaactcaaaattgcattctgccttttcaggatttccaatacgctctgaaaatcggtctccatgagttgtgccttttgcatttcacttccatcggcgacttcgacaccgacttggatttgttgatcaaattcatgcattccatcaatattcggtcgcctcttgcaaatttgacactggaagagattggctcactgacagcagacgaaattttgctactgcaacaattttctgaaataaaaagccaattttatgggaaaatgacggaaagggctaacgccgcttgggacagggaatgcaacctgctcaaattcactagcgatgtgagcgatttctgatgttattatcgggaccatttctgaacttttggtcttcccctgctccgcaattcgtaccgtttaaatttaattttagcaagcgatcactttgacatgcgaagtggcagaacttcaaaatgtacctcgacgactgctggtcaattggaagaaagaatctcaaagggaatggtcgcgcgctaacagaacattagcacatttagtggtaagtcaaatttcagccagagctgcaaatgaatatatttcaaatttcaatcacggacccaaaaaaaatttcgtaatgattcgtgatttggtaagggaaatcaggctgattttatttgatccttatagaaaatcttttcaaaacattatttaaattaaggataggatatagatcatggaaaatcgcaaaaatcttgatgtttcatagatttaagccgcacttgcaaattctattcaaattcgaatccctttcatataaaaaaataataaatttaaaaaaatgctcattgtttaaatactgtaaaattatactatattactctaacaaaggtagaaaaatattcagaaagagctttgtcatccggaggcgccatttttctctccatttttttggcctattggccgtgtccttaacacaaccgaaggaccatcgcgtgagagacgacgcttttccgacgcacattatttgtttccactcaaatttcttaaaagtgagcgaagcaaagctgttgaaagtcttcacaacgcaccgatgccattggacaatttattagtaatggcacatttcttactcttatttccacttttacaaatcaactaattttttcagaatagcggtgacatccaacaaagtcatgccaatgggcttagggacatggaagaccctgtcagcatttcgtttctgtaaaaggttaatccattttgatttagatacgaatgagcatttctgccacacttcttcaaacagcgtttgaatgttccggtgatttggtgatttccgaccaaaggctttactttttgggtgaaagtgctaaaagtacacaggtttggatgacctttcattgaaatgctttatgatcattttgttctaagaaaggcgtcgttcacgcgcccgtcacttattcgtgggattatgaccaaatcaaagagatgcacatccgtttttatcagttgaaagacactgcgcttgagctgttcaccaccactggcgatgcctttctcgttgttttcgcatcggaagaagtgaatgatggaaatagtaaattacattcggttttatttttatttttaggatcgcgccgttatcctccgaatgtttcgaacttttcatttggataaactcttcgtggaccacaaagcgcagcttaagtccgccacacaaatgtggcgccgtggcactttgacaaatttcgagtgagaaaaacttccaatttaatttcgaccctttgctttttagataccttatggttttgaataaattggccggcagaactttcaacgatttgatgcagtaccccgtctttccgtttgtcctttctgattactgctcggacgcccttgacattgccaatccaaattcttacaggtcatccaaattttacacaatttacagtcatattttccttccatttgtcaattcgttggttcagtgggttttctcgctcttttaacaaatattgtcggttcgattcccttcaatttcgtcttgttttgttgagtatcctataaaacagcctatgatgattttcaggagccagttctgcttctgaagcgatcattgttgaagcttttcctatctgaggctgttaatttgttgctttaataatattcgaattatcctttttttaatttattaaaaattaagtgtcaacaatttaggaatttgacaaagccgatggcaattcaagatgcgcacatggagaaagtttatgcacaaaattaccagagtttggcggaagagtacgaccgattcaaccaaagtgccgattctgtcggttcttccccaaaaagtggtttttcaaccgttcgttttgggccgtatcattacggaagtcattacgttcgttatttcctgggtgttcacttggttatttcaataagtccttcagtctaatactggaattgttgcccattatttggtccgtgtccctccttacacttccgttgctctcgaatatcaaggtcagcagtaaaatcgtttaacaaaataggtcaaatgattggttatattccagacaataacttcgacattcccgaccgtctcttcagctcaatggacacgacttggcgcctttccagctcagaatcgaccacagattttaaggtgttgaaactaatttttttatccaagaaagtaacaaatgcttaggaactcatccctgagttcttttacctctatgaaatgctacgaaatggcgacgagttggaattgggagttcggcaatctggggaccgagttgaccatgttcaagttccaccttggtgtcctcgtggagatcaccgtttggtagtgttttattatactaaaattggttttaaaaattgatgtttgcattttcagttttgtctaatccatcgtcacgcacttgaaagtacgttaattctgtgtagaaaattctctggaaaagcgatgctttttctttcttccctttagaccgtcatgtcacgaccaatcttcaccattggattgatttgatatttggtttcaaacagaacggtgaaaacgccgtccgagcaatgaatgttttccatccagcggtaagttcaaaatattcttcacaatcagtattttttaacatttaaaatagacgtaccgaggaagagatttcgtggaaagcaacaaagacgaccctttaattgtttgcgcgattcagacaatggcaagtaacaaattgcacaatggcacaataaaaatagatgcatttttttgtttagattcggacttatggtcagatgcccttgcaattgttcgattcgcctcatcttccgcatttgaacccaccgaaatgccaaaaccaacaaacaacgccaaaatgtccggaccctcgtccatctgtgtctgtctctgcgggctcatttcgggaacagtttcactccgtcgtcggtgtgaaatggggtgatttcgtaggcagtccggaacatgacggcttctatttctcgaccccatcacgatttttcacttcgggaacaaaacggtgcattataactttttaatgattttttaatgcaaacgtccaaatcgaatcggtgttcagctctctccgtctttccctggtgcattgtgatcagaccacggcaatttgctacggtattcccgaatcgaccgaattaatcgtctgttaccgaccggacagaaaaggtgtgatgctttggcctttgtgtttatttttccgtttcttccaagacccgctacgtctcaacaatgaattggcattgtgtgccgttgtcgcttggggcccttccaattttaccgacaatgttttgcgcattaaactcgtctacgctggccattctagcaaaaggcatttccaactttcgccttcatccatcgatgtgccgcaacagttttgggagcgtctcattgacttgcaatcgttggaactggtgtcgggttgcttattcgtccgcagccaatag

SEQ ID NO: 73555 - DNA, 1113 bp, Heterodera glycines
  Genomic contig location: Contig_ID=SeqID_1441; Location=4455..5567; Strand=+
  SCN-specific regions: Sequence locations=1-50,73-805,827-1113
atgtgtgccgacgttttgtaccattgtttgactgttggcattgtgccgcgtttgagtgtgagctttttgtgagttaatttgtgcaggaaacagcaagaaagcgatagtttcgagcagcaaataacgcgccctacgcaaaaaggacgcacttcgaagaatattctgccagtcgtctattttcttaaatagggaatttcagccaattgtgaactgatcatcagactgatttggacaaattggcttttttctaagttctattcttacaatggacgcttttcgaggcgacaaacagcaggcgcagaagagaatctccaagaaagtcgcgagcaaagtttcttcggcttccgatgccaattggggcgagtcgaaaaacagaaacaaattgcgaaccattgtcaaggagaagagaaggcgatttgcgttctcttcgttagacgcaaagccgggattgaacacagaagcgacggaatggaagccatggggtcgaaaaaagtcaccaaaagctaaacggataatgaaaataagatattaaattgagtactggtacggtacacgaatcggcagcagggaaccattgagaagtactctgaaccaattcaaagtcggaagactcggccgaagatgaatattctaacaataagtcattttaaaaataacaaataaaattacagaggacaacaaaacctcgccgattcccgaacatttctcgtcgctttgaagcggccaaactcgagaaactgctcggcgtccgaaattggtcagaaagtgtggaacgaagagagtcaatccaacagaagagaagttggcaaagagcttgacgaagcaacggattggaagaagaggcagccgatgggtcgaaataaggctaaaacattgataaacaatgttaattgattggtatgacatcaaaaagaatcaccgtcaagtgatcgggggaatggctgctggaagtgctatttgtacgccctgaagaggaggtggagggcctccgatggccaaattcatctgcaaattgtccttgtcctccgtccttccacaaagcaatgatgcataaccaaacaaactcttcacaagacgaataggaaaaagggtcactgaattgaaatggcaaaa

SEQ ID NO: 73556 - DNA, 1118 bp, Heterodera glycines
  Genomic contig location: Contig_ID=SeqID_10370; Location=2828..3945; Strand=+
  SCN-specific regions: Sequence locations=1-34,106-208,231-251,291 -301,328-890,912-1118
atgccatcatcaacaactgtgatgcaagcagtgccaacgacaacaacaaggagaacgatgacaatgacggaactaacaacactgattgtgaacaacaacaacaacgctcaaatgataccgctgaatttttgattgattaattgttgatgttgtgatgatgatcatttttatccttctccaccccatttttttaaaactataatagagcaaaaatatacatatattttttaggaggaattatagccatatacaatatataattatttatgttttatttacatattttttttcttactttgctcataaaaaattttattttttgtgcaattaaaatagctcattaatttcagaaaaaaaagctataacctaaattatggatcgaaaagcgtcgacctcgaagaagcgcaaacaaacggagaaggcccggagcaaacaacaggaggaatgaagggtcagacagttttttggtagtactagtaggaatgtttatatcccatttttttgcaaaaaaaaatcaaaattttttcgtttagacgtcctgaaaataagtaccaggtggttttcgcggtcgctgaccacgaatatggcaaccatttcgccaaattcgggatcacttaaccgaattcgaataaaaagtcgaaaactcgagtttttcaaaattcgcattaagatcaaaacaagctatattgaaacatacattttgttcagattatactagtaataaaacaatttcaaattttctaccttttgttcgaatttgagttaggggttcggaataagccaaaataattgccatatcatgatcagcgaactcgaaaccaccacaaaattgataaattttcttaaaaaaaatttttcccctggcgccaccggactccaaaaaaatttaattttttaagatcaattttaaaagtctttagtgaccaattattgcaatttacaggaaacttctggatcagatgacacggactacgaaggcgagctcacgataattgcaactgcgtgcgcgatggcaattttgctgatttgattgtacgcgttcggagcacactgaagaaatggaagaagccaaaaattgacaccccgcgggtaagaacatcaatttaaaagatatataa

SEQ ID NO: 73557 - DNA, 549 bp, Heterodera glycines
  Genomic contig location: Contig_ID=SeqID_10370; Location=4127..4675; Strand=+
  SCN-specific regions: Sequence locations=1-60,82-112,134-549
atggtgggtcacctttttggatttcgattccatgatcagaattcgaacaaaattcaaaaactcaaaatttatttttatgtttgtatctgtatatttgaccgttttgatcaacttaaaaacaaaggtaaattttgaacttcgactttttgttcgaattcgggtcagggatccgaaattagtcaaaatgaatgttggattccggttccccggccttcgataatttattgtaaattgaatcgatttaaaaatcctcaaaaatcgaccaaaatttaatcaccaaaaaatgtgaaaaatcgactaaattttcagttccgtatcctggttccggttacttattggcccataattttttgattgtgagctaatttatacgattttaattccattcgaaagcacttgattttggttaagatgtatgattaagcagaagtaagcgattagaaactcaaaaaagttcaaaaacaaaattcaccgatattttattgtaactattcaagtgttatttattaatcgctcagtttttgctgaatcatatattttgaaatataa

SEQ ID NO: 73558 - DNA, 2138 bp, Heterodera glycines
  Genomic contig location: Contig_ID=SeqID_10371; Location=1341..3478; Strand=+
  SCN-specific regions: Sequence locations=70-132,157-171,257-312,415 -633,667-668,756-1245,1267-1324,1346-1363,1386-1473,1495-1695,1722 -1911,1933-1982,2004-2138
atgacagaagatgagacggaagacacatcaacatttggcagctcaagaatcgatggctatctttacaaggcgagttttgaagcagtttatttccaaaatgggaacggtttgtggtcccaaattatggcacccaaacaaaatcacctttttccctttattgttaactgtttcagttggaacagcgtccattcgtcggccaaattcgcagaaagtattggtttgtgctgcctcgcgatactcccgttttatattggtatggcgaacgaaaaatttaaaaacgaacgcctaatttcagcccttttccctcattttcaggtacaaatcgcccactgattttaattgtgcgggtcgcattcttctcacgggcgctgcgttcctttacaaccccagggagcaagggattttcgagattcagtgaggaagtctcgattttatacgatgaatacttctgattctacttttccacccttcgggattcgtttttctcgactaaaatttcaaaaaaaatgaaattttctacttatttacgatttattgaatttataggacaatgaaatttagtcaaaacggatgaatccaacataaacaattccccaattatttttcagaggagtaaaatttctccgtttttagcgtcgacaacaaatgttatcttttggaggcgccgaacagccgtgcccggttggattggctcagcgccatgcagcaaagtcggcgtcggcactaccgtcgcgagaaggaggacaccaaagagaaatcatcagagagggaaggggagggagccgaccgaaccaatgccaatgaaaacgacgacggagaccaaatccaaggcaatttgccatcgacctcagcagccgaatcagtgccagacgaagaggtgccatttggggattaaaaaaatgcttccgaaatgtaaaattgaattatttaaaagtccgaagactccgcccggtcagtgttttacctgcgcgaggacggcgaactccacccgggcagtttggaagtaccgccggccatttacaccgtttgtgacgcggtggaactgaaaattgacacactgctcacccgcggtgtggaggagacccagcagttcgaagtggccaccaaaaagttactgcacaaggccaggagctcgttcaggttcagttagaggggggggggttgcatttgggaagtgattttcgggcgaatttctttttgggttgggcgtgtaatgggacccgaaaataaaattttcaacctcgattttttaagtttttctgtttgcacacatggtttaaatccgtcgataaaggacgaattatgaccattttctggattatttttccccgggaatttacattttcattcctcacgtaattattaacattttcatcatcccccaacagcaattcgttcccatcgcagcatcagcccagagagaattgtgctcgttgccaagaagttgttttcctaattttaattgcccacgagaaataaatgatttcataaatttgctgcagttgaccgagtcgttggagcagttgcgcaaccgctgctacgaactcactgacgatttggtggtccaccagcagttggtcaaatgtctgaagcggggcgttgtcgctgcacacaatcagcgcgatgcactgtaagcagttggatgaaccatggacaattgtttagggaggggaggggagcattcgtacatacctgaaaatttttatttaataaaatattttgaagaaagcgttgctgcgtggattcgtcgaccgacgcggaaaaggtggagttcattttggaacgtgaaagtgcgttggccaaggcgcaatttgccatttcggaactgagccgagacaacgagacgctgaaggaagagaacaggtgaagctgctcattcaaagcctttaaatttaatttgattatggagtcttttttaaatattaaatttttcgagttgaaataattttatttgttcgaccgttccctttggagtttgggacaaatgcataaaaataaaatgactggcccattcattgcattaaggtcaattttcccaattttacagacgccttgaggcggaaaacagctctttgaacatcactgtggatgcctatcaggagtcggtgcgcaccaaagacgagctgatcatgaagtag

SEQ ID NO: 73559 - DNA, 235 bp, Heterodera glycines
  Genomic contig location: Contig_ID=SeqID_10372; Location=41..275; Strand=+
  SCN-specific regions: Sequence locations=1-235
ctgtttactaccagttgaagagccgctacattatggtagaaaatgcaaaattcgaccaaatttgaaacatatttcgaatttagttgctcaaccatttccaaccgtcaatggaccgccaaaaacggctgcccgtggaaccgtcgatgatccaagaactgatcgacgaggtcaccagacctcactctccgatgcgtacacacaatgccaattccctggcggtggagacggtcagtga

SEQ ID NO: 73560 - DNA, 802 bp, Heterodera glycines
  Genomic contig location: Contig_ID=SeqID_10372; Location=656..1457; Strand=+
  SCN-specific regions: Sequence locations=1-802
atgccaaccgatgaagcggtgggacccgcggagtccgcaggatcggtgccaaccgaagcaacagccgtctccggcaggttgttcaaatgtgccaagattttcgaaaataactcgaactccttcagcccgtcgatctctcattttgtgccgtcctcctccttcgctgcttttacttctccttcgtcgtatgaaaatgccggcgatgcactcaaacaggacgattggctccttcggttggccgccgaccatcagaagcgatccgatgacattttcgcatccattgagctgagcaacaatcaggtgttgtcattttaaggaaatccccggatatcggtttaactggtagacttttgagaaaacggttttctcccttattttggactttcttacatttttcgactccttggggaattcgtgccaatgtcacgtgtaatcccacccctggcatcattaaccaacacttccccccttttcagaatctcgtcgaatggctgcagcgttgggacgcctatttggtcaaccacgtgctccagccgatgagtccgaatccgcagctgaaaatgttagtccgctgtggcattccgaacacataccgtgctcgggtttggagcaggttttacagtgccatgccaaataaatgctttttctaacataaaatttctccagtctcgtcgattttctggtcgggtcgaccaaatccgagacgggcaaaggctattacgactgtttgttgcgcaaagcccaacgcattcaggagcaaagcgcttccggcacggcggacgaggacgcggcactaaaacag

SEQ ID NO: 73561 - DNA, 621 bp, Heterodera glycines
  Genomic contig location: Contig_ID=SeqID_10374; Location=9..629; Strand=-
  SCN-specific regions: Sequence locations=1-533,557-621
atgactataaggagggtaaagcggataccgccaggattgaagcaagcgagtgtgactactcgaggttagtaaactaaaacgagcacaaactcacttggaccaaaagagtagcccgacattaggggacttctaaaaggcgacatgtgcgggcattttgtggaggagttacagtcaagttttaacaacaacaaaaaaattctttccaggagcgtgaattcccatcctcttcccccttgctatagaagcatgctgttgtttatccaatttactatttttttaatttaaaaaccctaaccctcttataacccaacaatcccgaacccccctcaaaaagaattcaccatcgttagatggccgaataagaacacattcggcaggttcaacaaccatttctggcgccgatttgccgtctttcggcgcctctttttgcccattttcaccgccgaagcacctgaaaatgtgccgatgatgtttaagcagaccagaaaaaagcggataaaaggccacagccctacacggccctgaaaaatgattttttcttttattccccaattaaattaccaaccaacccactaatctgacagaaacgcaaaaattaccggaatcctgactaaaaataaa

SEQ ID NO: 73562 - DNA, 1144 bp, Heterodera glycines
  Genomic contig location: Contig_ID=SeqID_10374; Location=653..1796; Strand=-
  SCN-specific regions: Sequence locations=1-229,251-337,381-529,551 -611,634-1144
atgattggcagtgatcagaaagatgcacctgctgcgcaagtgctgtccaaatggttgcacacgccaagcgctaatggtcagtcgaaggcgttgtactgctgcaactacaacggaggcattacaaatgttgcggaatgggtcaacaaattcaagcaggtcaacgaaatgtcatcgttaaaatttcaaaaattcctttctttaaatgctttttgtacaaaaatttttgttcaaaataattaaatttaaatttgttttcatcttgatttctttttttttttttgctccattgagcttaaaccgtttaaataggtgataggttgttgattaaatccgatagataaataaatttataatattttattaaataaaataattattttcctaacggctaaaagcctgtgtttatggcctggtcggcgatggtcatttaaatgtggggcatttgatgagtgagacgaattttgacgctttataacttttcattgaaacgaccaaattcaatatttctcatgtcctttattagcctgcaaaattttcgaaaaaattttggccattactttttggaaattttacgaaattttttttacccctcccccaatttttcaggcttttctcagtgccaccgctgcttcttcctatgaaattaacctgcagctggacgacccgacccagcttaaaaaatttgaattggtcaatgaacggacgcgggaaaagctgttgctgaagaaggtggcgccatcgccggattatcagcacgatgattgttgggagatgcgtcgccgtccaattgtgaaggcagcggctgggaaagcggaaaattgcgatgaatgggacgatttgagcacaattgacttcgagcttctcgacaacgattgcattgggtagagcgccggcaagaaatattgaaaaagtcgggattttgaaaatcaggcaacgacatgaatgccaatgccggccgtgggacaatttggcgccgaccaaatgggcgccagccattgtggaacaactcctttcatagctgatcgaattaaataattttaatatcttttgatagccctaagtgttttctctcatttgtctatgaaatttcgataaatttgcatgagcttcaaaaaagtaacgaccaaaaagattccgaaataaa

SEQ ID NO: 73563 - DNA, 519 bp, Heterodera glycines
  Genomic contig location: Contig_ID=SeqID_10375; Location=161..679; Strand=+
  SCN-specific regions: Sequence locations=1-519
atgcacggtcagggtcgttttcgtaccgccattttcgtaccgccgttttcgtaccgccgttttcgtacggggacgttttcgtaccgcaggggggtcgttttcgtaccgccgttttcgtacggggacgttttcgtacgagttcttgtacaagcgtcagattcaaatagaaaaacttaagaagaactaataaaaccaaaatttatcattttttgtttcccattcataaaattttgtagaaaattcataactttataataataacaaaatccaggacaaactaggtcgcatctcataatttcggaaaataccagcgagaaaattgttaaggttttcgggattgacattggcattggcataattgtgatcattttgagggacaatattgttattgatatcgttgtagcgttggacgagacgaagaatccgtgcgtcggcatcgagatacttctttttctgtgcaccaatttatcattatttagttttgttttaattacttgctgctggttcattttgtagtta

SEQ ID NO: 73564 - DNA, 467 bp, Heterodera glycines
  misc_feature (428)..(428): n is a, c, g, or t
  Genomic contig location: Contig_ID=SeqID_10375; Location=789..1255; Strand=+
  SCN-specific regions: Sequence locations=1-467
atgtcccccgtacgaaaacggcggtacgaaaacgtccccggtacgaaaacggcggtacgaaaacggcggtacgaaaatggcggtacgaaaacggcggtacgaaaacgtcctggcccgcctgatacatacttcatatatagagaccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcngaatccaatgacgaattaatgaattcgagatttcattag

SEQ ID NO: 73565 - DNA, 83 bp, Heterodera glycines
  Genomic contig location: Contig_ID=SeqID_10378; Location=1..83; Strand=-
  SCN-specific regions: Sequence locations=1-83
tccaagtggggaattgaacccaggcgaaaattatgaaaggtagaaagtttaaccactacaccacatgtgcatgtgtgtaatcc

SEQ ID NO: 73566 - DNA, 66 bp, Heterodera glycines; identical to SEQ ID NO: 65608
  Genomic contig location: Contig_ID=SeqID_10378; Location=861..926; Strand=-
  SCN-specific regions: Sequence locations=1-66

SEQ ID NO: 73567 - DNA, 1064 bp, Heterodera glycines
  Genomic contig location: Contig_ID=SeqID_10379; Location=184..1247; Strand=-
  SCN-specific regions: Sequence locations=1-412,434-457,480-766,789 -825,848-1064
atggcgtggaaagctggcatgcccgactgcagaagacttttgcctctccccatagcaaaaatgaacagacggtaaagaaagattttaaaaattttcattttccctattttccatgtttcagttggatttgtggcgacgtttggatggacattctgccatcttttgaacatgctcaactcgaccttaaaatggcattgctttccgaccgtttcgacatcttagtggacaaacattttgatgggaaaacgacgaaattgacaattcggagaacaatcgaattgaaaaggaggaagggccaaaagcgaaaatatatgccaatggttatcgtgtgcaatttccgttccacgaccgtccgctgcccaacaaaatccgctttaatcacattcggattaagtaattcgaacattttgtaacattttgggatgtttttacccgcgaaatttggcctatttttgcgaaaagcattcgtcattttggctttcacgatggcgatgatttggacaaattgcgtcgccgcatttcaccgacacttctcactgatcttgatcaattgaattcgatcaattccggttatctgtgccccgatggaattgctgacgatggacccaatgcaactgctggccaagctttgaccaaatggttacacactccgagcaaaaatggacagccgaagcaattgcatcgcaataattatgtggttccaccaaagctggaatgggtcaacaacttcaaagaggtgtgtctcgtcagaatttccgtcaaattatttttgtgtttaccaattttttatttagacatttcgccatgccaccacttctgtcacttacaaaatttgttttggtgttttcttgtcgctaatcgagccatttgaattggtgaacgaagtgacaaatgagaagctgacactgacgaaggatggcactggtgaattcaattggcttttggagagatgcccaattattggggagacggcggcggttcagaaacagcagcagaagaaggacgaaaattcggatgccaatttgaacaaagtgttcttccgcctttacgatgacattgggtga

SEQ ID NO: 73568 - DNA, 329 bp, Heterodera glycines
  Genomic contig location: Contig_ID=SeqID_10379; Location=2744..3072; Strand=+
  SCN-specific regions: Sequence locations=1-329
agtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatgcacaaaaaaatcagagcaaaaaaaagttcgaattactgggtttttgagttccttctggccataacttttttgaaacttaaccaaaatttttgagattttgcaaattaataataaacacatagagctatcgaacaacaccaacaattcttaatttgattgacagtgaacaaagttat

SEQ ID NO: 73569 - DNA, 1030 bp, Heterodera glycines
  Genomic contig location: Contig_ID=SeqID_10379; Location=1450..2479; Strand=+
  SCN-specific regions: Sequence locations=1-29,59-871,893-979,1004-1030
atgcgagtgcagagaactgtgaaaaggttcggatgttttttaaagaaaaatcccgccccttttgcccctcctctaaaaaagcactttcttgattgctgtctcgtatgcagtgtcttgactgtaccgcatctgcatgtcatgactttgaactgaccgccaatgagcttgtgacaggtgaaaccaacagccgtgcagaaatgcggtgggaattttcgctcgaaatgcattttcagctgccttttcaaagtcattgtgttggtcggttgtgccaccattctttggttcttttttgaccatttcaaaaaacgacgacgccctctcaaaaaagaaatgtaaaataaattaaacagaaaattttgaaaaattttccaatttttcagctttatctgcagcgattgttggcttttggtgttcgattttcttgcgccttctcaactcggcctcgaaattgcactgattagccgccgctttgacttctacgtggatgaacacttcaagacgcgcaaatggacgttgggcgaaattcgaatttgctacaaaattgaagaaaatggcaccaagcaaatgcatattcaccatgccgatgcaaatccattgccaatcccgcaaaatccgttgccgaacaaaatcatcggattccgaggcattaagatcgtgtaagaaaccgatcatccagattgttttgatttaggacactgactaacattttcagctacatcgatcaaaatgtcgtcgcatttctccgccgttttcaccgttttttctccattgttcaacggaattgggcattatcacgtgcagaagtgactgtggagaaattgacactgcaacaagaagacgaagatgtttggctcacgcgttgtccaattggatgggatgagatgaaatggggaaatgtgcaggatgaattattgaatgacgatccactgaatgcaattctatttttgatcagagaggacagattcgacgacgggtgaacaattttaaaaattcaaattgaattgattttaatgatgcaaaaatgcggtta

SEQ ID NO: 73570 - DNA, 269 bp, Heterodera glycines
  Genomic contig location: Contig_ID=SeqID_10380; Location=486..754; Strand=+
  SCN-specific regions: Sequence locations=1-269
atggcatttctcagcaggacgatgacgacgttcaacacaacgacgatgctgctaaacctggcacttttttgtcagtgcgttcattcgttggtcatccatccgcgactccgctcaacttcggctgcggttgctgcacgtcaaattggatcagggccagaaacaactgctgctgaagatgaacaactgcaacatttgattgacatcagcagaagcagcgataagtgcaaaaggatgcgttggtacggagcagaagcaaagcaaatgctcag

SEQ ID NO: 73571 - DNA, 344 bp, Heterodera glycines
  Genomic contig location: Contig_ID=SeqID_10381; Location=11..354; Strand=-
  SCN-specific regions: Sequence locations=1-212,234-344
atggcactgcttcaaatccgttgctggtggtgggggtggttccgtgcgcttctcgagtgccgtgccgtggtgtcaccgctactgccgattgtcgcggcacgttgtttggcggccaacagtttccgacgctcatccgccgtaatgcgcactcgacgaacgcccgggatgttccgtgccggattcactggacagttgaaggcggagaagaagcagtcatgcttgggcccctcgtcgtcaggcttgtccgtgaacagcgcgaacagcttgtccagcagcgacactttgccaaccttggacaccgcattccgttgtgccgcctccgttcgaagcctgatctcgtcaag

SEQ ID NO: 73572 - DNA, 102 bp, Heterodera glycines
  Genomic contig location: Contig_ID=SeqID_10382; Location=551..652; Strand=+
  SCN-specific regions: Sequence locations=1-102
ttacacctttttgaacaattaagctttggctttattctccaaattggcaagcgaaggcaacgaaagcaattcgatcaatttaaatttgttgatcagtcaaag

SEQ ID NO: 73573 - DNA, 66 bp, Heterodera glycines; identical to SEQ ID NO: 53774
  Genomic contig location: Contig_ID=SeqID_10383; Location=508..573; Strand=+
  SCN-specific regions: Sequence locations=1-66

SEQ ID NO: 73574 - DNA, 2335 bp, Heterodera glycines
  Genomic contig location: Contig_ID=SeqID_10385; Location=106..2440; Strand=+
  SCN-specific regions: Sequence locations=1-780,802-2335
atgtcgggcaaagcgtcgcggatgacgcgaaacgtcaaaacactcattcccgaagcggtgaatttttagtcgaattgttttccatccaacgcattgaatgaattgtttttgatttcagcagaaagcagcagatgaaaaaaccaaaaaagaagcaaaggcacttgaggatgtgagtgatctcccgtaaacacatcaccgagatgcagccgattcgcttcaaattttattggacatgaatttttgtctcccggaaattttttggcactaagttcccacttcttaaattcgaaatcggattctgtttcttgaattttctgaattcgtcaaaatttcgtttgcgcgtcattaattagaaatcgtgtttcggttcttaaatcatcaaatccgtcgaacgttttgttcacgattcttaaattcgaatcatgtttcaatctaaatccgaatgtttcccgcttatcaaactcgaaatcggatttctgatgcttttgaattctgaatccgttgaaatttcgttcccgatttttaaatttggaatcggttgcatccctaacacggcacctacgttcaactatacatcacataaccattttttgcatttagttcctggtctcactgagtccgttcaacaagaagtgggaagtggagcgcacgctcagttctggcgcctacggcgtggtgtttttgtgcaaggacccgttaatggagtgagtttttcttggccctctgctgctggtggtggtggattaatttatcccatattttgcttatcaatcatctctaattaattttaatccattttcaacaaaacagcatcaaaggcgtcgtgaaggttgcgcgtgcggagtccggaagtgaaacggccgagtgggaggcagctgtcatggacaaagtcacgaaaaatgtacgcctcggcaaaatatgccaatcatgatacatacatataacagggagggatggaatgctaatttccgaaattttctgcgaaaacgtattttagaaatattttttcgaattttgaaattttcgtttttgaaaaaattattaggcctaggaaatgccattcctgtgatacataatacttttgttacacaacaccaagctaatatccttttctcatttttacccacagacacacggaaagagcataaacattgtcaaactcctggacaagggcgttctggttgctccggacaacagtcggctgaacttcatggtgctcgaattctgcgaattgactgtcaagaaataccttagctatgtgtgtgcattttgttggtctttacacacagaattgttggcaattccaacttaattaggcttgtcgtccctatggcttttcctttggttcactaaactgcgctaaagtgcccaattgtttatgatgatcatcatcatatgccatgttttgtttaagcgaccggctggacctccacgaagggctcgcatctgtcaagtgttgctgggagcattgaaggccatttacgacatgcacaaccaaggactgttgcaccgtgacttgaagccggaaaacatgggcattttgtcgagggccgacccggtcactgtgctttacgatttgggcatgtcacgcatgtttaccaaccaattgggacaagtaaatcttgtctatacttgttgaccgtatacatatcccctctctgtgtttaggtgcgcgaaccacgaactgttgtcccgttcaagggcaccgttgagtgggcatcgggccatgcgctcaaggggcgtgagcaggtgcggtgccattttggcaaaatgacggcctaattaatcaaactttatttccaattccaacacatttcagactcgttgggacgatttgatcgcttggctgtacattgctgtggaactgtttgacccggacgtgaacaccgaatcgccgtacccgtgggacaaccacaggatcaacaacaccaaagtgattggcgattgattgatttcattcaattgatttcatattatttgcgtgtttttcaggccgttcgttatctgaagagctcgtactcgccggccaaagttctgctcaagaactggtaaggattgttgatggcatcattaatgtgttattaatgattgctaattattcccgtttagcccgcgtcaattctattccatccacacgtatttgtattgcggtaatcgtctgcttgtgccggactatgcattccttgccgacaaagttggacaagcgatggaagaaatccaggagcagatcaaaagtggtccggttactacgcaaggcaaacagccccagcagtccgcggcttccgtggcaatcagcaaaagctctgtggctcagtcgatggtcagcaaacgctaa

SEQ ID NO: 73575 - DNA, 133 bp, Heterodera glycines
  Genomic contig location: Contig_ID=SeqID_10385; Location=4597..4729; Strand=+
  SCN-specific regions: Sequence locations=1-68,122-133
atggcatcatttgtcatcaatcccggtggtcccggcggttatgtcattccaaagcgtcgaaatgcaacggaggaggaaaagaagaaagaaagacatggggcggcggcggcgacggcggaagatgacgccaaat

SEQ ID NO: 73576 - DNA, 892 bp, Heterodera glycines
  Genomic contig location: Contig_ID=SeqID_10387; Location=1122..2013; Strand=-
  SCN-specific regions: Sequence locations=1-343,381-521,543-863,885-892
atggcactgccgcagttcctggtacgtctcagcagccgtctttcggcacgtccaccgacatggcgcacttctccaacgcattgcaactgtgacaacttcgactgtatgcaggccaagaccgcctacagaatcttccagatcaagcagttcctcagctacttcatcaacctgatccctgcagaggaccttggcgagatgaacagcgcaaatgcatttgccaattatttcaacggaattttgcaggtgaccaccaatcatacattaaaaaggcggggagttcaaacaaatttttgtgaaaagagtctggggtggtcaattttgcgaagggactccggccgtggaattttccaataagaatttttagagtttttcttgaaaattttttcgggagggaaacggcgggagaatgaagtgcactccagtgggaaagttctgcagtaccgatgggtgccgcttttggaatttgaatgcggtttgttagcagatttttccaaaaagaccgatttttgcgattttgagccaaattttccagaaatttttctccttctgtcccactctagggggagatgtgtctggagacacctcttgtgcatataagacctgattctatctccacataactaacttattccaagaaataatttttattcaagaacacataaatatttatttggaatagtttgttccctctcccctctcgacaattttaaaactgtaattcttagttaataatttttttatgttaggttgttttccttgtaaaaatattgtttatcggggacgggtgacgttgagatgggaattattaacgacatttttccttttgcagaatgccatcaaagaaaaacagtctcaagaatccgttgaggagaaggcaatggcaagtgtctga

SEQ ID NO: 73577 - DNA, 1812 bp, Heterodera glycines
  Genomic contig location: Contig_ID=SeqID_10389; Location=1168..2979; Strand=+
  SCN-specific regions: Sequence locations=1-231,253-680,702-755,777 -1052,1074-1378,1401-1777,1799-1812
atggacgtgcagatatgtgagttctgatctgtttggcaatgtgtttaaatcactttaggacaaattttgagatggatttgttcgacacccaagtttatcgcaggggaggtaatccgtaacaatggctgcattcgagttccctctgcatttcagataaagatgaatcaaacgaatgttgcaaaaattcgatcgtaaaaccggcatgccttcccgtcacaattctcgcgttgcttttgttgatggctttctttgttccgatgcttaacgaggaaatgggcgattttgccgtgggcagcgcaaaaaaatacgaacggacgggcaaatgcaccgacgaatgcaggcaaattgaaaaaatgcacaaacggtcgactgttataccttttccgtttgcgttttgtcgagtcaataccgacgggaatgaatttttctgactcgtcgccgaggcatttgagtacttttcacgcgtggatggaattactacgacttgcgcaaaaagcggtggacattacggcattgtattggaatttgcgggacaaaacgcattacgaaacttcctggcaggtattgtttcaaatcgaaattttctgagtttgaaaacaaaattgttttactatttaggggaaagaaatatttggggaaatcgtagagactgcacgacgagatgtgaaagttggggtcgaattcttttgcttctttaatattttttcagattcgaattgcgcagaattcagaatcggtcttcggacctttaaatgatttgaaattcctggaaaagaaaggttttttatttatcccaatttttcccctcgttttttcaaggcattgtctccgtttcaacgctcaattttactgaaatttttggagctggtgtcctccacaccaaactttggattgtcgacaatcaacacttttacttgggttctgctaacatggactggcaatcgttgactgaggtgctttcttttggcactttcatttttttctttttgcctttaaaggtaaaggaaatgggtcttatgcttgtcaactgttcctgtttggcctgggaactcagcaaaatcttcaccatttactggagggttggacagaatcacaatcgagtgcccgctgcttggcctgtttatttgcgttcaaaatttaatgcccaacacccattggaaattcattttggggttgaaccttctcacacttttgtttcggtatgaaaattgtttcacgccttaatctttctgcccttttctttaagcattcacccgaacaattcaacccaaaggtgtccataattatttgataattttcctttcatttgtctgtagggcagagagcacgacctttccgccataactttttgtatgagcaaagccaacgaatttattcgtgtttctgtgatggattatattccggcaacaatttactcgccaaaaaacgacaatgtgtatgttctttcttctgtattattttcccaactttgaaaatacagcttttggccacccattgatgatgctttaaaagctgctgcttaccggggtatttgttgttgtattaaaaattagttacaacagttacttttaggagtaaaagttgaacttttggtgagcctgtggcctcattcacacaaaaaggctgtttatttcctccgctctctgctcgaaattaacgccgcacttccactaacaaattcggggaggaggggcagcatttccattgtgagttcgtttatttgcgttggtttatccgatttcttccagaaatacttccgggttccggttagtcctcagcaggctgttctggaatttgcgagggtaaaccaca

SEQ ID NO: 73578 - DNA, 1921 bp, Heterodera glycines
  Genomic contig location: Contig_ID=SeqID_10390; Location=305..2225; Strand=+
  SCN-specific regions: Sequence locations=1-298,320-1214,1236 -1373,1395-1676,1698-1734,1773-1921
atggagtgcatcggctgcttggctttccgaacttcgttctctgttttgctcagaccattcagttcggccaactttggtcagggagcacgggacattgggtgggttatcccatttaattttgtacaacagatgtgtttttagttcttgtcacaatgtttcgtcacgtcattcggccctccttgaaaaagctttggctccctttgtaccgcgtacggcgaaggaattggccgaatatttggccaaaaatgtcctctaccattctgtcggcgatgtcctcgtggtgcacaaaccttacggcggttagaaaaggctgaacaaaaggctgtttgatggactctatcagattagttgctactcatttcagttggctctttgggctatgttcaaaaggaatttggcatttttccgacaacgcaatacaaattcaaagatcgaatggacctatttaacggagtgaaagtgagtagggtcgctggggttctgcaaaaaaggcctttcagaaggatgattcggttactttggaggatgcaattccgcacttaaaagaaatattccacgagccaaagttacacttttgcaccggtctcaaacggtcggtccctttgagcctttctttgcgatacgtcctctttcagttgggtgtccggccccgtggtgcttccctgctctgagaaggcttttaaaaacatcggtcacaggttcttcctccaatttggtcctctcatccattgtccttttgtgccctttcagccttttccaaggagagtccatcagtcacagcaatgagcattggacagcccagcacatgcaccgagcattgtttgtcgggtgaactcaaacaaaagtgaccggaggcctttcttcagggcaatttgcatttcgcgccctcccagagacgaaggtgccgtcgatggctacgccacgttccaagacacgagccgtgccaacgaagtgagttaatatgacaaggctaatgggtctatcgaccaattattacaacaataaaacccgtttgttttgtttccgggtttttagtattgcctttcatcttttctttcagtatattttcgtgccttcggtaaaaatcagaaggcgggcgaggtacgggaaatttgctgtgcagggcgaactcttctaccgcgtgcttgactcgcagtgcggactttcactcctcgacattcatttctcaaaatgtgctttttttagggtgtaggaatgtaatttgaaaacaaaaaagcatcgttttttggctgcgtatttatcgaaaattaaattgctattcccagaaaaggatagaggcaaaacattaagtggcgttctcgctcgacataaattttgactttcgtttcagtcagccgacacttcccccggctaattctctcccatttgggctgtccaatctttggcgattggatttacgagcagagattgcttaacgttgacggacatccgatctgtgccgagccgaaggacgtgtggagggctgaggcgaaaaagttcgagccaagcgcctttctcaataaaatcggcatcggaagtttcggggagttgcgacctccgccaccccttttttttgcggtgtacgaaagcactttgcctttctttggcactacgaaatcggaaagacgaagaaccaatctcgtctccagaacaccgcctcctggtgaaaaaggacgaaacaaaatttaaaattctttgggaatggttgaagaatttttataaattattccaaacaacttctaataaagttattttttacagtaaattgtttacagatcatttcatggccatggttgacctgctcaacttcggaccatcagttgaaaaattgctaatgtcgcttgaacttggagaattagaagaagctgaaattccaccgaccgacaaaagcactaaaagcagcggagaaacaaaattttga

SEQ ID NO: 73579 - DNA, 496 bp, Heterodera glycines
  Genomic contig location: Contig_ID=SeqID_1442; Location=1746..2241; Strand=-
  SCN-specific regions: Sequence locations=1-64,109-249,272-408,438-496
atgcggcgatgcaaaaataatctgacggacgaagaatatgaacggtaaaacaaaagttttgaccaaattttatcatttacaaaaaaataaataaataaaattaattttgatgattgtagacttttccctaaaagtgccgataaatatgtcttcccgacgaatacaaatggcatttgtgtaggacttggcaatcaaatggtaattattttaatggacatttatcaatctcagatcaccgggactttgggaaaataaatatgcaaattaaaagtgctacaaattagccgctttttcttttccattggcttttatttatcatttttagttccgttttgccgcattgtatggcattggaaaaccttatggacgaaagccaatttacaaggcttaccataaatgcacgtcggaagacgagcgagagaagcaaatgcttttcccggtgttcgccagccaagaaaaattttttgtaaaattttgaatcttcgcagttaataaa

SEQ ID NO: 73580 - DNA, 1892 bp, Heterodera glycines
  Genomic contig location: Contig_ID=SeqID_1442; Location=3429..5320; Strand=-
  SCN-specific regions: Sequence locations=1-183,205-301,323-337,366 -419,441-546,571-817,841-1204,1226-1332,1354-1778,1803-1892
atgatttttttgaagtttcttttgttcctgactttttttgcgccggctcccatccttggtttgtttaaggcgcttttaaacttccgacaaaatcttggggatgccaaagcttgtaataatgagattcaaatcactgagttaagggtccattgccataacggaaatgaaggtaattaaatctaaatttacaatacattttttaaatttaggcggatttcgcattgtcttagctacccatccaattttgtttggcaaggatttctccggcattttttactttgaaattttaatcaaaaaaatgcatcagtaaataaacagcatttattatcctaaagacaaatttttactaatttttaatttatttagttccccttacgctttactctccttcggattcaccgtaaaaaaggacaaaaaattgggagaaacaaacattttttatcttaatcgtggattttttatcattaatggcgtatggaagtgtcaacagttgattcttacacagaaaacgatattgtcggatgtggcattaatttggccacccgacagattttcttcaccaaaaacggacggcgtcagggtttgttattttggactttttgctcataaaaaacatatttattttgggatttttgtagtttttggcacatgttttggcgatttttgaaaaactcttttttttataaaaatttcttttttggtctcaagttcttggccaagtgcctaaaattttaaaattttctttaattgcattttttgactttaatgactttttcacttttatgtcaaaattataattttagcgaagaaaatcctgaaaaataagtaaatcttaaaaagcattgcaatgcttcagatttgagttatgctagtgaaatatataaaagaatgagatttttgagaaattaagtcattttttgagtaattttcaaattttggcacaaacttactcttttttttttgagtttttagcacataatttgggttttttggcacatataaatccgttcactgttaatgactcttgagaaattataataacaatttcaatagaccaaaaaaaaagaaaattaataaatgtggcaattgaataaaacaatttttccaaattatttcaaaaacaaaaatttgatgatttttgacaaaaaatttaatcagttaactataaattctcaatttttctattcgtactgacaattttaatattttcttagcaaaaattaacattttaaagcaaaagtttgtaaaaaaaaatttttggatgatttcttatgggcgtattttttgaagttttttaggctgattcttaggggtgaatttttcgttttttattgcttggaaacggtgttttcgtcaaaattttacaaaaaaatgtcaattaagcacaaaaagcattaaaatgttaaattaagcacaaaaattagatgctcagcattaagcacgaaaataacaaaaagttgaacctagaagtttcattataccaaattttgttttttatattttgtttttttacccaattatccctttgactattcaaaaaaaaaaaccgcaaatgattccttatttatcttacttatcccaggttcgttctattcggttgccaattcaccaaattctgttcccgaccaattgttcccattcgttactttttgggactttggtgatgaaatcgaggcgaactttgggcccaatttcaaattcaagcccggcctctcaaaacccggtcaacccggttaacccggtcaacccggatttccccaaaaatcgccgggccgggttgccgggcccgggaaaacccgggcccggcccggtcaggtctctaatattaatgttccttgatttcgaaattgacctgttgatttattttgccatagcctaatcttgttaataaa

SEQ ID NO: 73581 - DNA, 1958 bp, Heterodera glycines
  Genomic contig location: Contig_ID=SeqID_1443; Location=525..2482; Strand=-
  SCN-specific regions: Sequence locations=1-201,234-492,546-945,1012 -1192,1221-1354,1385-1661,1705-1787,1809-1880,1903-1958
tgaattcgaatggcacaacgaattccatcgatttgaatggcaccaaagggaatggtgcgaattccattcaataaaaaaataaatattttccagaattagcgcccacagatgttgaagaattgaatggaaagctcaaaaaaattgaacaaaatatgacaaaactgcagaacgagaatgtccgtcatatttttaattggaaacaaaaattaaaaaaattaaaatataaaattttaggaaaatttgcgggcgaaaaatgccgaattggaacaacaaaagcagcagacattaccagaagtggagaaattgaattattcgcaaaattggaatgatgttcaggtaaattcaaattaaaatacaaaaagcatttacatattttcagcccaaaaatcattggtgcctcaacaaatcggccagtgaatttttcatctttaagcccaattatttgaaagccgtacatcgtggagtagagaattgtatgtttaatggagaaagattaattaattaattacgtaataattaatttaaaatgatttaaagaaatttttcttcagctgcaaaacttttatttgcggaatttgtgctcgttccacactttggcattgtgtattatgagatcaaaatcataaggagacaagcgaccaaaagcgagtaagtaaagaaggtcaaataaatcactttaacctctaaatcagttttcctgttatttttgtgaaaaggaatttcgatcgaagaaggggtggggcgcgcacagaaaaaaaccgcggtcgcgcatcgcgcattcaaattgccgcggagtcccaaatgtcgcggatctcgcaaaaaaaaaaacagcggtcgcgcatcgcgcattcaaattgccgcggagtcccaaatgtcgcggatctcgcaaaaaaaaacagcggtcgcgcatcgcgcattcaaattgccgcggccagcggatcgttcattattaaaaatttttctaatttttaaaccattaaaaaaaatttttttcattttcttataaaaaatcagttaaaatcccgcatatacaaaatttgcgatgggactgaatggtggggggtggctcccattagaaataagcaaatcgtaaattcagttcatttgggatcagaaaatcagatttttaacaatttttttgcggcgcattttcccaaaaaagttctggggaatgggcaagaggagggggtccggtgccgggaaaattttttaaattttaatgcgatttgttaacagattttgtcagaaaatgaccaaattttgcctcaatcttatattttcttggtaaaatagtgattttatgagattatgacataattttccataaatctcttgctttttacaaaaacaatacttatttttaaataatattaaacataaaaaacaatcgcttcgataaatgatttttttaattggtccaaaattgccgcggagtcccaaatgtcgcggatcccgcaaaaaaaaaaaaaaattgcggtcgcgcatcgcggcgcggtcccagccctgaatcgaaggctaaagactcagggatttacaagaaaaaagcaaataaaaaattctatggacttcaagctttcgtttgttatcaagaatgtaggccttgatgaggtaagaaaaaagttatgacctaagcaactgaggatggtcattgactggacacgtattcttttggggaaatccccatttcattttaaaagtaaacttataaaagctaggtgattttaagaatctgacatcgtactagttaaattttaaatttttcaagcgctattcaaaaatagcataaattaataattttgcttttaagtacgataagcattggcctttggtctaaatcggccgggacacatcttaccgatattattgcgatggcactgtttatggtcacaatgccaatggcttcgagggatttccctcctttgatgagggcgacacggtcggattcggggccaatttga

SEQ ID NO: 73582 - DNA, 639 bp, Heterodera glycines
  Genomic contig location: Contig_ID=SeqID_1444; Location=314..952; Strand=-
  SCN-specific regions: Sequence locations=1-155,178-396,439-639
atgagcggaattgagcccttggacgggtccgttttgtcaagtggaaccaactgggcaatagtgaccaaacggtgggcagaaaatgccaaagaaagggcaaaagcaaacgcaattgtcggcttacaagcacgacaccaaaactaagaaaatgtaatggtgtaaatgatttgtgtgtttgttttacttctttgtgccggattggggcccaaacgcacgagcaacgattaagggtgatggcaatatgcagcacataaattggatattcgaaaaaatataccaaaaatgtgccaatgctgtaaagtgccgagggcgacgtgccgaaccatgggcaagtgggagcaaaaataggcaaccgatagaacacaacatcgacgacaaaatgggcaatttccttacatttatttaaaaaaataattaaatttataaaaaataaattatctgacccatgaattgaaatatcattaccaaaatgccaatgatgctcaaaaattggaagaacggtgaagaaaattcttttttagtgatcagaaaaaaaatgatgcgcagatacaacgggatggagacgagttcataaatggaataacacacaaaggaaaggacggacaacatttaacttaattaatttcataaataattaaa

SEQ ID NO: 73583 - DNA, 3495 bp, Heterodera glycines
  Genomic contig location: Contig_ID=SeqID_1446; Location=568..4062; Strand=-
  SCN-specific regions: Sequence locations=1-8,30-65,91-395,438-551,587- 678,704-754,778-905,927-1214,1237-1239,1262-1311,1333-1545,1567 -1742,1764-2136,2158-2280,2367-2419,2444-2610,2640-2903,2990 -3152,3176-3495
atggaaatggaaaatcaacagcaaaagggtaagggaaattggacaaggattactgtacgtaccgtaagattattattataattattgctactatcaaatatcatttggtacttttccgttttggggccaaaggttgaatttttttaaatcaaaagcgggtgagtagaacttgactagtatttgtgcgaattcctctggcgcgaaaatgtcaaaacccgtggcgcagacccttcatttgaagaaataatctaagctctaattgtggcatttatgccttcgaaaaattttggcgcgtaactttagcaattcttctcgcccgctgttgatttaaaaaaaaattcaaaatttggcccaaaaacggaaaagtacctatcatttttgcattaaatgcagtgaaaaaaatgtataacaataaataaaaaattaatttttttttagtttctctcgaccaaatcgaacatttgcaaaatgaacaaaagagaaaagacaatgcagtgaaaaaggagctgaaaaaaattcagatgaaaatggtaatgaaaaggggaaaaaagattaaaataatttaaaaaatgattttattatatttgaaaagttgctccccgtccccgaggtccccggcccccgactttttgcccccccgactccccgacactaattcgggaattggggactccgagcgttgtaaaaatttaaaaagttaattcaataatgaagggggaaaggttgaaaatttatgaaattttgaacaattttcttaatattaattaattaaaaattccgaaaaacttttcggcggcgcctatcggcaccgtcggcccaacaaaaccccaaatttttttttccaaaaattgtcccaaaattgcaaaaattggtatttttaggaaaaatctgttaacaaattgcaaattttcaagaaaaaattttcctcacgctcctaaagctcatcccccctttgaaaccccacccctttccacttatttttaaaccagggcttccatcgaaaaattttataaactccaagcccaaaataagattttagtatcaaaaatatgaacattttacaacatttttctatgttatttttccaatttattcgatcaaattttatattttttgtcttctattatcaattttgatattttggggaggaaaatgcaaaattataaatttcagtaaattcgggaccaaaagatcaaaaaattttgcggcagaccttaaaatttcttgaaaaatagtgacattatgccataaaatttcaaaactataagtatatttaagaaatcagaataattttagtcgctaccccaaaatcagaacattcttatacataaataagacaaatggaagcccaggtttaaaggccagcctggactcactcttactggcgctaacgaaatcagatgattaaagtgaaaaaagaagatttacgagcatttaaaaagaaaacatgctttttttggttaaaataaaatttggtcattccccgatcggggtccccgacccccgacaattgagctcctctcctcccccatatcgcctcccgaggtccccggcccccgacattttgccccccgaggggtcggggagcaaccctagaaaatactaaaattcaaaactttatggtgaattttaattttaaggcgcttttaaactcccgacaaaattattgggatggctacacttgtcactatgacctcgaaatcactggtttgaagatccattgtcatttaagtgcagaatcgggtgaataaactataatgaataatgaacacccgcttagaaatgggttaaatgatactttaattgtttcaattaaacttaaaccgtttccttgtcgcaaatttcataaaaaatttgtgaaaattttccgagcggtgccttcggcctgcccccccccccctgaaaaacgcagcgcaacaatttgtgtgagaagtaacataaaatcctcaagttttgataggtagatctcattagcaaatctgaccgccggtctttctccagccctcgggcccattcttcgtcagttttggaatttacgcaaatctggaactatttgctcatacttacctcgccgagacaaaacgatcgatataaagcggggcggggcgttcacaataattttttccgaagtaaaagggtttataaatttgtttttaatgtacccgatcttggcgctaccttcgctccccatacaatattgtttggcgaggattttttcagctttttttactttgcaatttttgttaaaaaaataccaaagtaccagcattatttcttaccataaaatacatttaatcaaaaaattcaataatattaataataaagaatatgtttttctattttgatattatttttaaattattttagatgcctacacagtcagatcacctttggattcgcccccataaagtggacaaaattggaaggaacaattgtctctaactttggcacttatgcatactcaaacaatggctcttttacaattgatggcaaatggatggatcagaaattagatgcttttcaagaaaacgatattgtcggatgtggcattaattcggccacccgacagattttcttcaccaaaaatggacggcgtcagggtttgttaacaaaataataattattataacaaattattacataaaacgccaattttgaagacaacttatctcaatatcatcaaaaaaccacaaataatttctcatttatcttatccccaggttccttctattcgctcgacagtttaccatcttatgttccagacgaattgttcccattcgtttctttgctaacaattggtaacgaaatcgaggcgaactttgggccacatttcaaattcaatttggccactctttgaagagagcagaaacaatggacgaaggcgataattttgaattcatttattaattattatttttgctctttgtttatttttaatttttgattttgtaactcgaattattattttatttgtttttaattttattttattaaaaaatgctcttgaattttttgtgtgttttatatatctgagaattttgtccattaatatagtgaatacaaatatgattcaacaaatttctgttatccaagcctctacatctttcagtccaagtttttggactataactttttttattctcaacgaaatcaaacaaaaattcaaaaatttcaacttttttgcaattattacgttataacttttttggtaattatttagtcgcgaatcaatagcttagaaacagcttaaaaacagtaagcttttgaatgatatcaagattgttggatggttgagaatgataaaagttatatccaaaaactttggctggcgcctaaatggcccctactccttctatgtattcttgatttagttgagacgagtcggaatttgttgcttaatggtctataatcccaatttataaaatatgacgtaaaattggacttttaacgggtaaacatacccactgaatttgtctatttgaaaaatttaataaa

SEQ ID NO: 73584 - DNA, 2190 bp, Heterodera glycines
  Genomic contig location: Contig_ID=SeqID_10391; Location=1251..3440; Strand=+
  SCN-specific regions: Sequence locations=1-194,232-332,354-435,457 -887,909-987,1009-1276,1298-1445,1468-2190
atgacaaaaatatgctattccgaaagcttttcattatggttggtgaacaatggcattttgctgaaaaatgcaaaatggagaaaattccttctccgcaagggtttcattaatcaggtcattttttagcaatttgttaattttatgacaacaaattataaggggggggggtaattaattaatttgtgtccgaaagcataaataataataaataaacttttaaatattttttaaggattgtccttttttcttagagttgactgtatgcttcaaaaatatgctaaaatttataaaattgcttattttaaaacaaaactgttaacaaaacaactaattttaaaaaatagacccaaaagtattttgggaaaatctgaaagcaaatcctcccaaatcgattaaaaatcgcgaatgttaaatcaaataatattttaagcttttgaattaggttttaaaggtgtccttttattttgtgcataaattttttttcatttcagtgatgtccttttgtggaatttttgatggaagcccggcttttaaatttatttttcgatttttggatttatttttatgtcttattttaggcgtcctcaatgcttttattttttaggctcaattcgatcagattaagccatcagaaaccgatttgaaatggtccgaaaagaattgtgaaaatgaattgggcattcaaaaagttatgaaactttttaccgacacacaatgtgaagtgcacttctcagtgatacaaaagctgattggcaaattcccgggtttgaccaaacctttcgccgacaaagcttgggcattaccacggtatcgaaattacggtaatgaattaaaaatagaaccaaaatatttttatttcttcgtaatttaagcgctatttaatgctgaagaacaaattgaattatacaaatttatttttaattcggacgagaaaacatctcacgaaacggagacgaaattggcaatgaaacagttaattggaatggcaaaagaaagggaggagagtctttttaaaaccccagaaattgcggacgaaattcgaaatgccaaaacgcagacttttacgatgatggcactatccgaaactttttgtccctccaaagaatggcccatggatcggatgctttgtccacttggacagtacgtccaatttttgagtgaaatggccaaaaatcggccgaaaatcgaatgggaggccccgatttggtgctttgcacatgatatcaacgaaattttcgcatgggtacgacaaattttatttggaaaacgggtcgaatttttcaaaaattatttgaaaagagagacaaacggaaaggacgacgaaatcatcagaattatacgagaaaagccgggtgcaattttgagactacacaactttgttcagcataaattaatcgaggaattgtggaaagacgagcaaatccgcgagaagctttacaatgtgaactgtaagtgaaacggacttactaattagcactaattaatgacgaataaaaggagttattcggtcgattggggtcaactgctgataactttttttttgccataagattgggtcaatttaattcttaagctgaaaatgcgtcagtggaaaaggcattattaagtattgttgactaaattcaaaattggttgcgttctgatttgataattcggtttttcagacattcaaaatttaacaaaattttttaaaattaccaaaatccactaaaaattctgattaattaacgcattttgcactgatgcttttccggtcattttttaaaaaatcattctgatttagtttttcatggcttttttagtcttctccaacaaatcgcgacttttgcacaattatcgccgtgcaatggccaaaagttcgtcgcccattgagcgcctcggcgcccgtttggccgctgacattgcggcgatggccaatcatttgtcggccaaattcccaaaagttcagccccatttgcgtgccgctctttcgtcgtgccaatcgttttctccgccatttgcatcaaattcgaatttgtcttccttttctgaactgctcgacgtcgtttgggttgaccttcgctttctttacgataagtcagacccaacaatttgtgatgaaagaatctacaaattgacaattatttttgtgagcaattatttatcgggtgtgttagtggctttggcaattagttagttaattaaaccata

SEQ ID NO: 73585 - DNA, 1258 bp, Heterodera glycines
  Genomic contig location: Contig_ID=SeqID_10392; Location=46..1303; Strand=+
  SCN-specific regions: Sequence locations=1-116,212-417,449-456,479 -787,822-893,917-1094,1116-1219,1255-1258
  Gene Ontology: Biological process=N-linked glycosylation
atgggcgacataaaaaaattatttgaaatgaacggaatcacatttaatgagagcggcgaatttattacagcaaatgaaattgaggaaaaaggaaaaaatatgcagcgaaatgaaacaaaaaaaggaaaaggaaagaaaaaaagaaaaacccaaaaaataaacaaaaaggaggcgaaagagaaaaaggaaaagcaaaaagaaaaagagaaaaaagcggaagaaaatttaatggaggaaaaagaaaaagcagaagaaaaaacaactgaaaaactggaagaaaattcaccagaaaatgagaaggaattggaaaagatgaaagtaaaaagtggaaaaaacggaaacaaaaaatcaccagaatttgttttattggagggaaatccaacggaatttgtggaaaaagtgagttttaattgattcaaaatttataaagaataattaattatatttagcataaagattttattgtgatcaattgtgtggccgagcagaaaagtgattatgaaaaattttgcaattttattcgaggaaaaattcgatcgaaaatgaataatttaatggacaaaattggaatgaaaaattcaaaagaaattgaaatttgtgaaatagacacggaaattaacagagaagaaacatttaaaattgtgggcgaattggtccaccgggaattcaggtgaccaattattgttcgggttaattaattaaggtggtgaggggataaatgatcatgatttagcgttttgagtaattaattagtgaaggggtagtaattcataagcattttgtggagatattaattataattaatttaattattatttattggcggcataacttgcaattttaattctctctattttgagaagtttttgagaggtaattaatgcaaatgaattaatttaatttggttcccaaaaaacacaattattaatttgttcaaattttagcattaattttggcaaagtttggctttttggcattaaaataccagcgaatggcaacgaaaaattgaaggaacacttgaggaacttcgatattgaaatgaaaatggaatatttgcagcagttgggccttttgtctgttgaaatggacgaaacggaaataattaacgaattccaaaaattgggtgccaatgttttgtcgacggtggcgaaaaaatggtttttgatggacattttggaggagaaataataatcaatgaatgattggattgattcatttgtttttatttatttttgaaaattttttctaaattttctaa

SEQ ID NO: 73586 - DNA, 57 bp, Heterodera glycines
  Genomic contig location: Contig_ID=SeqID_10392; Location=1410..1466; Strand=-
  SCN-specific regions: Sequence locations=1-57
gtattacaattatgatttggtgaaaaatatgagaatgtctgatttgggttgaataaa

SEQ ID NO: 73587 - DNA, 2897 bp, Heterodera glycines
  Genomic contig location: Contig_ID=SeqID_10393; Location=175..3071; Strand=-
  SCN-specific regions: Sequence locations=1-70,190-206,233-460,483 -1693,1729-1862,1884-1944,1966-2182,2220-2655,2677-2751,2775-2897
  Gene Ontology: Mol. function=structural constituent of epidermis; Cellular component=intermediate filament; Biological process =epidermal differentiation
atgtacggaaacgtcggcggtgtgagcgcagttagtcgacctgccggcggaggcggtgcaggtggtcacagtgctggtggaggaggttacggcggtggaggtggtaacagtgctggtggaggaggttacggcggtggaggtggtcacagtgctggtggaggaggttacggcggtggaggtggtggcggttaccgaactggcggatacactggcggaggcggtggcggcggttaccgtggcccgcgtactggcggcaacgcggcggttggtgcgccctttcgtaggggcggcaagccccagcgaccaaagaaggaattcgtttacaccgatgaaatgcgggcattttacaatggctttgagtgagtaaccaaaatggaattttgaatgtcactatcatttcatcgttgcgttttttagtcccggacgtcgcgaacgaaagctcacagcaccgcccgttgagcttatttcagcttcttttaaaccaggagaagttatacaaggtttatttgcaattaactggctcatttgtttaaactaagctaaatgcttttttaggtgatgtcataatgtcatatttgagggacagattgaatcaggaagagccgaaattggacgttcatttggatggcggtgaatctgaggagccgaaaatggaagttcatttagatggcggtaagccgggggagtcagaattgacgtttatttttagccgaaaaagacgttcatttagacggcgttgaattagaggagccgaaaatggacgttcatctgaatgatggtgaatctgaggagccgaaaatggacgttcatctgaatgatggtgaatcggaggagccgaaaatggacgttcatctgaatgatggtgaatctgaggagccgaaaatggacgttcatctgaatgatggtgaatcggaggagccgaagatggacgttcatatgaatggcggtgaatcggaggagccgaagatggacgttcatttgaatgatggtaagccgggggagtcagaatttgacgtttattttgagccgaaaaagacgttcatttagacggcgttgaatttgaggagccgaaattggacgtgcatttggacgatggtaaaccggagtcgaaattggagacacaactcggtggtgagtcgccttggcattggacttcctatttttggatcattgatctttttcatttgcccatcattcgtttccattgtttttcttagacattcctcgctgtgtgagtggggctgccaacgtcgagctgcttgtgtctattctggccgagttgggccttactctcaccaattttgcggccaagatcaaagaccagttggaacaaatgaactgattgtgagcgggtattcggcagtcccaacccaattttctgatttatatccgaacggtggtcccatattcaatcatttattttttgcttttctttcccgatccatttcaatttttggtctcttgtggtgcatttttgccgtcttaatgttgaacaattcaaaattctctattggcagtactttttggacaattagttcgacaaataaatgcatccacaagtaaatggtgatttttccctcttttccgcaatattccgccaccatttccaacaatgaatctctcctctattcgccgtattttcacaagatatcatttgaatttggtagaattttcgtcatttctattagtttcctaaattctttcttttttcaaaattagccaaagtggaattcaggtatgctttcaatgagtatttctaccctggtcaggctccaattcttgaaatttaggcttggtccagtttttcgactaatgatgaatgaacatccttattgagaaaaaaacatatcttattttgcgtatttatttatctgttaatagagaaaacgcgatttttctaaatgaatttatttttgtctatagtcaaattcaaaattttgacaattttttctgttataaaaaatcgtgaaaacacgttttatggggtctttagggtcgttaatctcgaatctaacattccttttgatcaaattcgaatcccggatccgaactcgaacaaaaaagtcgaaaattcaaaagtttcaaaattcacttttatgttcgtacctgtacacaatgaccattttttgatgttgcaatggttttgggtacttattgggtttacggtatacttttaacacacatttttaaatgaaaaaattttaattttagaaattaatgaaataagtgttaagggattttcgaagtcgctaatcacgaattcgggctctgaccagcgctaccattcatcacatcagggacaatgaatttacaggcttcctgtaccaagggtaccctcatctaccatccatggttcgacccaaaaactcgaaaattttcgactttttgttcgagttcgggtcaggggtccgaaattggcaaaaacggatgttgtaatcggcagtattaccaatgtggtcaaccaagtgagagattgtcaaaaatttgatgatcctgctgctggattaaactcaaattttatcaaaacaaaaagaaaagacgaaatacagtaattgcatggggaggcacggtcccccagggtttcggcttgcgggcggggcaccgtcgccacccccagtattttgggctctaatgcagccaaaaaaaattactgtcttttttaaaacaaatttgattagaaggacctgtagttccgataggaatcaccgggaaatattcacggagaacagtaggaattggttttttaccgtacccccccccccccgccccccgggaccgtccgtctccgcgtaactgcccaccccaattgttgcaattcagaagttaaatgtgaaataccgttatattcattgatgaagaaagaagggatttaggaccaaagacaaattggcaataaa

SEQ ID NO: 73588 - DNA, 285 bp, Heterodera glycines
  Genomic contig location: Contig_ID=SeqID_10393; Location=2781..3065; Strand=+
  SCN-specific regions: Sequence locations=1-59,86-102,222-285
  Gene Ontology: Mol. function=protein binding; Cellular component =cytoplasm; Biological process=response to pathogenic bacteria
gccgcccctacgaaagggcgcaccaaccgccgcgttgccgccagtacgcgggccacggtaaccgccgccaccgcctccgccagtgtatccgccagttcggtaaccgccaccacctccaccgccgtaacctcctccaccagcactgtgaccacctccaccgccgtaacctcctccaccagcactgttaccacctccaccgccgtaacctcctccaccagcactgtgaccacctgcaccgcctccgccggcaggtcgactaactgcgctcacaccgccgacgtttcc

SEQ ID NO: 73589 - DNA, 1420 bp, Heterodera glycines
  Genomic contig location: Contig_ID=SeqID_10395; Location=321..1740; Strand=+
  SCN-specific regions: Sequence locations=1-24,47-217,239-879,901 -1328,1414-1420
atgggcgagaataaaggacaatttgcactgattgggggtgggggtgagtcagaagaaaatgtttcttcggcttctccttttcgggagaatgaatcattcgtttgtcaaaggaccaccaatttgataggtgaagattaattgctgattatttcattcgttttgccattttctttggcttaattaatcaatggcactttcgccacacattcactaattacccaaatgctttgttttgccacctcaaaatgttttcctcaaagcttcgaccaattcaaaagccgatcagtttcactgatcttcatctttttgctgacgattcatcttttatttgcggaaattgcttcggaaaagtcatcaaaagaaacatttaaagatgtaaccaccaaaaatgagttaattaactgattttaggcagtggaaagtaaaggggagaggacaatgagccgaggggggggggggtaatcacaaaattgggcttagtggcattttctaattttgctcctatcctcgacaaaactccaaaattatttacttttaaactaatcaccgctaattggccaatttgaaacaataattaccttttacagtctctggtgcaaaattcgccaaaaagcgacctcaactttctattccaacaacggagcactcagaaaacagctttcatcagacatcattatgcttcttccgtagcaaatggccaatctggacaacattctcggcaccggcgacggatacccaccggaattattggcaaattaattgccaaattaagcggaaagacgggaaaaattgcagcgactgcaagcaaaagcgatgatatttttgttgggaccgcaaagggtaaaatgaagcctcaaaagggtatgtctgtctcaccaattccccattatttccaaagttggacgaattccaaaccgcgggacagcgcccggacgcttttacaaatcgcgcgggttcgaccccccgccctttgtctcttacgcggcccccgcaggaagcgaagtggccaaaaggacgagggcaaatgcactgacggggacaaaagtggcattggccgccgcgggagtcggcacgggcatttggtactttggagcggagaatgccggtgggaaagggacgaagccaatgtttttggcaaattaaatttgaaagcaatccctttttatttttttttagctctttacgtcgcatttatcgtcggaggagtgctcatcgttttgattttggcactttctctgcttttttatttgtttttgtgccgaaaacggaaaaagggatattatgcggtcaatgagcaattggcttcggcatttgccaagaaagtgctcttttatttgttctgttgatttttcatttttgacaatatctctacatataatttcttttttattatttttttattaatttattttttcaataa

SEQ ID NO: 73590 - DNA, 1301 bp, Heterodera glycines
  Genomic contig location: Contig_ID=SeqID_10395; Location=1757..3057; Strand=-
  SCN-specific regions: Sequence locations=1-104,132-946,982-1216,1238 -1301
atgtccaaaatccacgacttttgcggcgacgaattgccggctcagctaatgtccgcaaagaatgtgctcactctcacttacgtgctcaaaagtgccttcttcgctcaaaacccaacacaaaacactcgaaaatgggcgggcgattggcgacttcgcgagagagacgaaacggaagacgaacactttggatgggtgggaacgggaagggggggggggggaattaatgggagggtaattaatttggtggcacagattgccgaatatcgcttcatcaaagatttcggggcgcagccaatcgaagcgattgcttcggctgatgacggatcaagtgagttttatctttaaatcagctaattaacacccaactaaaacaattgactgaagaaggatgttcctttgtgttcaacggcacaataaaaaagacgggaaatgtttggagtcctaattacccgggtaattaacacggccgattggccattgccatgttcccacatttaccgactcattttgaggcttttacccccgtaacgtcgactgccaatacgttttcatcggaaggccgggccaaaaggtgtacatcactttcgagttggtcgcccaccaattaacactaattgatcattaatttgttcgcttttcctttttcactccttcttaaggtatttcgatgtcgaaggcttcggacagtaaaaagaaaagcgattaatggacaaaaatgcgaatgttttgtttcagttgcgaggagtccacccaaagtgattttgtgctgtttagcaactacaaaacccgggacaggtcattagcaaaaggaccattttgccaatttggacactttcgttgccttaaggacaaatcgtcgcttctgcggccaattgaggccaaaaggcgccgttcaaagcgaatcgaattatttccgaatgcaatttcatacgaatggtaatgtttctatatataataataattaaaatacatttttttaatgtttttcatttttcagcgttttttccttttttcatctgatatttaagtattcaaaattacaaatgataattcttttttccttaagctattttcgatggcactggtttctatgcccgttaccaatttttgcacgaaagttcgttaaattttcccggcttaatttgtaaaatgtttttgtagaacccttaaaaagtcgcgtaaaattggcaccaaccggcggaggagcgaaagggggacgaacttggacaaaaaataacacaattattctatcaatcctatttttacttacgttttggtgattttttggaaacaaaaataaa

SEQ ID NO: 73591 - DNA, 1004 bp, Heterodera glycines
  Genomic contig location: Contig_ID=SeqID_10396; Location=1841..2844; Strand=+
  SCN-specific regions: Sequence locations=1-117,139-171,300-331,364 -452,506-847,884-1004
atgataatattacatttgttccttttcctttcatcaattttatgctgttttggcacaaatggagtgcaaagaaatgaacaccaaaatgttgctgaggttcaattgaacgtaattaaatttaaccataattgtcataaagtatatctcactaatttgactaagacatgaagtgagagagagagaatggttaagagtgaaagaaagagagagactgagacagagtgatatgagggtgagatgagagagagagagcgagagagagagagagcgacagagagagtgagagagagagagagagaaattgataaagaaattttttaattgggctttcatgcataatttaaaaataaatatgtatgtatttagaatgtaattgatcctaatgacttgtcatcacctgggaactttgttgaagacgaccacccgccgaagttctttcgcatggacatgagtaaataaaattttgaatttaagataaatatatttatttatttatttaaaataacatcaggtcgataaaaattttttctagagttcttaaattattaagaattattgggtcttgaaaaatccaatcccatgcctaattaaaatcttactatacctgcaatctttgtattaatggaatatacatattgaaatttaaaattttcttagataacacattgccaaaaacttttgctgaagagccattacaaagaaaacggcgagcaccagaaaaatatgggacaggaaagaataagcaggcgcaaaaggacaagtaattagtaggggtgccaaaaatatgtacaaaatatgtaagaaaaatcgcgaaatatgtacaaaaaaccacaaataccgaaaatggaaaaatttttcaaaatattaaaaaattcaaaattttgaaacgcaaaatatcatatttctatttcaacattttgggcttttataaatttctttgtaaatattttggcatttttcgaatttttcatgtaaaatttcagaaactttttaacaaaaatgca

SEQ ID NO: 73592 - DNA, 208 bp, Heterodera glycines
  Genomic contig location: Contig_ID=SeqID_10396; Location=3434..3641; Strand=+
  SCN-specific regions: Sequence locations=1-124,146-208
atgagtaatctcgatcaaaataggacaataattttgatcaaattgagaaatggccaagacaagcgaacaagttccaactacatggaccttgaaagtccgggatctgccctgtcttctgtacgacgatctgacagtgggaaaagcccgaaaaaagtgccaagatttgccgaaagtccggcatcatcatctcgatcgtcagctcttgggc

SEQ ID NO: 73593 - DNA, 526 bp, Heterodera glycines
  Genomic contig location: Contig_ID=SeqID_10398; Location=545..1070; Strand=+
  SCN-specific regions: Sequence locations=1-118,160-431,453-526
atgtttcgaatcccgaacccgaattcggacaaatttcttgactttttaatttttttatttcttgcggctagtatcttctacagtaatttgtcagtttggtcggatgtgcgtcaaacggaaaaaataattaaaattttataaaaatataacaaaaaataacaaatttcagaacaaactaaggtcgcatttcatagtttcgggaaacaccagtgagaaaattgataatgttttcgggattcacattggcattggcataattgtgatcattttgggggaggtgattgttattgatgtcgttatagagtgcgccgtcatgttctaacttaactttgtttcgttttgttttaattttttgctgctggtccatattatataatttaaatgggtcggggtcacttcggcgcggaccatttcggcgccgcaaattttgaaatgctataacttttttatttgtcagttaactttagccaatctggcatcatttgaaagctctatgtgtgctctatattcacatgtcaaaatagaa

SEQ ID NO: 73594 - DNA, 377 bp, Heterodera glycines
  Genomic contig location: Contig_ID=SeqID_10399; Location=100..476; Strand=+
  SCN-specific regions: Sequence locations=1-377
atgaaccgacggtaatgaattttaaaagtcacaaattcgtcgtttatttgactaaactgttttcccatttcagttggatttgcaacgacgtttggatggacattttcccctcttttgaccgtcctcaacttggcctcaaattggcacttctttcgccacgttttaattcgctggtggacaaatattttgatggcaaaagcgaattgccaatttggagacaaatcgtaattcgtcgcaagggcattggaccagaaatgaaactttatgtagagatggattacgtatttgtgccatttccattgcccgaccgtccgttgcccagcaaaatccgttttgaatggcttcagattgagtaattaaaaaacagttttatggca

SEQ ID NO: 73595 - DNA, 2431 bp, Heterodera glycines
  misc_feature (35)..(35): n is a, c, g, or t
  Genomic contig location: Contig_ID=SeqID_10400; Location=11..2441; Strand=+
  SCN-specific regions: Sequence locations=1-611,633-961,998-1148,1170 -1280,1355-1356,1379-1439,1464-2431
atgccggaccgtccgttgcccagcaaaatccgttntaagaatcttcggattgggtaaatcaaaatcagagagctatgacaataaaagctttccttccatttttaggtacactgatcactccgtcatcgcttttcttcgttcaaatcatcaaattttcgacaaaagaggcaccaatttacacttgcggattcaatcatcacacaccacggaaggccagcggatttgggacatttttgttcgtgaaatttggccaattttttctgaaaacattcgccacttgggctttccccatggtgatcagttggaccatttgcttcgtcaaatttcgccgacaattctcatcgatcttaaccaattggtttcaatccattcatttggtctgtcgcccgctgcgtttggtgatgattttgatgggccaaattcaacaatttctgctggccaagcattgtccaaatggttgcactctccgagaaacgatggacaacccaagcgattgcgttgcgtagattacaacaaacaaacggacttagattgggtcaacaatttcaaggaggtgtggccccacattttcaacaaatcactgatatttgttcctatcgaattgtttagcattttcttcgtgccaatgccatttcttccgtcagttaccaaattcttttttctgttcgtgtgccgtcaatacaaatggtgccgtttgaattggtgaacgaattgacaaaggaaaagctgacattgaccaaagcaaatgaaaatgactgggagaattggataatgaagcgatgcaaaattggagaggccgcggatgttcagcttcagaaagatgaaaattggggcaacaattttaacaatgtggccatttggcttttcagtactgattgcattgggtgagcaattaaaaaaaacatttagttttgttaaataattcaaatttcgcttaattaaggccattgtctccgccatcagcagaagaagaacaagaagcgggacaaaacagcgaaaaagtgtcgtcttctgctgacaattagtgacggacaaacgaacaaaaacggaacggtgatcagccgcagaagaagaaatgaattaattaagaaaataatggaccaatcataattgattagtgataaaatgtatatttataaaaaaaacctctcaaatatattttaaaaattcggattaaaaaccgcaaaatatgtaggttttatgctctaaaaaaccctaaaaataggttctaaaaggaaaataggctctaaaaagtctcaaatttaggtgtgtaaaatgacaaaatttattcaaaaaagtaaaaaaattaggaaaaatttttaaaaacaaaaattctttttaaaaaataaaatttggaaatgaatttttgagaaaattttaattgcttaagggcgtatttataaaatcaaaaataggttctttcggaatttttttaggcatttaggatttaaaaataaaaacctaatagtcactaataactagggaaccgatttctagtgaaaaaactttttttttttgctcaattgttttgaagaaaggagctcaaaaacgcatttctgcgttaaaattttttcatttggacgtcatttttcgtcactagaaatcactattttggcgtttcgtcacttaaaatagtgaaaattcacttttttggctttttgtcactattttttcactttttcgacattttttggaaaatttgttaacaaaaatgcaataaaaacaaaaaatacacccctaagaatcgacctaaaaatttttcaaaaaataccagttagaattggaaaattttcataaaaatttttcccccaaatttttcttacaaaatttttggtttaaaaatttcaatatttgctaaaaaaaaatgtaagaaaggaatgtaaagatttttttgctcaatttttggctgaaaattatgtcactattcgtcactattttggacttttttcactattttggcactttttcgtcactattttagttaactatttcgggatttttcgtcataaagttggttccctactaataactagtgatgctcgagagcaaaaatttcccgagaccgagacttgaccccgagactcgagaccgattccgaacttgaccccgagactcgataccgagacccaaaaaacccaagacttatctgatcaaggaggctgcagatgatgaagcgaaagtgttctacttaaaattagttccttttttgttcaaccttgttaacatatgcgtggcccattcttggttctgttccttacagatccagcagcctgaaccgatccaagcacaaaatttgccagccgaacccgacgaactgagcccacaaacgccgaaaaccgtccgttgttccccaactccacgtccagtccgtgaacggcgtccggttgttcgttactcacccgaacccgtggcaagacgaaaacggaaatga

SEQ ID NO: 73596 - DNA, 702 bp, Heterodera glycines
  Genomic contig location: Contig_ID=SeqID_10402; Location=862..1563; Strand=-
  SCN-specific regions: Sequence locations=1-348,371-702
atggaaaataaacagcccgagcaaagtgtggaagttgcaccagcgaaccccggcgaggaattgtcggaagcgaatgcgacggaggaggcattgttggcaccggaagaagaggcaaaaacggcaccaatgccggcggaaagtgaagtagccacacagtctgaagagaaggagaacgtgccggaccaccacccggaggagttgaactcttgtgccatggaatcgactcggctcattccgcccaccaatcacttttttggttcgttcattatgaatattataattcttttttgcttttttccagcacaatattgcgctgaattggttgggagactgctcgagaaaacttcgcagaaggatggcttccatctgcgcaaagaattgaatgggatcatgacgaaatatgaggccatgaccatcggcaaataagaaatttctcttccgttctctatttttttcttttttttacgaatgcataaaaagatgaaaactgcgaattgacttagcaaaaatacttcactattttccttaaaaatatgtgaaagtatactaaaaaatattgagtaaaatccaacgttcgcagttaacgtttttcacagtcttttgcgtccaaacttcacatattgaaagaaaaaaaatcgtcgttgacttgcttttggacttatcccaaaaatgataaatatggtttttattgaattaattaaa

SEQ ID NO: 73597 - DNA, 290 bp, Heterodera glycines
  Genomic contig location: Contig_ID=SeqID_10402; Location=1654..1943; Strand=-
  SCN-specific regions: Sequence locations=1-290
cacaatggcaccggcactaacattggttccggcactggcaacagtcacaatggcaccggcactttagccttgaggcgcccgtgggggtgtccgccgctggtccgaaacgtggacagacgccggccgcgtaggtcaaggaaacgcacccgtggcccctacagcgacaattccgacggatcggcattcactctttttcatggaatgcatggtagttttgatacttggggcactgcgggcattgacgaatgggaccaatcggcacagagtgtacacaattacggcatggttgg

SEQ ID NO: 73598 - DNA, 2167 bp, Heterodera glycines
  misc_feature (1925)..(1925): n is a, c, g, or t
  Genomic contig location: Contig_ID=SeqID_10404; Location=110..2276; Strand=+
  SCN-specific regions: Sequence locations=1-73,95-288,326-356,378 -405,438-456,521-1160,1182-1301,1324-1412,1446-2167
  Gene Ontology: Mol. function=helicase activity; Cellular component =mitochondrion; Biological process=growth
atgattacgggtgaaaatcgtctctttgccgttgactcggacaacccatccgcccacacttcagcaaccatcgagataatgtccccagagcatagaattgaactttgtgtcatcgacgagatccaaatgctcagagacccacaaagaggtgctgcttggacaagagcactgatgggagcgcctgcggatgaggtaagaaattgggacgtaatcgtttttaaaaacatttttcctttgcgatttatcgggtttaatcaattttttttagttatttacagtacgaataaatttcttttttaaacaaaaattttcgaggttttagttcaaagacttaaaaaagacgatttccttttctgcatagctttttaaagaaaaaacatagaaacagtattatttctagagaccgagatttcatttatttattttttgcctattttaaaagaaaaactatccttcattttttaatctaaaaaatgattttttaaattatttagttatattatacattaattaaaatttactgatttttgtgtggaaactgcccgccattgaaaaactcgtttgactggcttggagaagccggatccagactggttgaaaacagcagtttccgggtccggcctctaaaaaatcagtcaaaccgggtttatatattttcggttttctccaagtctatacccatatgcttgttttactatattcagattcatctttgtggtgaagaatccgcttatgatatcgtctgtcgtttgctggaccctattggtgaacatgttgaccttcgtcgatatgaacgcaagggcaagttggtcgtgatcgtaacccacggacttcgtgatctgagctcaacaaaggtcgtaatattttttcattgtgttatttaattcaaattaatccatttatgtttaggatggtgattgtgtgatacatttttcgaaaaaaggcattctcgacatggcacgccgattgaaatttgaatacaaaaaagaatgtgctattgtatttggagatttgccccccgaggttaagcgagaacaagtcaaacggttcaacgaccagaacgacccgtgcaaaattctgcttgcaaccgatgcaattggaatgggaatgaacttgaacatcaaaaggtcgcttttctttttaaattgcatgggtcaattaatctttgatatttttcagagtgattttcacaacattgaaaagtcgtgatggctctttgctccccgcgtatttcgtaaaacaaattgccggcagagctggcagatacgcgtcagcatattgcaccggcgaagcgatggcgttggatgatgctgatgctggactgctcgagaagctgatgaatgaaccaattgattccattgaccaggccggcattttgccttcattcgaccaaattgaggtgagtccacgctctttttcattcatttattcagaaccctttaataatccattgaagatgttttcctttcacttgccccaatattcgctgactcaactgctcgacatattcgtttcaatttgcacagttagcgaaaagtactttctgtgtttgaatgactcaattaaacaaattgcgcaactcattgaacacatccaactttcacttagggttctcttctcatcatacaatatttataacaattttcagcaattaaggaacgttacattttctgcctcaccccaatcccttccggtgctcacccctttcttaactcggcttttatcaaaatggtccgacgttattctgagggcaatgcaataactttcgcatggatccgtcctttggttttgcctgagttgcgaattgtcgacagagtcgacgcggtcaatcgacttgttgacgtttacgactttatgggcgcgtacctttggcttagctatcgttttgaggtaacccttatttgaatagcaatctttacaatgtnttctcaatatttaggaacatttttccgaccgagacaaagtccgcgagttgcaacgagaatgtgtgggatttattcagaaaagcatggacaaaatgttatctgagtatggagaggaggaggcaaagggagcgccgcgcaagggaaaaaggagggaaaacagcgattcggagtacgaattgagggcgatgggactgcacaggaacagctcgaaaaggcatgacgacactgtttccaaagtggta

SEQ ID NO: 73599 - DNA, 1259 bp, Heterodera glycines
  misc_feature (1234)..(1234): n is a, c, g, or t
  Genomic contig location: Contig_ID=SeqID_10405; Location=1..1259; Strand=-
  SCN-specific regions: Sequence locations=1-25,49-330,381-499,539 -1191,1213-1259
  Gene Ontology: Mol. function=methylenetetrahydrofolate dehydrogenase (NADP+) activity; Cellular component=mitochondrion; Biological process=purine base biosynthesis
cccgtgcccactgacattgacatttcccgggcacaacagcccaaggcgatcggtcgtctggcggccgaagttggcattgcccagtccgagttggagctgtacgggcacagcaaagccaaagtgtcgttggcagtgctcaaccgtctcaaggagcgcccgaatggaatgttaggccaacaacaaccatttttggcacatggcttcgtcctcttaggcctagcatagcccccactttttgataattctcgattttgctgccgtaaattaccgtaggcacagggggtttgcctgaaaatttcggcgccaaaaaatgccggaaaacggagagcgaaattttaatttattttttattttcctaaaaaaatatattttttttaattgagtatctaaatttcatatttattttgctgcgctattttttcaaattttttgaagagcggaaggtccggcgggggctttgaacttatttatgaaaattaaaaatccggcattttgatggaatttttaaaaatattctaaaaatttaaaatcattttttgtctccaaactcttcactaaataatttaaattctcgaggacgagtcagtcttgctgtgcttaaccaaaaacctaaaacattatccaaatccccttcctctgtttgaaggtatgtcgtcgtggccggcatcaatccgactccgttgggcgaaggcaaatccaccaccaccgttggactgtatgtatagtatacgatacagcactaaatatttccgtatttactaagtgtggttacggtattccggagccgggttaccgcccgaatcccggaactgagacccgaaaacccgacatttttatcgtctcgaaccctggcctggttttttggccatcccgacctatattagtctcgtcccgaattccggccctggccctaacttttgatggcacccccagttggatgtgatttcgttagtaatgccaaaattgtcagcctgttcgatcattgatactaccgtatttttctcagttagtgcccccggggcggcgctcaattagaaaaattattacagtattccatccacaaacacaccttttcaacgctccattttttaattggctgctttaagtgcgcaaagcttgtgcgcccatttgggtcgcaacactttcgcgtgcatgcgccaaccgtcgcaggggccaacctttggcatcaaaggcggcgccgcgggcggcggctactcacaggtggctgccatgnggggaggcattaagggggggggggg

SEQ ID NO: 73600 - DNA, 178 bp, Heterodera glycines
  Genomic contig location: Contig_ID=SeqID_10406; Location=194..371; Strand=-
  SCN-specific regions: Sequence locations=1-178
  Gene Ontology: Cellular component=extracellular space; Biological process=coenzymes and prosthetic group metabolism
cgggatcaacgtggtgcaaagcgatggtgaaaagcgtcacctggtgggcgatgtgaattttgaggaggccaaggcggtggccggctttctgacgcctgtgcccggcggcgttggcccaatgaccgtggcaatgctcgtccgcaacaccttcctccaggcggtgtgccaaaaactgaac

SEQ ID NO: 73601 - DNA, 665 bp, Heterodera glycines
  Genomic contig location: Contig_ID=SeqID_10408; Location=674..1338; Strand=+
  SCN-specific regions: Sequence locations=1-235,338-665
atgttccgcatttttggccgtttcgtcggcacttatcccatcgcatttctgatcttctcattgatccttgcttcgctgtcaggttgagcaaagttgcaaaaaatggaggccgaaatttagaaaataaaatggaaaattatagtttgcttaggttcatttcgctcatattaaaattcaaaaaatattcgattttttggaatttgagataataaattccatttcttttctatgaatctatttattttttaaaacatttttaaatattctcgaatatatacatacaaatttttaatttaatggaagattttttaaaaattcaataaatttaatttttatagaaaattctagattccgagccattgaaaaagcctatacctggacctgggttccatgttgacctggacctggatttcctgggaaaaaattttgaataatccatgtccatgaaaaatcctgccaaaaaatgcttggacctggacctgtttccagaaaaattcagacctgggtccaggacgaaaccgagaaaattcgcattttccaacccgccatttcctccttttcatggcatccggtatgaatttttgcgactttttattgtcaatttttaaagcaaatgaaattttttgcctaaattttgaaggcctttttattgttttactagcaaa

SEQ ID NO: 73602 - DNA, 715 bp, Heterodera glycines
  Genomic contig location: Contig_ID=SeqID_10408; Location=1685..2399; Strand=-
  SCN-specific regions: Sequence locations=1-77,101-326,351-715
atgccgggggaaacggtgccaaaaccgtacccatcacaaagtattggaccagagggataattgtggattttgagcaatagaaatttattttattttttacgagaaattatgaatatggcgaggaccctaattcgagggtaactttggatttagtcatcattccgctcaaaaagtttgaaagaaatgcggaataatgcatagagattcccgaaaatatgcatttttggttacggtcaatgcaaaagcctgcctgcccctaatttactaatgaaaacgggttcaaaattgggatatggaacccgaaaataggggagttttagtcatagtttattttttaatttaaagaattagcctattcaaagaaaatccaatttgctggattttggggaccatggctaactttaaaaatgcggccgaatttacattaaaatgctgccaaattttttgtggatttcggggccattggcatttgggtgaaatttaatttgtcatattttggcactttttagctgctttttcacctgtcccccaacggtggcggaaatgttcaggcgcaaaaagtcgtgcatccgaacgcattcgtccagccaacggagccggtgcatgctgtgccggtcgcgcgctcgcagcatcactgtggtcagcaggggatcgcctggggcattttgtgtaaaattttaaaatgagaaaaaagggtaaaaaatattttaataaa

SEQ ID NO: 73603 - DNA, 2072 bp, Heterodera glycines
  Genomic contig location: Contig_ID=SeqID_10409; Location=522..2593; Strand=+
  SCN-specific regions: Sequence locations=1-1425,1448-2072
atgagatggctcttcgtgagcatcctcgtttttgggcagccaagcaattccctggaactgtggaacaagtacaaagaccaaatgtacaatccacagggcattatcagtgcggctatacgccaagcacgggagcaagaagcgctagccgacattgattggcgattgcacttctttaactcaagctgcttgcactgtggcctcccagatccaccaaattcaaaagccaaaaatatcaatttggcagttgaagaagctttctttggtgatgatgatctgaatatgtcgcctggccagcaaaatcctaggcagcagcaaaacgctccacctccactcaacagcgaccaacaaacggtctttgatgctgttgttaaggcaattcagtcggacccaagggatccgactgtgcctcgccgtttcttcattttcggcgatggaggtacaggaaaaacattcctgtttggccaaattatcaaccgcttgcgcaagcccccatacacctataaagtgcttgctacggcatccactggctgtgcggctattttgctgccatatgggaaaacagctcattccacgttccgtctcggcagagaagtctcgctagacaagcttccaagcattccgcttgaaagcttctttgctcgacggatacgtgaggcccagctcatcatcattgatgagatcaccatgcttcataacacggtgattgcggtaatcgaccgagtgtgcaaagaaatggcaattcgccagcacaaggacctcctcttcggaggaaaaacggtcatttttagcggtgacttcaaacagtcactgccggtcgtgcctcatgaaggcttacccgctcaggtgacagcctgttttcaaacatctccgttgtttggacagttcaccacgatgaaattgaccatcaaccagagattgggccaaggccagcaagcgtacttgcaaatgtgccgccaaatcggccttggagagaccggagaacacttctggattcctccgcagttcctcgtaaagagcagggaagagttgatagactttgtctatcccgacttccaaaaactccttggaaatgacaaggaactgctcaatcgtctgatcctcgcacctcacattgacacgtgcgatgagatcaacgaaatcatgatggcgaatgtgcctggtcaagtgcgcgaatatttgtcttcggacaagccgcttgacgagcgtccactggacatcgatgaaattgagtcggaagtggcagcgttgaaccggcgcacagactctgggatgcctccccaccgtctgcgacttaaggtcggaagcgtcgttgttctacttatcaacaaaagtgataaggaaggactgatcaacggcacacgcatcgttcttgaagaacttggcgacgatcgtctggtcggtcgcgtcattaacagcaacgctgttggtggccaggttaagttcttcatcgaaagaacacgaaatgtctacgaggacaaaacgcctggcggcttaaaatatgagcgtttgcagtttcccatcaaacctgccttcgccatgaccattctcaaaggtcaaggccaaacaatcagcacggtcggaattgacctcgaaagggatgtattttcccatggtcaattgtacactgcattttcaagagcaacggacgggagcaacgtccgagtgtacgctcccagaagggagaccgatgcacaagacagagtcaaagtgctgaatattgttgcaacgaaaatgctcaatttgcaataaagcaaacgagttaggtccagcgcgtgcacactttaagatgtcaccccgttctcatctgcacttaaaacggacacatattcaaaaaagtgctgccagctggactgaatgaggcaggtgggccatgacgtgcgagttagggcacttccggtttccattgcattgaaaaatgcagtgtgtcaaggtgaaaccaagtgcatgtcggctgacgcaaagaccctaacacaaggcctaggtagcgaagctcccaaagcgcgaagcgctttaagaaccaagaaacatgtaagcacacacccgctagttcctacataaaacgggaacaaaaa

SEQ ID NO: 73604 - DNA, 625 bp, Heterodera glycines
  Genomic contig location: Contig_ID=SeqID_10410; Location=51..675; Strand=-
  SCN-specific regions: Sequence locations=1-107,130-167,285-320,379 -480,525-625
atggccaatttgttggttgatcggatgaagctgatgctgagcacgggtgattatgcggatgtgcactttttggtgggcgacggagacggaaaagaggcaagttttggcagaaattaaaaattttttgaatttattcatgggtttattattgacaaaaataattcaacatatttttttttaattcacaatattttaacatttttttaaagaaatgcgtaattttttgaaataattaaaataaatttgctttgcaatattgattaaatatattataatttaaatttgcgttaacttttggttttataaaataaaaagcaagcaaaaaattaattatttactattttcacttgaaataaatttaattttttgtatttttttcccggttggtcccggacaaaagccgaagtcccggtcccggcttctcaggtcttggcagttccggtcccggttttggcaaaaattcccggtcccgtacaactctaatttttttttttgtcaatttattttatttttcaaaatttattctgttttaagattatcccagcacaccgagcagttttgaactgcggttccgacgtatttgcggcaatgttccgttacgaagcaaacaaagcagcggcgaata

SEQ ID NO: 73605 - DNA, 365 bp, Heterodera glycines
  Genomic contig location: Contig_ID=SeqID_1447; Location=1..365; Strand=-
  SCN-specific regions: Sequence locations=1-141,163-178,200-310,332-365
aaaaataattccttacacaagttttttacaaccacttattgccaatttaatttcttgcagatttaaagccatccattgcctgccggttctcgggacagcaaagcactaatacggtgtttgactcacttcaaaaaataattcattacccaaaagttttttacaaccacatattgccaatctaatttcttgcagattgaaagacatccattgcataccggttctcggcacagcaaagcactaatagggtgtttgactcacttcaaaaaataattccatacccaaaagttttttacaaccacatattgccaatctaatttcttgcagattgaaagccatccattgtctgccggttctcggcacagcaa

SEQ ID NO: 73606 - DNA, 381 bp, Heterodera glycines
  Genomic contig location: Contig_ID=SeqID_1448; Location=2515..2895; Strand=-
  SCN-specific regions: Sequence locations=1-293,315-381
atggagcaagactttccacatgatcagctgcaacacttcactgtacatgggcatcaaggtcaacaaagggaggtacacaacccggttttgatatggtacaatggactcaaccacttccaaacaatcttggtcagtttctcagtatatgtcaattggagctcagttcatttggtgtttcagggtcctgaacagctgaactaccctgccgcacacgacatcgtgacgaaccagcagtacgtgactccagcgcatctgttacaggatgctatggatgtcgggccatctctcgcagggccttctgttgccatgcaagaggaagaatttgcagaagaatttttaccgacaaagaaattctgctcgagtgatgagcgaaggatctga

SEQ ID NO: 73607 - DNA, 787 bp, Heterodera glycines
  Genomic contig location: Contig_ID=SeqID_10411; Location=3083..3869; Strand=+
  SCN-specific regions: Sequence locations=1-223,245-787
attgacagccgaatggcgttcagccgagcactgctcattgtgctctccgcctcgctgacactgcccatggaaacgctggagaggagcttcagtaagtgcaaaacgagtggaagaaagcagaagcgagtagagggccatataatcaattgggtaatttttgaggaaaattaaaaacaacaaattttcagatgcatccaacgtctttcagtagtccataatttcatttaaattttttcaatttttgctcaaacaatctcaaaaatggagctgctcccgtcttctacaaatatgagtatcaagaagccagacccgtgtccagaaaaaaaaattcaaaggggttccatttttttgttgctctcctcttcaaaatttttagtgcaaattttgaaaattgaggggatacattaaatttgtacgagttttctgcgatttaattaaataaaatggaattccatgtgattaaacttgaaatacacagaggacaactgcaagtcggaaaaattgcgcgaaatcattctggagacaatcggactctatccccaccagtacagctaccaagcaaggtattaccgtattgtaataatcccttggacaaataataaatcggtcgtattaataaaacagacacatgaaacaagtgtcggaaaatcggtttggtaattggtggagcgcggtgattatcagtgagaggggcggctacggcatgagtgccatttatgaccaacatcaaaacacaaggcgagtggaatatgggcaagggatgagtcaggcaaaggccaggcccgga

SEQ ID NO: 73608 - DNA, 1885 bp, Heterodera glycines
  Genomic contig location: Contig_ID=SeqID_10414; Location=65..1949; Strand=-
  SCN-specific regions: Sequence locations=1-16,39-39,61-83,105-223,252- 431,466-1207,1229-1440,1462-1885
  Gene Ontology: Mol. function=oxysterol binding; Cellular component =cytosol; Biological process=Golgi to plasma membrane transport
atggcgaacagcacgagaggaggacagcaacaacaacaacggtgacgagaaggatgaagacgatcgaagagcggaaatggtggaggggagggggaattttaaagaaagtggaaaaattggcacttttgttttatggcaactgtaggggagacccttttgcttacggaaacgcggctccaataatttaagaattttccgagtttgtagagatggtgagccaagcgatggtgatgatgatgagggtgatgctgtgcaacgccactctgacgaggctttgctggacgcacttcggcaccaattcgccatgcttcggctggacgaactgcgcgaacggttgcgccaccgcaattgcattgggggccagtgaatgcgggcaatcgacgcatttacgaggccaaagtggcccatttggagacacgacaatggcacggaaaaggaggacaacagcagaagagggacccaaacgcaataaaacgtaataaaagggcaggggaatttttaatcggaaacctatttctttcgaaattgaaattgaataatccaagagtgaaaaaaatgtatttatcattcattaattactacggtgtgtgtggccattcattcgttctctttcagaatacagccattctctgcagcgtttggtggtcgccgaagaacggggcaatgcggcggagagtcagcgcattggcagaagggaggaggcacaaatttgcacggaatacgcccactcacagcccaccaaaaaggaggtgaggggaatttgtgagtgatgaggaacacttaccgtactctccgccggtggttgattgggtaattaactactaatgacaaaaggggctggcaaagcaccgactctccgtcactttgttggtttgtttcaactataaatatgggttttctgcaattagttttggtgtcattcgatggtcacattttccatttctacaaaatttggttaaatggattttaatggcaattttattacccatttaatgtccctccccccttatttgttaggtgtccttcttctgctatttgctgaccaatccgtcccaattgacgtccttcgcctgggggtaaaatacatttctaatcacatgccaacgcactttcagcaatccgagaagctgaaacgcattttggcactttgggaccaaggcgagggagtgatttcgcaacaattgttctgcaacattcactccgccgaggcgcatgtgcgcgaaggggcaatgatcgacgccatcggtggcgtttaataggagggtttagtcgtcttaaatgcaaattcgacctccattttgacaatccgaattagggttgtcccactaatatcggagacgtacatgccgggaccaaatccccatttattggcatggctttttaaaaaggcgaaggttcgccggcgcctacgagaatacggctgagaaacagtgtttattcgcttttgaatcaacaatttttcagattccttgccgtcctcaaatactacttgaactccttctaccctgcacgcaaaaccgacgacgcgaagaagccgtacaatccgatcctgggcgaagtgttccgttgccgttggaccctgcctggcgtgccgttgtccgcaagccgaaccgccggtggaccgttcccgggctcagcaaccaaccaggtccagtttaagtgatagcctcgtcactcattgagaaatctaacatttgttcccacgtttcagatgacgttcatcggcgagcaagtcagccatcatccgcccatctccgccttttacgtcgaacatccggaatccggcgtgacctgcgcatcgcacatttacaccgagtcacacatcgctgggcttacatcggtgggcgtccgcaacatcggccgggcgactgttcgactccaaaac

SEQ ID NO: 73609 - DNA, 733 bp, Heterodera glycines
  Genomic contig location: Contig_ID=SeqID_10414; Location=2450..3182; Strand=-
  SCN-specific regions: Sequence locations=1-670,692-733
  Gene Ontology: Cellular component=cytoplasm; Biological process =protein biosynthesis
aaatctgttgcaaaattagtatttcttttcatattgcacgtatttttattaaattttcattttaggcttgaacgtgatgggaaattggcggacgctcgtgcaaagtttggccaactgttggcactctgtctcaaccgaccactagggcgcgttggaaggcatcgcacggttgtacaaaaatgatgacaacattggcggcacggacatttttatgccgaaccgacaataaaatgttcatccgtttttgggaaccacgaattcaagcagttcaccgctgttttaagccgaaccgacaaaaaacccttcgtcaatttaggtgggctcttacgcggcgatgacttcaaacggtgcgttggtggcagcaaaaacaccgccggaggtgcagcgcgagttcgcctcgctcgccaaagtgccattggtcgccgggacggtcaaccgcggctcggaactgatcggtgccggctgttgcgtcaacgattggatcgcattcacaggcgagtgttggtagtgacgtgctgagtgagccttaccattttgggtttttcatttcaaaatcaaatacttacctttctgtcgaaataaaattggcgacaaaaaatttcgttttcccatttgcaggcctcgacacgacctccgccgaactgtccgtcttggagtccatcttcaaattgggagacgcggcgctgagcgcaatttccaccgattcgcgcgacctttgatagaatctatgctt

SEQ ID NO: 73610 - DNA, 710 bp, Heterodera glycines
  Genomic contig location: Contig_ID=SeqID_10415; Location=920..1629; Strand=-
  SCN-specific regions: Sequence locations=1-11,44-89,121-174,196 -317,353-379,614-710
  Gene Ontology: Mol. function=structural constituent of cytoskeleton; Cellular component=neurofilament; Biological process=N-linked glycosylation
atgtcggctgagttggaaaaggaaaagaaggagaaggaggaggcaaatgcccgtgttgccgagttggatgatcgtgtggttaagttggaaaaagaaaacgaggatttaaagaaggaaaacgaacagttgaagcaggcgctcaaggcagatcggaccaagtcaaaggtagaactgtaacttatttccttttccattaatgaaacacgctttgtcagcgcccagcagaatcggaggaaaaaatgtcccgaatggagcaaaattttctggacgctgtaagtgttgtggatgctcttgaggatgccaattttttggtaatcaaaaattttttaatttgaaaagaaaattaatttttgaaggaacgcgttggagggaaaggtggggaggaagacaaaaagaaggaaaagggagaagaagcggaaaaggacggacaagtggaggaaatggaggaggacaaaaagaagaagggagaaaaagtggagcaaaaggaggacaacgagacgaaaaaggaaggagagaaaagcgcggaaaaggaaggagagaaaaatgcggaaaaggaaggggagaaaaacgcggaaaatgaaggagaggaagagaaggaaacggaggaaaatgaagcggaagaagacgatggacaagggagcaaagctaagcgaactcgtttcatgtaaatgctgatttcacacgtatgatcttgttgacatggaaataaa

SEQ ID NO: 73611 - DNA, 142 bp, Heterodera glycines
  Genomic contig location: Contig_ID=SeqID_10416; Location=93..234; Strand=-
  SCN-specific regions: Sequence locations=1-142
cagcgagtagggggcgaaggcgggcggggggcgggcgtgcgccgattgggtgtcgcgaccaagggccgcgtcgacaggggcggcccgggggagcccgggctgtgatggtcgcacaatgaggagagcaacggctcaggcccgc

SEQ ID NO: 73612 - DNA, 575 bp, Heterodera glycines
  Genomic contig location: Contig_ID=SeqID_10417; Location=64..638; Strand=+
  SCN-specific regions: Sequence locations=1-179,213-409,456-543,566-575
  Gene Ontology: Mol. function=structural constituent of cuticle; Cellular component=basement membrane; Biological process=reproduction
atgccgtctcggacacttgttcgtcattgtattatcattaggatgtataccccgagttttagcctggtccccctgggccacccggcgatgtcggattccctggccaaccgggaaaccccggacaacctggccttcctggccaagatgcgaatgacgggagtatgggagcggtaaccttcaaataattttattttttctttattttaattttagcccggccttcctggcccgcccggcatgcccggaatgcctggtccgatgggcatgcccggcacaccggcagggcccggcatgccgggacaacgcggctttcccggaatggcgggcaatgttggcgagcccggacgtgccggactcccgggaattgcaggacaatccggacagagacaggcggacggcggatagtcagttttttttaatttaaattttaaattttattattttttaattaaattctttctttcagttgtccttgcccaccaaaaaggaaacagcaacggtcaatgcttgttgttggagcggcaaaaaggagccttctcttcccgtagaaaatttcttttttgtttagccaatga

SEQ ID NO: 73613 - DNA, 1727 bp, Heterodera glycines
  Genomic contig location: Contig_ID=SeqID_10417; Location=968..2694; Strand=-
  SCN-specific regions: Sequence locations=1-65,88-122,144-285,309 -387,535-996,1029-1106,1129-1328,1369-1556,1579-1651,1680-1727
atgaaaatagaagaagcttattcttctgcgtcgacttcatcacagagaacaattgaaccttcgcaagcaaaacagaagcaaaaagtgccgaccatgttcacgtcaccggcggcaacatcaaacaaaaatgaggctgccaaagcaaaatggggccaaaaagggacacaatttactttaaaattggcggcttcatcaaagcgaagtgccgaaacggcacaaacaaaaggagagcaaaagttgcaaaagcttctgctatcaccgaagggaaacgaaattgtgcaggcaaaatggggccaaaaagtgccaggactttacacttacttcgaaattgccattgattgcgggtaaataaaatagttttggggacgggacaaaatatcgccgcagaattttaaagaaaatttttcaaacttataaatctttaaagaaaaaattttaacaaactttttttatgggaaaatttaaataaaaaaaaatttgaaattttcaacgattttttttttgaaattttatgaaaattattaagttttttttcgaaaaactttccaaaaaaaaatttttcaatgatttttttcttcaaattttcttataaaaattttctaagattttttttaatgaaaattctaagtttgttaattttctttttcaatttctacggcaatatgttgtctcggcgatatttcgggcggcgatattttggggtgcacccattagtttctagaatttactaataaaaaaaaacatagggattgctttcttgttggagtttcgccacttctcaatgcgaatttgggtgtgaatttatgcgaattgccaagtgccattgcgtacaaaagcaatggtcaattttgtgccaatggcgacgacataattcggcatgacgaggagaagcccaaaagtcaatcagaaattgcatatggcgcgggcgatgtggtcggatttgggtacaatgccaatgcattctttggcacgaaaaatggagaattaatttgtgagtgatttatgtaaaaaataaataaattttcaaagattttagggactcatgataatttgattcgatcggcaacaaacgatgccaaacttttcccaacgatcagtttttgcgggtttggaaatgccaaaatcaaagccaactttggcgaaaacccatttcaatttgacgtggccaattatgtcttgacgaaattcctgctgtgatttcgttacaaattcggtttaattgttccatttcttaatttgtgccgttttcatccgatgcatttgtatgccaaaactatttatacatatagtcagtcataaacagaactcgcgttatatgcagataatcataaaaatgtacacaactttttcaaatttagggtaaaatttcctcaaaattcattcatattcgctaaatttagggtaaaatttccccaaaattcattcatattcgctaaatttagggtaaaatttccccaaaattcattcattttcgctaaatttaggttaaaattctcgaaaatggataaatatggcatcaaaaacaattttagaaaaagctaaaagtgttaattgagaaaatcaagtaaagaaaattttcctttttggacttcatttgacataaattacaaaatttagcaagttaaatttttaatagtgtttcgagaaacttctttgggaaatttttggtttttataaaaggccgctttaatggatagacctttctaaagatttttttttttaataaa

SEQ ID NO: 73614 - DNA, 781 bp, Heterodera glycines
  Genomic contig location: Contig_ID=SeqID_10418; Location=4220..5000; Strand=+
  SCN-specific regions: Sequence locations=1-40,62-128,164-381,493 -560,582-781
atgatggggacgaatcccaagtcgggatcccgaaaaatttcgtggggtcccgatcaaatcccgatcaatcccaaaagatattggaaaaatgatcgggacgaattccaagtcgggatcccgaaaaatttcgtggggtcccgatcaaatcccgaaaatcccaaaagattttggaaaaatgatcaagaatcccaagtcaggatgcggaaaaatttcgtgggatttttgagctttaacactagggttggcccccgacgtcggggttggaaaattcggggttcggggtcttcggggttggaagcgtcggggttcggggtcggggttgccaaatcgttcggggtcggggttcggggtttttcaatttttgccttatgccatatagtcaaattttttttataattttagcttaaaaatttttattattcataataataattttatgcatctttttatttctttttatcataaatatttttgtatagaattaattaaaaacgataaggcatttttaaaaagaacaattttcagtgaaaatctgtaaaaatagtcaaaatttcaaatttttcctccggcgccgggcctccaaaacttattttttcttaaaaaaaatttggctcaaaattaaaaaattggttatttttggtgaaaatcagtttacaattcattctaattctctaattttcagaaatttttcgcggtggcgcttaccgacactgccggactcttgttcccgaaaaaattgttatttttcaaatcatcttttgtcgcggcgcgcatgttctaa

SEQ ID NO: 73615 - DNA, 934 bp, Heterodera glycines
  Genomic contig location: Contig_ID=SeqID_10419; Location=67..1000; Strand=+
  SCN-specific regions: Sequence locations=1-200,228-298,359-372,394 -428,483-534,556-673,695-749,782-934
tgcgtaaagcttcgaccaacacccaatgatcaatttccattacatgatgaaatggttgctgtgaaattttgtcctgaccgcgtttcgcctggctttggcaaaaagcattaccgcaaagtggactgtatgctgtacaagagtacaatgcgtcaacggtatgttgttggttgtcatacacttactgtacgctagtatactgtataataaagtaataataataataataaataaattgaaaatatggctggcgatgtcttccttacaaatcaatgttataaaaaataagtgttacaattagtatatattttttaaattaaacaaattttaaaatgattaaaaaagatttaataaaatttttgtgcacccatttaaattattcaatttaattacatttatcaattttaggaatgttgtaaagttaacgtaagttttttattattaaaaataatttataaactacacaatattattattataaatttgtgagttttttctctcttttttttagcgttgctgctttgaaataagagtaagtgataataataataactaactctgacaatcaaatatataaatccattggatatattatatcctattaaaaaagtgtgtggattttcaattttcaggattgctgtgggcagcagaaggaaaaatccgtaaagattgatttaaaatcattacaaatattatacataatatgttaagaaatgctgtacaccaccacacagcgaaaatgtatgttgatgattataaaaataatattatatataattaaaatgttttttgtcatccaaatctcgcaatcttgttatcactcgaaagcttaacatgtttagaaactttttctaagttattgcttcgcgattagacaattactaaaaaagttatacttaaaaactgcgaaaaagtcgaaattttgaagattttctaa

SEQ ID NO: 73616 - DNA, 1025 bp, Heterodera glycines
  Genomic contig location: Contig_ID=SeqID_10421; Location=745..1769; Strand=+
  SCN-specific regions: Sequence locations=1-1025
atgaccgaggagttgctgaatgtgccgcatttgtgcgcctctttctttcggctgctcatttttgtttcggacatcgccgccgagggaattgcccaaagtccgccccaaatgctcgacgatattttgcgttgtgtgaaagccgctctcgactactctttcggcggggacagagtccgttctgcgctcgaaattgtcaacggattggcagcaaattgtgtcgaagactccgtgaagaaaacggggaaatatgcgacaatgactgaacgtcttctggccttggttccggtatttttttgcgaaattagctgtcacttttcatttctctcccaagaaaatgtttcaattggccatggagtacagcttcgagttggatttgctgagtgatgcttcaagcgcacttttttccctcatccttctcggcccggtcctttttcatatcaatcaatgcacttgttatttattgccttcctaattaactttcaggattcattcaaagccttcgttactcatttgctcaacttaccatccaatcaagaaaaccgagagcgcctggaggaagcgtttagccaacttttgacccctttccccggcgttgacgacatttctttcccggtccagccccattctcagctgaaccgccgctttcagcgtaacttttgaggtgttttctaatggaagaaaagcatcgccaaccaaagaaacctttcacatttaggattttctgatcagagtcagcggttgtctttgcttaaactgaccaacactttcacaccttcgaccgttcagttttaactgttaagctttgatttgacgggaaaacaaaaccatctcgctttatatttgatcttttgttatgaatttcccttttgttgtttccagtcagggcgtatgggaaagagaaatgaccaaaatcggagctcatgattttcaaaaaggaagacaaattggcaaatctgtcagcttcggtcttggttttctacgccctttctctctcctgattcattcctttttctgattgttaccga

SEQ ID NO: 73617 - DNA, 72 bp, Heterodera glycines
  Genomic contig location: Contig_ID=SeqID_10421; Location=1903..1974; Strand=+
  SCN-specific regions: Sequence locations=1-72
atgcggttgacatgtcaggcgatggttcggaaactgcacgcggaattggattatgcaagacattttccgaag

SEQ ID NO: 73618 - DNA, 3291 bp, Heterodera glycines
  Genomic contig location: Contig_ID=SeqID_10422; Location=452..3742; Strand=+
  SCN-specific regions: Sequence locations=1-397,419-1109,1132 -1860,1885-2013,2035-2716,2850-3291
atgtacgttctgatggaacatcgctctcccgagaggcgtcccgcccgctccgttcactccgtcgaacgacatcgtctgccattgctcaggggccgtgccgtcgtgcacagttcccacccatcctccccccatccggcggcaattcgttgtcgctactcaatcactccgcagatgagcagttcggcgacaagtgcactgctcggcattgaggagaaaaggaggaaaacatcgtctggccaacaaccgcaacagcagcagctgaggagacgacaatttgttagacagaacggaattatggcaacagacaatgagcaaaatgacgaggctaataacagaggaaaagcagcggaagagcaccatcagcctaattttcaacagaataagagtggcgagagagcgagagaagcagtaccgacaaatgatcagcaacggcagcagaatattagcaattggacacctaaaaaattgtcatcgtctggcccttctcgacttcggcatgttcaacctccaccaaacataaaaggagatcaaaatggaccggctgtttcatcatcaaaattgcagaaaacacaggcgcatcactacgatagtagcaacggttgtgaacgcattgatcagcaacaacaattgcgaattgcggttggccggcaaccgcttaaatacgccagcagtaaggtgaggccggtgaagacgacaatgccgcaacaacaaattgaaaaaggcggtgaatacggtgacaaagcacacaaaaatagggaggaggagaaggagaacacagtcagaaaacggatcagcaacagcacaccacggcggacgacgccgaacacaacgcgcaaagagttgcaattggcggtgacgccaaaccatcgtcagcaaagtgatgttgaggtgattatgatgatgcacaacgacggaagacaacacaaacagcagcagaaacatcagaactgtaacgataacaacacttatgagcaaatttcatgggacaattgcagcggaaacaatgcaattagcgacaacaacaacaacaacatgatgagagtggtcgtacccaccagggcagttgcaatgactgaatggccacctccgacggatgaagaaccacaacagcagaggaagcggagaaaggccatgatggaactgcagcagaaagggctgagcagaagcaagtcccagtcgcgcaacaaccttttgctagcacaacaacagaaagcatcgctggagcacttccaaatgggccggtccaaaacggcgacaaatttggcatttgttgccggcgaatactcaacgcttggcgtcgacactttgtcactgaacaggaaggggggtggcggacctttcgcgcttctccgtcgtggtgccaatttacgaaagctgtcactgcagcggtgtcgtcccgccttttcgggtgcccaatcggcagtcgttgatctgtttgatgcattacaaagtgatcagagaagggaagagagggagcgagcagaagcattgcccaacggacagtttgaaaggattcagcgcgaactcaaagcattcgcggaacgccgccatttggcgttgggcaggcgacgcaaagtgcgcattgcggagttggggctggaccaactgcacgcgcagttggctaccaaacaggcgaaggccgatgcttcttctggcactgtggaaggctacaattattccaccaaaatgtttcagaggccacgcaagaagccattgcacgagtactacaacgacgacgacgccgaactggagggtgaggcagtggggaagatgaaggaggacccaattagtttttatttataatctacctccaaaaagctaattttcaatttttaagaattcttgagcggacatgctcccattttttgcttttcaaaattcatttgtgatccaaactcatttgtgtcttgtgtctttagcgctggccaacaccgttgatccgaatgccccacaatcaaatggccaattgatagtgccggctcgaggcgactttccttcggccagtacgagtggtgcgtctgcgccgcctcccctgccccgttcaattgactctgtgctgtacaaatgggcaaacacacagccaaagagtgtggcagcggttcagttggacagcggcggaaaggcaaccgcaacattaacttattgtgagagatttatcgagcttgaagatttttgggatcggattttggcatagatatttttttttgaattgtctcaaaattcgcgaaataccgttaccaatatgccgttccattctcttaaattttgattgtagccaaattgctgagtcgtgccaacaaagtggcctaccaccttttgacacgacaagtgacagtgaacacgggcggtgtcaaagagcgtgtccatctgtgcctgcctgacgatagggtcgcgttggtgttccccaacagcgaacccattgcctttttggtcgcattttacgggtgtcttctcgccggtggtcagtttattgtaggaaattcgtttgaaagggaaacaaactcccccttttagttgtgcctgttccaatcgaagtgccaatgccgaaaagggacgtcgccggcctgcagcagttcggctttctccttggcagctgtggtgagtttgtcgtccgacttggctttggtgccaatgtttttctttactctttcctcctctaaggtgcccatgtcgcactcacttccgaaagttgcatgaaaatgctgcccaaggcgggctccgtctcttccgcctcggccgtcccttcctgctcagcttcggctccttttggttccgcctcctcctcttccagtgcccttctccattctccgtcgtccaccttcgcttcctccaacgccttcccttcttccacaacgggttccaccggctccggttcaagttcgggtgctcaacgcgaccacaacgcattcattcaccattccccgcctcagaacccaaacgatgtgaccgactttaaagtgcccacttattgatgcttttaactgcaaatgcctaaggagtaaatttccattttcaagggatggcctcgtctccattgggttgtcactgaacaccttggaaaaccgtccagggattggacactgccatcgttggttgcggatgaccacccggccatacattgagtacaccttcgatcgcgaaggttccatcaagggggtaagagaggaacgaacttggcattttgttcaattcacactctcccatttttcattgtcaggtggaatggtctcgacaagcaatgctcgcccattctcgagccattgggttagccgccggcttcaaggaaggtaa

SEQ ID NO: 73619 - DNA, 505 bp, Heterodera glycines
  Genomic contig location: Contig_ID=SeqID_10424; Location=536..1040; Strand=+
  SCN-specific regions: Sequence locations=1-157,298-505
atggtaaaaataaatttattacatcatttattatttgtgcatttattttaatttctttcaacatgttcattcatacatgacaaaatgacaatataggcaaaattagtattttaactttttttccattaaataaattactttacttaactgctgatggttacttttattatttaattaatttattttgtttaatataattttagttttattttttattaaacaaatattattcttattgtatagttttacctaataatatttttattataattattggaatcattatgttaattgttaaaatggtgctagtgaattaataaactttaattctatttatctctgagtaaaaaaatttcgaaataagagaaaaaaaattttagccaagcttctcatttgttattatggtatggaattttaccaaatattttttttgctcttactttaattacatttaatattaatcaatgcgtatgtgtttgatatttattttactaaattaattcca

SEQ ID NO: 73620 - DNA, 4364 bp, Heterodera glycines
  Genomic contig location: Contig_ID=SeqID_10424; Location=1..4364; Strand=-
  SCN-specific regions: Sequence locations=1-14,36-67,89-177,219 -253,299-499,525-716,738-749,773-1195,1217-1271,1311-1403,1426 -1434,1456-1465,1500-1549,1586-1591,1613-1733,1784-1797,1819 -1874,1980-1988,2010-2060,2084-2152,...
  SCN-specific regions: Sequence locations=...2246-2291,2377-2409,2553 -2629,2651-2946,2968-3010,3111-3144,3166-3186,3250-3291,3317 -3532,3673-3836,3874-3893,4027-4091,4228-4284,4306-4323,4345-4364
tccacattctgagccgtacggtgcaaagcatttgcacaactggcactgttggtggcacatttgactatgatcagacatggatatgtgcgctgtaagtttttcttatgattggcaaaaattttcaaaacaaaaaaaacatttccaataagaaactctaactcaaagaaggttggaggcaaaaatttacaaaaaaaaaaaattaattcaaaaaaaaatttgaaccaaacatttttctattcaattcggctgaaagttttaattttaaaattagatttgaaatttaatttacttttaaattcaatttccagatgcatactgaacacggtgcagcatcgccatgtgccattgcgcgactgtcccatccgacaaatttgggccgctccatgcaagacttgcgcttcatcatcattgtgattgcaccgtccagagcggtaaagtttttagcaaatggtaattaggtaaataaatacatttactatttcactttttggactcacagaaattttttaaaaataaataaaattgcactcaaaaaaagccaaaatttttggagttgatttttaaaaaatctggaatatggcttatattaaaaagtctaaagttttataatttaaaaccggtaccccccccccggttttcggtttcgtaattgaaattttttcggcactttctcagtatttgatgagtgccttcatgcaaaatgaaatacctatatgattttaaattattaattaattgaccaaatgagtttttcccaatgtaccttacccattttacataaatagagttattgttcaaacgatcaacgattttaatcctacaatctaaaattaaaaaaaatacttttgaatgtgaaaaaatccttctaaaaacattttcataaacaaaattattcaaaaaaacaacaacaaacaatagaaagaaagtaaacagcaatgggagaaatagtacactaactattacattattttacggtaaagaaacgagcgctgcggagaaatagtgcatgaatgtgcacccctctttcacccatttctcgctctctttacaccccagcaaaaaataaaatatcaaatttctatcatatataatgaaaggcgctccccgatacaagtaatgttcaaagtgtgtttcataattgaaggcagttaatgaaatttaaaattacgctgaacaggtcggttaaattatattttatcattttatttccattattcactttaatttgagtaccaatcgtccagttgatcgatttatgagaatcttaatactttttgcctttgtttttgtattaaaaatttttaattactttaagagtaaaataatggaataaatataattattcattatagtaattgcttctcgcagtccacattcatttttttattttcaaaaaatcagtcaaaatttttaattttatatattctgtactacataaattttaaaaattttcagaaatggaaaccatagatttaaagtaattttatatttaattttcaattttgcttcctggatggttggttaccacgcagcaacatgcgacagaggcatttttatttttaagttaattatattattaaaataagatcagaacaaaaataaatagtctttaccttaaggtagccgcgaccttcaaaatttttcagcattcattttactgtaacgatttagagtaaattcaatatactttttttgtgaagtaaaaaaacatgtaaataagcagtttaagtttcaaaaaataatattaaaaaaataaaattttattatttgataaaattttaatccattaaagtatcaagagagatctattggtagagaaaatacatctagagctgtcaaatacaatcgaccatacgtttaatttatagtgttactaatatatttatatatcatattaaaataagaataaaattatactgattaataataaatagatattgtcagctataacatatatttttatttataaaataataattgagcaattgaatattttctttaattcttttcagtattttttttactttgttaaactatatgaggagttggattcaaggtagaaaaaaataaataattatatttagtttaggaaaatcacatattataaccaaacagatactctaagatttaactgttatcttattattacgacaataaatcttattttaaattcaaatgaatattaaagttttaaagtttactatttttttttattttgagcatttatttataataaaataaaattgagttgatattaaatggagaataatattttttggataattcggaagttaataatttaaaagagataaataataattatatagaattgaatgagaaattaattaaaaatcctaagaataattaaattaataacattgaagctctagttgggagcaaataatgtggtttatttaatttttatatcctttttttatttatatatttttaattttctaaactcactcatatatttgaatattttttaatcattttcttgtttcatttaaattgtagttaatattattatatttatttttttaattcacttaaatccgcaaatgtcgttctacaaaagtcgttctgcaaatgtcgcactacgtataataacatgaattcgttcgaatatcattaaatttgaatttgcaattattaattttatagattgaaagttaaatatttcatcaagaaattttagatatatatcagtttcaaaaataacttcaagagatagacaattaaaaaagttctaacaaaattcaagaatctgcattttcagctgtgaatatcgcttcaaatgatttagggcgatttttgaaattggtcaaatttcactaattttttgaggtcccagggggtcaaattccccaaaacataaaactattatggagtgcctgtaagaccactatgtgttgttccgcttttaaatttcttaataactcgcaaaaagaaaaccgattttaaaagcgatttaaatttaagaaaatacaaaatcagtcaaatgcatatcttaatataattatctcaaaattagaaatttataaaagaaaagattaaattaattaaagaaaaaggaaaaatatactctaataaaaagaaataaattaattgttatgaatgttgcttattaaggcaatattcaccggcacaaaaatctatgaatttctcgagaggaaattcagcatgaaatttaaaaatacattgtaaaacataaaaagaataaaattaaaaatcaaaaataataaaattggcgcaaatattattcattcctatacattacgaaatgattatacattttccaaaagttttaaataaaatctttaatggaattaatttagtaaaataaatatcaaacacatacgcattgattaatattaaatgtaattaaagtaagagcaaaaaaaatatttggtaaaattccataccataataacaaatgagaagcttggctaaaattttttttctcttatttcgaaatttttttactcagagataaatagaattaaagtttattaattcactagcaccattttaacaattaacataatgattccaataattataataaaaatattattaggtaaaactatacaataagaataatatttgtttaataaaaaataaaactaaaattatattaaacaaaataaattaattaaataataaaagtaaccatcagcagttaagtaaagtaatttatttaatggaaaaaaagttaaaatactaattttgcctatattgtcattttgtcatgtatgaatgaacatgttgaaagaaattaaaataaatgcacaaataataaatgatgtaataaatttatttttaccatactgaagtttatttatatatttactaaatttctaaatattaaaagaaagtgtttaaaggctattaattaaaattccaattaatacaaaaagaattttaaaaattaaataaaagctaaatataaaatgaaaaaaacagaaacctaattgaaaaagaatgaaaaattctaaaaattaataaaaataaattgaaaataaatgtgcccagtgagcgaatgacacgaatgacacaatagctgtagttaaggctaagataagcgagagaatattattaaaataacattacatttaatcaaaatataaatttaaataccaaatttaaactaatatttttattattatctaaataatttaaaagtcaaagctcataataataaaaaaatttagattataataaaaagactacaatattcttattgatttagaaattctgatttataatggcatttcatcaaataaagaggatttagaaaattttcaatataactaaattacgaaaattttccaaaacatttttccaaaaaaaaataatatata

SEQ ID NO: 73621 - DNA, 563 bp, Heterodera glycines
  Genomic contig location: Contig_ID=SeqID_10424; Location=4136..4698; Strand=+
  SCN-specific regions: Sequence locations=1-11,53-141,163-194,216 -304,326-563
atgtttggttcaaatttttttttgaattaattttttttttttgtaaatttttgcctccaaccttctttgagttagagtttcttattggaaatgttttttttgttttgaaaatttttgccaatcataagaaaaacttacagcgcacatatccatgtctgatcatagtcaaatgtgccaccaacagtgccagttgtgcaaatgctttgcaccgtacggctcagaatgtggactgaaaatgatgctaattactaattagtagggctgtgatttctagtggaaaaactttgtttttgctcaattgttttgaagaaaggagcgcaaaaaacgcatttctgcgttaaaattttttcatttgaacgccatttttcgtcactagaaatcactattttggcgttttgtcacttaaaattagagaccggacaagaggatcggtcggtcggtttcggttaaaaaccgaaaaaaaccgaaaaactcaaaaatttctcggtcggattttttcggttaaaaaccgaaaatcgaaaaataccgaaaaaaaccgatcggtccgatctctaatataaata

SEQ ID NO: 73622 - DNA, 1239 bp, Heterodera glycines
  Genomic contig location: Contig_ID=SeqID_10425; Location=7..1245; Strand=-
  SCN-specific regions: Sequence locations=1-101,123-374,396-673,696 -854,913-942,964-1133,1155-1239
gatgatgcgtttcactatttcagctacggcagcaatttgttgactgaacgaatccatgtccatgtgggcactctattaaactaaatacaatgattcttggcatttaatttccattttcggcataattcttaagtggcgattgattgcggcacggggttccgtgccggattttgtgtagaatccaatctgtaaatttcacaattaattgcgcgataattccattggatttagtccggcaacaattccgtttcccaagtctttagttttatgaatcaccatttccggatcagtttaataatcaatgtgtgctatgtgatcagaaattttgaaaaaaacgaaatttccaaatttgaccgattctattttttttactgaccgttttttcaaaaattcccacccggcgaggcctctggcattccgtccattttttcccatatgattcggttccatcgcgcacagatcaccggtgccgagttcgtcactgccgcactgttgcccggctttgagttgacctttttcgatcgatcagagcgttggcagggcgccatagcgtccgttgagcgcaaaccgtccgcgcgcgtctggggatgcgtatggcgtgtgtcgaacgcgttggccacagtgttggacgcgcaggagtgcggctaccatcgcatggacggtaggacagaggggaggaatactgtaactctgttagacaatgacactgtttgttcgatgtacgatgcattttttatttggattttttgagtaccagctaaaaaacttcaaatatggactaaaatgcccgaaatatggactaaaaagctcaagaatggccaaatatggactaaaaactgacttaaaattactccaaaattttcataaataaagaaaattaaaaaaaaaatttattgaaattcaatttaatatggggtttttaaaataattttcggtgttacctcctcaaccttccagttaatgtactgcttgttgaccccgattctgttactgatccatcaattccacccacgtcgatgctctgccgtacctaccagtactcaaacccggacaaacagcacaactgtccatcgccccactacaaacatgtgaaaatttaatcctttctcaaggacattttgaaaaaaattcgctaaaattttttttttaaatttctctttcttgaatttttttttttcgagaggtggactaggttttttcttccccgcgataaattaaaaaaactttaatcttgttttt

SEQ ID NO: 73623 - DNA, 477 bp, Heterodera glycines
  Genomic contig location: Contig_ID=SeqID_10425; Location=2183..2659; Strand=-
  SCN-specific regions: Sequence locations=1-34,58-217,239-362,384 -441,463-477
cagcaacagaaaatgatgatcatcatcagacaatgcagcatcaacaacaacaacagaacgggtttgacgccaacactggtgtgcagttgccaaatgtcaccgattttgttgccggcggcgaacgacgatcaaaaacgtcgacaagaatggaggccgaggatggtggtgatcagtgataaactctgatcaaatcattgagatactaaatgatcacctctgattgtgagcactgatgacatatttgatcgatcattatttaattatataagtgttcacacatatatacaggccctattgcccaccctctcccaccaaaatggaaaaaaattgtaaatttgattttcaaaattccaaaaaattccctttctgcctcttggcattttgacggatcgcaaaatatatgcaatcttactttcctttaaattaagcttaaagcattaaatgctgtatttttcaaaagtctgctatattaataaa

SEQ ID NO: 73624 - DNA, 1022 bp, Heterodera glycines
  Genomic contig location: Contig_ID=SeqID_10426; Location=11..1032; Strand=-
  SCN-specific regions: Sequence locations=1-87,131-248,270-351,373 -395,417-741,764-841,954-975,1000-1022
  Gene Ontology: Mol. function=protein methyltransferase activity; Biological process=histone methylation
atgaatgtcaaacggtcatgccatgtgcacgggctcgcctcctggttcgatgtggcatttgatggcaccaagtaatttgggaaattcaaatttttttttaaattcgtttttacatttaaaaattttttaagtggtcgtaccgtttggctgtccacggcgcccaccgaaccgttgacccattggtaccaagtgcgctgcctgatcaaacggcccatgctcgtgctggccggccaagatgtacggggcagtctggaaatggtggccaacgacaagtacgcgttcatatttcgaaaaataaaaaaaaatttaggagttttttgagtagcgcaaaattttaaaaagcaaccttaaatacctttttattggaaaattctaagaaaaaaaaacaatgatttttggaaaaaatagttaaaaaattgctagaaattttttttttatttctcatgaattttcattgaaaaaattctgtttggtttttttttcatgcggcgggagaggaaaaaacgagctgctcgccaattttttacgattgtatacttaattcatttttccttattttagaagaaataattaaaatctgccttttttcagacaatcttacgacatggagttggagatgtacaccgatgcagcggcggcagcaatcgacaatgacgacgatggtgcggcgcaacagcaacaccaccaacggaatgtgttggacctgaaaatgccatactttcgctacacgggccaacccgtggcgccaccgccgggcgcccacgcggactgtccaagtgaccaactgaatttggctgtgaacaactttttggctggcggtgccgccggtggcggcatgggtcaacagcagcaacaacaccagcagcagcaggaagatggggaggaccatgagggggagcaacaacggcgccagcaacgccaacagtacaagcatcatcatcagcaacaacagcgaatgatgcacgccatgaagaggcagcaacaccaccaccaacaccatttggcatcatccaacaaggcac

SEQ ID NO: 73625 - DNA, 815 bp, Heterodera glycines
  Genomic contig location: Contig_ID=SeqID_10427; Location=82..896; Strand=-
  SCN-specific regions: Sequence locations=1-316,344-589,621-707,729-815
  Gene Ontology: Mol. function=protein methyltransferase activity; Biological process=histone methylation
atgggctatatgctggtcaacgagcggatgttggagagttttatgttcgcgcgcaaattccttcgccctggcggttagtaaatttttttcaaaataattttctttttcaaaaatcataccttacaaatgtgcacaccattaattaggaaatcgaattgcaacaaaaaatggaatatttggcatattttaaaaaattgcttaaaaatagctttttataggttaagataaaaaaaccatttaaaaatagccttttctggggtaagcaccaaagtgcaaaatggaccttttccataggctcaaaaaaatttttctccactaattaaaaaaaaaattaaatatttttgttgcgggagaaaatttttttagcaattttttccgacccaaaaggacatttatatttaaagaatttaaatataacacttaaagtcgttaaagcgtcccagagaagtcggtagacggcatcggggaaaatttgtttttttttatcccgctttagaaaattgcattttccagcgcctaattttcatgttttatttattttttgcattttggtccctttaaattttaaaatttttctagcgattttttggaataattctctttaaaaaataactagtaaatccagtgataaattgcttttaggtcgtatgtttccgacccgtgccgatttgcacttggcactgttcacggacgacgcgctgtacgcggagcagcagcagcgggccgccttttgggcccagcaaacgtttcacggtgttgcgcttggcgcgtctgcagagccagcgctggacgaaactgtccgacagccggtggtg

SEQ ID NO: 73626 - DNA, 292 bp, Heterodera glycines
  Genomic contig location: Contig_ID=SeqID_1449; Location=378..669; Strand=-
  SCN-specific regions: Sequence locations=1-65,87-140,162-292
atggaattgagaaatcgaagtaaacagatgagtgaaaaaggaaaaggtaaatcgaagaatcatcctttgtaaatttcaaaacataaggccatacgaatagttatttattcaaaagttctctgcatttcattttattcccaaataaatgtatttatatatccatccttccaatgtttgcagtttcagaaattattaaattgttaattgatattttttgcattactgagttagaaatacatttgtctaattaatttgtcatcatggttataactcaaattaagattcaattaaa

SEQ ID NO: 73627 - DNA, 2838 bp, Heterodera glycines
  Genomic contig location: Contig_ID=SeqID_1451; Location=595..3432; Strand=-
  SCN-specific regions: Sequence locations=1-86,108-379,401-887,1020 -1396,1418-2614,2636-2638,2662-2838
  Gene Ontology: Mol. function=ATPase activity; Cellular component =mitochondrial outer membrane; Biological process=mitochondrial translocation
tgaacgaaagtttggaaaaattgtgccataaaaagaagaagaatggttggcggaaattaaagatgaggtggaaatgcaactggacaaaatgatttcacaagaagttcgaattgatgagccaccgcagctcaaaaaatgaggacaaatgattagaaaattggacgaatggtcaccaaaatgaggacaaatgattatcaaagtgggacaaatggtcaccaaaaagggacgaattgtcatcaaagtgggacaaatggtcaccaaaaagggacgaatggtcatcaaatgggacgaatggtcaccaaaatgggactaatggtcaccaaaaaagagagaaaatgactgtttgagaaaggggagacgagcaatgccaaaagggacgagaaacagcaaccgcaactgttttgaagctgttcgagatgaattttgtgcatctaatcgacctaaattcgatcgttttaacatgtctacagtcttagtcatactgtattcgctgaattataagcccccgcccctctgtattagaagcccctccccctaacataagaacttttcacacaaatggaccaagttgtatttttttctaagcttttccgtttgtagtggcccattccaatttttgcaggcggtggccttttgaatgtgctgctgtactgctacaaaatgatgcacatctccgagcccaagcatttggtgattttcggcaattcgaatttgctggggggagaaaatggcggggcttttgctgaacagcggaaaaagacgacggccgttgtcgagctgggcaacttggacgaactgcagcagtgttggaatgccgagctgttcatttacgtggagcgtggcgagacggacggaggcgcaaaagcgaaaaaggcaaataaatgggcaaaaaaattaatattaaaaatgaatttgaattaaataaataatatttaatattaattattaaaaatgtattttaaattaaacaattaaatacatttttaatattaattattaaaaatgtattttaaattaaacaattatcattttcaggtaaaaaaaaggattgcaattctttccattccaaaatatggaaataaaatgaagtctaaaaacatcaaaccaacatataaatagtgcaacaaaaaaaaaggtgagaattcctacaattacgttctctagtcataaaaaaagtttatatcaagcaactcttttgtgattgtttcattttcattactttttacaaaaatctttttctcctttcattttgtcctaattttttgtttagttagatttgttttgcttatttgatctgaaaattaatcagaatgaccagcgaaaagaatttgccgttgacaattggcgtgtgtgcttcttccgttgcgctcggctgtattgcgtacaaattgttgcagcgcaaaggctcccagcaagaacttctagacgaaatgactttgaggaaaaagaaagacgaggcacagcttatggactcactgaagttggacccgaacactccgctcaactcacacgaggcgggttttgaagcgacacaaacaaaccgattagtcaaataacggaaattctttttcagttggcccttgcttcactcatctgtcagtatttttttgggctttgccgtcggtccttttgaaaatcttcgtttagcattttccgaggatgccgcttcgttcgagaaagtgggcggctgttcttccattttggaacttctgaggcagaaagttgttgtccctcttcaactggcgtccaacaagaccactcttccgtcgttgctgtacagtgcgccgaaaggtcgcctttgtcttatgaaattggaccagtaaaaatgagtgcataatgaatgcttttaaggaattcttctttatggaccaaatggttgtgggaaaactctgattgcgcgtgccattgccaaagaggtggatgcgtacttcatcaattttggaacttcgctcgtcggtcggttgtggattaaaaacaacaattgaattgcaataatttcatttttcagattttgtcaacggatcatccgttactatgaagtctctgttcactttggtcagtctttttttgaactttctgccaatccttccttttccaggcagagaaaattcagccgtgtgtcattttcatcgatgaaattggtgtgttttcatgtttttgcaattcgcttttgttcttgtctcacagatttgctgttccatcgcaatcggaatgactttcagctgctgaagacgcaattcctcgcgcaatgggatgagtttctgcgctgcaattccaactgcaacgtgatcatcatcggtgccaccaatcgtgtgctcgacttgggtgaggaaaatgcctttccatccgtcggtggtgtgtttatgcaacattcttttttagatgaaacagttctctgccgcttctcactcaaagttcacattcccttgcccgatgaagaagcacgcgagaagctcctgcgcaagattttggcgaacgagaatttggaggcggactttaactacgccgaagttgttgaagcgacgcaaaagatgagcagttccgagctgaaggaggtcatccgtttcgcgttccttctgcgctaccagcaagtcgtccaaactcagatcagtgttcttcagcagtgagtccatggcagaacaaaacatttgcaattccaatgttttcattgccttaaggtcgtcttcggtggccaacgagggaagcgaaaatgaagcggagaaaatccaaatcaaattgtcgcacaacgacatcatccgagcgttccacgacttgaagaatgtatcgatggcgccattttccgagtcagtggtgacggaagaagtcgtcgaggtggat

SEQ ID NO: 73628 - DNA, 643 bp, Heterodera glycines
  Genomic contig location: Contig_ID=SeqID_1453; Location=1191..1833; Strand=+
  SCN-specific regions: Sequence locations=1-320,351-376,401-643
atggccaactctccgctgcttcttctcccaattttgtcattgtccatattttgcgcgtttttatctgaaattgccatcggtatgccatcgccgtttaaaacacccgaagcattggacagaatggacggaataagcccggtgagcagcgcatggacatcgccgacgatcagcggatgcagcacgcccgagatgggagccggcagagccaatctgcggcgatgtgccagcatcgcgacggacagaatgccaacgacgtaccacggcgccggcagaggccgatccccgccaacactgagccagcaaatgtacggacgaacgacggcactccttcccggggcgagggacggacggacaattggaatttttgaattgattgattttttgggagggggtttcccgaggcttaaagaagcccgcttttttcccggaattcgatcccaatgtttttcggccgttcgaatcgaaattcgattcggccgattttgctacctaccgaagcacacacattgttgaatttaccgcttaattaacatacgtttttatctccttcaccagcttttcatttattttagaagaatgcctatttcttcgccgcctcgtcggacttccaattacaatcgtagcttaatgtaaaataattaaa

SEQ ID NO: 73629 - DNA, 676 bp, Heterodera glycines
  Genomic contig location: Contig_ID=SeqID_10429; Location=2098..2773; Strand=-
  SCN-specific regions: Sequence locations=1-615,637-676
  Gene Ontology: Cellular component=mitochondrion
atggcagagctgacaaacgaaatcgcaaaaaccggtgcgagtatcaaagacatttttcacgaaagagcatggcttgcggccaatatttattctgtatgcgtccgggtgatttgtgagacacgaggcgaggcccacgtgcgtgaactgatttcacaccttggcaagaagtacaagcaggcaagtcgagagcggtaacgaatttcaaaaaagaatttcttttagataagcttcccggggctgtcatcatcgcaaaacttgtcacgaaaaaaagaaatttgaagtttaaagaaaaagcggaataccgtaaatccgccatttgaatgcccctctctggtagaatgccccctccaattaaatgcccttttttggaggggttgaacaatacaatgcccctctctggtagaatgcccctctccaataaaatgcccccctccaggagggatcaagtatatccgcagggattctgggggtttgtcgatgccgaaagcgaaatctgattacagattcgttatcaacaccctaaaatacctataaaaagtatttttcagctaaatttgggtgaaaaaaattttcccactcagaaaccatgtggtccctcccccctttggtcccaaattcccaaatcaattttatttttctaatcttttccaaaaaaatagtagaaatatgaaataaa

SEQ ID NO: 73630 - DNA, 1581 bp, Heterodera glycines
  misc_feature (1569)..(1569): n is a, c, g, or t
  Genomic contig location: Contig_ID=SeqID_10431; Location=1053..2633; Strand=+
  SCN-specific regions: Sequence locations=1-393,423-723,745-1119,1181 -1191,1213-1304,1359-1581
atgatcagaaaacccaattcagaggttggacatcgtcgaattttgtccaaatttgtcaatgtgaataagcatcgcttttctgcgcaacagcaacaactgcaacatcagagaaccaattgcatttatcaacgtcacattggccaatgtgcgatgcgattactgctcaattcgatggtcaagtgggtttaattatgaaaaaatttcaaatttcaaaaatttttcagaaattcgtccaaaaattcggccgtggccgcgttgatgggctcgttgcatcatcagccgacgagtgccaaaagtcggcgtcaaaagccgatgagtttcttcgagcacattctgaccgagaacggcgacattaaccgggcggagggaccacctcccgccggcggggcagggcaacaacaaaaacaacaacaacaacaacagactcaaactgctggtggcacaacacagcccctgcagaagcaacagtcgacggcattgcttggaggtgatcagagaaagggcagttataataaattgggtgatgatcagatgcgtgatcattgctggattggggagctgggacattatagtcgggaatatcgtatttatttaattcgaacccccggggctcaattttcaaccaccctcaaaaggggggttctaattaagagggtttctaattcaatagatgcttcggtgaaattttgaaaattcataggtataaattagcagtagaactcttttcaaaatattgcccaaatgtttgttaattgtgcaggtggcggcaccggtgccatttcggcaatcggcagcacgcgcagagacttgaaacagggccaatttgacattcgcgcactacagcacaagcagcaaatggccgaaatcactaggcacgaaaatgatctattcatttaatttgcattttttctgatcagaccagttaggaagggcaaatcacattagacattttttagatatgctttggtcatttctaagacgatagtcaggcatctaagttatccgttttattagattagatcagtgatggtattcgttatgcaaggacatccttgaattgtgccctttcacttgaaaattttaaaatatccttaaattcaagatttccttaaattgagcattaaaaaaaacttaaaacttaaattttcaatttgaattttatactaaaattttttattaacttatgtcattatttttaaaagtagacattttttagttgtgatttggtcatttttaaggtgctgatcagacgccaaaagctatctgtctaattagactagatcaactagtatcgattaattctgaataaaaaaaaaattattttttaattaaaattgtaaaatattttataaattttaggaatcggattgaggaggaaatgcgcgagaatcacccttactttgatcggcctctgttcataattgcccgtgattcgaaactgcgccggttctgtcgtcggtttgtgcacgcccgctggggcttcgatgtcggcgctgaaatgggcggcgaagcggcggcagtggcacaaatggtgccggacgaacgccgccgctggcggtggaaagcggncccaacaataca

SEQ ID NO: 73631 - DNA, 1746 bp, Heterodera glycines
  Genomic contig location: Contig_ID=SeqID_10432; Location=628..2373; Strand=+
  SCN-specific regions: Sequence locations=1-389,423-521,543-583,605 -673,707-744,771-918,969-1461,1483-1496,1520-1746
  Gene Ontology: Biological process=adult locomotory behavior
atggcaaaagtgatcgctgacggactgttcttcacgcccaatgcgttggtgcgcgactttggcggagtgatgaccgtattcgtctacctgaccagcttggtcttcctgttgctgatgcccaaacacgtggagatcaattcggtggaacagtttctgatgatctgccgcgcgatgcgtccgctgcgcatttacacgctcgtgccgcacattcgtcgcgttgtagtcgagctgttccgcgggtttaaagtaattaaatttgttggatcttaaattgattcaaaattatggtatttctacgtttttaggaaattttgcttgtgaccattctgatgattgtggtgatgttcatctttgccagtttcggagtacagacagtgggcggaaggtgctaatattaataatttgttatttatttattaatacgcattttaatcattctaaatttgctcatttaagattggctgcctgtaatgatgtgaacgtcacacgccaagtaattaaattgaaaatggctctaaagcaaacattcatttgggactatgaatttcacttttataggttgattgcacgggcatgttctggcagaaaatctttgtcaccagaatggaggtgtacggtaagaaataatttttgttttttagcttaaaaaccaaaacattgattcaatggcatatattttgttcaaaatttaaatgtttaaattgatgttttttattactttaaaccaaaagcattaaacttttcaaaactaaattaaatttgatttatttcaaggcaaaaacagtgacacgcttcatccaaaagtgcttgtgccacgcgtttggtccgttaacataaaggaaacaaattaataatttgggttatttttgaaggacaaacccgcgaaatttcaattttgatcacattggcgcggcaatgtaaaaataacaatatgtaattaaattaaatattgttttttatattttaaaggttagcactgttcgaaaccttgtcatacaaaggatggaatgtgatcagagacattttgtgggcacggcaaggccctgtaaaatttggcaaaaataatgcaccttaattactctcattaattgggttttgcatttttcttcagtgggccgttgtgttcatccacatttacgtgttcagcggttgtatgatcggattgacattgtttgttggcgttgtgattgccaattacaccgaaaacagggtaaatggattttatcatatttcctccgatattcacaaattttgaaaataatcttgaaacatttcgagcggctaacaataagaccaaaaaacggttgtagggtttgcccacgacaaaatattttctggtttcggtctgtatacctagaaaaccattctaacatcggcattttttcccttttcagggcacagctttgttgacagttgaccagcgacggtggcatgacctgaaggctcgtcttaaaatggcacaggtttggtgccaaggctctcattttcatttatcgcatttaaattcttcccaattttcagccccttcacatcccaccaaaaccgtccgaatccgccacatttcgtcgcaccctttacgagctgacaatgtgccggctgttcaaccaattcttcgccgccatggtggtactgaattcggcaacgctgattctgccgtggaatgttgaggaggaggaggacaaacaccgattactgtacattgtcaccgcactctctgccattctcaatatgcttttcgctgttgag

SEQ ID NO: 73632 - DNA, 2037 bp, Heterodera glycines
  misc_feature (3)..(3): n is a, c, g, or t
  misc_feature (21)..(21): n is a, c, g, or t
  Genomic contig location: Contig_ID=SeqID_10433; Location=121..2157; Strand=-
  SCN-specific regions: Sequence locations=1-99,122-422,444-969,991 -1296,1318-1552,1574-2037
atnggaagttcacaagggctntataatcgcagcaatactggaggttgttaattttttggtactcagaagatggaggaatagaaaaggaaatttatgcatgaaattttcatcataaaaatggagaaaattaatagttatgaaaataaatagattattaggggcatatctagcataggaacttatcttatttaaaatatcgaacagtcagctcacgagaaaaagtatcatttccggaaatatcttctgggcaccggatggttggcctatttggcagcagaatcaaatagtgcccaagatatacccccgctgaaataaagcaatagaaattaaatgatggaataggccacgcaataagctctggtatgggtaattccagccgaagcttaatatttttttcaatttcttgttaactgtaatttattatttaactttttcagatttgactcatgcattgcgtcaacaacgcaccgaggacaatcacatttcgataaatggacaaatttactcagttgacggacctaatgttaatgttggtgttgaagggcatgatttgagtgtgaatgggagagtttatcaaaacagggccacagagcagtatctggaaattatacaagacaaaaacataagaaatgtaattgtcagtgtgccattatcgttattttctcgcgaaaacataaccgttgggcaaacgcgacatattcacgctgaatgcgatggaaatttatatatcgaccaatcggcagatgactgtattcgcatattatgcgttgatgtaaaaaaggatgccgctgcaaagaacttttggtcaacaagtggaggctttaattttcgatcgacgagtgttttttacaatttttcggtccgaggaactttacatatccataattcgtcacttgagtgtgctaacattgaatgtgatgcatctttaaatgtaactcactcaccaatagaacgtaatgcgcaaatgaaatgtggtgggagtttaagtattgatgagtcaccaatgggaaatattcggcttaactgtgatggatctttgcggatcgaaaaatcgaaaatggaaagcagtcagattgatgttggtggaagcattgggattgttgagtcaccaatgggaagtattgggattgactgtggtggatctttacggatcgaaaagtcgaaaatggaaattggcaacctagactgtggaggaagtttaaccattgtagaatcgccagcgcaaagtctaaagttaaactgtggaggaagtttaaatatgaaggagtcgccaatgaaaaatgttggcattaattgtggtggaagtgcaaccattaagaagtcgaaaatggaaagtggtcgcattaattgtggtggcagtttttcaattgatagaacgccaacgggaagtgttcgaattaattacggtggaagtagaattaatttatgaggtcaaacgaatgatcttgttcggaactgatcatgaattagtctagcataacattaatagatagaaaaacgcaatatacaccatattataattgttttctttgtatctcagtaatggataaaactttatattattttcaaagattttattattccctcttacgaagtgtattataaaaaggattaatttgcattaagaaacattaaatgtggaaacattatcacaataattttgaatttgctttaaaatggtgattttacatgcataatttaatatatgggtgccatttgataaataattaaacgtttcaaacttctcttgcgcattatttgcatgggactcgatcggataaagttagtactgaatttatgtagatttttccaggccaggggttcgagatagagttctggaatcaacttatggcccagcgagttttttgacggggttctacaaaaattatcgacataaactcaagggggcggagtcgttattaaaaaaaacaatatgattttatgaaaattatctatacttagccaaaaagcaaccaaatttttattcttgatatctttcgatagccctaattatactctatcaatctacaaaataaa

SEQ ID NO: 73633 - DNA, 820 bp, Heterodera glycines
  misc_feature (793)..(793): n is a, c, g, or t
  Genomic contig location: Contig_ID=SeqID_10434; Location=9..828; Strand=-
  SCN-specific regions: Sequence locations=1-231,254-540,562-568,591 -734,756-820
atggaagcaggagacgttgacataattcgacaacaacatatccgctattatgctgacattgatggcaggaaatatccaactgaaggacccgattatgatgttcttctttatgggacggatcttttagtcgacggaaagttatataaaaatgcagtccccactggttatatcaattatatcaatcgaattgaggaacgaattcccgttctcggctcatcaggccgaagttagttttatttatttcttattttctcgatgaggtttccactattaattctgagttcttaacgggctaaatgttttatcagttacgaagtttgcttgccataatcttatttcgttttaacttttttaggcattcaactgagtgcggcgggagatgatcaaggaaataatgcacgtttacatacgaatgttgttggtcaccaaatttcagggagtgtctccttgccagaaattccgattgggggaaactctgattatataaacactggacataacaagcatgatggaaaacccacttttggagacaccaaacgggaagaaaaacagaagaataaacagaaacagcaaaagagaggagagctaatcggtggaaattttacacatataaacaatcaaaacaatgaaaacattggtggtactcaagacatcggacgcatacaaattggaggaatgccaccaggaggagctcttcatttaaatactggtggaaatcgcaacgttggtggtactcagatgattggaggcataaaaataggaaagatgccgacaggagggacatttggtttanatattggaggcaatcgaaacgttggag

SEQ ID NO: 73634 - DNA, 928 bp, Heterodera glycines
  Genomic contig location: Contig_ID=SeqID_10435; Location=1468..2395; Strand=+
  SCN-specific regions: Sequence locations=1-130,158-220,242-282,304 -383,406-431,453-546,570-705,728-928
atgtcttctctgctgctctccatcttcccaattgtgtttttggtctgttgcaatgcaatgccaagtaaatgcaaataaatttaaaaaaagtcatgttttaaatatctaaagcattcaatgtaataggcactttttataaaattatttaatttaaattccaaagatttcccgtgctgcccgggcagtcagcaagtggttgctgtgatgtccaaatacattgacactttctcttctgctgctgacgagtctacagtatgctcaaccgctaaaagtactgtggatggaataaaaaatgaactgtcctctcgcggcggatgccaaaacggaggagaagcacaaattgtggatgaaatcgatcgacagctgaagagttcaacaaattagaaaataattaaatgaattttgagagaatggtacattttaagaaagagtaattaatttaaaaatattgaccaacttatctcattaagacattgcgaaaatggaaatcaattatgaggacgagtgcccgtacaatttgggctttgcccgtgccatgttcgacttggccgctgctgctgctggccatgcggggaacggcacagaatggcaatacatgaaagtacaatttgagcaggaaagccaagcaatcaaagcaattggacaagaaaagaactttgaagttacggatgtgcacattggagtcccaagcaaaggcaaataaaaataattattgaaattgagaaattaataattttctaggggtttctgcacatcaaaatgtgccgagtccgagccatgtgattgccaaccgtggccaacacagttcggttggccaaggaaagaaagaagaaccgttgtcatcggacttcgatttttgaggacaaacaaatcaggaggaaatagaatagaaaaccattttgttgacatgtcgaacatttatttaaag

SEQ ID NO: 73635 - DNA, 925 bp, Heterodera glycines
  Genomic contig location: Contig_ID=SeqID_10437; Location=109..1033; Strand=-
  SCN-specific regions: Sequence locations=1-32,55-532,554-614,636 -636,712-764,796-925
atgccaaacaagttccttccatacgaattagtttttgaaattgttcattttattcgtttccacaaaaaatgggcaaatttaaatgtgtcccgaaaatttgatcgtcctttactgaagcgaatggcacaatggcttataattatgaaaaaacgggtgagaaaatgctaagctaatttttggggtaattaaaaatcaaaaaattagcattaaaaatacaaatttcaggaagaacaatgcaagggcgccgcaaaagaaattctgaacaccatcttcaatttgcttcctcagcacgtgcgcagaggtgccattgaaagtctttacaacggtaagttacattaaccaaaaatggcgcatcacttttaggaattaattacatgctttcataatttcacccaaaagtaatttcagcacctttaaatatttcacctttaattttttttacattttttactctttaatttccgtaataattttaccagttatttttggcatagttttaaattagcagtttatttttcagcacctttgaataatttttcattaatttttagtacatttaaatttgatttagccaaataaagtttcaaatattttcacccaaatatactttaaacacatttaaaatattttcacttgttaattttttgtaaatttgaatttatttaaaattttaattatcaacaaattaaaatatttatcaaattatattttcggcacataaaaatttttatgcctaattcctttttgaggcatttaaaatcatttcatctgtattaaaaatatttcttttgtaataattaatccaaaacgaattaatttgaaataattatttacagctttggccgagatcgcaaacggaaattgtcgcttgcccaacttcaagaatttaggacaaatgggattgcgagccgaggacgggaattac

SEQ ID NO: 73636 - DNA, 1210 bp, Heterodera glycines
  Genomic contig location: Contig_ID=SeqID_10437; Location=2236..3445; Strand=-
  SCN-specific regions: Sequence locations=1-46,68-76,98-142,165 -660,683-1035,1057-1210
atggacaacgcgaacgttgtgaacccaaatccggcattgaggccgacgacgacgacgccagcaccacgtaaggacaaagacggaatggcaactttggcagaccgtaaaattgttcaaggacatggactgtaaaattcgttttcaaggacatggatagtaaaactcgttttccagggaaactgacagtaaaattttgttttcaaggacatatttcaaggacaaagagaataaattttgtttttggggtctgttccccgccgtgtgccgggaacaaacccaaaaatcgtttctaaaacgaaatgatgactaaaaacgaagagaaataaaaaaataacaaaatgaacacaactaattttcaaggacaagcaaacatttcttcaaggactaaaaatttcaaaatttcagcaaaaatgaagtgcaaattgcgcacggaatcggagaatggcgaactcaatgaaaagctgaacacgaaggaagaaactgaatgcgaaaaaacaatgaaatgtagcgcgacattctgcaaagcgaatgatggtgaacaatgatttaaatcatttttttcgcaaaaagaaaaatttaaaaaaaactcgagaaaaattgccgtaaccacgttttttatgccaatttttttttgaaaattctcggacaacaaaatgccaaaaattttacattttcaaattctatttgttttaatcaccattttgaggcgcattggtgtggaaccgctggtcatgcttcccggctgatgcgaagaaaaaggcgtgtgccaaagaagcaccgaatgccgtgaatgaacatcgtgccgaatggagcgcttctaagctggcggaaggcactgattggaagtgccggtgccgttttggtgctaacgggacggaaatgggcaatgccaagtttgtgccgtcgtcggcgccagtgccgagtgagttgaggagggaaatgcggcactggattgtttattcaaggtcgtgcggaagggcttttcaaggacatacgccgaaattaaaatttcccggattttcaaaagttcggaccataatttaattaatttttaaacgacacagtaacctttttcaaggaccaaaaaaattcaagggcagtacagaaatttttaaaaaatttagagaccattcgccacggcaacggcggaggaatggtattgatgatggctgggctcatcattggtaaatttaatgattttataaaataa

SEQ ID NO: 73637 - DNA, 377 bp, Heterodera glycines
  Genomic contig location: Contig_ID=SeqID_10438; Location=92..468; Strand=-
  SCN-specific regions: Sequence locations=1-17,74-342
atgaatagacggtaaggaattttttttataaatttcaaaattttccatttttttctaattttttcatttttttgtagcgacgtttggatggacattctcccatcttttgaccatgctcaactcggactcaaattggcattgctttctgaccgtttcgatgttttggtggacacgcattttgacgggaaaagcgaattgacaatttggcgaaaaatcaaaatttgcgagggcattggaccagaatcgaaactgtctgtacggatcgatgacaattgggtggattttcaattgccggaccattcgctgcccaacaaaattcgctttaaggaacttcagatttcgtaattttaaacttttgtattatataatatattaaa

SEQ ID NO: 73638 - DNA, 347 bp, Heterodera glycines
  Genomic contig location: Contig_ID=SeqID_10440; Location=1243..1589; Strand=-
  SCN-specific regions: Sequence locations=1-64,87-150,200-210,297-347
atgattagaagagttacaacagtgattagaagaggtacaatggtgattagaagaggtacaacagtgatttgaagaggtacaacagagattataagaggtacaacagtgaatagaagaggtacaacagtgataagaagaggttcaacatggtttaaaattatataaataaggaaaagtttttttattaaagaataaaaatcgaatgcattgaatatttaagaaatttgaaatgatattattttttacagataaaaaataataatgaaattatttattaaaaaaaaatttaaaatttacaaccaatcttcaaattaattaaaagcattgaaaaataactcaaaaataaa

SEQ ID NO: 73639 - DNA, 1285 bp, Heterodera glycines
  Genomic contig location: Contig_ID=SeqID_10442; Location=1848..3132; Strand=+
  SCN-specific regions: Sequence locations=1-330,383-391,419-461,678 -776,956-1285
atggatactggtggaccaagcctaatgggcattggctacggagagcctagccttatgaggtattggatactagaggaccaatcctaattaggtattaactaccggagagccgagtattggctaccgaaaattcacacattttttctttttctagtttttatacatttctaaaatccttaaattccttgacttctttcacacttcccacttataatatgttcaatgcttcctcattaaattccatcaaatacccctgccttctcatccaaaatggcgggactgaaaaacaacccttggtgagtaactactaataggaaataaccaaaagacttaaaaaagtaaaattaaaaccaaaataaatatttaattaaaaaataattaactccaagtttcaacttttgataaaataaaaatatttcctagtatcctggtcccaagcctattattttgtttttaaaaggaaaaattaaaaatacaatcttattaaaagaataaaatttaaaataaatcacatatttaatagaaataaaaaacaaattatcttaaatgttaaaaaaacataaaacaatatttcaattattagcagactaaaaaattagtcgtagatattaaaaaatttataaattaaatcgaaaaattatttaatataatgcaaaaaaaataatttgtaaataaaactttacatcagttggtttaaatttgtaaaaagtgtcttcataaacaattacgacctaccttaccttcttggttttttgaatcagcataatgatggattcaattaaaaaataatgtttattgtttagagttaaattaaattactaatttcttacaaaaattttaaattaatttatgtgtatcagttgaaaaaattttaacataatactaagaaaaattgctttattttaatatttttaatttatttttttatttatcaaaaaacaataaagttttaattgcattctgtccattgaaacggggcggagtcgttatttaaaaaaccatcattatgattttatgataaattatttataacttagcttaaaagcaaccaattttttattatcatataattcgatagcactaaatatgctctacaagtttacaacaaaatttcagaaaatttcgtcaagtttcaaaaattttagggccaaaaatgctcgaaaaatactcgaaaaacaaggtttattgagttcatatagccataacgtttttgaaactgaaggaaattttctgagattttgtaaaattgtagaacatacatagagctatcgaatgatatgaaaaa

SEQ ID NO: 73640 - DNA, 715 bp, Heterodera glycines
  Genomic contig location: Contig_ID=SeqID_10443; Location=188..902; Strand=+
  SCN-specific regions: Sequence locations=1-67,89-166,189-211,243 -248,270-330,352-363,385-485,512-533,555-583,605-715
atggtgcgaatcggtattttgggcatggaagttcggagtctgatcagggacagtaataggtcgagaattgggaacccctcccccggggtaatgaggtatttcaaattattttccaaaccgccaaattataaatccgaaacactccaatcatcattcattttttccattattttattttattttattttttgaatttattctgacattttagttaatctcaattttatttgttttatttaattgacatggaaattgatcagctaaattttcacctttttccttcaatgttcgtcttcttcgcagttctgaccaccgcatttatgtgattaattaaaaaactattttatttactcgcaataaaaatatataaaactaattgttttatttgctcaaattaatttttagttttggcgtcggcggatatgaaccgatgaaatgtttagtaagttaatgttttccaaatgggatgttcgcttcgtttgcgcttttatttatttatttttaatttttagctttttccaccgcttcaaattttgcattttgagcattctcatcgctcttaatttattccttcttttagcattcatcaaaaagcaaaatcgaccattttgggtttaatgtgtgcgaagtgctcaacgaggacggaacaacacaatcgaatcagccaaacaattcagcaatatttttccacgaggtgaaaatgattaaaataata

SEQ ID NO: 73641 - DNA, 1396 bp, Heterodera glycines
  Genomic contig location: Contig_ID=SeqID_10443; Location=1456..2851; Strand=-
  SCN-specific regions: Sequence locations=1-105,127-501,523-728,750 -790,819-957,994-1073,1107-1113,1142-1270,1292-1331,1360-1396
atgcgacacgcaagtgccattcaattacaggaagggcggagtgttcagtgagtaaaagaaaggggggaaagcgataaattaatgaaattaattataaaacattttgaataaggaatacatttcaaagcttttttgatgcttgacctcctttttaattatcctttctttttttaaatgtcattttaaaatttcagtgcgaactccggcgggtgaaaaaagcattaaattttttacattttgctggaaaaacaacagcaaaacgaagcagaaataacggcggacggacattcttttgacaaaataaaataaaatgaaaatggtaatgataattaaaatgaatgaatattacgttgattgatgcgttttttggggagagtaaaacggtgagtgatcgctccaactgatcagcagcagagagtgagtgctgttccgtggcccatttcgcttactgccattttctcaaagtgactcatccattttcggcaccatcgattgattacattattctctacaactatttaagcagtcaggcgaatgattttgcaggaaattctactttttttttgcaagtataacgcccaaaattggtccggtgatcagaacaaaacacctaaaaaccctaggcatttcacgagtcgagttcgaaaccgagctttttgagcagtacatttatatttttttatcttaatggttaatgaagaaatttgtgtctaatgaataaacgaaacttttaatgaattcagtttaaacgattttattggtagtataaatgatggctaaaaagtagtagaaataatttaaaatttaaaacaataaatgcacgcttttgggtgaattaaattataaaaaaattggtcaattattattaatgtccgactaattaaacacagtttgcctcatcattggcgcatttgtggggcgaatttgaccaattgcagagagactgtgaaaaaagagaaaataaaaataaaataaaatcttttaaataaaattgcacccgaataaatgcagaaacgaaagtgatcagagtcaaaagggagacgcacaaaagtgaccacctgacaaaagagcaaaaaatggcaattattaaaacagaagcaaattgataatgggaattattaacaaattaattatttaattagaaaaagtgaaaatggaatttataatttaccaaatgaggagaaaatcttctcattgaaccaggtgatgcgcagatggcattggatgaacacgttcggagcaaggacagagtcacaagtgatcagacgggggaaaatgggcaaatccttaaaagggcaaaagtgcagtgattaagagagtctttttcggtgttttaactttctaattaaaatttaaaccaaagtgccgaaagtggtcgaactaatgaacaaataaa

SEQ ID NO: 73642 - DNA, 443 bp, Heterodera glycines
  Genomic contig location: Contig_ID=SeqID_10443; Location=3526..3968; Strand=-
  SCN-specific regions: Sequence locations=1-120,213-354,376-392,414-443
atgctttttaagccttatcctggtaaaatcagagagtgaatgacattcattaaatctgaagatattcggagaaaaaaattttggggattaaaattgtttagaagaattttgtcctttaagattatttatttataattaattcattatattcaccaaaaaatttatattttgaaaatatttgaattttttaaacaaaaattttttaattttttgactaaactttaatttttgctatgaatgtgcaattttttaggagttttatattttctttttacagcacttttcttacaaaattttggacaaaagatggggagactgagtctttttgggaaatgggaccggacttgccacgaaccggaaaagccggaaccgggattttaatatgctagaaatatttactaattatataaaattgttgtgttatgattaaagaaattaataaa

SEQ ID NO: 73643 - DNA, 183 bp, Heterodera glycines
  Genomic contig location: Contig_ID=SeqID_1454; Location=1..183; Strand=-
  SCN-specific regions: Sequence locations=1-183
ctcaacaaatggaacccgcccattgtcacgtgttctcttgggaattgaactcgcgcactccgctttgctatcgcttcaatttgggcattagtagaagagtcttttccaactgtgaattaaattccacctaatgtcaaaggtgggggaggagcgcggatggctggagaatttcaggccaacaaa

SEQ ID NO: 73644 - DNA, 153 bp, Heterodera glycines
  Genomic contig location: Contig_ID=SeqID_1454; Location=1741..1893; Strand=+
  SCN-specific regions: Sequence locations=1-37,59-122,147-153
aaattttcgattttcacatttttgggctaaaagtggctcaaatgatcttttattgaaacaatgttgaatttcagttcgtttccgtgtatttaaacaaagtttgaaccaaaaatgtgaaaatcgaaaatttgaattttcgactttttgttcgaa

SEQ ID NO: 73645 - DNA, 1205 bp, Heterodera glycines
  Genomic contig location: Contig_ID=SeqID_1455; Location=5..1209; Strand=-
  SCN-specific regions: Sequence locations=1-119,141-579,601-1205
atgaacgagtcggccatgacggaggagaacatcacttacagcggttccttcgcaacgacagtgcattatgtgaacacgccgttggctaacagtctgaatgtgagggataagcatccgttttaactttagtttgctatttcatccaaaggaactgttagaaacaacagtctccgaaaaaggcatttcttccgcaatgagtttacaagaaaagaattcgccattatatgcttcttgcgaaaaattcatagaagccgacgcgacaagtttgagaagtttgagcatttgcagtgagctcaacgcgcgaataattcaacggggcggaagaacgcgcgtcagtggacgctctaacaaagataaaatggttggtaatttgttggctaattcaaaagtgaatacggtagtgaatggttagataagacggccatctccgccttcacttccaccgccactaccacctcgcaaacaatcttcacaggtttacattattgatgaaaataaactacgcacgatcagcaatcaaattctctaatttagccatgcttttcaaaatacattcctccggtgttcgatggtaagccgaattggttgtttttgtttctttagcgaattttgcaggagattacgttgacattgatgccataatggagattaatcaaagcgaatacattaacaaatcaatgctcattagttcgaatgccggtcgagagatgccaaaatatcaatcacacaatgcaacagattatattcaagtctatccgaatgcaacttcagaattaagaaaggttatgcaaaaactaggacatgtcgaatcaaatagactcattaaaatctgttaccaaatcacatccaaaatttccaaattttcccctgcggcgcctaccggcaccgccgcccaccccagttcccgaaaattttttggaaaaagtgcgccgcaaaaaagtggttttggaaagcaaaaaaaaaggtcgtcaaaatatatctttggccaacccctcccccttttttatgtatgatgaccactcattaactttcagacggacgattcactcagagcaccgatgagacgctcgagttccttgtacgacttctttgtatctcaacaacctccagttcattctcttgcgaaaaagaataacgaagccaaatactatgcgaggaattgggaatttggccgagaagtttcgtttcgtcgtcttcgcatatga

SEQ ID NO: 73646 - DNA, 2629 bp, Heterodera glycines
  Genomic contig location: Contig_ID=SeqID_1455; Location=1299..3927; Strand=-
  SCN-specific regions: Sequence locations=1-108,130-650,672-964,986 -1303,1325-1451,1473-1756,1778-2629
atgggaatttgtagatggcttggacgaaaggaagaagtttctttgtttgataatgggcttcgaatcgaatcaagcctcaaaattcttaccgatgacaaggtaggttataagaaaaaagaatgagagtaacactgtctatattgggccccttaaaaaacaaatgtctgaaaaatcctgaaagaataccataatgagcattgataaatttattttagtggcaaaatcgttatgttgtttgccagaggcgctgcttgtccgaggctcctttgctagtaattccttcacgcagaatttaaacaataaaaaaatcagggtattttcaaaaatggaggttgtcgtgaaagaggcgaacatttggaacttttctatttgcagaattacatcggatacgaatatggtcgtctttaagcctctattttttgaacaattacagtgtattttaggttttaaattcaaacgctcgaataagacgctcgccatcttgatacaaggccaaactttgatcttctcatttagcaatgtcgagagcatggtgttttggaaggagtggttgaaggacgtttgtgggcgaagtcatttattgagccgcacttataatgacggtgcttatttttcaggtgccatgtattttgtcaagtgccataccattccaaaggacaattccgtcatcaaattaaactctcgaagtgcacgaattcacatcactgtattttgttgtagaatacaagtgctactttcaaatgttattctttaaagcgctacgccctcgtcattgtccaggaagtgccgccgaaacagcgattgtatctcaacttggaagatttgtccggtaattactgctcggattggtcaattttttgtttttcatctatcagcagatgttgaatgcgttcaaaatcgctttgcgtttcgcgcattgacctacccctggtcaacaccgcaaagctttgtgttcactagcgatcagatccctgaactgacagccaaattgcagtgtctcctgaaggtgcggtcataggtcttttctgggatgaaattctcgttaagacgaagcagtaccttcaccagggcagtcaagcaagtcgaatgccttcgttgaaaagcagctcgcttggccaggcgtcgtccagccatcagcagcttctgttttcgccctctcctctctacgccaacgagggaagacagacgccgagtcccatttttgcgtcgctttatgcgaatgagggtcagcgcaagtttcagttcccatcactttttgttaataacaacagcgaccaacagacggagcattctccgctctttccttcactttatttcaatttgacgggtcatcagcagcagcaaacttaaaattgccttgcaaagaatttttcgttctgctttattttgttttgtttttcattcagatgctttaatcatttgttgttgactcaggtgccttcttttactgccatttctttgttcatttaatacctcggaacattctcgaaatggcagtccaattgcaatttggctcaatctcagttatggatgggtgctactggttgctttatttcttactttaaatacattccttttattgaaagagcttgataaattttctatgttttcttttgggtttttatggaatggtgcttaaatcgcgatcggcttccttatttcgatgtaatgccccattattaaagatatggatgaatttaaggacgtcgtcctcattcacaaagttttgatgaaggcgaagctgagccgcctccgctgaagaaaaagtcaatcgaagaaggaccatacgctattccggtggatttgggtaaagagaagtgcgagacaaactccaaaccaaaacgataccccaggaagcgaacggggaggcggattttctgtggaggatctgttgatagagagtgacccagcacagagcaaggaagacgcacaggaccgggcgtttgaggacctgcagttcatcgaaggaacgcccgcacaattcctcaaccaacagctcgtctccgaagtgacccatttcagtccgaatgcggccccgcctggacttgtcaagcccacttccgattcgccgtttcttacttttgctgagaatggccaccataaaatcggcaaatcactttcgagaaaactgaaacgacagctcactggatcatacacagttaggcatttcgattttgctgtacatttaaattctaagaaatatgatggcgacaaaagcaacagcatcagttacacgagggaaagtaatgagagtgcaaattgtggagctttactgcccacaaaaccagttatttcgatggcggataaagccatcagcaaacaatcagttgaaaatgagttagtgaactgccgaagaaagaacgagccttttgttacgtcgagtattcgaattgacagtgcgatacaacggggcagtgaacgtctgaagtggagccaaaggagttcaacttccaattcccagcgagagagcagtgtggagagagaagaacatcgtagccacagcgaagagtcgtctttatgtgaaaatgccgtggccattttggccacacaatgcggcatggacgagactaatgtgaaggtggaagaagaaagcgtccgtttgctgaagtccgaggaagaaatgtactga

SEQ ID NO: 73647 - DNA, 950 bp, Heterodera glycines
  Genomic contig location: Contig_ID=SeqID_1456; Location=1..950; Strand=-
  SCN-specific regions: Sequence locations=34-285,332-863,896-950
  Gene Ontology: Cellular component=membrane; Biological process=G -protein coupled receptor protein signaling pathway
aaaataaaaaaaattaacaattattatttatttccagccaatgttgggaaaacaagcttaattgatgttcttgtatacgatcgtttttctgatcatgttccagcaagaagtggtaccatccaatttccgagagaattcagcgaggatggcgttttgacgcaaataacagactattcaggtagcaaataaacgctaattgctttattcctcccaaatttttacaaaaattcggtcattaacagagctatgatggcaccgaaaaccgccaaaatagtgcttatgattttttcttttatcggcttttattttatttttttattttaatttgtttgtttagaaagggtacaaagcgatgaagaacttaggtcaatgataagagaagcaaatgccatttgtgtggtgtattcagttgatgatcgaagaagcgaggaaagggtaatttaacattttcgtcaatttagcaatgcattgattaggtcaccagctattggcttcccttaatccaagaaacacttggcggaagcaaccataattgttctgtgcttttggtagcaaataaatcggatcatcagaatggaggagatcacattgtaaaaatggctccgataatgaatggttggaagataacgtttttttcttactttttcctcttcttttaagactacttggaaattgaaactgttgtcgaatgctctgcgaaaattatcaaaaacgtctcagaaattttttattacgctcagaaagcggtattttctttactgttgcttttcatttcttttttgaatttaggtcatttatcctttccgacctcttttttctgttgagaagagagaattatctatcaaatgccaaaaggcaatcacaagaatattcaaggtgtaaaataaatcatatgtgatttgattgttaattggtaaaatttgttattcaatttcagttatgtgatccaa

SEQ ID NO: 73648 - DNA, 446 bp, Heterodera glycines
  Genomic contig location: Contig_ID=SeqID_10444; Location=257..702; Strand=-
  SCN-specific regions: Sequence locations=1-2,35-195,217-446
atgcccgcctgggtggccaagctggtgcctgattggcttaatcacggtgctttatcccttttcgtttctttttgcattccccccccccatttttagtgtctcacacggcccccgtcgcttttgtattggttgacactttgctgacttgtcaccatgcacccgatcggaagattggctccactgttgtcgtcgcacttttccttttctacgttggaatgtcagccgatttgaatctaacggaatttggcattttcccattatcctgtcctgaatgctttttttcattttttatagaattatatccgtccgtctgatcagcggtcattggctgtacccgattttcgatcggctgtccaaccagcaaatcgtgggattgctcagcaccgccggtgccctcttctggttcctctatctgatcggggacggatttaatatggccctttggg

SEQ ID NO: 73649 - DNA, 1020 bp, Heterodera glycines
  Genomic contig location: Contig_ID=SeqID_10445; Location=113..1132; Strand=-
  SCN-specific regions: Sequence locations=1-167,195-346,385-409,446 -892,914-935,957-1020
atgcgagtcccattaatttctctgtccgcttttcatttcgtattcccttcccttattttgttgacgtctttcctttttcctgtgcggttggtgtggcactatttttgacgggataaatggacaaaatgacgttttaatcgataaaggcataaataagtgacaaagtccgcacgccctcccctcccctcctgccacatggcaaccgaaggcaaagggacgaagacaccaaacccaccgaatggcattttttacactgcattttcctctttgttcataattgttgttgcactagtagaaggaaaaacttaattgatcatttaaaattgggcaaattgctccttttccctttatttttgatttcaaaattaaaaataattaatttatggggctggttttatcgccttatttctattttatctatatattttagatatttattaaaaatgccgctgttttcagctcatccaattgctttaccacacgacggctgccattgtcgcaatttgctcaattcggccacgctcttttatgcccaaattccattttattgctactgccattgttttcccggcttcatttgtacgtaataactagggagtccaaaaatatggatataaaatcgcgaaatatggccataaaatatggaccaaaaatcgcaaaatatggacataaaatggcaaaaatctcaaaatatggaaataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaa

SEQ ID NO: 73650 - DNA, 155 bp, Heterodera glycines; identical to SEQ ID NO: 51421
  Genomic contig location: Contig_ID=SeqID_10445; Location=223..377; Strand=+
  SCN-specific regions: Sequence locations=1-155

SEQ ID NO: 73651 - DNA, 275 bp, Heterodera glycines
  Genomic contig location: Contig_ID=SeqID_10446; Location=1396..1670; Strand=-
  SCN-specific regions: Sequence locations=1-139,161-275
atggaaagagaatgggaggagagcgactggaagatgaagctgagaatggaaccacggcgtagaaacggaacagaaacaaatgccgaaaatgtggacggaaagcgatgggaagcaaacggcaaaacgaacaatgcgcaggacaatggcaatttttatggcacaaaaactgaggagaaacgaaatgccattcccggaaaacgagcggaggaagagaacggcataaagaaagaggaggaggggcgaaacgagccaagaatggtgccaaagccgtggtg

SEQ ID NO: 73652 - DNA, 413 bp, Heterodera glycines
  Genomic contig location: Contig_ID=SeqID_10447; Location=127..539; Strand=-
  SCN-specific regions: Sequence locations=1-64,87-218,284-413
atgttaactataggtaattttgttttttcatttttttggttctcaaatgtctactttcactggttctggttctcagttgtcccggcgctcaaattttcttcggcaaaataaagtatgtttttggagtgatgaatcgtggctgtatgatggattgtatttgttgccacagcaatataaaaattcgaatttgcagcagcggcaagtcatcttggaaaaggattatttaatattttatgcattaattatctatctaatctataatatataaaatatttgatatattcacatgacggcatcctccatttttctcgattggaattttgcaatttgggcatttcttaaatttgttgactacatcttctgataatttattgtctctaaaatttgtgtcttaatagcgcaaaaacaataaa

SEQ ID NO: 73653 - DNA, 368 bp, Heterodera glycines
  Genomic contig location: Contig_ID=SeqID_10448; Location=996..1363; Strand=-
  SCN-specific regions: Sequence locations=1-368
atgacttgtactttcccaaatgtggctttccttacaacagtgcgttcagaggctttttatggcttgaccgttgccgcaagtcttctcggtttgcttagcgtcagagggttatgctttcgccgtaacgtttcaaaccgatgtgttacgggagaaggtaggtcggagaaattaaatgctaataaatctgcaggcgaattcccaaattatagcaattagagaataataataataaaaaagaaataaagaaaaagaattgaaaatttgccgaccgaatgcactgtcaatcaaaatcaaaagcaataaaaaagctttagctgactgcgccaaaatgttatgtccaaaagtggacacaacttaaaactaataaa

SEQ ID NO: 73654 - DNA, 379 bp, Heterodera glycines
  Genomic contig location: Contig_ID=SeqID_10448; Location=1576..1954; Strand=+
  SCN-specific regions: Sequence locations=1-323,349-379
tcaagaatcagacggaggcttttcaagcccttctccaaaatgcccaaacaaatccaaattccgtcaatcattccactatttattcgactatcaatagccaacttggccaattcacatataatccagaattggatttaacttttcaagcatggctcgaccgttttggcccgttcattcaggtggatggcaaggaccttccagacgcaatgcaagtgcgactgctgcttggaaagctcggtcaggaggagtacgctcgtcatgcagaacgtgtacttccaagactgccgaccgactttacattggcacagacaattgataagctcaaaattttgtttggggaaaccaaaagcattttcacacgtcgatatgagtgttttca

SEQ ID NO: 73655 - DNA, 3071 bp, Heterodera glycines
  Genomic contig location: Contig_ID=SeqID_10451; Location=1530..4600; Strand=+
  SCN-specific regions: Sequence locations=1-192,214-214,237-1032,1083 -1485,1527-2114,2144-2147,2169-3071
  Gene Ontology: Mol. function=peptide alpha-N-acetyltransferase activity; Cellular component=cytoplasm; Biological process=protein modification
atggcttttactggcattgcagcaactttgctacctgccgggaggacattgcacaatagatttggattagcattagacatgagcaattcaaatattgggccaagatctaaagcttggcaagagctaaaagaaacagatttatgtatttgtgatgaggcgcctatgataaataagcgcgcaatgaggactttagatgagaaattgaaagagattatgaataatggaattgcatttggtggcaaagttatgctttggacgggagactttcgtcaaactcttccaattcagaaacatgccacgagagctgaggtagttaattcaaccttaaaaagaagtgagtattggagattggctaaaagacataaattgacgaagaatatgagagctcttgaaacagagcaagaatttgcgagaaatttgttagagattggaagtggaacatagaatagtgataaatgatgagatatagttgtacggcatcaattatatttatcaggatgtgacccccccccccccggcaaatgcctttctctccgtttcactatttgcttttctgcactatttcgctgtttctgctcaaggtccaactatttggtacaacacacagctggtaataggtacactctttaatcgttcattattataatttttgttgctgtccgtgtgtaacttcgtcagcaatgttctttgccctgtgtgaacaatgtatgaggcgacacagatggagtgcctcttatttcagatccaagcactttctctatttttttcttttatttaaactttattattgttaacacttaacagtgccagtttataatttatcaatattcaatcagaatgtaaataaagaatttacctatgcaactgaaagttaaataggtatagacaaagggcaattggtattacacacaccgattcaattttgatcccctagttcaaaagtaaatgcgtgtgtggcgaagtggtttttttaagaatgtaaagagacaaagggaggtggagggcggaggttcgagtccgttgtgcaacatgaatatttttttatttatttttgtctaaaaaatttaaaaaatacaatttttgaattggatgtttttttgccaaccaaattggacaatcttggtttcattcgaaagttcttgataagaagaagatttttctaagcaaatgctaagcaattgatgagttagaaaaaagaataagcgttcgattttaaaatctgtctgaggaaaaaagttatgctgttcgaagtaaattcggtttttctctattaacagagacaaagaaatagtacgccaaaacgagagatgttttttttctctgcactctcttttcaactcgactagccttactttttggatttatcgccgccaagcgaacatagccaatatggaagtaaaagaaaatcccttcccggttcgtatcaatgcattttggtcaacttttcatcaccggtgcttgttctgttgccaagtcgcgaaatagatatatttttcaatgattttttttaattaatatttatttttgttccggatttttaattatactgtatatgaaattttagaaataatttatgtagacctatattctaggtttttattttttagatcctaaaaaaatttaaaaatcggttttaacctatattttggcgttttgcccaaaataattaagaaaaatataagaaaaaaaatgcaattcaaagttgcaaaaaactgccaaaatacctagttagttccctaacccgaactcgaactcgaataaaaatcgaaattttgaatttttcaaattatgattttttgttcaaatttagattaggaaatcggaattgatcaaaatagttgaaagattcgtgatcggggaccccaaaaaccccagagaataaatttttatgactatcacaaaaaaattttgcaaaacaaaagggtcccgccttttgaaaaaatttccaaaaacggccacttttaaagtagcgcccattttcttttgatacctattttcattttgtccatattgcgatttttagtccatattttatgtcaaatttcgtgattttatttccatttttgggaattcttgttataactttagctattccgaaattctttaccaaaatgtaaaaatatttcaattataattataatttcttcactacatttattgaaacaaattacaggtttaatgtctaatcaacaaattattagtcctagctgccaagctcttccttccagagagcaagctcttttcaagaaattaattgtatgggttttccatttcttttcatgtagaaaaatttcagaagtgctatgaacaaaaacagtacaaggttggcttaagatgtgcaaaacagattatgtcgaatccaatttatgcggagcatggaggttatttaagcgaaaggagggagtcgaacaaaacagtacgaatttaagaaacacttgcgatgaaaggattgattctaaattgtatggggaagcacgaagaagcgcaagaaatagtgaagaagggactgacggctgatctgaagtcgcacatttgttggcacgtctttggactgacccaacgcaccgacaaaaagtacgacgaagcaatgaaagcatataaaatggccttgaggatagagccggaaaatatgcaaattcttcgggatttgtcagttcttcaagtgcaaatgagggatttcgaaggatatcgagtcagttgggtgccttttcaacccatttttgttcccatttaaggactcccgctacaaattgctcgagttgcgaccttcaaacaaaatgggatggattggttatgcttcggcgtatcatttgcagggcgaatatgccatggcgttggggatcatcaaggagttcaagaaaaacaacaaggtgattgtccttatttttataatattcccttaatcttagaaggaaaaaattatttgcacttaatgatgtttttagccaacgtctaatgtcgattatgagaacagcgaaattttgctttacgaagtgatggtcctaacggaggccgggagaatagaagacgcattgaacaaactcgaggagaattccgagctgcataattga

SEQ ID NO: 73656 - DNA, 278 bp, Heterodera glycines
  Genomic contig location: Contig_ID=SeqID_10452; Location=2193..2470; Strand=-
  SCN-specific regions: Sequence locations=1-117,140-167,192-278
aaaataattatttgcagggttggggaattgaactttagaagaagaaaaaaaggatggaagacataaccaccaggccacgacgctcacactggctttacattctttgaaaatgatatgaaaaggcaaaaaggaaaagcttcatatctcggccagaagcttcatttagcaaaaataaaaaaaattttataatacaaaaggggggggggggtaatctacctaccctgaaagtttcattcggaagtcccacggtcacttgggtacctctcctttgtcagggc

SEQ ID NO: 73657 - DNA, 673 bp, Heterodera glycines
  Genomic contig location: Contig_ID=SeqID_10454; Location=1..673; Strand=-
  SCN-specific regions: Sequence locations=1-20,89-107,155-172,379 -420,455-489,563-673
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgcttttgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggtgcgggtcgccgggccaccgggtggcccgacttaacaccaaaatggacacccttacgggcgcactcccgttttaccgattaagtaaggaatcgat

SEQ ID NO: 73658 - DNA, 512 bp, Heterodera glycines
  Genomic contig location: Contig_ID=SeqID_10454; Location=1671..2182; Strand=+
  SCN-specific regions: Sequence locations=1-512
gtgctttgcgttggttggttggcgtgggtgagtgtggtggttgggccgtttttgcgatattgtggctggaaaaaaaaatgcgatttcactgtggggagcgcggccgtctgggttcaagtgcttgcttgcgcttgtgctcggcattgaacggtgatggctgctgctggggtgccacctttgtcgtggcctcagtttctccagcgtttggcagctgtcgaaatgaataaaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctgtggaccagtgtgcttgcattcgaaaaaacacgagggataagcgcccgaaggccttttggcctgaggaagtgtcctaaccggaaa

SEQ ID NO: 73659 - DNA, 123 bp, Heterodera glycines
  Genomic contig location: Contig_ID=SeqID_10456; Location=361..483; Strand=-
  SCN-specific regions: Sequence locations=1-123
atggcacgtgacaaagtgatgaagaaaacacatggcaattacccggccccattgcgcattttggacgttgtccgcaccgggctcgtggacggcacacaggagggctacgaggaggaaacaaag

SEQ ID NO: 73660 - DNA, 1394 bp, Heterodera glycines
  Genomic contig location: Contig_ID=SeqID_10457; Location=964..2357; Strand=+
  SCN-specific regions: Sequence locations=1-65,87-232,262-296,318 -703,725-953,975-1394
gaccttttgccggtcattcgttcgcttctttccgtcgttagcaatgccctcagcacttcttctgacactcttttgaccacagaatctgtcaattcgagggcaaaagagtcgcatgacgagcagaatttgtgccaattcaaatttgacgatttgagctcagaggcgcaattggacgcgtcaagccgcgcgcaaatggtcggctgtttggtggacggaaattgtgacactttttgggagagtggggaggaggagagggggcgcacggagcggcgactgagggcggcaaactttggcccgggggcgctgctgttggcacttttcattgacaatgccaaggacgaggggttcagagtgggacgactgagcatcaccagcccagggaggcgagaagatgaagcagcccggggggatgaagcagttcagcgaggggacgatgaagcaaaacacttgctggacacttcgttggacaaagttcgaatgcattgccgattagtgctaattaccaatgatggcctacaattaaggaattttccggatgggtcaaatgtgccatcgatggacgaaaaagcgtcgaaatttgcctttgggtattttatcggtttattttatgcatttaaaattcctttgttggccagggcgatgagcttggctgccgtgtccgccaacttcgcattctcggctttcgtcatggtccgtccgccgttccccccgccgcccctccgccaaaatccgtctcccaacaaatgcttttcaccagcggcgctcaaagcgacgcattcgctctgttccaactgttggctactcaagtgctttgtgaccgaattgcgcccgaggggacggaggacaacgcacttagggagacggtgttggacatggtcacggcacgggggcagctgatgcatcccctgcagcaatttgttggcactcacctcgccaacggtattcaaaggtgcgaattttaaattacattaataattataagtaattgctttagggaagtccaaagccttcgcatccgccgcaggcgcaatttctcatatgtcaacgctttgctccaattgctcatgcgaatgaattcagccgctgctcagccaattgttcacgcgtatgatcatcatctgctgatggcactttctgatttgtggctgttcgcttccgaagccgtgcaggaaaaagcattgaaagcattcgaatgtttaatcaccgccggcgacggagggcaaagggaaggaaaagtgccggaagggactgaaatgggcgtgttggccgaacgattgttggttacggtagtcaaagtgttgcaaatacaagtgaaggaacagcgagcagcagcatttgggactaatcgaggcagacagcaactgaccaaacacacaattggggtgagcaattag

SEQ ID NO: 73661 - DNA, 1590 bp, Heterodera glycines
  Genomic contig location: Contig_ID=SeqID_10457; Location=2384..3973; Strand=-
  SCN-specific regions: Sequence locations=1-244,272-1267,1290-1590
atgcacaatgattcgataattgtcgacctgtcattccgagtgctctccgccgatgtgccgggcaatgcgccccaaccgccgccgcattcgtattccaaacgcatccgtgccttccgcttcacgtcactctcgagttctttcaagggtttcagtaagtcagcaaaggccggatgatcgatctgatgggatattttcaatactaaaaagtctgtcccaaattccgtcccattttctgtgccaatttcgccccccccccccccgcccccgccgctttcccttcacattttccttgcagagggggcactgcatgaagcgaaaactgatccgtggccccggccaccgcttttcaagtgcggtgcgcacacattgccagtgaaaaaagtgcacacacttcagctgtacgcatggcgcctcgccaaggcgttcagagaaacaaatggagcaaaggtcgtccgcgtcctgatggaattggtctgaaaaggcatttgaacatggaaccaaacgaagcaattttgcaaatgaccgaccggaagagcataaaaggcaaggcggacattgaatttcttcccgaatgccgtggcataaatggccacagcttaacaccgactgacaagccaaagtgtccttctgatggcactcctccaactcgcagagaccattaagccgctaaaggagtaaaaggcggcataatcaaaggggagataagttgccattggcttggcttggcacctgttcagcagttgccagcgtagccccacaaaatcggcacttttagtcggccaatttgtgatctccgctcgggcattcgtcctcctcctccattgtttcatcgcttctcaaaaaccctccggggaccatttggccgcttgccctgccactgattttgcctgtgccagcgcccaattcgacaagtccgatcagactgttcgggttgatcagaatgagcagcagcggatgatgctggtcggtgctgatcagccggagtctgttgcagccctcgtggaagtccattcgcggtgtcaacactcccaaaatgccgacaccaatcggttgtgcgcgatggcattggtttcgtcggctcaaatgcaaaacggaaaaacagtcacggcacagcgaaagggcgcatgtctgacagcgcaactgcgcgcgcgtgcgtccgtcgtcatggttgtcgcagaggggcgacggagtgcgatcagtcgcagctgactgtgaaaagcattgggaaaacgaaagcgcaattccgcagatgccaccttcagtctctgatactcgggcacttcctccagccaatcgatgccgccaattgcggctaaagcggcgacagacaaccaaaaagaggcgcgacagacacaatgcgtaagcgaattgctcttggaaagcgaatcgtggaaggaggagcacagactgagcacgaaatgcgcgagttgggcacggagggcggcacgccagggagaagggcgaagtgagcgaaggaaacgaatgacaaagcgggcggactcggcactcggatggtcagaaatggcccagtgcggtggcacatcgcaggcgagagtcttgaccaatggaaaaggaccgatcagaaaatga

SEQ ID NO: 73662 - DNA, 829 bp, Heterodera glycines
  Genomic contig location: Contig_ID=SeqID_10458; Location=140..968; Strand=-
  SCN-specific regions: Sequence locations=1-314,337-541,569-569,641-801
atgagaggaaaggacattggattaagaaggattaacgggaaaggacggcacggagtgcgcagagaagaaaaacggagggacgcggagcggggcaaagtgccattacggcgatgggtcggcaaggaaaagccggaaccagcgggaggaaaagccaaaggcatttggacggatttggcgaatttatttattagccgtaagacgtgataaatccgcgcgcggaggtggcggaccacggcggatttcagtgtttatgggcttagaaagttcagaaatactgggaaaagccaaagaaaaaccatcgacgacaaagcgaattattggaacaaaaatttagcagaattaggcgaaagatggcaaaagaatggctaaaaaggggccaattgtctattgacacccaaagacggtgaaaatgccaaaagaattggcacaaaatacaaaattgacggattaaaaaaatggtatcaattaggcctgtttacacagaatatttgttcaaaagaattaaaattcaaagtgcaaaacggaagattaattaacgaataatgaagggaaaaaagcaaatgacgaagaaaattaaaaattaattaaccaaaacaacatatatttatttttattaaagaaatataaaataaattaaaatgcagaaatatggaaatcatcgacaaattggaggaatgccatagaaaaattatggaaaaccggcaaacgaaatgcagggaattttgccaaacgaagtgtcagaaactgcgcaaattgcgacaaatgccacagcccaaagcaaattctgagagaaaagaaaggaaattaattaaattaaaacataaataaa

SEQ ID NO: 73663 - DNA, 1376 bp, Heterodera glycines
  misc_feature (54)..(54): n is a, c, g, or t
  misc_feature (62)..(62): n is a, c, g, or t
  Genomic contig location: Contig_ID=SeqID_10461; Location=64..1439; Strand=+
  SCN-specific regions: Sequence locations=1-138,176-263,294-372,399 -414,436-1111,1149-1288,1326-1376
atgacaaaaatgttgaagcaaaacggtggcggcgaaagtgccattctgttgccncatcagcncaattcctcgactttgatcggctccagcgacgagtgcgacatcgtaatcaaagtccgttggatgttaatttaaaaatattttattttatttaaatttattttttccttttttagagtcccggccttcgtccaaaacacgcggtgatcgaattctatccgaaaacaaaatcattttggctacgccaattggacgcgaaaaacgaacagcaacagcagcaacagcaacagaaaaggcgcatggacagcggtgagaaaaagaaaatcattcggttactgtattttgggggttttgtaccccctaattactgtaacagtaaaataattttaaaaatttcataaatgcccgaaaacccttactttaagaatagaaaaaatcgttcataaaaagttctgtcctttttacagtaccgcctcctccaccatacccctacgaggacactgtggggccacaaaacctgtcggacaacaccagacagcaagtgttgagagatggtaggcagagaaaaaaagggcaagggcagacacacggaaacatttattattaaatgttgaaaaaataatcttttaaaaggttcactgattgaactccatccgatggacacactgcgcttcggcaaaggcgcaaatgcggtggaatttgtcttcaaaatgccgcccctccatcacaaaacggtggcacaacaatttttgaaattatgccttaattgggtaattatttgggcaattaaggcacctcgatcaaaatggtcatgatctgtgataaggtttaattgatcccgcggctcaaaaatttttcagaaataggaaatcaaaatttttttacgacccccaaaagcgtcggaaaccacaagtcggaaatcggaactccgtgccatcccaagccgtgactcgaacgcgcgggattcacgagcattcattaaatgaaaggcatcaacatttaagcgcttcgatccacatccgccgccggtgcgcaagaaatgctcgttggaccgcgaagacatttcgcttcccatcgtcggagtaaaaaattcggggaaggggcagggggcaattaaacttttaaattaattaattttttaatttttagagtcgcattcagccgaaggcacacgccgaccgttttgtccgccccaaacagcagtcaaaccacagactttgccaactcggtggccaccaaacgcagaagcaatcgcaaaatgtacagcagcagcaattatcaaatggagtaaatttaataaaaaattaaatgaaaaaattaataatcaattaggttgattaactgagttatgatttaattgcctaattacaaaggta

SEQ ID NO: 73664 - DNA, 427 bp, Heterodera glycines
  Genomic contig location: Contig_ID=SeqID_10462; Location=115..541; Strand=+
  SCN-specific regions: Sequence locations=1-170,192-199,225-352,375 -382,418-427
atgtaccaaaggaatattttggacgatccggtggaactatcgcgactcttgcgtcaggctgagagagaccacttcagggctgccgaacaaatgcgcacattaagaaaaatcgtgtgagtttgttttaccaaggcttcggggagaccgattcacctgaccgcctatccctctttattttcattaaataattacgccaccgaaattttaatattataattttttaacatttagtgaaaaaattgcggctgccaaaaagagcgtttcgtttcgggacgacaaggctgcagcaaatacagtgagcacgtacatgtcggatctgatcagtaatcggggaggcgggtgcctttgcaatgatacctccatcttcattcaggaagtgggttctatttattatttaaatgcttttgtaatagcaactggcatttaa

SEQ ID NO: 73665 - DNA, 1259 bp, Heterodera glycines
  Genomic contig location: Contig_ID=SeqID_10462; Location=605..1863; Strand=+
  SCN-specific regions: Sequence locations=1-353,388-452,474-667,689 -834,856-929,963-984,1015-1237
atgtgcaatacgcttatggagtcacccctgacgcccgcagaatgcaccagcatggttgagaccatatttcaaggcgccatttccatttcaatggaattaacttcggaggacgtcctgtgtaacttagtggacaaaaactggtattttcatgcactgatttggcaatgcactaattatttctttgatttaattaaaacgtttattttcaaacaatttttagctcggaaaagacatacaataagacgggcccgataagttgcgagtactgcaagataatgcacgcgaaggccaaaacggtaaattaaatcaaataaaaatgcgtatctcaattaaatagtttcgaacaaatttttgtttatagcacaataaaacaatatttaaaaacaatattaattagacattttttcactgcgctccttttcgtcccaaggtagcggaatatttcgacgcgatgtttttaggcctcagtgtcatgtgtgcgcgaatcgatacaccggaaggaaagatcactgtgaagaccatgtttacgtgatcacaaatggaatcaaacaaaccattaaactttatttggatgaaaaagtagcaaaaaagcgatgtaaatatactttcatgtgcaagaaatgaatggcaaatgccatccgttctttaccaataaactgaaaatctgaaacaaaaataacataattcttgcatatgggttttttaaattgccgtttatgttgtaattcacaccattttgaaccaattgatgaaaaacaaagagatgataagaaaaatacttttatgcttttttctagggtttctaccacatggttgcgtttttgtctttcctatattttcgagtttatatgcatatttttggattccctacttattatcaaaaaagctaattaatatttgactaatttaaaagctctatttctatggacaaaattttacaatataatttattttataaaaaagaaacaattactaaataatgcagtaaaagttaaataataaaaatatgaaaaagcattctcgtcaaaagtgcaaaaaaaaaaacaatgaataaaaataatgatgaatgacatttttctgtaacatttcttattgaagcaaaaggacggcaaaacgaaggcatttgaattcgaaatgaggaaacgaagagtaaaattattttattattggaaaaattgttaaattatttttgtattacaggaatggagaagtgaatttcgaaaattaaaggagagtcgtttaattttctaaaattccaa

SEQ ID NO: 73666 - DNA, 1250 bp, Heterodera glycines
  Genomic contig location: Contig_ID=SeqID_10462; Location=2743..3992; Strand=+
  SCN-specific regions: Sequence locations=1-161,187-237,297-1020,1042 -1104,1127-1250
atgaatgtgtttgatgacccggccaaacttttgcgccttttgcgtcaggccgagagagggcaccaaaaggctgccgagcaaatgcgcacactcagaaaaatcgtgtgagtttgttttaccaaggcttcggggagaccgattcacctgaccgcctatccctctttattttcatatttatttcttagccgccataatttcaatgagacatgattaggccaattttgaatttataaacgcaaaaaatatatactataatttaaaaatttcctttaattttcttataaaaaattatttaacatttagtgaagcggaagttgctgtcgataagggcgtttcgtttcgggaagaagtggttgcaacaaacgcactggacctgtatctgttgaatgtgttaaacaaaacggggaacggatgcctctgcaacggcacgtctatttttatccaacaggtgggtttttatatgtcatttttaaatgctttcataatagcaactggcatttttactgggaaaaatcatttttacaaattaaacagggactaacgagcagtttcatcggcggatctctcggaatgcaaataatgtgtagttcgttaaccgcgtcaccaatcaccccggcggaatgcagcacgatggttaacacagtatttcaaggagctgttttgattgcattggaattgagttcggcagacgtcttctgtaatttggtagacaaaaaatggtaagcaacaataactttttagtttgtacttatttcacaattgccataatcacttcaattattcaattaaacatttttccagtaatacgatgacatacaacaatactagcccgatcagttgcgcctattgtcggctaattcacgccaaagcaaaaaaggtaaattaaataaagcaaataaaaaagcatatctcaaagaatatatgcgagaaaaattaaatgaaacgtttttcattcatgctccatttcaacccaggtggcagagcatttcgattcgatgttctccggactgaaagtgatgtgctcccgtttggaaaaacagacgttaaacgaaagctgcaaaagccaagtcaagctacttacaaggaagattaaacaaatcatcgaagcttttttggatgtggatgaggccgaattgaggtgcctgcacatattcatgtgcaaggaataaaatggcgaatgcaagttaccaatttcttacaaatgaatttttgatttactgttgcaatcaacataatttgtaccatcggaa

SEQ ID NO: 73667 - DNA, 989 bp, Heterodera glycines
  Genomic contig location: Contig_ID=SeqID_1460; Location=373..1361; Strand=+
  SCN-specific regions: Sequence locations=1-142,165-168,191-191,220 -328,350-685,715-870,895-989
atgattgcacagaattgccgaaaaaattcggtaaaaacccaactcgttttttgccaactcgttttttacccaactcgtttttgacccaactcgtttttattaccccaactcgtttttattatcccaactcgtttttttgactggaaaatggaaaaaccaaagaaaacgtttaaatttttaaaaatttttagttctaaggtaatttttatttatttacagactaatttacggatcatccactaaattcgaattggtgctataaatggacagcggcagggcccgaaaaaagaagagggacagcgttacgtgtgctctggatgcagacgaatcaaggacaagaaggaagttcctagtgacacaaaattgcctgcaaggaaacgacttggtgaatcgtgggcagacagcggtccgaaatacccgcatttttgtcaaccattctcaaagactgagcttctaggcgttgaagtgagtaactttttgaaaagcctgaattaaatcagttttttgaggagcgaagaaagatccaagcggagttggcactcggcgcgagagagaacattgcttcggcgaaagtgcgaattgaatgcagaatcgaacaaaattacagcgacaaaacggatgaggaaaaggcgcaaattcgcgataaagcgtgcggaaatgcaatagcgacaaaaaaagtaattttaaaaatacaaaatgtttattagtttaattaaggcattgtatcgttcccaaatcaagcggaccatgaaggtgcgtacgttgcttgaattgcagcgtgaggaaagcgctcctctgtggaccactctgagagggcgattggcgcacagggacagtgaccactttcaagaacttttcctactggattgttcaaatgaaattgccattttttcgtcacctcgtcagctggccatgctcaaaaaaacgagaacaattataagtgatggcactttcaaaatggcaccaagaggaattttccaggtgaaaca

SEQ ID NO: 73668 - DNA, 1038 bp, Heterodera glycines
  Genomic contig location: Contig_ID=SeqID_1461; Location=575..1612; Strand=+
  SCN-specific regions: Sequence locations=1-139,161-453,475-785,808 -1038
atgtatagtcagcgcattggttgtaggtccgtaatggttacggatcatccactaaattcgaattggtgctataaatggacagcggcagggcccgaaaaagaagagggacagcgttacgtgtgctctggatgcagacgaatcaaggacaagaaggaagttcctagtgacacaaaattgcctgcaaggaaacgacttggtgaatcgtgggcagacagcggtccgaaatacccgcatttttgtcaaccattctcaaagactgagcttctaggcgttgaagtgagtaactttttgaaaagcctgaattaaatcagttttttgaggagcgaagaaagatccaagcggagttaaattttgaagttttaggatgacacatggattaaaaaccgtattggtcatgcattttttccctttttgacgtcgaccaacaccgtacaacaaatcatgctgaatcatatcatggtcgtcagcgtcacttttaccaacccggctttttgttagggcggtggattgcaaattttcaggttaacgtgaaaatctttctgtaacttaaataaaaaacaggaactgagccacgctgaagaagaaagtgcagtggcggtagacgaggggcgcgaattaccatctcagcctctgcaacttacaatcgaattggacaatgcaatcgccggtgaaaaggcgaacatcttggcatttttgaggactgactacgatgacgaacaattcactacaacgatgtcaaattattatggaagaatcgggcacttgatcgggttcaaccccgttcaaagaaatgagcttgacgaaatgatcattgacgatgatgcaaggaatttggcggaacaaagtctggacgaaaatggtcttctcaatgccgatttgccttttgacggactggatgaaattgaaaattttgctcgaagacaggcaagaagagaatgctattatttcaacagatgatgaagtcgatatcattaattaaacgcaaattttgaattttattatgttcttcatatttcattgcggttttcaaaaagctta

SEQ ID NO: 73669 - DNA, 2516 bp, Heterodera glycines
  Genomic contig location: Contig_ID=SeqID_1461; Location=2514..5029; Strand=+
  SCN-specific regions: Sequence locations=1-1343,1367-2516
cgcgcggcaacaagtgcggagagtactcgggcagtgccgtcaatgccgacgcctcagggggatggcctacccccttcccacaatgcccccattaccgatggatcgagtgcggcgacgggtgccctttgaatcggtggggctcgattttctcggcccaacagctactctggacgacagcggacaacgacagaaagcatgggttcttctgatcacctgcttaacaactcgagcaatttacatcgacgcaacccgggatttgtcagcaaagagcttcatcgctttactgaggaggttcattgctcgtcgcggagcaccaagccggattctgagcgacaatgcaccgacattcacgattgttggcaaaactttgggcgaatttggcataacgggagacaatccgctggaattcgcggactcccggggcattcaatggcgattcaccccgcaacacacaccatgggccggtggaatctttgaacgggcggtgcaactcgttaagcgagcgttgcagaagacactggggagctgtgtcctcgattacgaaggcttcagcacgcttttggctgaagttgaagcgacggtcaattctcgaccgatcacttatgtcaatggcaacccggaagaaccgctcccgctgcgaccgattgatctaattcaggagaatggtcggctcatagtgaatccaccgccgggatcctccgaaccgaacggccaacgacgcgaaccaccgcacgaacaactgacgagacaatggcggcactctcaacaacgacttgaacatttctggcggcgatggcacccagagtacctcatggcactgcgagaaaaggcgggatggaatcacccgcagaaacgggtgaatgcacccggagcaccaagagtgggggacatcgttttggtggaagataagttccacccgcgcaatttgtgggcgatggttcgcgtcgaggaactcaaaggatcaggcggccacgtccggagtgtgctgctcaaaatggcgaacggaagaatttggggaagaccagtgaataaaatttcgtaatgcacaaccgaatattttttcttcgctctgctgcaaccgaattcgccaaatcagacacacaattaggctaatcactttaattgagaaacaaaacaacaaattagaataaagctcggaacaacaaaataacaatccaaacaaacgtcagaggcgagagaagacttatttttaagcacaatcaaaatatcaaaaatgcagaagatttttggagaccggagacgaataatcaaaaaatccaaagacgtaaaaatgggaagaaaattgagaaaacaaaacgccaaataaaataatttaaaatgagaacaaagtataattaatatttaacacattcccgcacaaagtcaaaaggcgtccctgccgaattaaaaacattcttaggctgttgaaagggggcgattcgtccgggtgagctcactgccagcggtgccaacgagaaaagcgacgacctccagcaacagaagacatcgaaccacgtccaaatccacgatacggatgcatgcgcaactgctgaccggacacagggtggtcatctcgacccatccccgatcgagctgtgattgaacgcaatggtggacggtcacctggacccgagtccccacttcgattttgacggacaacatgaacggcggagcgaacggtgcggatgcccaattccctgttgccagggaatgaagcaatttgtgattggacccaagccgccaatgtcttcactccttctcggctcatccaaccatcggctgccactcgcgttgtgtcgaaagtgtcgccgtgtcggaaaatttccaagatactgcgtcccgtcgatgtcactccgacgaaccattccggaaccaattgggccagtcgagtcacaaattcgccaaattctttgtcccgctggcgcacatatggaggcgggatccagaacacatgagccgaacaaaaacgattgcacatttgtttgagtcgaacacattgttccatcatttggtccacagtttctgattgcaccaatgagtcgcgtccgacacaaatcaaaacagcttgcacattactggacaaaacacaatcgctcaaagctctgatgaccatcggcaaaggcccacgttcaacaccaacaaagtgcgtttggtcacgcatttcggccaaaagttggtggcaggacgaatcaccgacaagaacgcgaggtgtgtcgataaaaatggcggcattgtgaatcagtttggcacggactctttcaagaacaagccccgtattgtcgaagagtgttgtccatcccgtcttttctgattccgtcaacttttcgagcgccggagggacagccatctgaattgttaatgagttttccattttctttccattattaatgaccgtaattgtcgaaaagccagaattggctaatatttctctggccaaaacgcaattttttgcccatatgtgccaaatgtcctccatttgcgctacagttggaaatgtgccacttttgacattgtct

SEQ ID NO: 73670 - DNA, 3564 bp, Heterodera glycines
  Genomic contig location: Contig_ID=SeqID_1461; Location=3967..7530; Strand=-
  SCN-specific regions: Sequence locations=1-526,554-668,692-1894,1917 -3564
atggacgcggataaaattcgtccaattcttgaacttccacttccttcctcaaaaaaacaattgcagtcatttcttggattcatgacatactaccgtaaattcatttacggatttggatctttggctgcgccactcttccatctcattaaagaaaatacaccttttgtaatgggcgaaaaagaacagaaaattgttaattttttgaaaagaaaagtgttagaagatgttgtgttgtattttccggactttaaagtagctgcggaaaatgcgttgaggcgatttatcattttgacggatgccagtaaatttggaatctcagcagttctctgtcagccggacgaacttaaaaatgttcgcccgatatactttgcttctcgccaatgcaataaatatgagagtaaatactgtcctactgaactcgaagcactggcaatccgttttggaactcgaaaattttcacaattcattacgggtattccatgccgggtgatcaccgatcataaagcattaattcccatgtttcgaagtaaaaaggaaacgggaaatgcaagagtcgatcgatggctgatggaagtgaacgctcgttaccaattatctgttgaatatcagccagggaagcagaacgtggttgctgaccttctatctcgagttggaaaacagtcagacacagaaaaaatggaaaatttgttagatgattgtccgtctgaggtagttgttatcaaaaaattgtctatcaaagaaattaagacaaatgctgacattgagaaactggaccgaaaagagtgggttgaacagaccaaaagcagtgagttaaaaggcatttatgagtttttcgagaaaagagaaactccacaaagcattaacgaggcacaaagtttaatggacaaaatcaataattttgctctgattgaacaacttttgtatttcgttgaccaaaagacagggtcctttcgtttgttcgtgcctgaaaaatacagaaaagaactgatcaaaagaaggcacgaaggaaaatgcgcagggcatttaagcggaaaaaagttgtggagacaactttgtgaattatatttctggccaaacatgatgaatgactgcttaaaattcgcattgagctgtcggatttgtgcccattcccgtaagcctcggaaaaatgagccaccgatgcaaatagtgaagactttagagccactagaattagtgtgtcttgatatactttccattggaccatcagagtcagaaaaccgttatgtgcttgtggccattgatcacttcactaaatatctcattgctgttcccctaaccaacaaaaacagtgaaactgtcgcgcgcgcatttgtaaacgaatttattctcgtatttggcactccgaaacgtctccatagcgatagagggggtgaatttgtgaatgaaactttggcggaaatctcaaaattgcttggtgttgaaaaaactgtaacgtccggttacgatccacaggctaacggagtaacggaacgcgcaaatcagaccatattaaatatgctgagaaaatcaaccggttcaaattggagttgggacgaaagacttccgtttattgtgttttgttataatacaacgccatcggaggtgacaggcttttcaccgtatcaattgcttttcggaaagccggcaaattttccaggggaacaggacgttaattggcaaacgaaccccaattacacaattgatgaggaaacctatattcagctttttcgtgaaaacttaaaggacataataagcatagccgtgaaaaattcggaaattgctagggaaaagtcgaaaaagtactacgataagcgcccaaatgttactgaaaacaaatttagtaaaggagaccgctgcatggtgctatttccgggttcgaacgctcgctctccccataaaaaattattgtggaacaattttggaccttataaaattgttgagatcagtaaatcatccgccaaagttgtacctgttgataaaagagctgaaccaattttagtcccgattgaacgcctaattagagtaccaccagaattgccgaatatttctacccttccaagagggaaaaatatgtatagaaatgttctaaatgctttgattgcacccaaaagttggacgaaaaagaaaaatgaccgaatcggacccaaaaaattggaaattgaagaagggaattcaaatagtcaattagggacaattgaatttttagacggggcgatggagttagacaaagacgaaagctacgcgctcacatggtcttcgatttgcgatggccttggacatgaaatatgctcaaaggtcaagtgcgtggatctcgacccagttctcgagacatcatccgaaatgggccaaactgtcgttaaaactccgctccaagcactcctttcggcatttttgttccgttctggctcagcagtctcagcatccgcagctcaagaattggtccgcttggtcgtcaaatccgatcctggatttgaattgattttgtacgaaggaggacggagagacaatgtcaaaagtggcacatttccaactgtagcgcaaatggaggacatttggcacatatgggcaaaaaattgcgttttggccagagaaatattagccaattctggcttttcgacaattacggtcattaataatggaaagaaaatggaaaactcattaacaattcagatggctgtccctccggcgctcgaaaagttgacggaatcagaaaagacgggatggacaacactcttcgacaatacggggcttgttcttgaaagagtccgtgccaaactgattcacaatgccgccatttttatcgacacacctcgcgttcttgtcggtgattcgtcctgccaccaacttttggccgaaatgcgtgaccaaacgcactttgttggtgttgaacgtgggcctttgccgatggtcatcagagctttgagcgattgtgttttgtccagtaatgtgcaagctgttttgatttgtgtcggacgcgactcattggtgcaatcagaaactgtggaccaaatgatggaacaatgtgttcgactcaaacaaatgtgcaatcgtttttgttcggctcatgtgttctggatcccgcctccatatgtgcgccagcgggacaaagaatttggcgaatttgtgactcgactggcccaattggttccggaatggttcgtcggagtgacatcgacgggacgcagtatcttggaaattttccgacacggcgacactttcgacacaacgcgagtggcagccgatggttggatgagccgagaaggagtgaagacattggcggcttgggtccaatcacaaattgcttcattccctggcaacagggaattgggcatccgcaccgttcgctccgccgttcatgttgtccgtcaaaatcgaagtggggactcgggtccaggtgaccgtccaccattgcgttcaatcacagctcgatcggggatgggtcgagatgaccaccctgtgtccggtcagcagttgcgcatgcatccgtatcgtggatttggacgtggttcgatgtcttctgttgctggaggtcgtcgcttttctcgttggcaccgctggcagtga

SEQ ID NO: 73671 - DNA, 2386 bp, Heterodera glycines
  Genomic contig location: Contig_ID=SeqID_10463; Location=6..2391; Strand=+
  SCN-specific regions: Sequence locations=1-450,472-638,660-1748,1770 -2161,2184-2297,2319-2386
atgccagcgccgcacgacaagtcaactctacggtctttccttggagcgctcacatactacggcaaattcatcaaacaaatgcgcgaaataagaagcccattagatgaattgcttaaaaaggatgtaccgtggaattgggaagatgaacaacaaaaatccttcgagaaagccaaagaaattatgctttcggatttattgttaacgcatttcgaccccaaattgccaatcattgtggccgctgatgcttcaaaaggaggaattggtgcaacaatcagccatcaatttcccgacaaaagggaacgtgtcattgaacacgcatcatgcactttcacgactgcgcaacaaaattacagccaaatcgaaaaagaggctttaggattggtgtttgcggtacaaaaattccaccgcatgctatacggcagaagattcactctgctgactgatcacaagcccctactggcaatcttcggatcaacaaaaggcatcccaatttattcagccagccgacttcaacgctgggcgttaattttgtcaaattacgaatttgatattaaatacgtcaacacaaaggcattcggaaatgccgacgtactttcgaggctcatcgcaaattatccgaggccatcggaagacattctcatcgcaaacatctgcaatgacactgattgctgtgttaattttgtttttgaggccaaaattgagcaacttccgatcaccgcaaaaataatagcggaggaatcagcaaaagacgaaattctacaacaaatcagtgccttcaccaaacaaggatggccgcaaaaattggacgacattaaattgtctccttttcttccaaaaaaggcacaaatatccgaaatcgaaggatgtctcgcctacggtgaacgaattatcatcccttcgtcactccggaacaacatcctcaaatcattgcattttgcacatcccggcattgtgcgaatgaaagccattgccaggaaccacgtttactggcccggaatcgactccgaaatcgaacgagtggtcaaacaatgcgaggaatgccactcagcggccaaaaatcctacaaaagcgacccttcagccatggaaggcagcaaacggagtttttgagcggattcacattgatttcgccggcccgtgcgctgacggccaaacatacctggtattggtcgacgcctactcaaaatggccagaagtatggcaaatggaaagaacatccagccaactcaccatttcaatgctcaaatcattcgtgcatcggcttggaattcccaaagaaattgtctccgacaatggaagccaatttcgatccgccgaatttgcacaattctgcaaagaattcgacataaaacacaccttcacgccgccgttccacccaatgtcgaatggggccgctgaacggtttgtcgacatttttaaaaggtcaatgaaaaagtgccgtcaagaaggcaaagattggcttcaaaaagtgcttttggcgtatcgcacgacaccaaacacggcactcaacggtcattcgccagacgaacttttccttggccgacgcatgcgcacaagaatgacacttgtccatcccgaaaaacaaaaactccagccaacaaatttggaaaattttcaacaattccaagggcaatacatcaaaaagatggaaaatcaattcaacacaaaacatggagccaaatcaaccattttccaaaatgaggaaccaatttatttttggaatttgaaaaacaataaagccatttggctcccgggaaaaattatagagaaattcggcacatctccgacgtatcgcatcttggcaccgacgcttggccgagccattcatcgtcatgccaaccaaatcaggcgacgtttcccaattgaattggaggacaatgatcaagttgaagaaaatgatcagacacaggcacaaaatccgccgcactcgccgatcgcgcataaaccgcagacgaatcgccagcaaacgcccgccgctgagcccgtgcatttgcgccgatcaggaagagccaaacaagcacctcaacgactggacctggacccgtcaaagcctaaatacggcttaatccgatcatgaatcccaaatcgagggacattcgacttaaggagggaggtgttggatagggatcaaagatcactttcccatcattgttatcgactattctctctccccctttctctgtccaacactatttccattctctctctctctgcctatctcctccacatttctctgaccccacgtctttataagtgcgtccattccctcactcatggctctccgctccattcattcgcattggacatttttattattttattctcctccgtcgctgcactcctccgacctcatcaatttgtgcatttatttttattggtgtttatta

SEQ ID NO: 73672 - DNA, 302 bp, Heterodera glycines
  Genomic contig location: Contig_ID=SeqID_10463; Location=2714..3015; Strand=+
  SCN-specific regions: Sequence locations=1-302
atggacgcacaacaacttcagcaaattttggacgcggctctaaaaaaatcagcagaagtttttgccgccgcactcaacattcaaaatcaaaacctaaacccagggtcatccacaacggcatcacttgcggcatcaatcaatgcccgcctcgaaaaattcaattataatccggaggttggacagacatacgatgcttggttgaatcgatacggaaaaatcgttcaacaagacggcgcttcgctcccagagcagtccaaagtccaacttttagtcggaaaattaaacgaggaggaatacaaacg

SEQ ID NO: 73673 - DNA, 786 bp, Heterodera glycines
  Genomic contig location: Contig_ID=SeqID_10464; Location=1..786; Strand=-
  SCN-specific regions: Sequence locations=1-138,160-280,303-585,607 -720,742-786
  Gene Ontology: Mol. function=prolyl oligopeptidase activity; Cellular component=cytoplasm; Biological process=protein metabolism
atctctgtccccgatccctaccgcggcttggagaacgcaacagcgaatgccactaagcaatttgtcgaagaaatcaacaacatttcacagccttatctcaatgcgaccacagtgcgccagaagctaaaccattcgtagatttttaaattaattaaatttggttacatttctaattacggtgtggaccaaggatagtacggaattccgatttccgaaaatttatgggacctcggaatgccatccctggtgtggacaatgccattgtcgatgctgatgaattaattaatagcttttttcttttcgagttttaggcttactaaaatgtggaactacgaaatattcttcacgccagaattttgtggcggtttattctattattatcacaacagcggcttacaaagtacgttccgaaattttcgttttcgaatttggggtccttaaattctttttaattaatttcgcctctttcgtgcccttggaaaatgcttctccaacttaagaccaaagagtgctctaccaaactaaatccctgaacagtacgggaaaagtgttcctggacccgaacacgctttccaaggacggcacaactgcagtgaccctggaaagcttctccgacgacggcacagtgttcgcctacggtatctctgaaaagggcagcgaatcggttactgtaaaggtgggccaaacgaagcatttcttttaggggggcatccgcagtatttttgactataaaaagaggctttaaagggagggtgaggacctgcccgatcagcataacgatcttca

SEQ ID NO: 73674 - DNA, 1101 bp, Heterodera glycines
  Genomic contig location: Contig_ID=SeqID_10465; Location=1107..2207; Strand=-
  SCN-specific regions: Sequence locations=1-304,348-470,493-578,609 -614,658-729,751-1101
atgtccgcgttcatagatagtaaataaagattaattgaattctctcccccaggggcctatttcaattcccgtcgtatctccgatatgatgtcatatctcagatacgacatcatatcgtcacttagcaccgccgccagaaccaaagcaatgacaaacatcgaccggcggcgatttactatggcattttaaaagctaacagttggcatcactgcgcagaaatttactggccctaaatgtcggcttcttcgaggggacacattcagttggcatgaaaagttgtaaagcaacattcggcttttacctcattattattattattattattttaatataatatattttttaaagttaatcaatacgaaatgaaaaataattttatttgcgttgttttttgccacggcatttcaatgggtggctttgccaacgtaaaaagtcacatgaaatagtcataactctaattgcgcgcgtcaattcattttctgcataaatggcaatgttgaaaaagaaataaccatttctaaattgaaaatgaaatttctaattttatgcctcttttttgctgtcttattaaaatattcaatttcacaaaagccacaaaaagggaaaaaaggtgcatattttaaacataatttatttaaagaaattaaaatttaaatacagagagtgatgatgacaaagaaggcgaagttccaagtcaaacggaggacaacggcaccggcttaatgtccaatattttaaaaaagacagctgtggcactcgctctggtctgaaattgttttcggcactatggcttcattaatcatttggctagagatgatttagaaacatatttattcgatcatttctgattttaatgggccagggaggggcaaaaacgtagtttaaattatgactaaattatgcaagaattaattaaattaattggcattgtttcatgaaaaaaataatatttagcaaagccccttcattacgggttcagcaataagattgccatcctcctcaacaagtgaaagcaccgccgatgttcaaccaacgtaccaataccaaaaatgtaaaaaatattggaaattatttgaaaatatcaaaaattctattaataaa

SEQ ID NO: 73675 - DNA, 573 bp, Heterodera glycines
  Genomic contig location: Contig_ID=SeqID_10466; Location=94..666; Strand=-
  SCN-specific regions: Sequence locations=1-50,81-86,130-201,223-573
atgaaatttctaattttatgcctcttttttgctgtcttattaaaatattcaatttcacaaaagccacaaaaagggaaaaaaggtgcatattttaaacataatttatttaaagaaattaaaatttaaatacagagagtgatgatgacaaagaagacgaagttccaagtcaaacggaggacaacggcaccggcttaatgtccaatattttaaaaaagacagctgtggcactcgccctggtctgaaattgttttcggcactatggcttcattaatcatttggctagagatgatttagaaacatatttattcgatcatttctgattttaatgggccagggaggggcaaaaacgtagtttaaattatgactaaattatgcaagaattaattaaattaattggcattgtttcatgaaaaaaataatatttagcaaagccccttcattacgggttcagcaataagattgccatcctcctcaacaagtgaaagcaccgccgatgttcaaccaacgtaccaataccaaaaatgtaaaaaatattggaaattatttgaaaatatcaaaaattctattaataaa

SEQ ID NO: 73676 - DNA, 474 bp, Heterodera glycines
  Genomic contig location: Contig_ID=SeqID_10467; Location=1495..1968; Strand=-
  SCN-specific regions: Sequence locations=1-297,320-474
tgctgcgttgtcctgcagcagggtcttgtacgggctccttttgttctgatttagagccctatcaatcagtaccagatttaagtgatgcttttccaggggtcaatttttgcaaggaagcatccggttttatccgccagggatgtctttcgccttcttatgcgtgcttattttacagattgtttgcggcgcctctttccccctacccctatgagctgtacaagtgccctgtttggcaattccaattgagactcgggattattttgcagcttaatgggtccacaaaagccgaagaaataactatgtctccagggattacccaccattggccgttagctaagttgtctgtcacctttacccccagcggtttgccacccttaccaattttgggaaacgattttattgctaaccgttcacatgcggcattggtccccgaatggcactcccacctccactgtgattctgaatttgcagcca

SEQ ID NO: 73677 - DNA, 1057 bp, Heterodera glycines
  Genomic contig location: Contig_ID=SeqID_10469; Location=1..1057; Strand=+
  SCN-specific regions: Sequence locations=1-217,257-282,311-384,406 -612,635-1057
  Gene Ontology: Mol. function=structural constituent of cuticle; Cellular component=extracellular; Biological process=cuticle biosynthesis (sensu Nematoda)
atgtgttcagctctccgtcaaagaggtgatgttggagatgagtgagctgcaaagcgccgaggggacagcagaagctgaacagtcgacaacctttggcgagctgcactccctcctgcagctgccggagattgacggcacaagcggcacatcgaatggcactcgtttccgacgtcaggcgccgttgccgggccgggcgcaatgcgaaggtgggggggggatttatttaaaataagaatttaaaaattgtattttaaatgttttaggttgttgcatcccgggactgcccggcccgccgggcccaccgggccgcagcggagtgcccggccgtccgggagctcccggggctcccggatttcctggacgccctccagcgtaaaacagccatctgatggcttggaaaagctgcctgctcatttccgccccatttagcatttgcgaagaagtgacccctccgccgtgcattccgtgccctccgggccaacccggccctccggggtcgcccggcgaagtgggcagcccgggcccggttggccatcccggacgacccggcaatgatggaccaccgggtgaacaaataaaatatacccaacaaattttactccatttgcgttcaggcccccagggacccccgggcattcagggcgaacacggcgacatcggccgagagggaacgcggggggagccgggccgaccagcgatttcgacacccgccctccccggcgactcgggcccatccggggaaccggtgagtgtgccaaagaaatgatcccctcccaaccccaaattgcagggccctcccggcttccccggtgaaattggcgagcccggccgtcccggcagcgaagggctgcccggaccgcagggaccgtccggcgccccgggtcctcccggaccgccgggccgacccggcgaagacggcacgacggggcaccaggtggagccaaatgggagacaaatcgggcaaaagtgtgtttagggaccaccgggagaacggggaatatgcccaaaatattgcgcattggacggcggcgtcttcttcgaggatgggacgagacga

SEQ ID NO: 73678 - DNA, 4001 bp, Heterodera glycines
  Genomic contig location: Contig_ID=SeqID_10470; Location=1..4001; Strand=-
  SCN-specific regions: Sequence locations=1-453,485-557,580-582,604 -662,684-703,730-797,820-953,974-1014,1036-1513,1535-1917,1939 -2316,2339-2754,2777-3016,3039-3217,3239-3455,3478-3774,3799 -3885,3907-4001
ttttaattgagctgctcttcttcaactccgcttaccgtatttgctctaattatagcccagtctctattaatttcgcagtctccaattatccccccctttctgaggagttcgaaaaataatcccccagtctctattaatttcgcagtctctaattatcccctctattctgaggaggttgaaaaataatcccccatgggctataattagagcaaatacggtatctttaatttcacttccattgcatattcagagtttttctcttctcatcctccaatttttgctttgtttgcactgattttgatggagagacctttgatcattccatcaaatcatttaaagtgcaccccccccctttttttttgctttatttgcactaatttaatccctaatggatacgcccactttcatttgataaatgtgcctcataaatgtccctctcttcttcctccgtagattaattaattaattcattcattcatttatcgatagacattttttatgtttcgtcttagcttaacatttgtttcagcgaaagttcaaaggggatgccgctactatccaaaaacctttttccatcttttctttatggcaaatttttgcacaaacaaaaatgatttgcattgaaactttgaatctaacccaaacattcgccgctatttcgcttcagagaattattatttttagacccaaataaacattattaattccaacaaagaaaacaaacaacacttatttccaattgagagaattcagctgatgttcactgtccagtgagtttttattatttgaatttgcgtttatttactttttggcgttttgtctctcccagcttcgatgtctccgttccttttgctctccatgacgaccaatttgtttttgtcacgggttcccatgagcacctcggaaattgggagacggggaaagcattgaaattggacaaaagagagaatgggtaattaattaattaattaatgaactcgtcgagattttcaaactgagggattttcttagtgaattttcaaagtttgtctttcagccgttgggttggccttgtgaaccttggcgcggacgtgctcaaattccgttacttcatcggctattacttgcagtcggaggaggacaaaggccccgttttggccgtctccaaatgggagacgcattcgacgcccgtaattttcagccaagacaaaacatatcgaattaatcatttgttgccgtctttttagcgctgtgtgatgccaccggtagaggcgagcactgcgggcatttgccgtgccaatttgcgcgacattttcggcttcagcggcggacgcgaattctttagcgacggatgggtgctgacggacgaaatgcaccaaattttgatgaccgtttccggcgaggcactcaaattctacaagcagaagcacatcagggaggagtacaggctcaaaatggtgccgtttgacttgcgaaggaacagaaatgtgagcgattggaaagggcacaaaatcaaattgggacgaaatgatcgaaaatagagaggggaggagggtcatttggcaacttccaaaattggtttcagcaggcttttttcgtgccaaaattctatttacgaccatttttgcctaaattttgcctcgggggaaattcgtttggatatgggggatatttttcaggacgcttccaatgccgaggatgacgaagagccgaccgtgactgccatggacgaattgccgccgctgacccatccggctttgccgagccattctccgactgagattgccgtaagatcaaattactcgccagtcccgtcgaccgggactctcaagctgactttgttcctccgtctcggtcactttcctcccgaacttgtctttgtcgtccggtcgctccgctctctccccattgcctttttcgtctgacaatcgttgagtgtcctccgtttggttgtctctctccacatctttccctctttctctttttgcattttccctccggcgttttttggccttttggccatttcttcaattcactaaccgtacgaaacacaacaaatcggagggatgtgagaagagatgaagaaacggcactgttgcacttcgcaattgaagaaaggtgaacatttgcgctttgtcttctttaaattcgtctctttctgctttctctcgtcatttccatgccaattttttcgcttgtcaagtctcaattttgacaaaaaaccaagaatttctggcaaattcattcccttcggtgcttttgaattcaaaaaataaaataaattttgctttgagcaaaatctttgaggaacattgtgccattttcgtcctccgtcccttcctttgctttttgtgcccttttataattaccgcttcaaaatcgagacttttgcctccgttccgtccttttcttcttcgttttctctcatccattcactcgctccaggcactgttcagtgagcgaatccaacggccgtccgtttttgttgtgccgggcgctgtctgttgttgttggcagccaattgtattgttggctcgaggactttttgggcctggtccctaggcaattaacctaattaggcttaacattagattgtttgatcactaattgctatttaattgatagcctttactattatttgtttgtcctaatcgaatcaaatgaggctctagcaataatttgtttctgcagttattgtgcccatttgctttttttattattagctaattagttttacctaattacccccttcgttttttttggtaaattccgattaaacttttcccttccttccttttgtcccacttcccttatttctgttggtgtctttttcatccatttttcttaatttgcccaaatattaattttcctaactcatttctccgcacatttcagtctctctcattggacgcgcccaaatttcgcgaccaagaagagtttggagagccttttcacaacaaagtggactacttcatgttcaggactcagtcggtggccgtcgaatttttggcacgttttgctaataactcattaatgatgcattgggttaattgaaaattcctttgaattggcagagtttccgcctcgaagtgtacttggccaagtcggataagctggtggccctgggctacgcccttccctccacgctccacgacactttcggccgcacttcggtccctctcctgaccaaattgggtgtccccgtcggcaaagtttactgtgcgtgcttttccatctgtccatgtgtgctttatctattccctttgctcttcctcagtctcttatttgttcatccgtccgcttcgactgccccaccccaacccgaccatgcacaactgttacgccaaacattggaagaagcgcagcactttggaagtgggccaccgcggcatgggcaactcgtacacaaagtgagggtggccggattgtagggtgtccccgaacctttgcctgagaaatccaagttttccttacattctctccctccccactctcttcccttaaaagtcgtcgaccatccgtccccaactctgtcccgaacctccaaaaacccgcaatatttcatcagatgtgcggtcgcgagggaaaatacgctgcactcgctgagctcggcgtacaaaaacggtgccgacctcgtcgagtttgacgtccatttgaccaaggacaaaatcccgatcatttaccatgacttccatgtgatggtttgggtggccaaacgactgccaaccgcggcgaccgccacgggcggcggggcaacgaatggccaaacggacagcgaatcggacgacggcaaaaagtcgcaggggccgaaagtgatggacttttaccaattggcggtgaaggacttggagctgaaaaagctgagacttttgcacgtgcgtttttgttttttgagaatttaaattcaaatcgccaaaaaacttttttgcggtttcagttggaccacgtccaagtcaacgagaacagcttgcacagtgcgtgcgattctgaggaccatcgacgggtcaccggtgcacatgacg

SEQ ID NO: 73679 - DNA, 1957 bp, Heterodera glycines
  Genomic contig location: Contig_ID=SeqID_10471; Location=3876..5832; Strand=-
  SCN-specific regions: Sequence locations=1-627,649-1329,1364 -1399,1428-1445,1467-1522,1552-1558,1581-1755,1777-1788,1855 -1908,1946-1957
atgagacctggacggtaattacatatttttcgggtcccgttacggacggtctgcgttcgtttaagtgtggtcattttagcatgagtacttgcctgtaatgcaaaactcacagtttaatatgtttccatgtaaggggaaaaattaaaaagcaattgcttaaatacagtcatggtcatatgtttagactcacttagtgcttttttattgaatgcatgataaaagcttaatttttggccaaacggctaacatgtttagtgttttttgtagcattttatgtgggctttccaatgatatcactacatcccaattgcttcgcataattaataattacaaaataaaagtcaacttcacccccaattttgggtggtcatatgtttagactcactctttagttcttcaataaaatcaatattttgtaggccaaaaattctgaaaaaattcctgctaagctagcttttgatgctgatcaaaaaagtctcttacagcaacttgatcagatcactccttcatagtgatcggcacaccacaaaatacagtgaaaatcggggaaattttcgaaaaaaattcctagggggttgtgaaaatttttttggaaaattttatcaagcccattagaaaggggacaaaattttctaaaatatgtaaaaaaccgaaaatctctacgacttaaaatcgctatggtatggccacttcaatttcagtcatgatcattttactgtaaaatgcactatttacttacgaaatacagtactttttgtagacactgaaattggattgcccatatctcagcgggtgtaagtcgtaaagtcaccattcaaaaggcaaaccggtagagaattcactgttctttctaatgggcttgataaaattttccaaaaaaattttcacaaccccctaggaatttttttcgaaaatttccccgattttcactgtattttgtggtgtgccgatcactatgaaggagtgatctgatcaagttgctgtaagagacttttttgatcagcatcaaaagctagcttagcaggaattttttcagaatttttggcctacaaaatattgattttattgaagaactaaagagtgagtctaaacatatgaccacccaaaattgggggtgaagttgacttttattttgtaattattaattatgcgaagcaattgggatgtagtgatatcattggaaagcccacataaaatgctacaaaaaacactaaacatgttagccgtttggccaaaaattaagcttttatcatgcattcaataaaaaagcactaagtgagtctaaacatatgaccatgactgtagctaattaggttatcccatatttggatttttatataaaattatttttattttattttttggtgtttatcattttttgatgttcttatgaatcatctattaattcatttcatgtatttaattttgcaatctttggcaaagatagtttaatttatttgtattcatttacttttctaattatagattttaagtttatttctcatctgtgtaacgtaaatacaataaataataattaaataatatttttaagataaatgttgaagaaaagattaaaactgtaactttttggatttaacacttcaatcttttaagtaactttacgaaaatattggttaattagaaatgtgttgatatatctgtttttgtttattggttttttattatttgtaatcaataatcttttttagttaacttataagagcataccaaattataatactatttgaataatatgcttgaatataaaaatttattgtcatcagtttgtttaattaaataaataaattatatctaatgtaatttgaaattaattaaaaaattaattcattatttcagtacatattattgtttcattttattgtgtatttatcgttgtattttttgctgataaattaaaatttgtacttatttattttaaataaatctctttaataaa

SEQ ID NO: 73680 - DNA, 3292 bp, Heterodera glycines
  misc_feature (1985)..(1985): n is a, c, g, or t
  Genomic contig location: Contig_ID=SeqID_10473; Location=358..3649; Strand=+
  SCN-specific regions: Sequence locations=1-109,166-355,377-391,421 -793,837-908,930-992,1045-1245,1267-1268,1290-1448,1477-1661,1683 -1745,1767-1933,1967-2198,2220-2286,2316-2884,2907-2955,2977 -3129,3152-3292
gtacacaaaaatattcccagagaaaaatatgcagaaatttggaagttagtggaaaatccaattgtgattttacatgatggttttattcatttcaacagtgtgcaattggtaaaaatatttataaatttagtaaaataaaattttcaaagtaattataaaaaatttcaatcattgttaaagcaacttgacgaagaggtgaggttcacatgccaacttttgggtgctgaattggcattgccaaagaaagaggtatttttttacagaatgcagttgaatggcaggcagtactgcccttaaaaaattgcaaattttaacattttttgcccttatatctgataaaatactttaaattatccaattaaaaaattggtgaaatagtcaaaaattgggcattttattaaaaaattaattgaaaaatttgaaggatcggaagtcggaaggggttggaaattcagacatgtctaagacaaaatccagggtatttagaacggaaatttcgtcttaaaaatattgctgaatcataattataccataatctcatgcgtttatggcttattacagttgtacgatgcgattgaaaaagtactgtacgggctcattaagcaaaatgatgatgtgcagcagtcgttgagcgcctccataacactttttcacacattttgtcttaattatgaacggcgaaaagctgcgctggaaaccattgacaaatatgtgaggaatctcattgagcaaccaaatgagcaaaaattcttgaaaattcggatgagcaacaaagtgtttgaagtgagaaagcaaaaaaaaaaaaaattaaaattaatttttatttaaattttattgcattttgcgccgcaaatggaaaagagtagtagagaagtttgaaaaattgttaaaaaaccaagagggaggagaaccttttagttttccaaaatctaacccgaacgcactaggctttttctcgagtttgagttatgatggtttctttcactaaagtcaaaaatttttacaaagaattaaatctatatatttaatattatgtttataattgggaattataaatttttcgtgaaatgaaaactaattttctaaattctgagttttttgaatatccattttacccggtacccgaacccaagttctttcaaacccggtgtttcggtatcatgtcagatttttagcttgttttttttgccattttccaggaaaaagtgcggccagtaaagggggcactcgaatttttgggtgcaattggatttcgcatgcaaaaaagtgttcctactgtggtgcaacagccggacggtacctccgctaccgtaatcagcaatgaaccgtatctggtgatgacaccgccaaacgaagcgtatgtaaaagccttatgcaaacaattgggtgaagcattggtgcaattgaaaaccggcgaaccaattcagctcaaactgttccgagacgcgaaggtaaaatttttaatttatgaaaattttcaaggaaaatgcgattattgaaatcgcaaggcttttgatttttttaagtataaatttttgaaaaccctataggtttttagtttattttaacaaccttatgattagtgactcgttaacatggtggcataatcaaaattctacattcttggtacctttcgatagcgcagttttttctctattagcctgcaaaatgtaaaaatttttgttcaacttttgaaaaagttgtatgaaaataagtactatttctgccattttctgccataacttatgttaaatttgataattttatttgaagttttgcaagttaatagagaaaaagcttggctatcgaatgataccaaaaatgtaaaatttgattgcttttaagcaaagttataacatattttgtcatcgctaaaatggcaggattttacgaaacgcacaaggtggcgcgacccagcacgaattttgaattgcaaaaacttttctcctcattttgatttaaaaaactaggaatacagttttatntaattctcacccaaccgtaaccccaaaatacagctcttcaaaccggatcaaaacgttcaccaacagcagagcgttacaaaaggatactgtaggatccgtgtcaaattccctggcggttatgtggcccaggcaagttatttagctacaactaagcttcatttaatttaaaaaaacaggaaacataatctaaatctaaactggtctgctgtcctattctaaaaagacaagaaacatctttttttcgtcaatttgcaatgaaagagtccttttttccaaggatgtccttggaaatcagcattagaaaaaaatattaaaaattttacaaaaattcgttaaaaatccttaaaaaattttcaaaatgtaacataaaaattgtcatattcatattcggtgaaaatttgtaaaaaattggccaaaaatcgcaaaatttggtattttttatttacagcaatttttttttaaattttaagggcattttccgtgagacagaaaaattttcaagtgtccgtgcgtttgttgctgagcacatttcatttaaacatggcatgttcaatctgattcctgctgttcctcctcaaaaacatggcagaaaacaattgagagaggaaaacaacacgctgaaagaatatgggttagatcagtctggagtggtcaattttagctgggactcggagactcaggtgggcggcaggcatcaatcagggccggagggtctgcgtttaatgttagacatgggtctaaatttctgcaaaaatcccgggccctgaaaaaccggggcttcctgtgccttgggagtggtcaatttttgctggcacgcggagactcaggtgggcggcaggcaccaatcaggggggccatttgggtatatgaattcgagagtctgcgatctctcacccatttttaattttaaatcatttaaaagttcataaagaggacccgaattttgagacacatggcccttttctgctttttggcgttttcctgcctttttatggattttcagaagatttattcataaaaacaaagaaaaattttatgccgcaaagcttaattttttcttggtcatttttttttctttttttttgtcatgttataatttgcttccatttttttaaaaattttttgtacctcattagtcaacctgaattttcaaattccaggaaattattactcaacttccggatgatcagcaaccagtgtttatacttcaataaacttgacaaatctacacaaaacgccaattacccatgccgatcaatgaaactaaaaaatgagtagagagattttaacccaatgatccccgataa

SEQ ID NO: 73681 - DNA, 1121 bp, Heterodera glycines
  Genomic contig location: Contig_ID=SeqID_10474; Location=614..1734; Strand=+
  SCN-specific regions: Sequence locations=1-91,116-479,501-638,661 -717,739-884,906-1121
atgtcgcgttcaaatgattcaataaatgacgaaataacgcctgaccaacaacggcaggaaggtggcacgaatggaaatgaattaaacgcacaattaatattttttaaaaaattttcagcttcggaagaacatcgtgtgccaatgccttcaaatttgagtccgtccgaagaatggcgtcttttgagtgcccgaatggaagagttgaagcgaatgaacgcgagtgggaccgtcaagtggaagcccggcgagttgatatgtcgggacggcggggcggaaacggtgtgaattttttaaaattacgtaacagaaaattaattcactcaaaatattttacctcttaacttctttttactcaactatccaataagcatggtaagtcattcgatagctctacatgtttaggagctagccaggcccgtagccaggagaaaaggggggggggggggaagaagaggaaggaaaagcgcaagggaagcggtgaaatcaaagaaagcgttactaaccccgaggggcatttgtctgacgcaagagggagttggggggggggtaatccgaattttggaatttcttaacaattccgttaaatccaattgtagcgttcaacaccctttctcttgcggatgaggcaaggaaagtaaattttttattggttaaaatttagtgaatggcgaagctggacagaatgagcagcctgaccatggaccagacgaagctgatcagcctcagcaacagcagcagaaagtggttgagtgtggaatgcgaacaaaacgtccttttttcaaattttttccccatttttagcaccgtaacaatgacagttttgcccgtatggaagtggaattgagggagacgaaacatttgtgcacagtcaccaaattggaacttgaaaatgtaagttttttaaacaaaaaaacgattgaaaaagggcatttggcctttcccttcagaaggcacttcaaagtgagatgaagcagcagcaaatgatggatgagctgagctcagtgaagacgcaggtcgataagattggccaggaacaacaacagcaaaagaaggagcagcaggaaaagcaggaggaggacgcaaagggaaaatacggtaatatcaagggaatactacggtaa

SEQ ID NO: 73682 - DNA, 2683 bp, Heterodera glycines
  Genomic contig location: Contig_ID=SeqID_10475; Location=400..3082; Strand=+
  SCN-specific regions: Sequence locations=1-96,119-189,216-277,299 -846,871-1034,1057-1188,1212-1281,1303-1398,1423-1480,1505-1957,1982 -2207,2266-2488,2511-2653,2675-2683
  Gene Ontology: Biological process=signal transduction
atggaaaatttcactgctgcgttggaggaacagcaaaagaaaattggtgtgttggagaattttgttggcgttgtgaaggagcgattcggaaatggtaaaaaagaataattttgaattttgttaattaattattcgatcattaacctgtctatcattgaactttaattggctattaattaattgattgattctttgtttgtctgtttgtttagagctgtcaaagtctgtccatccgaatttccgttcggactttactgaggtggaaaaaaaaaatatatataatggtgaaagttaatttagaagctttcaattccacctcaaaattgttgggatgcaaatgcttgtcacaaaaatctcacaattagcggacccaacagaacgacggtcctttacaaggaaaacaccaacagcagcagcggaagaagtgaatggaaccttattttatttctccgtttttttcctttttccagccggctttctgctctctgatatgatgggagcaatcttatcatcggaccccgactgttctctgtttgcgaaaaatccgattccgcaagaaaattcgggcattttctactacgaattggagattttgaatgtcagagggtatatctcaatgggactcgccaccaaagcaatgccattgaacgaatttgtcggacgttcgaatggctgtgggtatcgaagtgatggccttttttacattgacactttctgctgggattataaaaaagcggcttgttctcgtggcgatgtcatcggacttggcattaatttggccactcgacgtctcattttcacgaaaaatggacagcgattgggtcggtagaataaagaattaatggcctttttaatttaatttattcatttgcaaatgtatttccagatccatccgatttgttcttccctccctcggctgatcgtttgttcccttgcgtttctttgggttcgccgggtgataaaattgaagcaaattttggcccgaatttcaaattcgcatttttggtgaattatttatttggaatgataaagcatttgataataaatggtgtgtgacttctccgtttttctacactcaaaatttaaaaaacgaacaaagaacgtcaattttgggaccatttgattaaaaattggttcgaaataaggcatttttttcaaaataatggcacgcactgaactgctcggctcttagtttacttttttcaaacttttgagtgtatgaaaaaacgattgagtaactaaatgataattgatttatttcaaaattgaatttagaccattccaaagactgtttcaattccaccgcaaaagaattcttgggattcctccgcttgtcacagtgacctcgaaattacgggtgccgaacaattgatggtcaattacaagaaggagggagacagtaattttgtttttattaaaaaactcatctttttatccacgttgcaactaagcccgaaaagtttattgtattccttttatgctctctctctctcgctctctctcttcttaatgtcggcaaaccaattccagctcttcctatcataattgctaacttttctatataaaatgcttttaatttttctttaagaatggcgcactgtctttgcaaaatgcgctgttccgaccaccggttctgctgtcattttttactttgaaataaaagtgataaatgagaaacagtaagtggtccaattattgtgctcacgtacaaaataaagcgaacttgctaatagattaacgaccatcggattggccaccaaacagcagacgccattagctggaagaattgcaaaacgccgtggcatttttgcatatgagagcgacggtgattgttcaacggaaggacgcaacagacgcaatcgaagaaggcaattcggtgacggagacacggtcggatgtggcatcaatttggcaaatcgccatttgttcttcaccaaaaatggacagcaaatgggtcaaaaaaaatattatttatttaaaactaattgccaattttatgtgtgtttaagatctcacttttgtggtggattcgttgccttctgatccgccgttattcccttttgtttctttgggtgattccggcgacaaaattgaggcaaactttgggccgaacttcaaattcgacctcgccacccttctctgatctgataaaggaagaagaaatttgttggaagatggcgtattttgtgttttaattgacattttacaaatattcatttttctttttttaaaatttattcgatttttattcttttttaaatttatgcacattcgaaaagataaacaatttttatttttgaatacaaccaaaacatgcatccatctttccaaatacggtcgaatgttaagcgattctgctgttggtcggttttacgtgttccatatttatgccatctcgtcggatttattagatttttaactgtttttagcggatagcattttaactatttctgccctttagtgttcaacccaattgcaaaccatgccctatcgtataaataagcatgctttaccttctgttgtttgcaaattctgtcttttcacccgagaggtttttttgaaattatatttcatagccaaaattaatcacgaaaattaccgagttaaattcattcaaatggagacaattataaaatttaagagaatgtataatcttttgatcttcaaggtttttgtgaaagta

SEQ ID NO: 73683 - DNA, 1279 bp, Heterodera glycines
  Genomic contig location: Contig_ID=SeqID_10477; Location=1647..2925; Strand=+
  SCN-specific regions: Sequence locations=1-233,257-480,502-566,610 -620,660-803,830-992,1018-1196,1218-1279
atgaatttagaccgagtatttgtgaatgatagaagtaatgataatgaacagaatttgttatatgcttatgtttttgataatgattatgaagtagttgagagcagttatgatatattggaagagcataattatagtaaacggtcaagaatggatgttgttggtggcgaaagccaggtatctctgaattcagatattggtattgctggaccgtcacgtatgagtgatagtcaatttgaagaaaggagaagaactgagtatttgaaaagaaagagagaacgtgagagaatgagaagagaaaacgaatcacaaaaccagagagttttgcgtttagaacagatgcgagatagaaataatagtcaaagatcggaagagaatgcatatgagagacagttacgtctagaacagcaaagaattagacagagagtgattagacaaggtgaaattaatgtttatgcagcagggtcttatgtgaatgctcatgaacatggacttggtcttatgaatgttagatgtgaattttgtgatgcattgcattttgttggagagaaaataagtggccgaggcaattctttcaaggattgctgccattatggaaaagtttttgttcctgagattcctgagcaggatttccctgaggaattgagggatttgtttatgaaatttgacgcgaggcatgtgaatttttttgaaaatgttagacatttgaatagcagcgtttcatttgcttcaatgaatccgctgaggtatagatatccgaataaccgaggaccgtattgctttcgcatttacggtcaggtttatcacagaatgaatttggctttgaatcccgaaagtggcgatgagcctgcttacgggcagattttcatcgtagatactgaacaggcaatgcgggcaatgagacaaagcaatgtcggtgttgaccctcaattgttgagaaccgtttatgaagtgataaggaatgcgaatccatttgctgaggcttatgtgatgatgaaagaggaagaagatgatgaagttgagagagcgagaaacgagaatagagagcctgccgagatcaagcttttgtttgagaccggaaggcaattggacagacgtttggggtataatgtgccacgagcgaatgaagttgctgcggtttatgtgcctggagcagatggtgaagtaccggatgcaaagattgttatcagagaatgtggaaaagagttaaagattttgaatagcattgacccgatggtaacaccgatgacgtacccgctgttttatccgcgtggtacactcg

SEQ ID NO: 73684 - DNA, 2737 bp, Heterodera glycines
  Genomic contig location: Contig_ID=SeqID_10478; Location=975..3711; Strand=-
  SCN-specific regions: Sequence locations=1-498,546-820,844-898,920 -1895,1917-2142,2165-2737
atggaccgccgccaccaatctgctgatcagtctgacagcattaaacgacaattgatcaaggagtgtgccgagatggaggagcaaattagccaactttacgaacggagaattaagcaggagaaacaacttgcggaaaaggatgagataataaaacggctggagagcgacctttgctttaatgtgagttcccggcaaaatattttcaaaaacacagaaacaatgattaatgatgggaactggatgttactatatgatgtggtcaatggaaactcgtacatacaagcgggcaactcattcaattaaaaatttacaaagtctaagcttaagcataggcctagcctaaagcttaagccattgtacgagtcgcctttttacgagttgttatgacatctatatgttctattctgataacatctcatcatttaagcaaaatgcaccaaaattttcgaaaaatatcattaggcggcgctcctttgcacgccatttgtttgacctctgtttccttgggattttgaattttccttaaaaaataaaatttcctttttgttatgccacaaggtttagtgtagtaaattgagtccttttctcaaattgcacacagaaataaaagaactgttaggaacaaacaaattgggtgtttccgttaatccggcattttgcctgacgaaaaaattcaaaaaacaaatcaaaaggcaaaacaattaaatccccggcacacattacgcactcattaatgggatgaaaatgtaccatttcttaaatgtatatttgaacgcagatcaaatgttctcaaatgctggacttatttcatccaaaaaattcactttttcataattcattttcgtttttacgaataaatgcgggcgagggaaatgctttgctttattaacaaatgtttatcattttttaatttaaatttctcaaaaagcagaaagtttttccgctcattgggcaccctcggtcaaaattcccaacatttctatgcgtgtcttattttagcgatctctctcaactctttgtcttttttaagcacactataaaaatgtcggaacccactaaagatgaacaacttgccaaattaagaaaagatcgcataggaataactgcacacgtggaagaactttgggaagaagatgcaattagggagaaattgtttgaagagaaagacaaaacgatcaaagaaatggaaacgaccaacaaagaaacggtggaaaaaactgccgagggtgggatgtgcgagagtctcgactctaggggggtattctcggtttctcaattaaaaaggcatttctcgcacttccctaatggaatatggatttattatgtcttatattttctgtgcattttttagaaagccgagctcagtcagacaaaatccgaactcaatcagacaaaatccgaactcaatcagacaaaagccgctcttcgccagaaggaagaagaaaacgatttgcttaaacgcaaattggctgaactacaacgtgtgccagtgaaggtgtagttgcgcattaagaatctcgaaactcgttgcaatcgaattattctcaccgttttacagtttttggacagtgccgtggccggtgtttcgttgtcagctttgccctcctcctcatcagttcaaattctgtcggttcagaagaacattttcgccgattatgagttacagccgaactcacttgtcgagcattacaacagttgcataacggaagcggaacaagaacttgtcactattttcaatcaatttggacgggaacaagcggaagcggtaagtttggcacaatcctcacataaaaaaagtcttagtctcaaggcccgagctcaggtttgagttgtctatggtccaatctcagtttcgaaacgacagctaaaatatcctaagcaaataaaaaacattcctgaagaggggataataaattcaaaaaggattcgtcattaattcacgaattgacatattaattttcaggaccaaacgatcaaacagttggaagagagaattatggaaaaagaagcggaggcaaagtgtcgaatttgtctcaagcacgagtttgaagggtgaattgaattaatcactttcattcatatttttgaaaaatttcagcactggcgggacaaacgcgagcaccaaaacataccgtcacattgggtgaggaatgtttatgcttttattaccttttactccaacagatccctccactctcattctattagtgtactctgtaataaagcctaaatgggggacgggtgcttgaaaacgagccccgaggggattctgtttgagtaaatgtgctaaatgttctaattaatgtctaattaccctaaaacataataacttttagaacacaaacaactgaagtcagagcgtcaaactcatggacattcggtgagggaaatgaatgtttaaaaattgtcaaattatgtcctcatgccaaaggctgttcgatgggtacaaaaagtttccttctctgaaattcaggcccaaaagtgtctatttttgctgttatttcgagatttaagaagacatgatcccctagaaatggcatttgtctgcaaaatttattgctccccttgagagtcggtcccctgccttttttctgctctcatttgatcacacttttcagtcattttaatgatcgttctgttcggcactttcgccgtctgttgcatcattttgtaccaaattcggacaattcaaaatgccgtgacgttgcattatgttcggggacctccgccggcttga

SEQ ID NO: 73685 - DNA, 560 bp, Heterodera glycines
  Genomic contig location: Contig_ID=SeqID_1462; Location=55..614; Strand=-
  SCN-specific regions: Sequence locations=1-131,196-390,412-560
atgcagcgtgcgagcagtaggtcggggcgccgcgcccgctcccagttgtggaagcgcacttggatggtctcggtctgcgtggcacgcgaccgggagccggcccgctcccagacaccgaccacggtgaagaagtcgtcaacgacttcaccgtcgtcgtcgtcgtcgttgtcaccggcttccgctttggttgtcgtccgccttcggtcgcgtcccgtctgagtcaactgaagaggtgggcggattcaattgttgtcggctggagtgatccatccaaaaaagacaaattaagagccgcctttaaggtgatttttcattaaatatttgtttagctttgatttttcagcaaatttacgaggacgcatatgcatatttgtgcaaatggtcacgacaattttctgagatggatgaagtgattggagattgggtcatttttgagtctgagccaacatctgaaaaagttcggaaggcgcataggcatttttgtggggcgacaactgatgatgaaatgaatgatttgtatgatgagatcgctgagtcgcaacagacactggagctcgagg

SEQ ID NO: 73686 - DNA, 3105 bp, Heterodera glycines
  Genomic contig location: Contig_ID=SeqID_1462; Location=625..3729; Strand=+
  SCN-specific regions: Sequence locations=1-239,261-788,810-1030,1052 -1177,1211-1333,1411-1464,1487-1715,1738-1741,1764-2497,2539 -2760,2786-3105
atggctcgcgtgctggacgggcgtgcggagccgctccgcgtcgggctgtccgtacagccgcccggctgggacaactgcttccacgtgccgatgcgcccaccacagcagaacagtgcgcacgcgctggcggccgccctcgaaacattcgcgaagcagtacgacgagctcgacctgttctccgccgacgtctgcttcaaagtgtcggcggtttgggccttgcccggtgagctcgtcctccgcatcccccacccctgtccctcgacaaagtttgacccctccccccaccgtttagccgcgcgcgtggagggcgcatgtgccgaggacgagcagcgcgcacgtggcactgtccgctgccaatcctttttgccggttgtgaacggggcgggcggcgaccgctggtgcatggcacgcgccatcgtgctggggctggcccagcggcgcatctgcgtactggagcagcgcaacgtggtccacttccgcgccttctgtctggcgcagcgtggcgaagcgggcgcgcccgaggcacgtcgcctgttggaggacgcaacggtgccgctggaccgcccaacgtacggggctgccgaggcgcaacgagtccagcgctggctggacgccagcctaggcgcccaccaagtgcggctggtaatcttcgcccgcgagctggcctaccgcgtggcgtggaagggcgcgcggctggcacgctttaacctgtgcttggtggcgcaggacggccactacgggtacatacagtgcccggagcagctattccatgtttgtcaatgtccctttacttgtgaaattattttaaatatgggaagcttttaggcgcgccagtactgtgtggactgcaagcagccggtggaccggcgcacgcacccgcaaggctgccgggcgctgtgcccccagtgtcttcgctttggctggggcgtccctgtgcgcgggagccgggccgcgctccgtcgcgctgcgccgactgtctgttcgtgttcgagaacgcggactgcttcgaggcgcaccggcgccgggtggacccgccgccgccgcctggctggcaacacgaccgtcgtcgcggcagaccccaccgtccgatgtgtgaggagcggcgcgtgtgcgcccgctgtcgtcaggtggtgtggacccgtcacggcgcgcacgcgtgcgccctcaacaacaatgttggccgacagcaagcagcacaacaacaacaacagtgcgaccgatgcttcgggattcacgacgcgcagtggaccccccacttcatccagccgaagcgggcgcagtgtcagctgatcgtcaacgacgcggtgcggccacccgtcccggcggaaggcctcgacggcgacaacgacgacgacgacgacgacgatgataacgatggcgatgctgacgatgtcgacgacaacgacgacggtggtgatgcggaacagaatcgacaacgtcgacgacggcgcccgctgcgctttctgttctgggatgtggagtgtgcccaagtggcggacgaaaatgaagagggggacgagggggtgccggcgcgagtgctcaaacatgtgccgctgctggtgtgcgcggaggtgatctgtgagcggtgtgtggccgcgggcgtggacttggagcgcgagccggaccgacgggcgcctggctgttgctgcggcggtgcggcttggcgagacggacaacaccgccagtggttgatgcgtgcgcgcgaggacgcgttcagcgacgacgacgacgacaacgcggacggggggcggcgatggcggcggccaaacccgcgccgcttgcgtttcttccacgacgcggcgaccgggcgttcgccgatggcacagtttgccgattttgtgctccacgacgggcccgtgaatgtgcgcaccgtgatgctggcccacaacggggtacgggggtgtacaaaagcggagttgaagaaaagctaccatctacgctttgtaggggcggtacgatgtgcatctgctgatggaggagctccagcggcgcggagtgcgcccccggcggctggtcgccaccgggctgcgcgtctacacgctggagctgggcggacgaaatcagcgcagcgtggtcgccaaggactcgctgaactttttcggctgtgccctgtccaagctgccggccatgttcgggctggacggcgtgccggacaagccgttcttcccctacaactacatccgggccgaaaacatggatgtggcgcatgtgggactgccgccggctgccgactacgacccggaccggatgcgcccggcggagcgcgacgcgttccagcgctggcacgcggcggagcaacagcgtcgacccaaccgactgttcgtgctgcgccgggagctgctccgctactgtgccaacgacgtgcgcattctgcggcgcgcctgtctgcgcttccgccacgtggtcggcgagctgtcgggcggtgtggagccgttcctggccgcctccaccatcgccgggctggcgctggccatctaccggcaacaacatctgccccgtgatctgatggtgcacacgccggagggcggcttcctgcgcggacgacgcgcttccgccgcctcgcgccacttcttcgcgctgctggagagactgcgcccgcaatggcgcggtcgactgcgcaccgcccgctggtccatcggcgaagcgtgcgtggaggacgacggctaccggctggacgcgctgctctaccgcccggtgccgctgcgcccgctcgtcatcgagttcaacgggtgcttctttcacggtaaggaagggggggggctccttttcctgcactttttccatttgcctcgtccaaggttgccccgagtgctacccgaggcgccatcaagtgttggcgggcggccaaaccgccgagtcgctgtgtgccaggacacggcagcgtgcctgggagctggagcagcaccacggcttcgcggtgcgcacggtgtgggagtgcgccttccagcggtggctgcgccgccagcccacccgagtgcggcgcctgtacacggatgtgtgccgggcggtgcccggcccgatggacctgcgccgggacgcgctgttcggcggccgagtggagccgttcgcgctccactacacgtgcacagagcgagaggaaattga

SEQ ID NO: 73687 - DNA, 1206 bp, Heterodera glycines
  Genomic contig location: Contig_ID=SeqID_1463; Location=43..1248; Strand=+
  SCN-specific regions: Sequence locations=1-124,146-408,431-858,885 -1206
atgaagtaccgcgccttccccgtgggtctgccccgggtgctcagcgccgagcagctcgaccgtgtgcggttgccgtggacgagtgtggagcagaatccctaccgcggcttcttccactgccgcgtgctgccgcctcggcccgccgagcttggcgagcgccacgccctgttgccctaccggacgcgcacggggcggctgacttttccgctgtgcgccgcgtgcgccgagtgggccaacgcggacaagaaggtgcagcgccagcaccgcccggtgccccgctgtcgacaccgggcggcgcaacgtgcctggacgcacgcctacaccgatgtggagctgaacgcggcgctacagctcggctacagggtgctggcgctgtacgaagtgtggcactacgaccgctgggcgagcctggaggcgggcaacagcctgttcgccggctacgtcgacacgatgctccggctgaaggtggaggcgagcgggtggccggccgactgccagacggtggagcagcgcgcgcgctacgttgcgcgctacgcggaccgggagggcatccgactcgaggcgggccgcgtgcagccgaacccggggctgcgcgcggtcgccaaggcattgctgaactccctgtggggcaagctggcccagcgcgcggagcgggacgacgtgtgctacacgggcagcgcgcgcgagttccacgagctgttgggcgacccgcgccaagatgtggtcgactttgtccacctcaacgagcagctggaccggtgcgtggtgcggcgccggtggccctttgtgcgcgcgccggacaccaacaacttggcggtcgcctgcttcgtcaccgcgcacgcccgcctccatctgcacgggcggctggaggaggtgcggttggcgggcggccgcatgctgtactgcgacaccgactccgtgtactttgtacgcgcgcggcgaccacccggcccgcaacaacaccagttccttcgatccgagggcgacgcgttcgggcagctgatgcgcgagtggcccggccggcgcattgtccaattcttcagcgccggccctaagaactacggtttccggcaccggtgcgccgcgagcggcggggacgaacgtgcggagcgcaaggtgcgcgggctggagctcacctacaccgccagccaactgctcccgttcgagcgcatgcgtcagctggtgctcaacttcttcggccggtga

SEQ ID NO: 73688 - DNA, 1223 bp, Heterodera glycines
  Genomic contig location: Contig_ID=SeqID_1464; Location=864..2086; Strand=-
  SCN-specific regions: Sequence locations=1-218,240-254,285-1223
atggattcattcggaactgtcgcctggattctgcgaccaacggctcagacgacaggcactgctgtgggctcaatggagtacgaagaggaggaaaacgggacaggaaagttggtccacagtgacacagctactgtcaccacacctaccaccgccgagtttagactggaaaaagaagccccctcctccgagaaggacggtgctgaagagggcagcggcggccacggcacactgctgttcatcgaatccgatgatggggaggaggaggaggaggaggaggatgaggacattgaagacacccccgtcgccacagactccccctcggctacgacggcaaccgttgtggatgactcttccaacactgttaaaggggtggagcagcgctccagtgagcacagtgacatgacgaacggtacgggcggtggcggtggaagcgaaggcgcaaaactgctcggcgggggagaggaagaggaggtaggtggaggccagctaattttctaccccccccccctactgtttgtagcctgttcgaatgccgctgctcaactacctgtgcgcgttcaacgactgttcaatgaaggagcttcaactcctcttccacagtgtccacgcgcgacagcgtatggtgtcgcacctgcaacaacactgccgacttcataccgcgcatctgaaaccggcggagcgtaacattgcgctccactgtcacgacctcagcgtgcagaacgccaaccggacgttcgcctgcggtggctatctggagcttaccgtaattcgatgactgtgtagaccaataatggtgcggccttctgtccaggttcgacaatacttcttcgccaaacacgggctaaagctgaagcacccgtacatgccgtgcatgatcgagttcgggggcggcacgcacgcctcctactatccgtaagcggggggtacgcaaaaatgggggaagtgagcgtaaacgccttcagcctggagctcgtccatgtcgtgctggagcgtacgaagcgcgccaaacaggagacggtgaagcaagaagagccataccgtcgtgaatccggcgacgtggctccgacaaagtcgatggcaatgccggaacgacattgttgccgctgttgctgtcgatgcgctaacaactagctttttgagagacatggtcattgtagatttgcgcgcgtgatcacgtaacttattgtgctgttatagtttttgtgcactttttttgaaataaa

SEQ ID NO: 73689 - DNA, 1363 bp, Heterodera glycines
  Genomic contig location: Contig_ID=SeqID_1464; Location=3484..4846; Strand=+
  SCN-specific regions: Sequence locations=1-700,731-845,867-1363
atgacgttgaagcacactgtacgcatgctactcatccccgaggatgtttatcgacgtctgatggacaaccccagtgcagcggcggcgacgtcttctaccacgtgcatgaacaagttgcccacgcccgcaactcccattgagcacacggcacgcaaaatggtggcggcatcgagcaagcacacgaacgacgacgaacgcctcatccactaccaacaggagttcaaacgctaccagaaattgctggaagaggaggcggaacgaccgctcaacgtacagctatcgcaacggacaacaaacgcactgcgtgacactgtgctgcagaaggcttcgccggcaacagcgacgccgccgccagctcgcccccaacggaccacacctctgtccagacgacggggcttacagcatcaaaaccaagcgccgagcgcatcttcctcttcttcgacaaggccaacaaaaagtagcagcagtaacgagcaacaacaaccgctcccccagcagactgctgctccacaaaaaattggcgatctgcctaagcaagctgagccgcgtatacatgccgcgatggcgtacgcgcaacagaacccaggcttgcttggcgtcggcggtgaagacggtcagcaaattttgcaccttgcccagggcgcttatcgccccatccggggcagcaaccttgacacgctgctccgctaccactttgtgggtcgtcatcagcagcagcagcagccgcggtcctccactaccacccccaccgccagtgtcgctaaggcaccaccgggctacaaaaccttcgtcaacaatgcgcgtgacgatcttcaaatgtggcgtctgctgtttccggatgaaagggcggcggcggcgggcagtgattcagcgtcaacagtgggcggacaacctcggcgccaccaacctctgcgcggacaaaagaaaactggcgcgggccgcctactacagcctaatcatcatgcacataaatcggttcaaaaaagtgcgacgagcaagaggaagcccaacactgtggagcattccactgccaaacgttttaagcctcaattatggtgattggaagcaacgccgtccgctcactgatggtggaaagtcttttggacccgatttacaaggacgaacggtcgccagcttgcttcaccagcgtagagcccctgctgcgggaggcgaagcgccggcacccggacgcccgtcttacgcgcgcggagatcagccgctacttggcgggccaacgtgtctacaccctgcaccgacaagtgcgacgacgcttccgccgtctgccgactctggcctccggtctacacaccgactggcaggccgacctggccgatttccaacgtctccgcgcgcaaaaccgcgg

SEQ ID NO: 73690 - DNA, 186 bp, Heterodera glycines
  Genomic contig location: Contig_ID=SeqID_10479; Location=1263..1448; Strand=+
  SCN-specific regions: Sequence locations=1-186
ggcacccccacaaagtgtccaagccacgaaatgtccaaaagagtaaaaacccacgaaatgtccaaaatttttcaaaatttataaaaacaaaatgagtctaatttaggatttttcggttttcggggtcgctgaatacgaatataccctttatattaccccttgcctaaccttaagcccatctgaata

SEQ ID NO: 73691 - DNA, 470 bp, Heterodera glycines
  misc_feature (427)..(427): n is a, c, g, or t
  misc_feature (440)..(440): n is a, c, g, or t
  Genomic contig location: Contig_ID=SeqID_10480; Location=661..1130; Strand=+
  SCN-specific regions: Sequence locations=1-164,202-470
atgaatggatcaatagaaaatgatcatgaaatatatttttattttttgttggtcgctaatattgttcgcctatttttcattataaataaaccaatataattttgcatcgttttcttcgtccaaatgttaatatatccttccgagtaaaaatattcagaataaacttaataattttatataaaaattattaaagaattaatacatattcgcttaatttactaaaaatgtctttgttctccaaacaaatgtctgagcaaattgcatcttcaattaaagacaattacgcaacattcttcccaaacagcaaagaagctaaatttgcccataagtcaaatactgcctgggacgacttaacaaatgagcttaatgccaactttggttcgtcggtcactgtgaaacaagtcaaagaaaaatggcacaatatganaaaagattcgaanaggcgctttgtcgaccgaaagcggtcataa

SEQ ID NO: 73692 - DNA, 673 bp, Heterodera glycines
  Genomic contig location: Contig_ID=SeqID_10481; Location=1070..1742; Strand=-
  SCN-specific regions: Sequence locations=1-61,147-190,212-256,308 -325,347-461,483-673
atggccaaaattgtaaaaaaaatcgacaattttaatcaatattaataatttcaggtctcacaaaaatattttttaatataattttatgattaatattttaggttaatatatttataaaaaaatttcttctatataatatattttatggtggacgcaaataacggggaatatttcgagactcaaaaaacgaaaagcagacatttttgaaatgataccaaattatttcatttcgcataactatgaacggagtttatacaaatatttaattatatttttttaatcaattttttaataatttttaaaaaatcgaaatgtcgcccagttgtcccccacacaatcccggccctgacatgtgccattcatccaatttcgaaattctaatccgtactaagtattttttgagtcttatttagccaaaatgttggatgtacagccccaaattgtgctcgtcccgtccattgtgccagtgattgtgacagcaattgcgctctttttggccacaaatgggccccacaattggccagcactgtggcaagagctgatcaatccgccgtcggatgcgcgacatgccatcagagggccatcaccatattcggcacatgtacggcttagccaagcggggctcgatatgcgccgtgcgcaactgatggtcagtgatcggagacaaatttaa

SEQ ID NO: 73693 - DNA, 176 bp, Heterodera glycines
  Genomic contig location: Contig_ID=SeqID_10481; Location=1952..2127; Strand=+
  SCN-specific regions: Sequence locations=1-47,69-124,169-176
atgttcaatagatttgggccagttttaccttctcccgtccaaaattataatgttttctgatttttatagagatatgtttttttattccttaccagggaattgagtgtttatgttgaattttccaaaaatgtataaaaaaggtaacaaaaatatgtgtgtttaaatcaaatttatga

SEQ ID NO: 73694 - DNA, 1850 bp, Heterodera glycines
  Genomic contig location: Contig_ID=SeqID_10482; Location=314..2163; Strand=+
  SCN-specific regions: Sequence locations=1-153,175-273,295-299,338 -350,372-413,490-501,523-1157,1181-1292,1315-1644,1666-1704,1726 -1764,1786-1850
atgcgaaaattgtcatcttccaaatcacttaaaatttcggcaaagcttgacggagaaaggaagaatgcatttttgacaaaaccaattaaaagcttgacggatggagtccaaccaaatgttggtggccctgttttttcgccaaatgtttttcatgaacaaaatgaagaagataaagaatatgagaagcaggtgaagttgatcaaactgtaatacaattagtttttgatcacaagatatttaaaacactgaaaaattcaaatggctagcaaatttaaagaaaaattttccaaattttcgttttgcttgtgtaataaatttttggggaatttttcccacctaattacagcggaaatttcctgtaagtcttcaaatatattaacttcagcattgctgttaatttgtaagctctctacaaattttaattcaaaatttaattaattttctcaatataatttaaaattcaaaaaattaatttgtttttatattaatccagggaatctatttgaaatcaaattttgaaattattaaatttgtaaatttataagtttatctacactattatacaactaattttttgtaaagactgataattatgtgccgttcccgctctactggcatgccgtgttggaacattttgatggaaaagtgccggccaaaattattgccaatattttgggccgtctgatcactgccttaaaactttgcaaaggcaaccatgactatgacgtgatcacttcagtaattgattttgacggcattttgacggctgaacattttttggccctcaaaaaaactgatgggccaatttttcaagagaccgaactccgtggagacatcgctttcattgtcaagaaaattgatgtgccagcaaacacacgtctggcctacatgagtccggaacaagtgatggtaagtatggcaaaaatatgaaaagttaaatgtccgaatcgatcgaaaccgggcgatcggaatgttacaaattaaaatttggacgagatcttcgatcatgtgcctctaggctacggcacaaaccgatattttcgattttgatccaacagattccgaatgatcagggacatcccgtgaaggacaagtgccacctaattagcaaaatttaaattcgatgagtgccctcattaacggttcccgcgggacacggatttccttatttttaattcttgcaaagccaaataagtaaccgtacctaaacacttggattaatgccaatgctaacatatacaattttatgcctaatgcctgtttaacagcacaattcctacaaccactccacggaggaggacattgtgtggtcattgggcgtgatactgttcaccatgctcatcaaccggcatccattgcaagggatggcaaatgagcatttcaatttggcacaacaaaatgccaacaataacaaccgaaccgttgacattggcacattcttggccaattcttcagaagacatgttgccaaaatggcgcaaaatgattacattttatgtgcgatcagaacaggaattgccgttggaatacctcaaatcgtcggtcggtgttggtaatgatcatgttctactaatcccggtgattgaggtcggtttatatgaaaggcgcgatcgatgattttcgatttggtaccgaaaaccgatcgaaagaattttaaaatcaaaaatttttgatagaaatacccaaccccaaaattcccaagaatttaaatataacattttgtggctaatcaacaaaatgccaaaattacggtttttagcgctgccttcaaatgcaaaagcagcaaaggatttcgttgtgccgtttgcgcaaaactttggaagaaattgtggagaaaattgaaaatgctaa

SEQ ID NO: 73695 - DNA, 749 bp, Heterodera glycines
  Genomic contig location: Contig_ID=SeqID_10483; Location=467..1215; Strand=-
  SCN-specific regions: Sequence locations=1-364,386-485,508-749
accatcggcgaatgtcacgtcgtaaatcacaccagttcgctttgaaatcttgccctgttgccaattttgggaaattctgtggcgggcaaagaccttgtttccgatcgaaaactcccttaatttggttccaaatcgcttattgaagcgtcttgccatttaaaaaaccataattatgatgaattaagcaagtgcgcaattttgtcaccgtataataccgtagtggataaatataatgaagagattttggatttattacctggtgaacaaattcatatttaagtattgatgaaacagatttaagtaaaaataacccagtaactccagaaattcttaattcattgaaatgttccagtataccagatcatgaaattaagcttaaaaaaggggcgatgataatgttattacgcaatttaaatgtaaaggagggattgtgtaatggaacaaggttgcaagtgactgatttgggcaaacatgtaataaactgtatcattaaaagtggagatcgaattggagaacaaacttttattccaagaattaccttaattgaagaaaaaaaatttccttttctactgagtagacatcaatttccaataaagcttgcttttgcatttactataaacaaaagtcagtctcaaacattttcgaaaattggtcttgatttcaatgatgatcctttttcacatggccaaacatacgttgctttatcaagagcgaaatcttggaacgatattaaaattaaattatctgaa

SEQ ID NO: 73696 - DNA, 1446 bp, Heterodera glycines
  misc_feature (1310)..(1310): n is a, c, g, or t
  Genomic contig location: Contig_ID=SeqID_10484; Location=1817..3262; Strand=+
  SCN-specific regions: Sequence locations=1-163,187-317,353-469,496 -562,584-774,804-840,862-894,916-1005,1027-1061,1083-1446
atgattcaaaatgcttttattttttcttttatttgctttttcaacaaaatattttttgccaaaaatgtcaaaccggccatcaatctgatcaaatattcggctatcatttctccgccgggtttttataaaattgcaatttgggacagatttgaaaagaaaaaagcacaacaatgcaaaaatctttttgaagaagttgaacaagaagtaagaaattaaaagcatttttataaatattcaattttggctaactttgccctgaaactttgagagtgatttttcattatgccaatattctgccaattcgggaatagtaattcataaattaaatattctaatattttaaataaaaattctttcagtaatttttaaagtttcaatttcaaaaaacgattattttcaaaatattttctttttttcatgggtcaattgtccgaattttgaaattttgtgctttttctcccaatttaattgtctaaatttttacttttaatagttcaatggtaaatttcatgctgttcgtcgcttcaagtattatgatggcattgaattagaatattttgctgaatgttttgaaaactttttcattgctcagacaaatgaagacggtgaatttgatgtgaatttaatgggtaacattggagaaacaatctttttccaaatatttccactctataataataaggtaattaattagaaaatattaaatgcaattaaaatatgacattgatactaatattcaaaacctatttatagctaaacgaagtgaaatttgcatattttgttaatttctttaaattaaattttcattaattccttcttcaggctccaatccgttccgattctttcccctccacttttctccaaagcatacacagaaaacccgattggaggttatgtgtgcattttgagcaacatttttattttctaattcataaggaaaaaaagactaaaatcggcacaatgttggacaattggcagagaagtgccaatgccaacccatcggatgaagaagcctttttcctcaaggcatgtttacaggaaatagcgtcaagaattgttgacacattcaccaagggcatcaagctgaccaataatgaaatcagcatccagcgcaaatattggagtgcatttcaacagatgaaagggcatggaattttggccggaaaattggcacaaattgatggaatgccaaagttaatgaaagatttatgcagatttacggttgctgattatgaggcaaactccgccgatggattcgaatttaatgacaaattattgcctttggctttcttttgtgcggaatttataanaaatggcaatgaaaagcatgagagcatattggagagaatgaagcttgtgaagtttgaaaaaagtggagaggaaatgaacaaatgtagacattatttattttatcacttttattttttgtggaatgggattaattag

SEQ ID NO: 73697 - DNA, 1056 bp, Heterodera glycines
  Genomic contig location: Contig_ID=SeqID_10485; Location=566..1621; Strand=+
  SCN-specific regions: Sequence locations=1-13,35-1056
atgcgccgctattatgggactgattttatggattttatcagcgagcaaggagaggaagaggaaattggtcttaatttcaaacagggaattgtccgagtggggcacgtccaattgcccatgattgcagccattaatattgagtgccgaccgatcgaagtacgacttttgcaaacacacactctcccaccgctctcggattccgttgggtggggacggataaacagaaatttgagtcctgaggaaacattcatcaccgctgagagagaacacgactattttccaatacgtgtggggaagtgtctaacaagtcccggggcgacccgaattgtaccactccgcttgttaaactttggaaattgtgacataaaagtgcacgggggatcccgcttggctgtacttgaaccgctttcagctgacacgcatattaattggttgcgaaagtgtacagaaaccgaagaaagcatgctgatgaacgacgaggaatggcataaattcaaagcagaaagtgatcaaataccaccggaagccgattggacagatgaaactctggcgttcccaaaaaatggcgaggccaccaagccaattttggaaagaatctcgctgaaggaatcaattttgagtccgggaggaatgataaaattgaggcaaatcatcgaaacaaacgaatttgtatttgtgaagccgggcgaagtcggtctctttaaggggaagacaattcatcgaattgatctgactgaggtagccagaccatgtcaacaaaggccgtatcgttatcccgtggcactccaaccagaaatagagaggcaagtaaaagaattactgcgacagaatgtaatccgcccctcttcctccgcttgggcttctcctattgtgcttgtacgaaaaccggacgggtcctacagcttttgtgtcgattatcgaaaattaaatcaattgacaaagcgatcaacatattatttgccgagaatccaatcgattcttgacgaagtgacgggaaagaagtatttttcggttgctgactggctccagtggattcttccacataaaattggctaa

SEQ ID NO: 73698 - DNA, 1053 bp, Heterodera glycines
  Genomic contig location: Contig_ID=SeqID_10486; Location=440..1492; Strand=-
  SCN-specific regions: Sequence locations=1-5,128-142,164-374,396 -521,543-646,698-813,836-1053
atgggaagaaaagaagaagaaaaacgaaatgaagagaagaaaagggaaataattagcaatttctataaaataaaagagaaaataaaggaaaaaggaagaaaatactcaacaaaagaatggaataaaattaatacgaaaatagcgaaaaaattggggacaaatcgtcaatatattgctgaatggatcaaagaatttggtcttcaaaaacaaattcataaaaactataaatcaaaaactgatgaagaaaagttagaaattgtacagaattttattgaaatgataaatgaatataagcaaaaaagaaaatatacgagaaaagaatggcaacaaaattatgccgaaatttgtaagaaaattggagtaggccatggaacaatttacaaatggaagaaacattttggcattcgcagtaaaataacggagaaagaaaaaatggaaaaaatgaaaatttattggcaaacaaaaagagaatatccagaaatgagtgagaaagaaattgcaaagatgttgaaaagtgatagaactaacatttcaaaatggaagaaactgtttggataaaagaatcgttgaagattgaaaggatgattataagaaaaattggataaatttgcagaaaaattatcagaaaaactatgataatttctagttttttttttcaaattttttgtatttgtattaaaaaaaattattttaaataccctaagttttgaaatttttcttagtgaaaataagtgaaaacagtcaattcaaggattgggagtgacaaagccctactctggagactgttgggactcggggacacccaaaatggggcccctcgtcgcagctccgggcgggccaaaatggccctaaacaccaagccccaaatccgcttttcgctgtcctctttatttgctgacaaaggaaggtccccaggtgtccgtgggatttccgaatgaaatttggtgggtggttagagcacccctgggttcttaagaaaagtggttttattttttgcggaatgagcccgagtgccgagttatgacgtgccaaacttttttttatcccaataaa

SEQ ID NO: 73699 - DNA, 1594 bp, Heterodera glycines
  Genomic contig location: Contig_ID=SeqID_10487; Location=889..2482; Strand=+
  SCN-specific regions: Sequence locations=1-105,131-951,973-1196,1218 -1222,1251-1594
atgccactgactcaattgcgcgtctatgtgctgaagtgtctcatcgccactttgttgtccgggcatgcgaacaccgtggcggttcttcaatttgcattgaattcggagaaaaacaaaatgcaaatgcatgaaatcctccggaattcgatggtcggttactactcgcaaaaccttgaggtatgtgcaaaactgcccttttttgttgccgaataacaaattcaattgaatttgtcccgttttcaaggaccagggtcgactgacgcgcattctcgaaattgcgcacgagctcaaaattcttggagaactgctcaacatgacccaatttgcgttcgtcatcgacttggccacacttgccgcccgacgggactatctgaagttggacaaattcattggggacaaactgagcgagcatggcgaacgctttgcgcaagacctgtgtcattacttacgacgtcgatgccccgtgttgaccaccataaacccgttggccaacgacactttccactccatgttctccactttgcaacagcgggcagcctcttggccagtgatcacggccgatttgaaccaactgattgcgcagatcagccgaggaaaggtcggttgcaaggctttgtagccgttttttgccaaaaaaaggaatatttttgccattttgtgatccattttttgaagaatattgcaaaattggggtccggtttatgccgttaggcgccgtcgggagagtttttgggaattttaatccaatttgttaagagaattcctttttcctgttcaggcaacgcctgcatcagcacagcaatttggaggcattggcagtgctggtagcgttggcgctggtgtcaatccgtttgtgccattaaaaggacagggggagccgcggatgttcggcgcttcgtcaagcgcagcggcatcgggcattgccaacgccttcacaatgttccgccatcagcacgccgaccagcagcagcaaatgctgcgaagcctgcgctccacgcccggcgcctcggacttccacgacttccgtctgaccgcgcaaataccgccaagtccgagcaatcaacagcaggccgagtttggaggtaattaataaacgcgcgtttcattggtcatgcccgcattattatcaaatcgctcccataaaccatatttaaagggtccggatcatatgttactgatagaaacttaagtcgattaaaaatttcccaaagttttaattccgaaataatcatttttttataaaatttttagcaaccctttcaaaatttttcatttcccttcgaaagggggagggctgggggcccatccaaatgcatatgctcatgatatttatgactttagtattccaattttgcttacagatgacttggccaccgcagtgttcagtgaagacatacaggaagaagcgaactcatattttcagcaggtttcatttgtcctcaacttaacaattactattttccattgtcgtccatagatttatgctccaaatggtcgcatgtctgtcaatgatttcatcgcaaaactcaaaggttttcggcattctggaaacatcaaagagcgcgtgagtatttattttgtccaccaacgaaca

SEQ ID NO: 73700 - DNA, 476 bp, Heterodera glycines
  Genomic contig location: Contig_ID=SeqID_10488; Location=1744..2219; Strand=-
  SCN-specific regions: Sequence locations=1-476
cgaaagtaccatttggacgatataagcgagcgcatgttgcgggtctttttgcgccatcggagtgtaacagatggaaatccattcgcgcaagatgttctccactttgctctgcagaatttggtcctcagtccgaacgcccaattcgttgcctggcgccgggcagaaggcgccgcggccttcagagaaaatgccgggcggaagtgccattcgttctgcggacataatgggcgcggcgggatgaccaacaatgggcggcggatgatgggaagggatgacgccatggagagtggtggtcggagtacgaacatcggtcatggacatttgactggaagggatgaacggtgtggcgagcacatttgtcggcgttcgagaagaagcagcagttggtgtgttcatcagaccaggcttggtaaactcgataaatctgtcctcgggcgcgagcggtttgaagccacagattttcctacaaaattttc

SEQ ID NO: 73701 - DNA, 591 bp, Heterodera glycines
  Genomic contig location: Contig_ID=SeqID_10489; Location=393..983; Strand=+
  SCN-specific regions: Sequence locations=1-31,53-591
gttgtggcatgttcacaggtggcggcttcggatgtggcatcagcaattgcaccaaattcacataagtggtggagggcggctgatcatcttttgaataagaaaatttgttgaaacgaaaacattttcggcggtaaaaaaacgtttgaaaaaattccaggcaaaaaatggggttaaaattcaagaaaattttgcttcaataaagaactcggtaaatctcatgatactaatggcgctgcggtttagtcgagtcttgaagacaataaaatgtcaaaatgttcgcttgggccaagagaattccaggccagggaattaccgaacaaaaggggacccaaagtgcccaaatttcctcaaaacccaattctcgaaagcatcgccaattttggcacctttgccgaactgactgctctccttccaatgccgtcggctgctggacatcattgaagatgatggtattgcttggtggtgctgctgttttttgaatccggcgccgactaagccggcgccgctgcgccgggttcgaatccgaatcagaaacagtccgagcgccatcagcgcacatgcaacgccgcaggcaccgaacaccgccctgga

SEQ ID NO: 73702 - DNA, 1569 bp, Heterodera glycines
  Genomic contig location: Contig_ID=SeqID_10489; Location=1138..2706; Strand=-
  SCN-specific regions: Sequence locations=1-129,151-1368,1390-1569
cttttgcggataattatgcgcaagtgttgcgcgaacgatggcatttgggcgaatgtggcgaagacattctgattttgattgtcaaaacaccgccacaaatggtttcgtttcgaaaatcaaaccaaattgaaattttaaatttaattttttcagcagtccaccgatgggcctcagtcgtccgcgcactcgcggcccaacggcccatttccggtgaaaaatgagcatataaactctgtcctgtggaaaagttaattggcctaatcaccgacaaatgatctcgttctactttaatcctaaaccctgatcactctaaaattttgcaaaaattaactgactgatcaccgacaaattgatcccataatcactttcaaattgaacggcagacaaactaatctgtcttgtgattgtctgatcatcgaaaaattgtttccattccactgttatcgcaaaccctgatcacttcagacgaatcctttttgaattttgattttttatcccggtcaactcccgaccaattccccgaactttggatcgctctgaccaattctttgatcaccgatcactatgcgtttccgatcaataattttttaaccccttttcccgactgagtcgatcaaatgcttgtaccttctatttcaaagttatatgtgttcagatgcttttcctctcgcttggcccactgatcactagtcggcttcaccccgactttgccggccacgcgcttcggcacattttgtttgatgctaatgcgcaactccaacacgacgcacgccctctcttcaaagtgcgcacacaaatattgttattaatccatgaccaagcttaatggggctgttcgaaatttccaagactcgagaattgggtcccgagagttgtgttgaatcgtcagattggaccgggacgggttccctgatactgaggacgggctttttaattgtaaggccaggagcgcaaaaaattttcggttttttgagaattttttccccttttgagaggggttgaaaaataaagcccacgggggttttattttagggaatactgtattttattttttctcacaggtgctcaacgaaatgttgctgcgcatggacgccgaagtgtttggagcgttggcaccggcagaattttcagcgggcgttggcacggcaccgtcctcctttgtgtccacaccgcacgcgcggcaccggcacagttatgccgatgggccgacggtgccgtcacgcagtcacataccgccatgggcatggtccaggaatttagaatttaatttggcaattcactatggcagaaactcgggggcctcaagaattgaggcccggttcttgagcagcgagagatgcgattggcccaaacccagaaaattcgagaattgaaattttggcccaaaaattcgtgaccaaattttggccaaaacacgaagggaatagtcaagactcgaacttagttttgagaatatttgtctcggtttggagcccgagaaatatgagaatttgccaattcaatttttggggggggtcgaaatttttaggcataaaaatgttgaaaacatttttatctgttaaaagcaca

SEQ ID NO: 73703 - DNA, 1340 bp, Heterodera glycines
  Genomic contig location: Contig_ID=SeqID_10490; Location=783..2122; Strand=-
  SCN-specific regions: Sequence locations=1-74,132-238,365-465,576 -680,730-882,912-954,984-1340
atggccaattgcttaacggatggttttgcgacccgggctccacaatgtccatgtcggaaggtgattaatggaagaataaaaaatgatttaaaatataattaaaaataacaaaaataattaattaattaattgttttgcgtaatatatcagaattaaaatcattttaattgcattaaatagcaattaaatcgtatttttgtacgaatttttgtataattaaaataaaattggttgaagcaaaatttattttatgattataaatttaatattcattaatttttcattaaaatgttttaatgaaaatagagcctttaatattttgatttattaaattttataataaacaattatttatttttttattgtcaagtttttgccattgacgaaacattgcgacgaatttatgaacaaaatcggcacaattgcatctgtagaaatgaagataatgttcaaagactggaaattggtgatgagtaaattatttaatttatttatatcatttttattttttttgtatttaaattttaaaatttataattaattattcaaatatttttatttcttttttattttcagataattctgctccaaaagatcagcttctttctcccgacatttgctggttccgttttgggtttgcctttgtgcctgagcttagtcctgggcccgattcggcctcgtaaattttcaaaaaaaaaaaaaaaaatttttataaaaattaataatttagtgccgaacattgtgccaacaataattttgaaattggcacaacaaacagcagtttggaagcagaaaatgaatccaatgaacagcttccattcaacagattattcttaccacctgaaaaggggtaaaatcttcttttttttttaccaatttggcaaattattattttttttgaaattttaattgtaatttcctgagtttgacatttttgagtattaagtgagtgcctttttttaaatttgaatttaattttttttctctaaatttggcatttttagattttaagcaaatgccattgctatttttgggtttgcttataaggcttctaaatttggtttttcatttgaggaggcattcgtctaaaattaaaattggcattccgtgccaaaatggaaaatgcattaaaattaaaatggcgtggcatttatttaaaaatggcaattcttttaaaatttaaattatccattttcatcattagctgacatttcatttaatttaattggtacattcagagaaaacgcctttctctaaatatttaaattttctaaaaaaggcattttaccaaaaattggcatttttactaaattttcttcggtagttttttttaaaataaa

SEQ ID NO: 73704 - DNA, 984 bp, Heterodera glycines
  Genomic contig location: Contig_ID=SeqID_10491; Location=402..1385; Strand=+
  SCN-specific regions: Sequence locations=1-1,37-857,879-984
atggaggacgatgaggaggaggaggagaagggaatgtcactgatcagcagggccaatgtgaggagacagctgagagggatggcacaactgctggaggaggaaagtgccaaagggaacggaacggaagagaaaaggagcgccggaaagagagccgcgagggcaaagcaacgtcagcggagggggggggaattccaaatgaattaaacatcggcattttgttttcaaattgcccttcctttaaaaatagtttgtgccaaatccagtccgttgcagaattggagcattggctgcaggcattgaaagtgccgcaaacattcgccgcccttcgggcagaagccgaacgatggcgacagacgaaaagcgccatggcgggcgccgaccagcgaattttggcacagggaggggccgctttgaaggaaaagctgcgcgagttggcgcagcgacgcggcgcgggcgacgctttggtggcgggggacgcaatcgcaacggacgcattcgaaatcagcgacaaatattatgccaaaggtaaaaaaatatttggttatttctcaaaaaaaaaatctttctcagcgattattcacaccgttccgcccaccgatttgctcactcaaagagacttcgaaaagttggccgactgttttcggcgctctttggaaatcgcttcttcccgtggcttttcctccgtcgtaacgttccgtcggcttttgacctttgattcgttgaagcaaatttaggcttttcctgagatgttagcaaaaaatgcaagcgaaagggacaaagagcgggcggcacaaattggcgtcgaagcggtggccaaatggatggccaaacatccgaagggaaaggtaaggccaaattatcacccaattgcaattaattagtcattccctaatgtcaaggtcaattccgtccttttcgtcatccagcaggacaacaaacacatgttggagcagtaccagcagttggtcgagcagaaatttggga

SEQ ID NO: 73705 - DNA, 652 bp, Heterodera glycines
  Genomic contig location: Contig_ID=SeqID_10492; Location=12..663; Strand=+
  SCN-specific regions: Sequence locations=1-16,39-54,197-238,269 -499,521-652
  Gene Ontology: Mol. function=protein binding; Cellular component =axoneme; Biological process=eye photoreceptor cell development
atgtttgtactgtccattggtaaatggtttggccattttgcgcaccggagacgcgaggaaacggccgaaagggaaaaggagaggaggccgaacgaagtgggaagagagaaggaagagataaggaagaacagggaagaggaagaggaagagcagaatgagaaaggaccagctgaggaggaagagaatgaggaggagggacaaagcgaacaaaaaacaatggaagcggaaaagagacaaaaggaggatgaggaggaggaagaggaagaggtaattgctttcgattagtggaacttttgtccaattgttttgcttttcatttgccctttttcgctttttcagtccgaagaccgatcatcgacggatgagaatgactcttttgcgcttgaggacggcacttcctccaccgatcctttggactcggcggatgagctgttccttgaggcgtccgcctttgccgagttcacggtcagcgaagacggctcaatttgggaagggaccggcggatggggcgaagcggacgacgcgacagacgcggagtacgagacgagcgtggaggaaatgctgatgttacggcacgggacggtggagggaaagcgcagtccaacgccaccctcaaaaattggcacgatttgctcatcggcggaagacgaag

SEQ ID NO: 73706 - DNA, 1806 bp, Heterodera glycines
  Genomic contig location: Contig_ID=SeqID_10493; Location=163..1968; Strand=+
  SCN-specific regions: Sequence locations=1-138,356-549,572-655,829 -872,929-1248,1278-1281,1303-1501,1527-1806
  Gene Ontology: Mol. function=cytoskeletal protein binding; Cellular component=cell-cell adherens junction; Biological process =intercellular junction assembly and/or maintenance
atggccgccggggtgaagacgataatcggaggggcggtggaagcagtgatcgccacaataattaggacgaccaaagtggaagtgattcgtgtgaagcttgaggaggaccaatggatgggccaaaacggactaaaaggagaagaggaggaggaaaaggaaaagggagagcagaaaggagtgggaggaagggaaggggaaaaggaggaggaaaaggaagaggaagagcaattagaagagcagaaaggagtgagaggaaaggaagaggaagagcaattagaagagcagaaaggagtgagaggaaaggaagaggaagagcaattagaagtgcagaaaggagtcggaggaagggaagggaccgaaatgcataaaaatggcaaaaaagagcagcaacagcagcaaaaagagcaaatggaacccaagcagtacctggcggtgtacacagcacaaacatgcatcaaaagagcagcaggtggacggattagcaattgcttaaacaatttattcaacaaaagccaaccacaatttaagagaaaggcggaaaatggcaaaaggaacaaaatggaacagcaaaagcgggggaggaagacgaattgtcaatttacagcgacgcattggaagagcaatcggcggaagaagcagacgaaccgaagaaggaagagagaagggagatggaggagggtgggaaagagaaagaggaagagagggaaagagaggaagagaaggagagagatgaaggaaaagatatgaagaaaagggaggggaaagaactaaaagaacgaatggaagaggagaaaaagggcaaagaaagaaggccaagcaaagaaatggccgaagaacagctcgtaaacagtgagacatcggacgacgaatgcgaagaagaggaagaggaggaagaagaggaggaggaagacgatgaggaagtggaggaatacacggacgaagaggaagaattgtgctcggagatgtcccaagtggagagggaaattgagcggatgagaagggaaagtgtggcaatggtggaggaaagagaagtgaagacgaacacgccaatgaaaatggcaaatccgaggaacaattcacccgaaaaagcagcaggtgaagaagccgcgggaagggtggcggataaagagcggacgccggtggacgtgggcgtatactccgggtggaggagtacggtaatggacgggaaggatacggtggaggaggaaaacgacgcggaagacagaacggaaacgccgaaaccgcctaagaaggagcagcaacagcagcagcagaagtacgccaagacaaacgacttccaatggccgtcagaggcgcgacgaatgacggcggcggaagaaaagccgaaacaaaggggcaacgaaaaggaggagggggtcagttgagggaatcggagggggggggcaactcattagagagggagcggactcattagagagggacgggggttcatttgaagagacgtaattggaaaacagatgagcaattcgaacgggtggccaatttaatttatattttaaatatatgttatgtttttttccttcagctgttacaggaaagtgatcagagttcagcccctctctctgctgtccgaattgggactgatcagctgccgagctcctccgcttcttcggccttcgcccacgggactgatcaaaatcggaatgtccctttttctctgccgtcagtttcggttgctccttccatttgcagcgggtccaaaccaatgccgagccaaatcagcgacaaggcgatcagcagtttggaggtgggcaatggcaaagggatgctcgaaccattgattaa

SEQ ID NO: 73707 - DNA, 1066 bp, Heterodera glycines
  Genomic contig location: Contig_ID=SeqID_10494; Location=1160..2225; Strand=+
  SCN-specific regions: Sequence locations=1-125,164-181,208-288,310 -311,333-467,516-559,587-705,765-775,799-843,866-1066
atggtctattgtgagcctggtgatatgatgcaaggtgaagtgtatttgctcgctactcttatcgtggttatttttactttggctacaactgtaatttatattatcattggaattatgctgaagggtaaatttaattacataattaaaatacataaatttaaatgacaattttacaattcgttgtaaaaataataagttttcatttctcagtgattagaagtgatcagaacaacagcaacaattcttctcagtcccaaatcgaaatcactcgtcgcattttcaaatcgttggctgtgatcatggcagtgatcttttgcttttggtttttgtttgcactgatcgccaacattttggcacgaggactgatcaccagcgatccggcactgcaatttcttatcattcgattagtgacgcaattgcccttaatcgctcgagcgattaacgcacctgtgctttacttttgcaggtaaaaaaatgaaaaaattaattaaaaaatacaaatatatcatttaaaacttatatgtaatgatttttagaatggtaaagaattattttaagcttaacttctttttatttaaaatttattcaaattttcaaaagttcataatagcaaaaaagaaaatttattaatagagcttcgtttttgaggtacaaaaaatcgcgaaatcgacacataaaatgcctaaaaaatcgaaaaaggtagccattaattttagttttatttcatttgtaaataaaattatgaattattaaaaaaataatttcgaataaggacaaatttttaagccaaaaattttatcaagaaaaaaataatgattttgggaccattcttgagaaaattttcaatttttaaatccttgttaaataattaatattatttcattttcagttctgaatatcgtgaaataataaaaagtgaatttccatgggttaaatttttgctgtgttcaaacaatcataatcccccagtcgttgttgtatctgccgggccacaaattctcaattcttcgaacatacaacaaatgcatcataactgatgaattgtgaaaaattttaatttgtcata

SEQ ID NO: 73708 - DNA, 1363 bp, Heterodera glycines
  Genomic contig location: Contig_ID=SeqID_10494; Location=2683..4045; Strand=+
  SCN-specific regions: Sequence locations=1-245,275-1363
atgacaaaaatccataagaaatattgtgaagagattggaagagggcaaaatatagagaatacattaaataaaatggaaaatgaaacggaaaatttaatcaaaaatttgaaaaaagacccgaaattgcaagaaaaggttcaaaatatggttgaaatggagctgagcaagaaccgaaaactgaatgaaaaaattcaaaacgcaatggaacgcagaaaagttaattccttctacgatttgcttaacggtaaaatttaaatttttattaatttatttactctttttagccgcttttcaaacattttttggaaactgcaaaaactgttccatcatgccacaaaaagaactgtcaggaagaaggaaacgacggatggcaaaacatgaaatgggaaacacttcaaatacagcgaatgagcaaaataatttctctattgctggacaaaatttggtgactcaaccaacggatgtgcacaattcaaatgagacaggtctcgagctcgtcactcattcatctgatgacaatgaccatcaaaatggtggtacaaaccgagtttttttgaatgccgaactcccaccacaaaatcggaatttgtctccgactcgtcaaattttgccggaagatagagccacaccaactcaaactgttgaccatcatccagccaatgatcaccatgttgacataccacctgtagcacatgcaaatgttcatgaactgtccgctgagcagggacatggagccattccaattgctcaaccggcaagacaaaatcaagcggtgaatgagcaaatcagaggattacttaaccaaacttataacgcacgccaaggagatcgaatattcgtttgtaaatttagcaaatttattttttctttgataattggcctttgggtgatgttgtggatgagtatttttaaagaacagcttcagttcgatatttctctaagtggtccaatcgcttttttcatcctctatttgtttattttgctttcttttttcccttgcttgttttatcacgttgaggtacatcaaccaactcataaccaagatgtatgaagcaagaatcacgcaagcaacaacagatcagcttctcatgtttctctttaattatcttttttagtttttagatcatttcctttctattgctcacctcactataattgtaaatttatattggtaaacttatactgtcggtttatttctttgaaactattaacctttgagtaaaagaagctgtcaccttttttatgtgcaaaattgagagaaaaattatataacttaaaactgacaaattatgttcgaaagtaccgaccatcatgcttaaaactataactaaggattatgtatgggtttgacagacaaaattca

SEQ ID NO: 73709 - DNA, 708 bp, Heterodera glycines
  Genomic contig location: Contig_ID=SeqID_10495; Location=205..912; Strand=-
  SCN-specific regions: Sequence locations=1-187,251-521,543-546,605-708
atgcctgtgccgacagtgacgaagcggcactttgttaaatcaatgttattataaaaatgcaatttcctaaaattgttgggatattttttttcgaaaaattaaaagggatataaatttttattgcttttactttgtaaaatttgagtgtttcttttaaattttattccgcgttctttaaatggttgggttatttatttttttgtaattattaaaattaaaattaaatttataattataatttacttttaaagcgaagtttttcacggggataatccgctttcggagccggaatgtgcaaatttagccggctttatgcatcagcattcgccacaaattgatgcctatttgacgctgcattcgtaagtaatgtgctgatgcatggctgtaaccacagtttgataacggaatgggttcgtttgaaattaaaaaaattaatttgttattggtattaatttgaaagattttggcaatttatttctaattgaagcccaataatttgaattgaaaaaaaaataactttaaaaagtttccaaaaaatcctatttgaaaatttactattaatatttgcattaaatattcttatttaaaaatataatattttttacaattagcaaagagttggaaatgaaatggccaatgccatcgaaaaagcgggcggtgaacactttaaagttggctgtggtgatgaaattttatgtgcgtaattaa

SEQ ID NO: 73710 - DNA, 322 bp, Heterodera glycines
  Genomic contig location: Contig_ID=SeqID_10495; Location=1227..1548; Strand=-
  SCN-specific regions: Sequence locations=1-137,166-288
  Gene Ontology: Mol. function=carboxypeptidase activity; Cellular component=extracellular space; Biological process=histone acetylation
tttggcaaaagcgcaaagaatggccaaaagaagccaattatgttggtcgatgctggcattcacgctcgagaatggatagcaccagcagttgcactcaaattcattgacagtgtaattattgcgctattaattagtgcttaattaattattttaattaattaattacgttttttagcttgcaagcgacaataaatacaattcaattctcgaccaacttgatatttatgtgattccagctgtaaaccctgacggctatgagcacacttggacaagcgatcgtcagttttgttttaatatataaataattttttattttattaaa

SEQ ID NO: 73711 - DNA, 460 bp, Heterodera glycines
  Genomic contig location: Contig_ID=SeqID_10496; Location=153..612; Strand=-
  SCN-specific regions: Sequence locations=1-140,249-423
atgcacacacgttgcattcaaatgcggacatttttgccgattctgacagtgccaaaaaggtgagtgccgaaagagtcataaccaaatgaatcgaaagttttcgttcccgcccttattaaaatttacgaactttaaggaacttaaattttaatttgatatactattaaaatatatatattgaatttaaattttaatcaaaaatttggttatatttacttttaattattaaattattttataaaaaattaggaatgtaacaaaacacacaaataaatagtgtaattcattgtgagaattctaaattctaattaaataacaactaataatttaattttactaataaaggttctcgactttttggacaagaattggatttggcgcgacacaattgtggcaaattatggcgagtaagtttggaaacactattattaaaaaagtaatttaattatttataaataaa

SEQ ID NO: 73712 - DNA, 418 bp, Heterodera glycines
  Genomic contig location: Contig_ID=SeqID_10497; Location=137..554; Strand=-
  SCN-specific regions: Sequence locations=1-77,108-418
atgccgcgaccgggagtagtttgtgtacccggaaaagggcataaacaaattggccaaacaagtaattaaggacgaactaattaacaattaaaattataaatttttaagattttgcccgcccttcaaattttggcggaagaagtgagcaaaatgacatgatgaattcattaaattagagctgatgtgaaaagaaatacctaattatcagtgaaatatatataccctatataaaattgcacagactgtcaaaaggttgtgggtactgctcgcccatcccgtgcctatgaaggagtacagtctttgaagtagccgccccaaccccaaacctggtttaccgcaaaagaccaagccaataggaagggagtcctttgaaccaaaacctattcgactcccttatgaagttgccgccctaattaaa

SEQ ID NO: 73713 - DNA, 1794 bp, Heterodera glycines
  Genomic contig location: Contig_ID=SeqID_10497; Location=655..2448; Strand=+
  SCN-specific regions: Sequence locations=1-77,99-229,291-296,318 -569,678-854,939-1034,1067-1107,1129-1424,1473-1600,1646-1765
  Gene Ontology: Mol. function=carboxypeptidase activity; Cellular component=extracellular space; Biological process=proteolysis and peptidolysis
atggaatcacataaatatcaagttggtcgagatttgaatgtaatattgtcggttgcgagctaaaaaatataattacttgattaaactaattaattaaacagaatcaaaatcataggctttttccaacttttctggacttcttgcgatcagttcgtggtgagttgaagtgtcaaaagtatcgatgtgggtgatcagaagaggcgggggtcatttcagtacggaacaaatgattttaattaattaataattattttaaatatattatttttaaatatttttaaatattatttggaggcaaaaaatccatcaatatattttacccatttcgcgcaatcccaacgaatgactctcaagtgctggcattgcgtcatttcgcaaatttgatggagtcgtcaaacagtcgcaaaggcactgtccaattctggcaacatgcacacacgttgcattcaaatgcggacatttttgccgattctgacagtgccaaaaaggtgagtgccgaaagagtcataaccaaatgaatcgaaagttttcgttcccgcccttattaaaatttacgaactttaaggaacttaaattttaatttgatatactattaaaatatatatattgaatttaaattttaatcaaaaatttggttatatttacttttaattattaaattattttataaaaaattaggaatgtaacaaaacacacaaataaatagtgtaattcattgtgagaattctaaattctaattaaataacaactaataatttaattttactaataaaggttctcgactttttggacaagaattggatttggcgcgacataattgtgacaaattatggcgagtaagtttggacagacactattaattaaactaattaatttaattattttaaataattaaaaattgttgtaaaattaaaaaaaaataattagtaaattaaaatcgaccgcgagtgaactgatcgcaagaagcccagaaaagttggaaaaagcctctgattttgattcggataaatatcatcaatatgatacggtagccgtaatttattttaaattataaaattcattttttcagattgtctcatatttacgacttttggccgaaaataattctgactttatttcatttaattccatcggaaaatcgtatgaaggccgcgaaatttcgtatttaaaggtaaaaaaagatattttaattcgttattaataattttcttgggtctgtttccaagtccggcaaaatttttaagaaaaaactgaaaatttttaaaattgaagcaaattttattaatagattttattcaaaatttctccggcttcatctatttggacaactaactcaaatcgacttagacaaaagattaaaaaatcctcaaaagtatagaatatttaacaaaactctcatcacatcacaccaattttttcgccagaaataataaataaatttttaattaaaaattttaataataacaaaatttcagtttggcaaaagcgcaaagaatggccaaaagaagccaattatgttggtcgatgctggcattcacgctcgagaatggatagcaccagcagttgcactcaaattcattgacagtgtaattatagcgatattaattagtgcttaatcaattaatttttaattaattaattactttttttagcttgcaagcgacaataaatacaattcaattctcgaccaacttgacatttatgtgattccatctgtaaaccctgacggctatgagcacacttggacaagcgatcgtcagttttcttttaatatataaataattttttatttta

SEQ ID NO: 73714 - DNA, 160 bp, Heterodera glycines
  Genomic contig location: Contig_ID=SeqID_10498; Location=1776..1935; Strand=+
  SCN-specific regions: Sequence locations=1-160
atgatggacttcgggcattggaggattggcaaagcttttcagaaaaacgattccaacgcaaatgaacagtcggtggaaggacagcatcagaaagaaacaatgacagcacacgcgcgactgatcgaagatttggtgaaccggcgattttatgagccgacgg

SEQ ID NO: 73715 - DNA, 1518 bp, Heterodera glycines
  Genomic contig location: Contig_ID=SeqID_10499; Location=267..1784; Strand=-
  SCN-specific regions: Sequence locations=1-52,74-260,282-1477,1499 -1518
atgatcagagagaagaagcaagagaaggaggatcagagaatgatgaaaagcaaaaacaaagaacgaaataaaagacctaaagaacacatatgtaagcatacagatcagatcagagcacaaagagcaaaggatcactcaataaaagccccaaaatgagagcaaagattatgaccaaaatgcaaagtgcgcgcgaccaatggcggcactcagagaataaaacaagcagaagtgcccttcttaaagcgcagaacgcaaaaagataacacaaagaacaaaaccacggaaaaatcaaagagcaaagatcatgaccaaaactcaaagtgcgcgaaatgaatgaatcagagaacgaaattggagactcaaagtgcgcgatatttaagcacacaattcaaagaaccattaaagctcaaagattgctgatcgaaccaagccgggagcacaaagaacaaaaacattaagttaaagagcaaagatcatgaccaaaactcaaagtgccgtgaaaatttcactcccctcccctcttctgctgctcatttgtctgtgcccatttgtctgtgcccatttgtctgtcctcttttgtctgtactcacttcttcgcgccgaaagtcaaacgaaatgacggtccattcgtcgtcctcaacaaaattcttcatgttcactttgggccgtgtgtaatggtagtcaatggtggccatgtcgtgggtccaagaggaaataataaacgagcaattctatgggaaagggggagggggtaattaaagtgatcagaatgccagtcgaagtgatcactgatcaacgccaatttggccagcctgaccactgatcaccctcattaactgtcttctgccacctgctggtcgtaagggaagaaacgcctaaagcaattcaatttaaacgaatttgaaaattatttttaggagccccacggcctcttacacgttcattttgcagctcaacttgtaaatggcggggaacatcagctggatggcggcaccacgtccatcattctgtagtaaccaatttttaattaagtaccattaatatataattgtcctaggtatcatgtcatccctctctaccctcggtaactaattactccactaattatccccctcccttctccctcttccaattatggtaaattaattgaccgtcccccgtccttttattgagcatttttttttatactcaaacttcaaaaacaccccatcattaaaatgcaacttttcccattatacttttgtcattgtcccaattagtcccacatttttgtcattatccctttgttattatcataattggtccctttttccattatccctttgtcattgtcctctaattgcccccccccccttttctcccacccgccaatgtcccgtctcgacaatggcattcatcaccgcctcgctgttcttcttgtccatattgcccgagttgtaaagcaccgtgtccggaatccaaatgtcctttttttttgaaaaatgaacaaaaataattggccaaaatgcctaaaataaa

SEQ ID NO: 73716 - DNA, 2443 bp, Heterodera glycines
  Genomic contig location: Contig_ID=SeqID_10499; Location=207..2649; Strand=+
  SCN-specific regions: Sequence locations=1-80,102-1297,1319-1505,1527- 1604,1627-2443
  Gene Ontology: Mol. function=acetylcholine receptor activity; Cellular component=nicotinic acetylcholine-gated receptor-channel complex; Biological process=synaptic transmission
aatatgagcttctcaacagaaccattgtgccatacgaagtctgctctttgacttttagcatttattttaggcattttggccaattatttttgttcatttttcaaaaaaaaaggacatttggattccggacacggtgctttacaactcgggcaatatggacaagaagaacagcgaggcggtgatgaatgccattgtcgagacgggacattggcgggtgggagaaaagggggggggggcaattagaggacaatgacaaagggataatggaaaaagggaccaattatgataataacaaagggataatgacaaaaatgtgggactaattgggacaatgacaaaagtataatgggaaaagttgcattttaatgatggggtgtttttgaagtttgagtataaaaaaaaatgctcaataaaaggacgggggacggtcaattaatttaccataattggaagagggagaagggagggggataattagtggagtaattagttaccgagggtagagagggatgacatgatacctaggacaattatatattaatggtacttaattaaaaattggttactacagaatgatggacgtggtgccgccatccagctgatgttccccgccatttacaagttgagctgcaaaatgaacgtgtaagaggccgtggggctcctaaaaataattttcaaattcgtttaaattgaattgctttaggcgtttcttcccttacgaccagcaggtggcagaagacagttaatgagggtgatcagtggtcaggctggccaaattggcgttgatcagtgatcacttcgactggcattctgatcactttaattaccccctccccctttcccatagaattgctcgtttattatttcctcttggacccacgacatggccaccattgactaccattacacacggcccaaagtgaacatgaagaattttgttgaggacgacgaatggaccgtcatttcgtttgactttcggcgcgaagaagtgagtacagacaaaagaggacagacaaatgggcacagacaaatgggcacagacaaatgagcagcagaagaggggaggggagtgaaattttcacggcactttgagttttggtcatgatctttgctctttaacttaatgtttttgttctttgtgctcccggcttggttcgatcagcaatctttgagctttaatggttctttgaattgtgtgcttaaatatcgcgcactttgagtctccaatttcgttctctgattcattcatttcgcgcactttgagttttggtcatgatctttgctctttgatttttccgtggttttgttctttgtgttatctttttgcgttctgcgctttaagaagggcacttctgcttgttttattctctgagtgccgccattggtcgcgcgcactttgcattttggtcataatctttgctctcattttggggcttttattgagtgatcctttgctctttgtgctctgatctgatctgtatgcttacatatgtgttctttaggtcttttatttcgttctttgtttttgcttttcatcattctctgatcctccttctcttgcttcttctctctgatcatttctttgatcttttgcgcctttctccagtgatttgtccattttcattttgttgttttatctccattcaatacaatgctcatttgtcaatgcttttccaattccacttgaatacatataatttccccgttttgttcattagttaaaattcaaatgctgcgcgaggccctgggccatgctttacgcccatttggtgatccgccgtaagccgttgtattacattgtcaatttggtggtgcccacttcgatcatcactgtggtggcggtgatcggctttttcacgccatcctcaagcacttcggaacgggacgagaagctgtatttgggcatcaacacggtcagtggcattgtgccatcctctgagagaaaagcccccccccaaaaaaaaagaaagtgtctttattttgccaaagttccatctgctggaaaacatcctgactttcaaggataaattgttgggaatatggcctttttccaaggacatctttgaactcaattaacggtctcgagtctcggttctctccgttcagttgctgaccatggtctctgatgcttctgatggtgaccaaccaaatgccgaacacttccaattacgtgcctttgatgggatggtcagtttgtctcctctcctccgtatttcagcagaatgaatccatccatccaaaaaaggtattacatgggcatcattttcgtcatcgttttcggcaccattcttgccaccgttgtgcttttcattcactctagaaaggcgcgccttcagccactccctcgcccattgctcaaggcaagttgagcaaaaaaaaaatgtttttaactgtattttttagagagatttaaatcagaaaaatatttaaaatgccttttttg

SEQ ID NO: 73717 - DNA, 969 bp, Heterodera glycines
  Genomic contig location: Contig_ID=SeqID_129; Location=1308..2276; Strand=-
  SCN-specific regions: Sequence locations=1-717,739-937
  Gene Ontology: Cellular component=cytoplasm; Biological process =regulation of translational termination
atgaccaacattggcgagattctgacgtacgccggctcgtccttcaagcacggtgagtgagcaaaagcctgatcatccatccatcatctgtgaatttgcgccccttttcagtgatcaactgcaacatcatggtggccgacatgagcgacttccaggcggtcaacgagacgatcaagaacttcttcaccgaggacacgtaccctgcgcgcagcttcttccaagtggtcaagttgccgaagagcgcgtacgtcatgatcgacgtggtggcgatcgttcagggccagagctgagctgaagaaccggagaacgagcgcggcagacgaataacagagatgtacataaacctgtctattgtatatttgcgtgatcaacgttcatatcgatgtattgttcttttctgatcactgctatgtgtatatattgtatgtttgctgtgttgcgccgaccggataaataattggaagtgatttttcttttctagtgaaaatccatcccaccccaaaacatgcataattagcccgtcacatgtggattaggggagacaaaatctgcatttggtgtcaaaaatgagcattttagaaaattgtcgccgaaactttgaaaatttgagtgcaaattgttaaagaaattttcaccaaaaatgatttgttattttgagccaatttttattaaaaaataagttttggtggcccgacggtgtgccgacatccgcgccttgggaaaaattggaatttctaaacagattatcactggaaattggcaatttttaggtcaattacgttctatgaaattcagcatctcaagaaaaaatcatcatctctgtcttgaaatcagtagggatgggaatttaagtcaaatggcttttttacatttcgacaatgaccgtttcgccaatgaccgtttcgacaatgaccatttacgactatatcatatcgccaaaatttaaaatatcaaattaaatataataaa

SEQ ID NO: 73718 - DNA, 72 bp, Heterodera glycines
  Genomic contig location: Contig_ID=SeqID_129; Location=5180..5251; Strand=-
  SCN-specific regions: Sequence locations=1-72
tccaagtggggaattgaactcaggcgaaaaattatgaaaggtagaaagtttaaccactacaccacatgtgca

SEQ ID NO: 73719 - DNA, 498 bp, Heterodera glycines
  Genomic contig location: Contig_ID=SeqID_130; Location=328..825; Strand=-
  SCN-specific regions: Sequence locations=1-79,103-142,177-316,352 -468,490-498
atgtcgtcaaaacccgaaactttggtggagcggatgaagcatttgttgagctcgggcgatgacgcggacgttctctttttggtgggggaaggagagggaaaggaggcgagttttaaggggaaattgttacaaatttaaatgcttaattaattttaaattaattttaatttaatattgttttctttaagcatgtgcccgcgcacagagcgattctgaattcggcttcggacgtttttgaagcgatgttccgttttgacaccacaaaaaatgcgactgacaatgaatcagcgggtggagaaggtgtaaaaaaaacaacaaaaaattttgtatttaaaaaaaaaaaattaatttgaagcgaagggtcccgtagaagtcactgacatcgatgcgcatgtgttcaaagtgatgctcaacttcatttatgcggatgatttgagtgaattgaatggagacaacgcaatggcagtgctttacacgggtcagaaaattagtttttaa

SEQ ID NO: 73720 - DNA, 3926 bp, Heterodera glycines
  Genomic contig location: Contig_ID=SeqID_1466; Location=446..4371; Strand=+
  SCN-specific regions: Sequence locations=1-261,335-1283,1305 -1807,1887-1977,2002-2175,2197-2756,2850-2997,3020-3052,3075 -3285,3310-3350,3409-3481,3520-3701,3724-3926
  Gene Ontology: Mol. function=thyroid hormone receptor activity; Cellular component=nucleus; Biological process=signal transduction
atgccaacttcttcctctgcccacggcaccgccgccggcttctgtgccgtcccgtcccccttctgctccgcctcgtcctcgccctaccaaatccgtgacaccgccacttccgctggtactgcagctataccacacctgcaccaaggccaggacggcgaagtgatgtgtgccgtgtgcggcgacgggccggcaaagctgcactacggcgtgttggcatgctacgggtgcaaggcatgtgccgtaattggtggatggaggggcaaattttagtttaaatttttaaattgaaattagaattatgttgaattattcataattaaaattttcttaatttctattcgctaattgccaaaacttgttggtgtttctatttttttaaatttaaatgattgacatattcgccaaatggattcaaaatgtttcaattcaaattaacatttatctatccgatcatatcactgatttaaaaaaaataattagcttgaggaatattctttatattggcccattaaggggaattagttccaaatccaataagctgaccctttttatgtcccaatgcttttcaagggcttcttccgacgcacattgagtggaaaataccattgtaagcgcatttaaaattactgcttaaatcaccttttcaaaatttagatgtctgtcgcttcgacaacgattgcattgttgacaaatgtgagttataaacgatgatgactcatcgcaaatgcaaaaaattgagccaaatttaatcccaagactctcgcaaagacagcattttctggccaaattcgatgaccaattttgacggtgccattttcagtccagcggaacagttgccgatgttgccgtttcaagcggtgcctcgaggtcggcatggacccgaaagcggtacggcctgatcgcgacctgaccggcaaacagcgcgtgccacgaattcgcaaacgagcactagacgaggagctgatcaatcatatggtaatgatccagaacctgggcttcgagagtggtgcattcgattctttggtgcacgagagtgagaatatttcccgagactcggaaccccgaaaaatccaagcctctcgagaccgtcggccatcaataaggtgttccctccggctcaggttcgtctccagggcaatgattggtcccgcaaaatcccggtggaagcccgggtgcttctgatgcaactgctgaacatcgagtccaaagttgccaaaggggacagtgccatggaccgtcggctcaacaccggcgttggcggtatcactcaatcgacggcggcacaacaacaaaatcaacaccaaaatcagcccccgttaccatacgaaccgtcgacagcaacggcatacaatggtggcaaagagacgacaacaagacaacaacagagggaactgtccctgagggaactgttcgagcagaagccgtcgctgaacacacgcagaacggaggtgtgccgatttgggaagggaagaaggaaacatgaagaagcgatggtggatggacaattgcggcgccaagtcaaagcgacactgcggcgcccgacattttcggcaccgatattttatggcgcccccataaataatgcgctaaaccttttaattaacatccttttgctgcgccgcaagtgtcagcaccgcaagcaaatgtcgcatcaccaattggagagggtcccgttattaagtgccgatcgaacccattctttgggcgagagtcggatcattaactaaattaacggctcactgtcttcatcagtgagttattctttcagctggcaatttctgatccgacatgtaactggccagatcactgatttgatttgatttgatttgatttgatttgatttgatttgatttgatttgatttgatttgatttgatttgatttgatcactcttccctcggacctctctgtagctcaatggaagagttgcccattgtattgggggagtcgtgggttcgattcccaaccgaggcctaacattttaccataattattttggaatattttttttatccattctctctctgtacagatgtgctatgagccgtaccgaatggcacaggcggaagaattgccaaaaattgcgcatcgcggtgccatcgcttcggtggattgggtggagtcgttggccgaactgctcgacactgtgcttctggacacgcaagacaaagttgaaaatttaagaaaagccttttttaatttgaattttgtggcagatttcgctggtcaaagcgtgctatgcgccgttgaccattttcaacttttcggcacggactgcgcaaaacacgcgcaacccggacattctgtgcctgtgctcctattcgtatgtgccgcgtaaattgccgcccgattttaacgggtcaaagtgagtgcaattggcataattagcatttgttttgtcataaattgatcattagaaattaattggaagtttatccattatccgaattttttaataatttcccgacttatgccattagtatttcgacatttatgattgatttaccatttttaatggcgatgttagatttattagagtgcgatattctgaaaaatttatggacagaattcgggaaactcggacaattttcaaaaatgctccaatcgggatactgtgaaaattctgccaaaactagagtgcagcgggaccgggaatttttggcaaaaccgggactgggactttgccgggacctgagaagccgggaccgggacctcgatttttcttcgggacgggaccgggaaccgggaccaaccgggaaattttaaaaattcaaaaaaatttaattttaatttatttcaagtgaaaataatacaaaattaaatttttattttgttttttatttaataaaaccccaaagttaaagctaaattaaattaagaaaaattttcaaatcaaattttcttcatttctttcaaacaattaatcattttttgactcaaatgatcgaatattattagaaattcagatttacgtttcacataaattttttcggcgcgctttttccaaaaaacttttggggaagaaaggggtccggcggtgccgttaggcgccgccgggggaaattttgaaaatttgagtgtaatttgttaacagattttcaacaaaaaaggctggttttcgggattaataggctcaacaatttgtacggattttcatttaaaaaaatgataaaaatgtgacaattaaaataaaactatgagtaatcatattttgtcgataggaaacacatgagtatacaaaaagaatattccaaatatgttagtttctgtagagggattgaaccaggggaaagaagaagggaaagtcaaggagactagccactaggccatccgcacaattgtcgtcgatacttttaaagaatatattaatatatttttaaaattttttccttttaactccaattatcttcactaatttttcactcagacccccattcttaccagtgcttgtttttcccggttgccctaccccgggacctcgaatgaccgggaattcccggcccggtcccggtcccgctgcactctagccaaaacccgtcctgttccggatttataagtaccaatctttggcatttgttagcattgatggtctaaattcattttggcattgtgccaaatcacgtttccctttttcagccacctgtccaacaatctgatcgatcgaacactgaacgaattggtcggcccattgcgcaggctggccctccgggaggaggaggtggtgccgctgaaggccatcatcatcctggacccgaacacgcgcaacttgtcgcccgaggcgcaacgtggcgtggccgaactgcgcgaccgtgtgcaggacatgctgttccacgtggtcaaggagttgcacccggtgcacaacgcagcccaacgcttcggcaatctgttgttgctgttgccaacaatttcggtgccaaaatcgaataa

SEQ ID NO: 73721 - DNA, 956 bp, Heterodera glycines
  Genomic contig location: Contig_ID=SeqID_1466; Location=7653..8608; Strand=-
  SCN-specific regions: Sequence locations=1-216,260-662,712-714,738 -816,838-956
atgcagaataaaatgaacacggactttgaacaaatactcactttgctccgcggccaatccacaacaatgacagacaatcgtggtaacgattaatgacgcatatgtgatttcgcttccgatttttttcgggtcccgaattctggctttcagaaatttttattcaaatgcctgaatttcttaaattttttcatctttgtcccactctggtgccgtgccatatttaataattaaattttatctttttaaaaatattatattacgaaaacccaaaatattaaaatcacaacatcaaacagttgttcatgacgacagcagaagcagcaatacgaaaagtggtgatgttcatcaccagcagcaaaatcagcgtgtccatgggaatggcggcggaggcgaacagcaacaacagcgacgacaagcgcaagcagtaccaccaccagcaacacaaacaacagtagcgggcccaccgttgttgcagcattttgcgtcaccgtacagctgcaatttgatgatgccattgtcgtccagcgccaatcacccggcacaattgcaaagttcgtcaagcagcagcaacaataacggcaaccgcaacttgggtagcaacaacgaagcggacgaggagggcgacggcgcagaacaaagaccacgacggcatgatatcgcggaacaacagcagcaacggcacagcaacgaaagtgccaacaacaacaacaagccgtcatcgtcatcatcgtctgccgatggcactggtgatcgccgtcgtctgccgatcactttttcgcccgattctgctgacacaattctgtgaattataatattttgttgttgttgttgttgttgaaatgtcgatgatcaaccaatcatcaatgttttgatcaatcagtcaaaaaataagctgaaattaatgggacaaaatgttcgcgctttaaaaatggcactaattatttatggacattaaa

SEQ ID NO: 73722 - DNA, 1984 bp, Heterodera glycines
  Genomic contig location: Contig_ID=SeqID_1467; Location=1..1984; Strand=-
  SCN-specific regions: Sequence locations=1-96,157-282,304-330,382 -545,587-843,865-880,902-1067,1109-1236,1276-1984
  Gene Ontology: Mol. function=delayed rectifier potassium channel activity; Cellular component=voltage-gated potassium channel complex; Biological process=two-component signal transduction system (phosphorelay)
tttcattttcagtcgcctacgtgaattcatccgtttctaccaaatcccaaatccgttgcgccagcgattggaggagtatttccaacatgcatggtcattgattgattcagtgattaattaattaattaattaatatatttatattgattgattaatagcctatagtaaagttctcaaaattcttttaagtgactatttcgataatcccatcaaaatttttaatttaatctgcttttcgggtagagcagaaaaaattcgggcatttttttttgttatttatagtttaaaaataccttccctttcagatataattttccaaattaaattgtcttttatattttatttttagccaatttttaaaaattcaaaaataattaatttgtcctaattattgttaggtcgtacacaaatggcatcgacatgaacacagttttgaagggctttcctgattgtcttcaggcggacatttgtctccgtaattattttactattttatctctcattaatattttctcgaaaaattaaagtcacaatttctcaagcgcaaaatttaaattaaaataaattaaaatttttaaattattatcttttcactaattcaattacttttgctcagatttaaaccgtaatttgctgaactgttgcccggcatttgcaaattgttcgcccgggtgcctgcgggcattgtcaattcgcttcaggtaaacaaattaatccattaattaaccattaaaaaatgtttaggacaacacacgcgcctccggtgattttttaaaccgattaatttaaattaatgaattcaaaacattttagggcgacactttagtccatcggtaaatttattaaatattcatattcatcaatatctctcctcggaatgatttattgacaaatatttatttaaattttggttttagcggtgacattttggcacggctttattttattgctcgtggctctgttgaaattgtaaaagatgatttggtcgttggtatttgtggtgggtgaaatatgttcttttcaaaattctaacttactaaaattttttattatcactcattcgaatgaataatttaaaattaaattttggcaaattttattttttaatgcctaaggaaaggacgatgtgtttggcgaaaacccactcatttatgaagaggttggcaaggcgaactgttccgtccgggcgttgacttactgcgatttgcatgtgattttgcgggacgatttgctcggtaaaattttaatttagtttttaatcttttatatttttttcaagatgttggcgatatgtatcccgaattcgccgaaaatttttgcatcaatttggtgatcaattacaaattgcgcgacgaaacgctgacaaagcggcgacggccgacatttgagcgccaaaagttgcagcgagtttcctcaaattcggcgcgcgaacagaacgaaggtcggcaccgctactcgataggagactcgagatcggtcattccgaggccctctctgaaatcgagactcagatccaagacaatctcgaaatagaaactcgagatcaatcatcccaaaacgttactgaactcgagactcgaaaccgagatgacttcgagacagagactcgagatcgattgtctcgagacctctccgaagtcgaaactcgaatccgagtctcgagttccaaaaaactgagccttttcttgagtcggaacttgaaacctaaacttccttcattcagatgtccgcgcattttcctcctcattcgccgcacaaaaccatttgtcggcagcgaccgcggtcggcgcctatgaaagtgttcggcgcagtctgaacggcatttcgcgaacggacagtgccggcaacggtccgacaactgcactggaacaaagtcatcaaacaaccaatgctgcaatttttgaaaaacacaattctcgaataaatcctcacttttcggcaacaatttttaggattcgggactcttgacctctttttaatgctt

SEQ ID NO: 73723 - DNA, 1838 bp, Heterodera glycines
  Genomic contig location: Contig_ID=SeqID_1468; Location=1..1838; Strand=-
  SCN-specific regions: Sequence locations=1-31,68-177,210-261,287 -491,520-649,679-702,729-870,905-976,999-1365,1396-1411,1434 -1709,1739-1838
  Gene Ontology: Mol. function=voltage-gated potassium channel activity; Cellular component=integral to membrane; Biological process=two-component signal transduction system (phosphorelay)
aatttaattaagacattactttgttaaaggcaaattaatatttattttttaattaaataaataatttccaaattttccaatttattattcttcggtgtattttgagtctgcttaaaaggcactaattttgccattttcagatgattgcagctgtgccatttggtgagtgttttggccataattttcattattattttaaaattttttaacagatttgttacttgttgaaaccgacagtgatgaggtgtcaattttttaacttctaaattaaattgtaaaaaagagatatcatagttcactaacaaataagggccaaaattggtcacaaataaaattaatcagcaaaaagtgatcagagccggggactgatcagcggaaatgtttataaactcttttttatcgtccccaatttagacgacaactttaattggactcttaaaaactgctcgccttcttcgcttagtccgggtaaacaaaacaaattataatccataaaataaaattttaaaattttttaaaggtggcacgaaaattggacagatactccgaatatggagctgcagtgagtgacaacatcaaattaaatgaaatttggttaatttattttcctcccattcaacaggtgttacttttattggtaaagttggcattatttgtttaaataatttttaaaagttggttagccaaaatattttaaaattcataaaaccatatttattaaatgcctaatttcggaaagtataaattggttaaatgatatactgtttgtgatcgatcacagatggccttattttgtctgattgctcattggctcgcgtgcatttggtacgccattgggtcggctgaactgcttcacaaagtgataaatcgaaaataaattttaaaatttaattaattatttattggttcagaataatatcacatggcttcatcaggtgagaaaatagtgacatcatttggagtaaaaatgatcagcaattaattaattcattcattgtacagcttgcgcggcacctgaatgaaccatatcggcaaaatgggtccttaacgaacggcggtccgtcatgtgagtgttgaacgggtcgagaattatgtcgagaatcaaattttgacaatttttttttaccagcgttaaaagcctaattaattctgttataagccttaattttcgagggcaaatcctttctttcgggtggcattaattcgaaagtttttttggcaacaaattcctttgatcagatactctaataattttatcatttaaactattttttgatcacataattcggtcaaaccattgtcaaatcagctgatcactgattcactttttttggaatacccggagcattgcctgattttgacaggcctttgccaattttatgggtttgcatttaatttaattggattgccataaaaagcccgaccaaaatttggcaaaatttaaatttgatttcgcgtttttttcctctttatcataagcattttttgtgtcaattttgcagtgaaatcgcgttacgtgacctcactttacttcactctgagcacaatcacttccattggctttggcaatgtcagcgcaacgaccgattccgagaaaatattcaccataataatgatgatctgcggaaggtgatcggacggacggacgggcgatggtggcaaattaattccattttcagcttaatgtacgcttcggtgttcggaaacggtattaattttcatttttaataattaatttggctaataatgtcgtggtattaattacaaaaaatattacagtctctgccatcattcaacggttatattcgggaacggcacggtatcacaccgaaatgagg

SEQ ID NO: 73724 - DNA, 519 bp, Heterodera glycines
  Genomic contig location: Contig_ID=SeqID_1469; Location=103..621; Strand=-
  SCN-specific regions: Sequence locations=1-102,150-496
atgagccaaaacgtaataatggcatttgcttatcgaattatctcatatttccttcctttaattcaggttctgtcgcttggcgcagacgtgctacctgaggtgaataattaattaattaatattagctaaaaattatatttttttaattacctaattaggtatgtctataattttccattttcagtacaaacttcagccaagtcgattgaatcattgcacgtaagtgtggtactactgattagagttgatgtcatttggcatattcctttatccctgtaaccgtagtccgtaattagggtaattatgcatttccaaaatcactcatttaattgccattttgtgaatccctgcgccatgcccatagtgccataattaatctgtaatttttgcgtcatttatatgcctaaaaatgcaaaacatttgtttttttttttgttgcttataatgcatccatttatttattttgcagaatcatccactactccccattcaaaggtaattaatattttttaaattaaa

SEQ ID NO: 73725 - DNA, 651 bp, Heterodera glycines
  Genomic contig location: Contig_ID=SeqID_10501; Location=1089..1739; Strand=-
  SCN-specific regions: Sequence locations=1-20,43-389,412-541,563-651
atgcctcctggcacagtgccgatgatgatgatgatgatgatgctctgtaggaaccatttaaaatgccggtccgtctgcgaacggtcgcacttcgttctccgcacgaatcgcaccggaccgattcactgggctctcgacctttgcaaaaacgtgagaatttataaaaaagaaaagaaaaatcggggcaatttttgtatgggttcaaatggagggaagagaaacaatgaaatgtatgcactatttctatttgtctctttcttttccgttgtctatttcacttttctatgtcttcttttttccaatgtgatcaactgtgttttattgttttggtcaaaaattgagctcacttcattaattaatgaattattaattaacaattagtcaaagtcatacatttttcttcatcttttgccaaactctgttttggtactttttcccggaattcgggtcgacaaatttctcggattttccggcatccgaccctcgggatcaattctcggttttcgatcataaaaaattcgagcctagaaatcattatcaactgatccttatttattttaatattgacaaatttgtgtctgatatttttatgaaaaattgccgatcagaatttatctaattttttttatttcaaattccgttggtaataaa

SEQ ID NO: 73726 - DNA, 1259 bp, Heterodera glycines
  Genomic contig location: Contig_ID=SeqID_10502; Location=145..1403; Strand=-
  SCN-specific regions: Sequence locations=1-128,177-179,228-397,426 -485,508-1067,1089-1102,1124-1125,1148-1184
atgcctgttaatgatgtcgtgtttagcgatgcgtccgccgtttcagtgggtgtatgtgccatcgtcggcccaagaaaaaccgaagcgaaaagcagaaaaacaattttaaaaatcatgctaaacaacagaataattttattgtttttttgagaattaattattttttaaattaatttgtaaatgaaaacaagaaaaaacaaatttgtttctaaaagatatgtttttcaattttcaaattaatatgtggttttatttaaaaaagcataacaatttaagtaataaagcaattttaatcaaactttgccagattaacaatttatgatcactcacagaaaaaacaaaaatatccgaatatgccatgagataaccaacaaaaagcccttacaatatttgccataattggtttatttatttttactgaatctcggaactttaattgattcaagaaatttcaaaaaatcgcagattttgcatgcgtgcgtaatcacttggccataactttgtgaagtcaatgggaaaaacataatcaattagaaaaagctgggcctaatataatggaattatccggcaaatttttttaattcaaattgctttattaaacttgaatttttatgatttttaaaattaaattgtttgccactttgaaagacgaaaaaattgctccgctgtacattagtaaattgtattttttatttttccagcacaaatggctcaacccacccaaaatgttcaccatcataattaaactcaagaagggaccggtccaaaaggccaacgtttaattttttgcgcaaatttgtcatttaatttttttgccaaaaattttttttaatttgctgcctcaaggtatcaaataaggtgacacattttgctaattaatgaagtaattaggcgaattaatgtgcgggatgctaaattgattgttataacggggaagtgcatgaataattatgcagttgttttttgattaattgctttggcgcacttttttgtcctttttattataagccaaatttgttttacgtattaatgatcattaaatactgcgaacaatgaatgaatcaacaaattgacaaattcatttttattatgcataattgcgaaataattaaaattaaaaaaacatttaacaattaggacacatttttggtaggaaatcggcttattaattatggcgcgttgtgtaaaatacatttaaaaatatgcataattaagaaattaaaattatttatagaaaaatatttatcaattaaaataaa

SEQ ID NO: 73727 - DNA, 254 bp, Heterodera glycines
  Genomic contig location: Contig_ID=SeqID_10503; Location=582..835; Strand=+
  SCN-specific regions: Sequence locations=1-108,146-254
aaacgctgtgaacatgtcaattgcattgagcagaagccaaaggcattggcattacgtgccacgcttggtgaagtcgaggcggcatcactcaaattgggagagtaagcgaatatatatatttgtttagttttaaatttaatttaaacagaccggacatgccaatgaatgagattgaccgtgccgtggaagtacgtcttgagcgagtgcaggaggtcaaaaagtcgatgctcaaggaagccggactggaaacagac

SEQ ID NO: 73728 - DNA, 535 bp, Heterodera glycines
  Genomic contig location: Contig_ID=SeqID_10504; Location=121..655; Strand=+
  SCN-specific regions: Sequence locations=1-46,68-420,442-535
  Gene Ontology: Mol. function=ceramide glucosyltransferase activity; Cellular component=cytoplasm; Biological process=glucosylceramide biosynthesis
atacccgctcattctgatcagtgatcaggggattttcatgcagaaacaggcactgagggacatggtgtgcaccatgcgtgaacgcccggacatcgctttggtcactcagccgccgtattgtcgggacaggggcggcacctttggcgccgctttggagcaggtgatcgacagtcagtgtcctacacaattgggaactcaactttcccacattttggaggtgtattttggtggtgctcattctcgcatttatttggccagccacgcctttggcttcgtttgttccacggggatgagtgcgttgatggtcaaagacattgtggagcagtgcggcggtttcagacagttcggtgcctacttggcagaagattactttcttggccaggcctttgtcaaagggttggcgcttcaattacaaatgcttttcttttaggccattcttcattttcagtggcttccgcaatgtcatttctcatctgcccgcacttcaaaacacagccaggcccaccgttcgttctttccatgaacgcatttgtcg

SEQ ID NO: 73729 - DNA, 110 bp, Heterodera glycines
  Genomic contig location: Contig_ID=SeqID_10505; Location=1091..1200; Strand=-
  SCN-specific regions: Sequence locations=1-110
atgaaatcgtttattctcgttgttcttttctcatttctcttcatggctttaatgatgccacttgtcagttcagaggaatcggaaacaaaaatgaaatcgccgattagtgg

SEQ ID NO: 73730 - DNA, 168 bp, Heterodera glycines
  Genomic contig location: Contig_ID=SeqID_10506; Location=795..962; Strand=+
  SCN-specific regions: Sequence locations=1-168
acacccgtgtctcctatatttacgtgttcgagccggacaccgttttggagcgcggcattcgtccggcattcatttcaaatgcggcacgctttccggacgtgcgcgaggggtaccattttcgtccgccgttgggatggatgaacgacccgaatgggttcagcaaatttg

SEQ ID NO: 73731 - DNA, 1066 bp, Heterodera glycines
  misc_feature (1055)..(1055): n is a, c, g, or t
  Genomic contig location: Contig_ID=SeqID_10507; Location=1..1066; Strand=-
  SCN-specific regions: Sequence locations=1-114,261-282,306-502,524 -553,577-610,643-679,701-835,908-960,982-1003
atgaaattgggcctaatattccatttaattgtgcttttaatcgtcttaattaatattaattatgtcggtgcagaaaagaaaaaattgcaacaaaaaacatttgatgaaatatttggagaaaaatgggaagagaaagaagaaaaacaactaaatgagcagaataaaagagaaataattcaaaaatattataaaataaaagagaaaataaagcaaaaagaaggaaaatattcaacaaaagaatggaataaaataaattcaaaaatagcgaagaagttgggcacaaatagtaattatatttataaatggattaaagaattagggcttaatcaagaaatacaaagaagtcacaaatcaaaaactgatgaagaaaaaattgaaattgttcaaaaatttattgcaataaaaatgaatacaaacaaaaaagaaaatattcatcgaaagaatggaaacaaaattatgccgaaatttgtaagaaaattggagttaactatggaacaatttgcaattggaagaaacaatttggaaaagatgaaataatggaagattaattaggaaaaatttaaatttttttaaaaagctatgtatgatgatggattttaattgattccaaaaaattaatgtattttttaaatgtaaaaattccaatgtccaaaattttctaatcgtcgattatatccaattttcaaatttttcttttacaccgataaaattgcgttaatttgacaccagccatccgggttatgccgaatgggtatgtatttccgataaatttactcacattttacaatttataaatcggttttttagaaggttttaactagaaaatattttgccgtattttttcaattatatttattaataataataataattttttgttatttttttgaaattaatattttattttccgaacaacaaaaaccaaaaaaaaaatcttgaatgtagtaatttttgtgataatgtcatttttatgagaattttttaatccaggaaaaaacgccccaatttatataaaaatttaaaatatttaatttttgcaaaaatataataattcntttaaaataaa

SEQ ID NO: 73732 - DNA, 1148 bp, Heterodera glycines
  Genomic contig location: Contig_ID=SeqID_10507; Location=1300..2447; Strand=-
  SCN-specific regions: Sequence locations=1-482,505-779,822-963,1069 -1148
atggattccaaacctcaggagcatattccaataacggtctaacataagttttgtacaaaataatccaaatcctagaagattttgatttaataacccgaaataaagaacgcatacgtaaatatgcattctttattatttgtgcgacatgattggaaaattgcaatttattatcaatatttatgcctaaatccctaattgtatccacaacatttattatatttccatcaattttatatatttctttggggtttttatttgagatttttgaaaaaaatcggaaattttcggaaattctttttttgaatttttgctaaattacaaaatggtttattttaaatttcgaaatagttaatttaggtatgtaatttggactcccaaataaaaaccaaaagtgcgccgcaaaaaaagtggtgtaaaagaccttccaaaaaaacgtactaaaacaatgtaaattgatatgaaaaaaaaaattctgttgcactaaataattttccaaaaaatttttggttcctcggaatgccatccctggtttacggtaaatttcgttacggtataatttgggtgacacaccaatgtcctcccacagcaagcataatcaggcattaaaataaataccattcaatgagtccgtgtagtacacattcattttgggccgtcccgaaacggcatcaatcaccaccaccgcagagccggaataaatgccgccgatgccatcatgctcaagtgccactgcggggtcgggcagcaaaaagattggctgatgcacccaattgatctttaaaaatgccatgtattttacataaatgccctaattaaaagaccaaatcaacgaattggcaattttttttcattattaaaaaaactttaaagaagttgaaatctggtccagctcaatcccattcccagttcaaaaaaatgggaaaaattagtaaatgactggacaataataaaaaaagcaaaaagaattaaaaattaataatattttacataattataatttctttttaattatttttaatttttcagaattttaaataaaggaaatgtttttaattttatcataattttcataaacttaattcattttccataaaaataatgcaaaataacgaaaatattaacgaaagatatgttgtgacgctaataaa

SEQ ID NO: 73733 - DNA, 2845 bp, Heterodera glycines
  Genomic contig location: Contig_ID=SeqID_10508; Location=827..3671; Strand=+
  SCN-specific regions: Sequence locations=1-8,30-230,286-398,436 -725,749-821,843-865,887-1017,1039-1509,1532-1532,1562-1839,1892 -2263,2286-2466,2488-2491,2514-2622,2644-2845
atgctccaaaagtgtcactttttggctgatcaaagcgacagaaatgcgtcggatgatcgccgtagtgagtgcattttcagcatttgtggttcccatttcattttgcgcatttttaaagcattccttttggtcaaacttttgttcatccaaagactgtcgtccgaaaaccgtggctcacaaagggaattggtggaacaactgtttggtcggtaaaatgtgttcattttggcatttaaataaacaaaaaatataaaataaatatgcaatttttgatttaaaaatttaggttctccattttcgttacaccaagaagtgatccgagcgtaccatgatcggccatccacttttatggacttgaaaattttgtaagttttccattttttaagttattttcgaaattggccaatttaattggaaaatgatgacaattttcagcctccatttgctcactgctgatgaacaacgggctttgcttgacttcatttcctcaattttggtaccaattctttttcgcgctaatcggttggatcccatttgggctttccccatgcatttgttgggtactttacgtgaccctcttctggaagttttcaaaaaacagaaattccaaaaaatttttagagaatttttgtttattttttagactaacaataaattttagcagaattttttttcaaaatgctaattactgggtcgagaaaggatttgcatccgcttcatttgccaccaattatttgcccatttttccgccagaatgaccctaatgttggtgttcatcctgcgcttgttgaccattgttttgcttcttcctccgatgaatccgctgctgctcccttttccgtttggacttttctgttggccgaaatgatctcttccttttgcttccaaccgcacactttgtccgaccaatccctgaagggtctgtctgtgtttgaccgatcatttagcattcatccgttcatgccatttctttttgccactgacgggacggactatcccatgaaaatgcgaaaaaaacattttttagaatttttttaagaaaattccggggggggggggacgacctgctcccgccgttattgagtggatgacccgacccaataatgtaaaaaatagcatggcattctccatttttcagactccgtccgtcgactgttgagcagaattttgcaaattaacgccaacggcagtgacctggccattgctatgcatgcccaaatggtcgcaaattattgttgggaattttttctcagaaccggtaatatatatatatgcatatgcatcccctctttttacagtaacttttacaaaaacacagtgcatttgtcgtaataaaaatactttcactaatcccccccccccaatattttcattaatttcagatgattacaatgtgttggccttgctactttcttttctggaagtcttgaacaaacaaacccaatgcaacccgctcattcctgtccttttgtgcagaatttacggtaaaatatttattgtacagcacagtatttttttttatttaaaatatgatttggcccaaaatttcaaaaaatttaaatgccaattattttcagcaattttcggcatcacttggcgcatcaatgagctggtcagacaaatggacatcaaatttattcagcgcgttaattttgccttcttccaatgctttgttgccgaaaattttggacaatttcggacggccggaaattattacgcatcgatgggtaagtgaagaatatattagttttatataaaacaaatgcaattttaattttcccattttagtgaatttgcagaaatccaatactaaagaggtgaggaggcaaaaaagggacgaaattattttaaaatcatttaagaatgaattattaaatttattttaataaaagtttactctccactgatacataccatcgaattttcttccatgtcacagctctctgttttaaattgaatgataatttgttcagatcagtgaatgcattgtctctgcgtttcggaaggaaaaatactttcaaatcgccaatttgtacgattttatgcaaatttggtaatgtttttttatccgagtgcatggattaatgttggtaaaatattaattttgactaactttagtcagaattccgtctattcccaatgctccgttgtccaaatggccgttttctcagcctttttcgattcacagtctgtggaaatcgcttcaaatcatttgacaatggacgaagatgattttggtaaaagcggcacaaaaaatttacagtattacattgatattttaaaatgatgttcttttgaaatataaatatgtcagaaatccccctttccggaattatttttagtaaatttccggcactttttctctcctgcaactcccaattccctgataattttgaggggaacctcgatcaccagttttcttgcacattttttcttgtaggatgatgtcctgaaaaacggattaataaatgtttaatttgttggacattcaaacatttaccataaataaacacgtatttcagatttaaagcgcaccatcgacaacagggagttcagtgctgtgaaggtttttctgtccgaagcgacgcttggcgaaatgcgcgatgggacacttaaagaaattgtgcgcagagagagagcgaaatgtgcaattgcaattttaaactatttcagaagtcctatctgaggttgcgcgtcactctgtgccgggccatttgctcaattggcaaacagtcgttagcacagaatgccgccaccttttttgccacattggacgagtgccggacggaatatgcggaagtgccaaaaattgtgggacgaccgacacatttcaaaaaaatttaaa

SEQ ID NO: 73734 - DNA, 1369 bp, Heterodera glycines
  Genomic contig location: Contig_ID=SeqID_10509; Location=480..1848; Strand=-
  SCN-specific regions: Sequence locations=1-149,172-320,342-369,399 -645,667-845,880-1001,1027-1082,1104-1150,1172-1346
atggtttacttaaccatggttaaagacgagcataccggttaaggtcggtcgttaaccacggttaacgaaaccgtggttaatgcgttaaccgtggtttactaaaccgcgagacgagcataaggcgccagcagcggtgccgataggcgccgccgggggaaattttgaaaatttgagtgtaattttttaatagattttcaacaaaaaatgctgatttttaggattactatgctcaatttgttcgaattttcttcaaaaaataataaaaatgtgttaattaaaaaactatgagtaatcatattttgtcgataggaaactcatgattatacaaaaagaaacaaaatattttaattacttagaggaattgaaccatgggaaagaagaagggaaagtcaagaagacgattggccgacatttgcggcgctgacacttgcggcgctgacatttgcggcgctgacatttgcggcgcccagtcaaagcgacacttgcggcgcgacacttgcggcgccgacacttgcggcgcccagtcaaaaggacacttgcggcgccgacacttgcggcgcccagtcaaaaggacatttgcggcggcgcaaaattcaacgaccccaaaaatatttcaacaatttattaaagttaacagaattgttattttaatagtttattttttaagaatgcctaatttaacaataatcttgtaacctaatcacaaagataaaggttgagtcgtttgccgttggctaatgcatacattaataggagagaaagatttttttccgttttatgcagctacttcagttcttcatccgtgccataaaagcaaattttttccaaatttctccgttcagtgagtttctcaaacaactcaaaaagataattcatctcaaaattatcacgttcgaccagaagctcgccgcccgccaccacgaaagtcacgtacaaaggagtcgttcgattggaccgcaaagcgcaaaaattacttattattcagtcttaatatgccaaaatatttgtaactttttgtttttatgtaatatatcggtgtaaggattattggatcaaacaaaattcaattattgatcagttgaatttaagttcatttaatgtttaattatattttaatacaatttacgctgagctgatgtgcgtgtgtatcatttgtttttgtccgcaaaacgatattttggtttagtttaaatataattgtatcaatttaagatttgatcttgttaaactatatttagctttacattttgctttgctttaattgtgttgaattacataatgaattatcattgcgtttattttcataagtcactttgtttcttcgggtatttttcaccaattttctcaaattgataataataataataaa

SEQ ID NO: 73735 - DNA, 237 bp, Heterodera glycines
  Genomic contig location: Contig_ID=SeqID_10509; Location=3773..4009; Strand=+
  SCN-specific regions: Sequence locations=1-102,124-214
atgactgaccaaaacagcgaagcaacttttgccgaggaaaccagagagctcaaggccgagattggtcccgtctttaaccgcgagaaactcgacaaggcgtacaagaaacttgcaaagaaataccatcctgacaaacacaagaattctgctgagaagacagcaaaatttcagcgcttacaaaaggcaaacgatgagctcaagaaagagctgcttaaaccggaggcaattttattttaa

SEQ ID NO: 73736 - DNA, 136 bp, Heterodera glycines
  Genomic contig location: Contig_ID=SeqID_10509; Location=4082..4217; Strand=+
  SCN-specific regions: Sequence locations=1-136
atgatgggatcgccaaatgcagctcggacgcttgatgagctcaacaaagtgggccatgacgaattgaagaaaatggcaactgctcaacgtggcggtgattggaccggaacagtgacaattgggggacaacaatttg

SEQ ID NO: 73737 - DNA, 436 bp, Heterodera glycines
  Genomic contig location: Contig_ID=SeqID_10510; Location=233..668; Strand=-
  SCN-specific regions: Sequence locations=1-60,90-436
atggttgtcacgttggacggagaaacggcaaaagtgggttttttttgtgggcaattgcccaaaaatttaattaattaaattttaaatttcccaaaaaatttctcgcgcattaggtcctattggaaagcactgttgaaatcaaaaaaggacctgagtacaaattctttcaccaatggttgggcaacggcgttttggtcagcgacggggaccattggcttcgccaagtgagtcccataaattcataaatcagccgaggattactaagatttaggattttcggggcttgggtggggaatatgttagaaaaatgataattatcatatccggccaattttattttttccaccttttgcaaacgaatttttaccatcttggctagggtggtggtacagtatcctttacacctcccctcctgctgggactgttccagaataaa

SEQ ID NO: 73738 - DNA, 677 bp, Heterodera glycines
  Genomic contig location: Contig_ID=SeqID_10510; Location=741..1417; Strand=-
  SCN-specific regions: Sequence locations=1-170,203-409,431-614
atgcttctgttcttcgttgcggttgtgctgctcgttttcgttgtttggcgtatttttgccatttcttccacccatttgcgcttcatccgcacttccaatggcatttacaatattccggagacaattccgttcctcggccaggcccacgtgttccctcaaaactcgttcggtaatatttacataaaaattttaaaaattatttgggtgctaaaaaatagcttttttatggcatcccggaggcagtaaaatttgttttaaatttgagatttttaatattgtatttctggatttaaagtgaattaaaattcaaaaaaatatcgaaaaaccctaaaaaaattctcagaaataagatgaattaagttattttgaatttatttgaacaattgaccaaaccctttttctcatcagtgatccaaattgatttgagtttcatctttttgaataatcacttctaaaattctttattccagcatggtccagctttattgtggaacaatcaaatggtaataatattgtattaacactaataaaaaaaacataattaggagataattaattcataattacagacgcggtcagaaaaggacaccatttgatgagatggtttgattaacaaataattgtattattatttttaattataacaacataaaattgaaaaaaataattgaattaaa

SEQ ID NO: 73739 - DNA, 357 bp, Heterodera glycines
  Genomic contig location: Contig_ID=SeqID_10512; Location=250..606; Strand=+
  SCN-specific regions: Sequence locations=1-46,78-117,174-201,223-357
atgcacaactcatacgtgggtcaaatcggtgaaaaagggaagtacgtaaaatatttatatattatatttatatataagatttttcatgagattcatttgattataaatgccttgaagtaattaaaattattttttcagtatttttgttttagaaataattaactttttaaaatgagtaaggaattaaggtatacattttttaaaatctattttccattaaatttattcatttgctgactttacgaaatattgatggttattgaagaaccagaaccacattttatttttatgaagacttcattttcctctattattcgatttaaatcattttttaatattcatgttatttcacctaaa

SEQ ID NO: 73740 - DNA, 224 bp, Heterodera glycines
  Genomic contig location: Contig_ID=SeqID_10512; Location=1533..1756; Strand=-
  SCN-specific regions: Sequence locations=1-26,147-180,203-224
atgaatggcaatcagaataggtttactatttttataaaaagaagtaataaaattaataaaaataactaaatattaatcaatttctaaaatctccaaaagtagataaaaaataaaaaaataataatttaaaaaaattctttaaattacagagtaaaaaagagcgagtataaaagagggcattgcttttattttcattttaatagaaaaagagaagaataaataaa

SEQ ID NO: 73741 - DNA, 1111 bp, Heterodera glycines
  Genomic contig location: Contig_ID=SeqID_10514; Location=42..1152; Strand=-
  SCN-specific regions: Sequence locations=1-368,390-407,445-546,635 -682,706-1034,1058-1084
atgcagcgtgacaatgaaacgtgccagatgatggtgaaaaaacattgcaaatgcggttgggcacgatgccatgagaggaggggatggaatgcgagtttgtgttgccaggccgggtacgacttggtgtgctgtacattggttcgacattttcagaaattcttacaaaaaaaataattcagggccctgattaatacgtgccaaaaaactagaaatataagctaaatcaataaatgtccaaatatgagctaaactggacgaaaaatgccaaataattgttcgaaatttgcctgcaaaatggtttaaatttaaccatgaaattttcaattttttttttgccaaaatcacaatttttcgtaaaataattttgtaaaagataattttaaaaaatgcaccaaaaactaaactagttttttattttttattaaataaatatttatttaatttggacttcaatttttaccatttataggatactcttgacattacaactggaactattcaacaactggcaagtttttctatcaagcaaagttcctttcttaagagaaaatatttaaagtttaatgaaataatttcatttaatattttttgaaaaattaattttaaaagaattaattaataattttttataaatggaataaaaagcatcaatatttctgattaacaaaaattatatttataagaaaaagaaaacaataaacaaattttcaacaaatttaggaattggaagagaatttgatcgcaaatcatggccaagatgagcatcgattgcctgtattgaaagaaatggctaaaaatgaaatttgctcggacactgtgcaaaaatattgcccttgcgaaagtgccaaatgtgcacagcgattggatgacaaatacgaaggcagcatttgttgtgagaagggctttgacgtggtgtgttgtgtgggaatgctcaacaaattataataatttaattgttggaattctgtgaattaattgcgtctgccggccattaattaaatgtatgaccatttggaaattaattggtcgatcaattaacacaaattattgtatttttgaatttcatttgattgaaacaaaaaactaaaattttattaaatatttaaataaa

SEQ ID NO: 73742 - DNA, 873 bp, Heterodera glycines
  Genomic contig location: Contig_ID=SeqID_10515; Location=477..1349; Strand=-
  SCN-specific regions: Sequence locations=1-180,204-574,596-873
atgtgcaaaatgatttgcttctcattttctcaattatttgttgttctcgtgctcatctgtccattggtgtcctacgcattagcaccatcgaacaacaacagcaggttttacactgattgttgtttatattatttacatattcatgatcagatttgtttttcagcaattcaaatttcaaagcttttcaataaatattaattcatcactttgttcctcagcaaccataatttttaattttttgatttagttcgatagcacaaattgtaaagtgtgtttctctattagataataaaatttcaaaaaataactcatttgaaattttgcaggctaattgaaaacatttagaacaatattggcgtagccatcgaatgataacaaaaattaaatttggttttgagtaacatcatagcgccaaataattttgagcgttttgatcacgtaattttttgatgatagaatatgattaaaaatctgctgatcccctggagacgtaaattcatttattaattaatttaaatcatcggatgccgagcgaataagtgagtgaatcctttaacattttagtaaaatgccaacatcatcattttttggccaaaatcggtcagtcgccggcatcggcattcttggcaccttttcccggcctggcattggtgcctatctgtcaacatggatccccgaattgagcaagaccaactgttcctacaaggcgatgaatgtatgccacccatttgtatggggttcatgcgttgaaaacgatgtacgcgtgaacagccacccgtgctgcatggacggctatgagtggcgatgctgtaccaaggcaagccgtacaaacaaaattatgtgcaaacataagttgtattgggatgaaagcgg

SEQ ID NO: 73743 - DNA, 435 bp, Heterodera glycines
  Genomic contig location: Contig_ID=SeqID_10516; Location=430..864; Strand=-
  SCN-specific regions: Sequence locations=1-1,38-86,141-359,381-435
atgttgttcaacgttcttttcttatttttccttctcattgtgcaaattctctcacaaggaaccaatccgccaacttgctttgtgagtataaaattatgtatttaaaaaaatattttttaacattttaatgtttaaaaaaagcattttaggttccatgccctgcaaatgaggaattcggctacaaaaagtgcaacggatgtgagccgagttgtgacaagctgaaaccggagatttgcaccaaaattgcatgtccatgctcatgcgactgtaagccgggaatcttccgcaacacaaagacgggaaaatgcgtggagaaatgttcatataatgacaattaaaaaagcggaaaataatgctggagaatttattaatttcccattcacaaaacaaaatagtattttcttgtttgaccaaacaatttgttaattgaataaa

SEQ ID NO: 73744 - DNA, 2098 bp, Heterodera glycines
  Genomic contig location: Contig_ID=SeqID_10517; Location=516..2613; Strand=-
  SCN-specific regions: Sequence locations=1-40,64-241,263-560,594 -835,857-1019,1056-1246,1268-1733,1755-1799,1821-2098
  Gene Ontology: Mol. function=protein C-terminus binding; Cellular component=cytoplasm; Biological process=regulation of cell cycle
atggaggcagattttcacggtcaaattcccatttgtcttctttatccatcatttttacatttttcagctccttggttttacgggtcactttcccgcgagaaaactgagaagtgagccgaattcattttggaagagcaataaatttttgattttaaggtgcttacagtcatgcgcagatgggactttcctgatcagaaattcaacaaactatccgggtaatttaagaatattcatttcgaaattgaaaaaacctttttggaagaagttttgcttgggctttaagtcgttgtttacttacatatttctcattatttttggttttagttataatctctaagactgtaattttcaggcgatttcacactttgcgttgcttgcaatttgcgggtcgagcattacaggtcggcacacatcgcaagaaaatggcttgaacaatgcttcgaatctccaggatttacatggtgaatgaccactttacgtgtgacaaagaggagctgttcgacacgctcactcagctcgtatcggtcggttggttttccgattgctattccattagacgaattgtccagaaaaatttttaagaaatgcaaaacgggcgactttttcagccacaaccaaaaaaaaaagctaatgagttttgtttcacgcactcattcccgtcgcttttgagcactacaaaagggatgccgacggactgtgccatcgtttggtgtgcccttacatttccgaggaatgccaaaggcagcgaactcacatcgatttggtgttagttgaggagcgcaaaaaggagttcgagcaagcggcgctgttactctccgttgaccatcttcggcttggcactgtcattggacacggcgaattcggaggtgtgtcttttacgcggtttactccaaccgctttttttgaaaggtttcaagaattactcaaaacacatttaaagaaacgcgttcaatgtctatttaatttcttggaagcaactcttttcctactctagaaagggaatttttcaaagaattatcatttttaaaatatttttttcgaaaaatatttaaaaaccacgtatccatgatggtcaccattacaaatacaatacaaaaaagaattctgttcattgtcagacgttctttcgggcacataccgaggcagaaaagttgcagtgaaaacgctgaagaacggaatggtccaggatttgctggccgaagcgcgttttatgatgtgagaacaatcttttggcgttaatcaaatcccttccattttgacactttttcagtggccttcaccatgaaaaattggtctttttggtcggcgttgtcattgaggacccgcgcgaaagtgaagtgtacatgctgaccgagttcatggccaatggcaatttggtggattttctccgttcccgcggccgtcaccacgtggaccgaccgcgacttgttcaatttgcgcagttagttttttttgaagtgacttcgtgtgagaaaatgccgcgccatctttgcctcccccttcttttcagggacgtggcggaaggaatggcatttttggagtcgcgcaattttgtccacagagatttggccgcccgcaatgtgctgttggacgaccgattggtggccaaaatcggtgacttcggactcgctcaattggccaatcagccgtcaaaagagtcggcgaagggaaagtttccgatcaaatggagtgcgccggaggcactccgacagaatgtgagcgatcggtggcattcattggcatggtggcattttgatgctccatttttagctgttcaccaacaaaagcgatgtttggtcctttggcattttgctttgggaagtgtattcctttggcagagtgccctacccccgaattgtaagtgcacggctcattaaggcactaattaattgaccattgctgatcatccattttgtgtcccttcagcccatccaggatgtgctgaggcatgtcgaaaagggatatcggatggacccgcccgagggcactcccccgctgatcctttccctcatggacgactgttggcagttgtcgcccgcctcgaggccgtccttcgccgaaattttggacattttatgcccacgaactcgctgataaa

SEQ ID NO: 73745 - DNA, 2199 bp, Heterodera glycines
  Genomic contig location: Contig_ID=SeqID_10518; Location=175..2373; Strand=-
  SCN-specific regions: Sequence locations=1-85,114-1605,1629-1678,1700- 1867,1889-1930,1952-1981,2003-2199
atgggaggggtcggaacggaacagccgaacaccaccactggggaacagagatgttcacaatcagcatcaccaaaggatgttggaatggaacaggaggaggaggagacggaagaaggacctgtcgatagcaaagacgacgacgaggagggcacggagagagggcacagtgccgacccatcagcaaaggtgggctcaacacttgccatggcattagtttgccttgccattcatcgtcatgccctcctcatttgtcagtgccataccgactttgccgccgaactttcgctgctccgtcgctccgcttcggcttcgagtcccttgggccccgcctccgccgaaccttccacggaattcgttctgaattcactttttgctcgatcttcgccattccgtctgctcggctcgacactgctcaacccgatcgcaccaacaacttcttccattgacaatgatcactccgatcagcgtcgtgcgttgtccgctttcgcacccgcgtccaaatcgcccgtcacttatccgacgcgtcaccatcgctttgtcagcactcccaatggcaatggcacatcacttcgaaacaacggcagtggcaacggtcagccaccgtacctcatccgtcgaggtgaatactgtgacaccggaacttgtttaggtactttttggttatgcgggcgcaccttcaaatttctaaaaaagaaaaaacgcgcgttttaaaaaagaaaaaacgcgcgtatgtgttagggatgtgcgagaaatgatttttaccgagactctcgcacatcctagcatttgtaaatgttcccagcgcattgtgcgaattcctttggcgctaagacttcaaacgtgcataaccgagaagtacccttgtttatacgataaaaaagcgcagaaagtgctaaattaattttaaaaaaccttcaagggtttggcgtttcaaaatcccggggtcgccttgccagcggcactctcccgcctccgggttcgtccgattgatgaaaacaattgattgatttttaatagactcggcaatttctgttcgtaaatttgacatcgtttctatgtgttcgtcaccgacggaaatttgtggggacggtgacacaaaaatagaggaagaagcaaacagtggcaaagcgaacaacgtcacaaattgctggaccgatgccatggaatgggcggacggtcgaggcaatggaacggcaaatgccaacggaacggctaacaatgaggacgaagacgcattgttcgcgcgccttgtagtggcacggctgaaaaagtttggcacgaaggaacggagggcggtgagtcggtgaaggaattaatgactattctttggaagtttcccttttaggttcgttcacgcattttcaattggttggaccaaaaagaagaggaaatggaaacggcgacggccgaagacagccaatgaatgccaaacattgcttttcgattgatattttgccattcactgatcagtcaatgattgtccctctctcattctgccaaattttctctctttttctttgttttcactttcttttatcttttgccgaattcattttgtgtgccgttccccttttaacctttgctcaattgaccgatttctcctccttaactgacaaattaattaatttgtcttttattttcaatttatctttgtggctaaattaaaaaaatggaccaatgaatttgatgagaaaatcagcagcagcaaaacacatccaaaagtttgtccaacacttcgcttgagtggccccgggggcggcggaggcgacaattgcccgtcccgccccttcggttgcccttctcccccccccccgcctccgcccaatccttcgccgttttgccatttcttccaattgccccacggccctttttctcttccctttggccaatcagtgcaaatgaccctttgggcacagtaccaaagccaaacagaagagacgggaaaaggaaaagcataaaaaacagttaatgattgtgcaaataaaaattgcaaattctcagcccaattaacgcgcgccgatgagctcaacgaatgccaacgaatcaatcgacactttgcccctggcaacaaattctgcttcgaatagtgccattcccggcaaagtgcctctgagtggtgctgagttggaaagattgctgcgcatgcgcgcagaacgcacgcaacgaacgccaaagtgcgcgcgggttggtgcgaataaa

SEQ ID NO: 73746 - DNA, 379 bp, Heterodera glycines
  Genomic contig location: Contig_ID=SeqID_1470; Location=1029..1407; Strand=-
  SCN-specific regions: Sequence locations=1-379
gcatggcatccaaagcgtttggagttgctttcgtctggcgccaaccaaacggtggtcagatggtcctactcagattcggtagggtgtactaagatttttcactgattttttcaaattttatgttgaattattaagtttttttcaaaaaatttctaaaaaaatacgctgaaattaaaatttttacaaaaaaattttcgggtaaggaatgaactgcccccgtttgggtaaccctttttcatttgcgcttcattcactccataaaatgtttgtttgccatcacaggactccatttggcttccaatttctcgctttggcgacattgttggcgacgaggtcaattgctatgacatcacttattcgccttgtggacggtacgcac

SEQ ID NO: 73747 - DNA, 1216 bp, Heterodera glycines
  misc_feature (22)..(22): n is a, c, g, or t
  Genomic contig location: Contig_ID=SeqID_1471; Location=52..1267; Strand=+
  SCN-specific regions: Sequence locations=1-265,287-1216
  Gene Ontology: Mol. function=protein kinase A anchoring activity; Cellular component=integral to membrane; Biological process=eye photoreceptor cell development
atgtaccaaccgtgccccgacngacctgtgcatgtgatgaaagttcctctccaacagtcccattgtgcacattgcggccaacacttaccaacaattggtggaaccatccgttggttcgtttggcacccaatgggactaacaataaacgttaattttcctttccaatttcagttaaaattgcgcaaaatttggtgttttctctgaaccggtggaatccgaactttgtgcaggtccaaactcagtcgtccggtaccaaagttttgaacgctgccgccgcctcagcgacagacaaatcgaccgcagcggactcgtctgcttcatctacagcaacgtcacaaatttccacctccgaactgccgatcactgtcgacccgctgctcgtggttgccaatccgtcacagaaagtgccgaaacgacaccttggcgaccaattggaccaacggctgacagtgtcatggagcaatttcatttgcactgttgacagcagcttcatcatcgtgtgcggttaccctgactacagtttccgactgattgagacgggcaatggtgaggacggacatttgggcacataaaactcatgttgtatcggcaccttttcagtacaagttcggcaagttgtgctcggtcatggcaacgtggtcacctgtttggcatgttccgagacgaggtgcggtcattgggaggaattaagggacagcagttcgtttagacacattattgtgttcaaaattcgagactttcaccaaggggaaggccagccaatcattttttcttaaaatcctccacccccttacaccgtgctgtttagtcttttcgccgattgttacgtcgcctcgagcagtgccgactgcaccgtggtactttggcacttcagtcaacacttgggcctgctcgtcggcgattacaatttgcctggggaagagccgtcgccacgtgccattttgactggacacgactcggaaatcagtggtgagtgggtgagaaatgcaaacagagatccggcttggattctaccctccccgggtgtaatttttcccctatgttttagcaatttgcgtttcggctgagcatggcattgtcctctacggacggtacccttctgatgcattccacacagggcgacatgctgcacatcatcatctgctcgaacggcaacggaacggacacattggcaccaatcaacgacattctgttcagcagagactgttacattgcg

SEQ ID NO: 73748 - DNA, 2900 bp, Heterodera glycines
  Genomic contig location: Contig_ID=SeqID_1472; Location=2658..5557; Strand=-
  SCN-specific regions: Sequence locations=1-293,315-465,487-832,863 -988,1014-1258,1301-1378,1440-2166,2188-2328,2350-2900
atggaccgctgggcacgcgagtacggcacgcacacgcacagtcaggaacagtttgggccaaaggaggcgtacgagcgaatggtgccggtgccgcacgggtcacagtttagcatcacggagccgggaggtgagacaaatgggtgaaatgggggacaaatgggcgaaagaggggacaaatggaccaaaatggcggacaaataagccaaatggaaaatagatgaaatgaattaaaaaatgggcgaaatggtggacaaatgggccaaaagacagatagcccaaataagtgaaaatgagctaaaattggggacaatgggccaaaagttagacaaatagccgaattaagtgaaaatgcgagaaagggagggacaaatggctaaatgcgtgctaatgaacgagatgaagatgggggataaagccgaaatgggagaaaaatgctaaacggggcatgggcgaaattgtcgacaaatggatgaaaacttagacaaatagccgagataagtaaaatgggcgaaacggggggaaaaatgagcgaggtgaagatcggggatattggagattgcgggaaatattaccatatggggggggggcgatgtatttaatgggaacaaccaactaagacaaaatgccgaaatgggacaaagtgccgacataattaattcattaaatgcccttaatttgtagccacattcgactcgaacacaatgtattcggaccatttccaagtgtcgcccgagtccttcacacgcattgaacgcccgcagcaaattcggccgtcgacggcactcagattgagtggcaacatggacatggtcaccggatacagaacggtgtcaaaatgtttttaaaaatttaaatttacctaattaagggactaattagtaaattttgatcgggagaatcctgaggaggatgggaatggatgaaagtcgagagcttagcggaggctactcctttgagattttgaaattgtcttaattttcttggcaaatttctttgaattttcaaaaattttcccgaaaaaaatttctattttttcaggaattccaaaataaggtaaagcctggacatgatcaccggatacagaacggtgcaaaaatattttcaaaaaatttagtttacctaattaaagggctaattactaaattttgattgggaggagtcccgagggaatggatgaaagtcgagagcttagcggaggctactcatttaagattttgaaatttgtatcaattttcttggcaaaaatttctgtgaatttccaaaattttccctaaaaattttttctgtttttcaggaattccaaaataaggtaaagccatgccctgccggtgaactggtcgaatcattgaaaaaggaagacaaatcggacacggaggtgaataaattattaagaaattaattagaattaaattaaattaattgattagtttaataattaagcaggatcgctgcttattaaagtgccacggcacaaatgaaatgcgggaaaattgtaaaagaaatcaattttggcaatttacggcatttttgtcccaaattggtaataattattctcagaaaatttggcggtacttttccgttttggggccaaagtttgatttttgcctcacaaatcattttggtgtgtagctttagcaattctacgggcccacggttgatttttaaaaaaaattcaatttttggccccaaaacggaaaagtaccaatttggcagcacctgcgaatactttgggtaaaattttgaaaaatttaggaaaacttttttaacactctttccccccccccttcaaaaaacgattttagggctatgcccttgattgttagttaaaattttttgtaatccactcccccgcgctccagcaaaaccggtgaaccttaatatggcgatacggtaaaattttccaatttttcggtgcccaaatttccaaaattgcaaaagcgatactctcgagcagtacacatattgattaaatttaccgaatttcctataatataaccaccgggggctctatttttcgacccccgtcaaaaggggggctttatttcagggggggctctaattcaaggggggaggggctatattataggaaatacggtatttgtgtccaattgcaccaattttcagcattttcaattccacacaatcaacaaaggacatcgccattacaaatccaaagagaatttggcaaccctttcagccggtgaagaacaacaatgaacagtggaaatgaatgatgaacattttattatcgcactaattatgatggaattagtttttaattgtgattgattagtgaatttgatggaaaggtcggccaattttcggcaaaaattgctgagttttatttgccaatctctccctatatagttgaattctgtcgttcattatttagtatttgttttctcatgaatttttaccatcaacataaaaaacatagaaaacttgcgcgtctgcggcattagattgtttgatttgtatgtctatcgtatttcaagaattcattcgaaattttgaattttatctcaatagtaacattatgccataataaataaatttcatcaaaaaaaaaatatctaatgctttgtcttggcctgttcgctgttcgtttctttgggtcttttggtccaaagctattttttcattctctattttttacaataacttataaatattgtatacttaaaaaatttgttaagcgcacgctaattaaacaaaattattcgatgcaatccaacggagctgcgaccggcacggcatcggcggcggacgccgggcgggcgaacacggcacaaatggcgcaggcgaatggtggcattgaacgtgagcggaagccgttggagagtcgtcaaattgtcgcacaatacatcaaatatgcagtgaaattggaacggatcatttga

SEQ ID NO: 73749 - DNA, 993 bp, Heterodera glycines
  Genomic contig location: Contig_ID=SeqID_1473; Location=236..1228; Strand=-
  SCN-specific regions: Sequence locations=1-24,47-686,793-993
atgaggcctatcttgctaatgaccgtgcagaaaaaatactgttttacaaatgagtatacggtaagacgcaatggttctgaagagtgggtccctcaatccgtccccgaaaatttaggtcattttcggcataagttatactataatagagccccagagggctttatttttcaaccccccccccctccctcaaaagtgaggctttatttcagaagggggcgggcctttcagggggggggttatattataggaaatacggtatatcctgaccccgacgctccggatcccgaaaggataggactattgaaaagataaatatttggccacaaatataatttcaaaaaagttgactcaactccctcgatttcggccgagccgaatttttcccgtctcgaaaacaatgttttttctgttcggcatatagcgcgagggcaccgttggcgagctgggcacagtgaacaggacggactttgtgccgcaccagggccgtgttgagcgttacgagcggcgcgtgccgcccgagtcgcacattttgacgcccgagccgggcgcattggtgccggcgagtaccgtcagccgcgacgagtttggcgagaagcgagcggagcgcgcgcagcgccaccgcccgccggaggcccaattccgcctggaccaaggcgcatgggaggtgaaaacagtgatttttggagtttaaaaattaattttaaatttaaaataataaaattatttttagaattgtatttaaaatgggatttttaaatttaaaaaaaatcacaaaatttaaaatataaattagaagaaactaatggacaaaacacattttaccaataagctaaaaagcaagtaaaaatcatttttaccagaattccggttttgaaccgggaaatcggtcaaaaatgggaaaaaatcgggaaataccgtttaaatccgggacccagggagtagacttgtcctggtccaggctttaatttaggtaggtatagtagttataataaa

SEQ ID NO: 73750 - DNA, 166 bp, Heterodera glycines
  Genomic contig location: Contig_ID=SeqID_10522; Location=73..238; Strand=-
  SCN-specific regions: Sequence locations=1-43,67-166
atgccagccgctgcaccgcccacaccgatggcggagccggcgccggacgagggcggcaccggcgcgccagccaacgcggctgggccatatccgtcactttccggcccgcgcttgtttgttgagaaaccggaatcgccggtgaagaaatcctccgctatacggtcca

SEQ ID NO: 73751 - DNA, 2261 bp, Heterodera glycines
  Genomic contig location: Contig_ID=SeqID_10522; Location=264..2524; Strand=+
  SCN-specific regions: Sequence locations=1-2,50-221,243-691,717 -1049,1079-1241,1267-1476,1498-1587,1627-1649,1671-1708,1737 -1806,1847-1915,1937-2043,2104-2209,2232-2261
atgccagcgcaaccgcagccgccgcctccaccgccgccgcagcttccgcaaatgccaatcgcgcctccgttgaggtgggtgagcgtgcggagatccgggcactatagggggacggaacaaaatttcgccgccgaaatctcgtcgagacaaaatctcgccgcgaattttcaaaaaatttcaaaccaaaaatttttcaagaaaaaatcttagaaaatttgtttataagaaaattctattaaaaatgattccatcaacaccgtaggccgttgccgaatgcgatcggtggcgccgccggcgttgcgcaaccgccgcagccgcccccgggcaatgcggcgccggagccggtgcgcccgtccgcgctgcttggactgatcaacaaagcggacgaaggcttcaaccaagtgatcacccactttgagcagggcacgcccatcgaagcggcggccatcgacataatggaggtgggcgcgtgagaaattttagcggatttaaaaaatttattcgataaaaaattttttgctacaaattttaatttaaaaaacccagcaatttaaaaaaaagctttttcaataatagaaatatttattaataggccttaattacaatttggaaatttgagaatgatgtgtgcttattgaggtttaagctaatgaaattgtcaaaaaaaagtttcaatatgaaaaaataacgaaatttttctgaatcataaaatatttggcgccactgtaaaagtggccgtttttggaaattttttcaacaggggggacccttttgttttgcaaaatttttttgtgatagtcataaaaatttattctctgggttttttggggtccccgatcacgaatctttcaattattttgatcaattccgatttcctaatctaaatttgaacaaaaaatcataatttgaaaaattcaaaatttcgatttttattcgagttcgggttagggcttagaaattagtcaaaatacatgtcagattcgtgattagcgacatattgatgggcattaattcaatggaattttttctttcaaatttaccgtaatcccaaaaattggttttaaaatttttcaaaattctgagtttttaatgaaaatttaatcactcatcatttttcgaatagtgatcagcagaagctcaccaaattttgtaggggtactaaaatgaagagaattaacctattttaaactttttcatctattattggttttaaatttttttttcaaaattttgagttttccattattttattttttaaaattttttgcaagttttaattctccatattttttaagaaagtgctttgaaacccaccaaattttattgccatgttattcataaactctaatgcttatattctaaaaatggctcataaattctttaaacaattttttacgaactttttaattatccctattattttaggattatattttaaaaagttttatcgaatttaaccccttctataattaatataatctcaccaaattttataagcatactctccggtacaggactaaaacttaatctgaaaatatctcaacgcttattcgttttaaaaaaattttcgaaattctgagatttcccattatttttttttccaaaataaattaataaatattttttcagagaatgctctgaaacccaccaaattttattgtcatgttattcatgatgaactctaatgcttatgtagtgaaaatggctcataaattctttaaaaaaaattttttttacgaaattctgagttttttcttaaattttgtcccacaagaactgatcagaatcgtaccatatttttaagggtatttttaattatatataattattttattcatattttaatgccccgggagggctctattttagggaatacggtaaattaaattttatacaacaggtggccttgggcagtcaaaagttggacagtcaagctaaactgctctcccacgtggaccgcgcatttggactggacaatttgcagaggttacagcgttgggcaaacactggtggagcattggatttgctcaaggaacaggtgggaattaattaattaattaaaaatttttgaaatttttggtttaataattcaaaatttaaattcgcgcccttttacagttcgccaaaattgccaaaaactacaaaccccctccggcactggccgccatcacattgccaccgcagttggactatttgttgcaaaacccaagcggcggtggcggaggcggtggacttggcggcattggaagaaaatgaaaaaa

SEQ ID NO: 73752 - DNA, 1274 bp, Heterodera glycines
  Genomic contig location: Contig_ID=SeqID_10522; Location=2776..4049; Strand=+
  SCN-specific regions: Sequence locations=1-36,58-267,289-295,317 -324,386-398,429-996,1018-1077,1131-1274
atgccaaaaacactttgttctagagctcggcctggacctggatccaggcctggatttttcctggacccaggtccaggtcatttttcggcaacctggatttttcctggacctggattttcctggattttgtccaggaaatccaggtccaggtccaatgtgaaaaaaaatccaggtccaggtccaggcttttttcaaaataccgagctctactttgttcatttggcatcggtgccaaaatcggcaaaaaaaagaaaggtaaaccaataatgccaaacaatttttagacatagtcccaaaattttccaggtccagaaaatcaatgccaaaaaattaatttgttattttatttgaacaagattaattaatttatttttaattaaattttctgactatccgacaattaaatcataaaattaaaattttaaattgaccaaattagtggaaatgcacgacaaaatgaccactttttttcttcacttctcttcaatttatgcatttctgcacccaatcatttttctttcacattttatttgggcttactgtggcgcttacagtatacgcaatgcatacccacgcctaccgtagtaattcccctctctttaccacagtaatctcgcttcatatttttttttcttttaaatgttgctcttctcgaaatgctgaaaatttattttcgaaatcagaattttgaaaacggcattcttgagcagcaacagtaacctctatgtacaagtcgtttgagtaccgtacattttagtacactgtatattgtcctaaaaatgctattccatccacgcaggatccaaaaatgacacggcactaaaacgtcttgcaccatttttattatgcttcattcattattaattactaattaatttatgccttcattaatgttgtattgtaccaaaaatggcgctacagtatccacgcactttgtgttttatacattttcattccctcttccttcgctgttccattgcatgagattatgtactgtatttgcgcgcttttgttctttcccatttcttggttactgtgcaatttatttccatttttaatatgcaattttcagatttcttttttttaaataattttaatgattttttaattttgttttaaatataatttttccgataaaatatttgtttttccaattttttccctccctcctacggggacaagtgtcgatttcagcagaagaatctccaaatgaatatgtatcatgttcagtataaacaaaaaatttggtggtaactgatggttatatgggataa

SEQ ID NO: 73753 - DNA, 599 bp, Heterodera glycines
  Genomic contig location: Contig_ID=SeqID_10526; Location=2287..2885; Strand=+
  SCN-specific regions: Sequence locations=1-196,219-224,247-463,518 -518,547-599
atggaagtaaaatttccatcatttttagatgtaatttttagtaaatttaaatatgctcattttaatgttagtttaagtgtttcttcatccatcaaagtaaaaattttcttgttttatttctcatccatagtttcccttttttatgcatttcttattttaattacatatatctaatcaaaaaaatcttttctaactaattaagatattctttcagttcatcttggtcagccaaatgataataagaatctcaaacatgctgtggttttcttacgtgctgggtcgtttcttaaaaactgccaccatgggcgtttcttaaaactgccagggcgtttcttaaaaactgccaagtgggcgtttcttaaaaactgccaagtgggcgtttcttaaaaactgccaagtgggcgtttcttaaaaactgccaccttgggcgagaattaaactacaaattaaaacaactatatagaaatattttatctaaattttattgatataaagtttgtaaattaatatatatattccagtatttcttttttaaattttcttattctttaaaatgttcaccaaaaacatgaactgacaagcataacaaattctaaaaa

SEQ ID NO: 73754 - DNA, 300 bp, Heterodera glycines
  Genomic contig location: Contig_ID=SeqID_10528; Location=431..730; Strand=-
  SCN-specific regions: Sequence locations=1-159,220-300
atgaggaggaaattgaattacgagaggatttggtcattgacgattgcgcaaattttgatgaaattgatggcgaaaactttgaggattttgattaagattccgatgagcaaattgaggaaattgatagcccattatgttcaggtccatttgatttttcagaaataaaatattttcatttaaaaatttttaaaaataattttctaattaacaaaattatttcagaaaaatcaagtggatcgagttttttcccttctccggaaaaaaaatgccaaaaacagattttatttcatattcggataa

SEQ ID NO: 73755 - DNA, 64 bp, Heterodera glycines
  Genomic contig location: Contig_ID=SeqID_10528; Location=1..64; Strand=-
  SCN-specific regions: Sequence locations=1-31,53-64
tatgcacccaccaaatttcattccgaaactccacggacacctccagaccttcctttgtcagcaa

SEQ ID NO: 73756 - DNA, 99 bp, Heterodera glycines
  Genomic contig location: Contig_ID=SeqID_10528; Location=694..792; Strand=+
  SCN-specific regions: Sequence locations=1-32,54-99
atgaccaaatcctctcgtaattcaatttcctcctcatttttaatgcacctttcaattgatgctgcaaaacttttggccaagaatatttcatgctcgttg

SEQ ID NO: 73757 - DNA, 1265 bp, Heterodera glycines
  Genomic contig location: Contig_ID=SeqID_10529; Location=1143..2407; Strand=-
  SCN-specific regions: Sequence locations=1-57,79-99,124-163,204 -327,350-641,666-682,704-843,867-1158,1180-1265
atgaaaatttccttaatcccaacgacccaaatgttcacacccaaaacatcgagggtatgtggtccacatacaaacgcaaattccgccccaatctggtaatgtttgttttcttcttttctcatgtcttcaacgcatttgtattgccattccatccatttgaatcgattttggaagataaatgtgaattttgttgaaaaatgaaattttgactttttgttcgaattcgggtccggggttcgaaattggtcgaaatgaatgtcatattcctgatcagcgaccctgaaaaccccaggaaagacgttttgatgaatttcaaaaaaaaaatcatttttttgaaaaaaggtggggaggggggggacaacccttgctattaccccaaaatattcgtactaataaattcaaattcagtaattttccatattgattgtgggaatttcaaacttttatcatgttataactcaagtcctaggcagactctttctaaccaaaatgctaaatttattctttttcctattgattctaaatgttcaaagtgattttgtacccttataaccaaaattattagaattttcgaatttatgttttttcatgtgttagagacatgaaaatagtgcgccaaaacgagagaaaaaagaaatacgtttttattattatttataatttttgaatgggagtataaacaaaaataaaatcagtatagaaaaatgcagatttttcttctctatcgctatgcaaaatttggtgcggatttaacatagagaaaaaaagctagacatagaaaagtaaatgttgttttttacaccattaaatgaagagatagtacgccaaagagagagaaattacaaagaaaaagagaaacgacgagatagtctaggctcacagtggagttgacccatagtgatagtatggtttacaggttcgaattcgggttcggggttcgaaattggtcgaaatgaatattatattcgtgatcagcgccctcgagaaccctaaaggactttgaagaattgcataaaaccccctttttgcctcttttttttgtgggacctgtaaaccatactattaccgaatttgagtgccaaaaaagacatttttgtaaaaaaccaaatttttcaaaaaatcgccaaagtgggctccctttaaaaaaaagaatttcaaaaatttttaggcgccaaaaatcgtgaaaaaggcactttgataggcacgaaaaaattgaaaaatttttatgcttaacacatcaaaacaaacgcacaaatgataataaa

SEQ ID NO: 73758 - DNA, 273 bp, Heterodera glycines
  Genomic contig location: Contig_ID=SeqID_10529; Location=925..1197; Strand=+
  SCN-specific regions: Sequence locations=1-210,232-273
ttgaggtggtgtcaactccgggaacaagcggcgccacgggtgccaccgctgtgtcacaattcattgaaggtactaacgtttgtctttgacacttcataaaattaatcgtaattgtgaccaaatttaaatttagaagacgaggaaaaatgtgcaggttgtgccacagcatcagccactgtacgaaggattgcaacaagcgttgaatcggaagaattatttttattatcatttgtgcgtttgttttgatgtgttaagcataaaaatttttcaatt

SEQ ID NO: 73759 - DNA, 466 bp, Heterodera glycines
  Genomic contig location: Contig_ID=SeqID_10530; Location=130..595; Strand=-
  SCN-specific regions: Sequence locations=1-195,218-317,340-466
atgcttagtacattggaagagctcggagcaattccatgtggcacgcaacttgcgtaagttatgactgattttttgcttaaagcaaattggttcagatttttttgtggacaaattgtaagcattttgccatctgagaagaaattgaccgctttgatgacttgtgcttcttgtgaaaacattgctgttactgaattcaaaaaggtttcagaaaatttttcaaggatttgttcgcttggataagtaattacggttgggttgtatcgacgatatattagcattatttaggtaattaaaatgtcgattcttaaagctcaacgatttgttgttgagcgttttgatggttctgtttaccatactcctttgccgtacgaatttgtggttatgaacttcacaaaaattgcagttgttcaatgtgcttcaaagattgcggactgttttgaaaaattgacttcgggttgcttttatt

SEQ ID NO: 73760 - DNA, 1251 bp, Heterodera glycines
  Genomic contig location: Contig_ID=SeqID_10530; Location=1478..2728; Strand=-
  SCN-specific regions: Sequence locations=1-8,39-521,544-683,705 -758,788-1251
atggcttcacacactgaaacaaacaaacaaaaagtgaagctttctcacggtgaacatctttacacatttgataaaatgagcaaaatggaacgacaaaattttgtaggtgcgaattcaaggacagcgtaaacaaatgtaaaggctaattggacggacctcaacaagcacttcattggtctcgcaacgccacacactataccgcaaatgcttcaaatacgtatgacgaatttttaacaaattaaaaactaacaagcaaacttattttagttaatcaaaagggcgagccacgaaatcaatgcaccaccagcagtcccgaccaatttgaattttgagatcgcccaagcatacaagacctacacgtcgacggatggcgttgaggagctgttttgttgggccactccggtgtatacttcgaaaatggaaatcaaaacccgcaacggtaattttgcaaaaaaaaaagcaaaaatttttttctcagaattttattgtttggtcgccaatcattttggcgttttgcggacagaataaatgcgtgttttggggacggaagcaaacatcgtgcgaaataatgttcacacttttgcgtgcagcgggccaaattttgctcccacttctttttccgtggattttgaaatggatatgtcaaatgccgttacgataacctttcccggatgccagattcggttttgcttttttcattttatacggaacttacaaacgaaagtgaaacagcaaggcttatggcaggtaatgttccctttattttaaaaattttttcaaaatttaagcgttattgtgctgatccggtgtttcctttaaatgttcggatgctcacatcagtcgctttcgttccattttgtgatgtcaggaatgcagtgacagcacttgacatggaatttggaaatttgtcggcttttcaacctctcattgattggtcagaattttagaataattttttaggcttttggacaattatgttggacgtcctcgtcccaatggcacgtggtcgcaaccgttgatccgtctactaacggacattggatggagatgcgaggacgaacaacaacgcagaagcggagcaccaccgtttgcaaggcgcgttcaattgtcgtcatccatcgttgtggcatttcattgatgttcttcgacttgaacagaaaatcaccgatctcaaatacaattctgcgatcgctggattgtcacctgagaaaaagcgaggcaaatatttggcagcagatagacgaattctga

SEQ ID NO: 73761 - DNA, 580 bp, Heterodera glycines
  Genomic contig location: Contig_ID=SeqID_10531; Location=833..1412; Strand=-
  SCN-specific regions: Sequence locations=1-19,402-403,433-436,499-538
  Gene Ontology: Biological process=N-linked glycosylation
atggaaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaataaaaaatttggaacgcttcacgaatttgcgtgtcatccttgcgcaggggccatgctaatcttcgagcaaaaattgtaaataagagatttataataaccatatcattaatataaatcatatagaaataattaaaaatataaataaa

SEQ ID NO: 73762 - DNA, 687 bp, Heterodera glycines
  Genomic contig location: Contig_ID=SeqID_10531; Location=1516..2202; Strand=+
  SCN-specific regions: Sequence locations=1-216,250-470,492-687
atgagcaaacgacttcgcagtgaaactgacgaacttctttctgccaataatcccgacctttccattcttgaacaacgaatgtcacgactcgaaaatttgcttgagaggcttttgccagtgggcgtgggtccaattccagaagatcctatccagcgccttgaaaagcggatggaaaaattggaaaatcaagtcacggcacttgttctggcactcgaaaaacggccaatttctcaacaacaacaaactccatggggttgtcccccggaccacatcatccggcacataaatgctgttgttttggactctgacatcataagagaaaagtcaaaaagagctgttgtggagaaactgcctgagggaatcgatgaaaaggacgtggtcaaatcgattgctgaaaaatgtggtgtggctgatgaccttattttggacgaaatccatcggcatcccgaggaaagaagtgagtcgaccagccaaaacacaagaaaacccagaattctcaaaattccattcgcatccactgaatctcgtgatatttttctgaaaaaattccgtatggcactctccaatttaccaaattttccaaaatttctgagtgccagacgggatatgactcagtccgagctctccattctttacaaccttcgctcccaagcttataattcaaacagtagctgtggacttttttaa

SEQ ID NO: 73763 - DNA, 669 bp, Heterodera glycines
  Genomic contig location: Contig_ID=SeqID_10531; Location=2341..3009; Strand=+
  SCN-specific regions: Sequence locations=1-224,247-273,306-452,474 -501,523-669
atgccttggattaattccatattaataaatgcccgttcaatcgcaaacaaaatagctgatttagaatatctaattgagacaaataaacatcaaataattttgataaatgagacttggttaaataccaggaatacaattacaactgagttaacacttaatggtaaatttcaaactgttctagcaaagacaataagagaggcggcggatgtgctattttggttagcaatgaaattccatttaaaataattttatcagaaagcagaaaccaatgtgaaatcattcatattattttatctttaaaaagtccaatacatattataaatgtttacagacccccaaattgcacaacacaaaacactaaaaaaatgctaaaatatttaacaagtgtaaatgaatcaaatagaataatttactgcggtgattttaacgccccaaatattgattggaacacaaataaattattagcaaaaaatgacccagttgcaaatgctttcattgactttattgaccaaaatcaattattacagcacgtaaaagaaccaactcgagaaaagtcaattttggatttgatttttttctggaaagccttccattgttaatgatattaaggttttagaacatttttctacatctgatcacaaaatgatcagctttaaagtttctcaagaa

SEQ ID NO: 73764 - DNA, 2832 bp, Heterodera glycines
  Genomic contig location: Contig_ID=SeqID_10533; Location=1..2832; Strand=+
  SCN-specific regions: Sequence locations=1-205,259-262,284-533,555 -634,656-692,714-942,964-1078,1101-1110,1132-1375,1397-1422,1450 -1458,1503-1677,1699-1883,1937-2832
  Gene Ontology: Mol. function=acetylcholine receptor activity; Cellular component=nicotinic acetylcholine-gated receptor-channel complex; Biological process=synaptic transmission
gataaaggccaacaaatattgtagtttaaatgtcttaattttctctttctggtacagtaaccctccttccatccgttacagtatttggctgcccgacacgacactgtacaattcgttggtgatgaaagacgacgactcgcgtcgccttttgaatgccaaactgacaacaaatatgaccagaaaggtgttgccttattcctagatatttattttttttaatatttatttttatttatttccattttaatatttttatttcccattttccttttttggccgttttggtggaaatgctttacccgaccatttacaagttctcgtgtctgcttaacctgcgttactttccgtacgatctgcaggagtgcacaatgactttctcatcgtggacttacgacaataagggcaaaacattggaaaaataaataaacaaaaacaaaaaagcaaattgaaataattgctgaaattccttttgaaggcattgattatgtgccgtattccgacgaaattggcacttccaattatttggagaacgaaggatggtgaggaagaagggcaaccttccttttgcttctgatcattttcaatttttcataatttatgctccccatttttccctattttaaattttctccgcttttccttttcaaaatgatttcctcctcaatgtgtcccccaaaaggggtttaataattaactttggccccctttttgccaatttttcaaaaatgggtttattaatttcagtttatttcctgctgatcccccattaatctaatcccaaggtatttgctgagctcgacgatgcgtcgggaggaggtcaaatacacgtgctgtcccaacaaatacactcttctcaaactcaccgtttgagtgttctcttttcgccctaattacttgactcccccctgattttcagctttatctccgtcggaagccgctcttttatctgattaatcttatcattcccaccgcaattatcactttaattgccatcgtcggcttttttacgtctgtttttaatttcaaatataattatattcatttctgtgctcattttgcccttcagcacttcttctgcgagcggaatgcgtgaagagaaagtgtccctgggaatcaccactttactttcaatgagcattttgatgctaatggtcggcttaattggaattaccctaattaattgttgaaatagcaaattgaattgtttttttatttacatgaatctttttccataggtcagcgatcaaatgcccacaacttcgacttttatcccgctgatcggatggtgtttaaaaacaaaataaataaatcaaaaatgattaattaaggttcattttgggaatgatcggcgtaatcagtttgggcacactcgcctcctcagtggtcatagcagtgcaaaaaaggcacacaattcgcaaattcattttaattaataaaatatttaaaaaagtgccatccttaaattattatattcaataattaattttattttattttaattacgctgtgtttaattgctttaatttgttcagaggtcgcctcggcgaacggctgacaaagcgcgcggttcgaattgccaaaatatttggtgccatttcctacactgaaggtaagtgaaatgccattccttccattgtaacaacataattcgaaatgcctcctccaatttaatttgggaatgaattcctcaaaatgtcagtgccgcttcacttgcgcaagggaacgagcgagcacgcggaggcaccgccaccctccgcctcttaccgacgggcggccaaattggccacgcggttggccaatcggcgtacggaggacgacgacggcacagcgacgacaacggcaccgaagaaaccggagcggactttctcccaattgttgcgcagggcgacggtgccgtccccagcggcggcggcggcgacggctaacggaggcggcgaatcaatcggaaaaatgccaacggacaaatcgacagaaccgctgatcgaaacggggggagaagacgcggaaaaaggtgggaaattcgttgagagagcttaaagtggagagcacctctaagtttcagcgtatgatcaagccaagcggcattcgttcgtgcgccgttgcggcagtgccgtgccaatcgacgcaatggcggacccgacatcagttgcttcggcgcggagcagtgcgatgccatctccgcgtgccccgcccctccatagcgcagtcaaaacgcagccgctccattccaacgccaccgttttgatgccgttcagtctgtcgctgatcagcgccgacgacgaaagcgaagaagcgagccaagtagggaggggcaaatgcacagatatagctgaagcggaacggaaacaaagcaaatttaggccagcggatttgtgagcccaagcggaaggacggcgcccggcggactgcgccatggcgttgggatgttcaacggttcaaaagccataatgcgcaaaaatttggaatttttcagaaaatttgcgtctgagtcgccaattggcggtcaaagagttcgaatggatggccacaatcgtcgaacgctgttgcttcattgtgttcgccacaatgttcttcttcctctccattggcatcaatttgctcggtgcgttcattagcgtgcccttttttcgtttttctctcatttttcggcatttttttgcccttttaaatttgctaatcaataattaatataattatttcctaattcactggccttgtcactgactttatcagtttatcagcctaattaagcatcactttgatcctctaattaccttttgttttcccttaggctattggcactgggccaaccctgaattggcattcaacaat

SEQ ID NO: 73765 - DNA, 528 bp, Heterodera glycines
  misc_feature (433)..(433): n is a, c, g, or t
  Genomic contig location: Contig_ID=SeqID_10533; Location=3311..3838; Strand=+
  SCN-specific regions: Sequence locations=1-201,224-528
tgacgcggccaaaacgcagcgacggccgtcccccgccagcgccgaccctttcaacgcgttcgccatcactgatgttccgctgatgcgactgacaaagtcgggcaaaattaattggagataaattttgaaattggtggggtcgaaattcggaaaaggggggacagaacgccaaaataagtgcgggagggcctaacccatcccattttgtgatgagagagagaatctttgctgaatttcgtcattttttgccagggacattttggcccccggccgttacgacgttcgcgtccggccgatcattgaccacacgaagccgctgaaagtgcacatttcgatgagcctttaccaaatcattgaggtgaacgagccagcccaaaacatcaaaatgaacgtttggatgatccaaaaatggcacgacgaaatgttgcattgngacccgaggtggacggaatgccaaaaaacaaaaaagaaatgccaaaacgaaaaaaaacggcagagaatacgacatgatcaacagcaccattctgc

SEQ ID NO: 73766 - DNA, 1572 bp, Heterodera glycines
  misc_feature (1127)..(1127): n is a, c, g, or t
  Genomic contig location: Contig_ID=SeqID_10534; Location=133..1704; Strand=+
  SCN-specific regions: Sequence locations=1-354,378-1572
atggcggatgaagcgaaagtcaaattgctgatgactaagctcaacccggtcgctttcggcgaatataagcgcttctgcctgccggaggaaatcaccaaattcggcttctcggacaccaaaggtcgtctaatcaaattgttttctcatcccccatcgttagctatcgatcgctacgaatgcttgagagtgtgccgagaggatggcgaaaattttgaaatttttgtgaaccgactgaaggcagccctccgcaaattccgtttttcggaattaaacgaagaggaattcaaatgcctggtcctgctcacatcgctgaagtcaccaagcgatgcaaaattacgccagcacatcctcgcgcgactcacaacagaggacacaaagacgacgaaaacagccaaattattcgacaaagtcgtcgaggatttgaacacgcagctaaaaacggaggctgaagcgaaaatcctggagcggccaaaattcaaaatcaatgctgttcaccacagcgatggccaatcatctccaaatgacgcagaaaaaggcaatcgatccgacaaaaatcgtaaattttcggacatttcggatggaaaatctcctcccaacaattgttttcgttgcggagagctgcactgggcgcaaaattgcccaaataaaactcaaatgtgcagcaaatgcaacaggagggggcacatcaaacaacaatgcgacaaaatccaggcctaccatcaaaataagaggaaaattgttcctaaaatcaacatggtaaatttgcctgtggctttcaaaaattcaggcaaattttcgaagcctttgaaagcgaaaattttggtaaatgaaaagccaatcaaattcaaactggacagcgcagcggatgtcaatgtcatcaataaagctgcattcaaggcaatcggccaaccaaaagttcaatattgtccagaggaggcacaattatttgacggcacacgtttcaaatttattggccgtggaatcgccaatttccaattcaatggaaccaacgcggaacaacaattttatgtggccaaagatggaacaccaaatcttttgggtgtggttacgttagaccgacttggattcctggaacaaataaaacgcctgatcaatgcctcgaatcncaatcaaatttcctccgaaataccggccaaaattaaagacaaatttcaacggtcaagtgctaaaataagaagggagggagctgtcagcagtataaatttcgacaaatttcgccctgtccttcgcacaccgactgtcacggccacggaaaatttctcaaattaccggaaattcggcaccaaatcccaaccgcccaagattggagagatcttcagtcgacgacacaaatcagcggcctggagccccggaaaaatcaaccaaattcggcaaaattcctacaccccatttcaggacaaatctcatggtaaaattcgtgccaaccaaccggacaaaatgaaggaaaatcataccggcaattatctcccgcaaattggtgctattcagctatgccatcgagggccgggtgatcatctgcgatcggaccccaataaattgtcccatgtgtga

SEQ ID NO: 73767 - DNA, 164 bp, Heterodera glycines
  Genomic contig location: Contig_ID=SeqID_10534; Location=1895..2058; Strand=-
  SCN-specific regions: Sequence locations=1-22,44-106,143-164
atgaattatgatgaattgagcattgtgaaggaagaagctgttgttaagacaaacggtgaacaattcagttgttgtgccggtggacaacacaataaaatatttttattgaagaaaatggaaaaataaaatacaaatatttggtcggaggaatggagcaaaaatag

SEQ ID NO: 73768 - DNA, 191 bp, Heterodera glycines
  Genomic contig location: Contig_ID=SeqID_10534; Location=2121..2311; Strand=-
  SCN-specific regions: Sequence locations=1-73,127-191
atggcgatttttcatctgatgattatggtaatgagaaaaagggaaacggtagaatttaaaatttggaaacgatataaaattaaatgacttaaaattaaaatttaaaataaataaaataaaataaaaatatttgtatattttcagaaatgaacgtagaaaatataaaatttgggaaacgatactgaaataaa

SEQ ID NO: 73769 - DNA, 681 bp, Heterodera glycines
  Genomic contig location: Contig_ID=SeqID_10535; Location=700..1380; Strand=-
  SCN-specific regions: Sequence locations=1-147,171-208,283-438,481 -558,580-630
atggaaaagcaaaagggtaagggaaaatagacaaggattactgtacataccgtaacattattttatttcaattattgtttaatataatcagttcaaatttaattggtttcagaaaagacactttttgggcgaatcggtgaattggagggacaacaaaaacaccaaaagcagcaaggggaaaaggagtcaaacggtgagttgttaaaagtaatatttaaataaatttacattttttaaattaaatatttcattattaatttattatattcatataaaaatattcttcatgttattagaattggttggccaaatcagacagttgaaagaagagcagaagaaatatttggaaagagtcaacgaattggagaagcaccagaaacaaatgcagcaggaaaggggcggtaagaaaatcgaaccatttaaatttattctcttggctataattttattttttcaataatttcttttttaaataaaaatcgttagattttcgagagcttagttaattagctaattatttagtttctattttcaaaagcgaaaatttgcaagatgagcagaaaagaaaaaacaattcaatggaagataataatgagaagcagatgcaaatggtgaataaataatggaaagaaatattaaaaattattattttattatatttaatttaaaactttaaataaa

SEQ ID NO: 73770 - DNA, 2443 bp, Heterodera glycines
  Genomic contig location: Contig_ID=SeqID_1475; Location=943..3385; Strand=+
  SCN-specific regions: Sequence locations=1-18,40-80,102-223,246 -267,301-519,562-684,707-1052,1082-1096,1119-1687,1710-1740,1815 -1982,2019-2119,2141-2145,2200-2241,2263-2443
  Gene Ontology: Mol. function=cytochrome P450 activity; Cellular component=microsome; Biological process=electron transport
gtctttcccatttttgtgctttgcttctcttttttcctcgccttttacaacttttactacaaacgcagaaaacttcctccaggttaatttttgttattaaatttgccattttcgttaaatttccgccgtttattttaggcccaattccgctgcctttggtcggcaatattttgacactcatccgaaaaaagccgggcgaagacgcatttttggaatggaagcgaaaatacgggccaatttacacttattggctgggagaaatggtagaattaaatagaaaataatttaatttaattaattccttccccttttagcccgtcgtttgtgtcgccgactacaaaaatatcgtcgaagttttccgcaaaggcggcgaagaatttacgcaacgacaaatttttgtggattttacgcacgaattcagaggcacaagccaaacataagcaaagaattttaaagatttaatttgctttaggcaatatttatggcattttcttcataaacggcgacttttggaaaggttttaatttaacttaatttttaattaatttatttaagttaattgactgacattaaaattttattcagaacaacgaaaatttgcgtccacagttttccgtaactttgggctgtacagtaatttaatggagaaaaaagtgagcattgaaaatcgaagtaataaactataaaattttcaattttaaagattttggtcgaactcagccgaatgttcgaacgaatcgaccgcaaattggcaaagagtgaaagcagcgaaatcaatctgatcgaagacgtcgaaatttcaattggatcgatcataaactgtactctctttggctacggttacgacaatgaggcaaaaattcgaatttattttttggttttttatttattttgttttttaggaacgaatcgacgaatttcacgaattgctcgcacttttcgacagcgctttcaaattggcatatgaaaagaatttgggcagtcttttctcaactttgattgtgtgctttccgaattcaacaaaaaatttgccattttttcggtttaattcgaaaatattttaaaaattatttaaatatttcagagagcgatacgaagctctgatggaagtgagcagaaatctgcgcaacttttttatgaaacgcattcaaaaaagagccgaacaaatcgactttaaagtgagtgaaaatgagaaaaaagagaaaatcggagaattcacagagcgacgaatacgacgattttgtggaggcatttttgaaggaaaaggaacgattggacggacagggcattgcgcactcattttcgtaaatggcaattaactaattgagactaattagacaatcagagaaaggaatcccacccaattgacagaatggaccaattgtggaacatttgcatggacatttggattgctggacaagtgagcaaatttaattaaattatagaaatgcgaagtgcatgccatgaaaatgcaatttgactgatgccaaattcggaaatgccttaggaaacgagcagtacaatcatcgcctggggcatggcgcacttgctgaacaatccgaagagtttggcgcgagtgtacgacgaattggacaaagtgatgggcgacgaacggcgactgatcaccgcgggggacaaagcgcggctgccttacacaaacgcaacgataaatgtgacggaaaatgacaaaaataaataaataaatattacagcaaaaatatttaaaaagggaaaggaagcaaaaataaataattaatttaaaatgaaaaaataaaataattattattttatttgtttaagccaaactgtgccattcccttttaggagtttctgcgcatttccaacatgatcgtgcagaatgcctaccgacgtgtattcgtcgacgtgaccattggcaactttcaaattcccaagggcacttgcattttgccacaaatttcggtggttttggccgatgacgaagtaacaaaaagacaaaaaagaatttaaatttaaatcatttaaattttaaaaatttaggtatttgataacccgaaaatgttccgacccgaaagatttttggacgaaaatggcaattttgtgacatgcgaaaaactgattccattttcagttggacggcggtaagaaaatttgaaaaattcaatgaataattaaaattacaataattaaaatttaaaaaaatcattaaataattttattgctttgtatggtttggaattttagaaaatgttttgccgaatcaatggccaaaatggaaattttcttgttcactgcaaatattctcaatcagtacagagtgcgtttaacaaccaaagaaagaatattaaaatttaattgcatttattttcagctttcggttggcaaagttttgccctcaatcaaacgcgaaatgggcataacaattcattgtccgaatttcgagtgccgagttgagaaaagaata

SEQ ID NO: 73771 - DNA, 1437 bp, Heterodera glycines
  Genomic contig location: Contig_ID=SeqID_1475; Location=5182..6618; Strand=+
  SCN-specific regions: Sequence locations=1-22,136-221,243-537,565 -639,662-1437
atggaagagaaaggagaaactaaagagggagaaaaagaagaattggaagaggaaaaagaaggggaagaagaaatggaagaggaggaaaaggaggtggaagaggaggaaaaagaagcggaagaggaggaaagagaattcgtaatgggaggaggaaaagacggaataaagttgcacaacagtgacagaacaacataaattgtaaatggcgaaggtgtgaaagttgaagcataagaaaaaagaacactcattcattgccagaaacgaataaagtgatgagataaagcattgatttgtagagttctcaattaattgcctaataaaaaccatcataaccctttaaaggtggcattgggctatcctaaaatttttgtcgtctaaatttttaagaaatgactttgcggttttcaagctgagatttttttgttaaatcatttaattttaatgacaataaatttagaaaacttagtttgccgattgtgagaaaagaattttgtgagtctcttaagattaaaaatgtacttggcaaagtcgaggtcatctgttattttttgtatatttaaaattggcttaatgtcagtttttaaaattaccttcccttttcattagtcccaaagtttggggcctacgggaaacgcatacaaaatgtttttctaaaaccaaatcaaataataagcaatcaaaaaggattttttacgcaatgggtgatcataacccgacgacttcttcagcttcgataattccagacgattcaccggtaaatgtacaaaatcctgaaaattcagatagcatttgattttaaggtcgatgaaaaagatatgccggcaacggaccgcgcgattgaaaaactttttgatggaattgacgcaatttacttcatggaaaacggattcaaagcgattgcgcacgaattggaagtgcgtgccaattggaattcttacaaataaacataaaatttttgcagtagatttagttaaatttagaacaattttagaaactttccgccatttgttccgaattggaaattgacgagttggaaagggaacggtttaagcttaaacggcaaatgcaaattgtgtcgaggaaaatgtcggcgttaatcgtcaaaaattcgctgtctttcaatcgacaagtggaaaattatgaaagtgtccgaacaaatgctgaacatttgttacgaataacgaggcgaatgcgaaggtgcgaagaatgaatccattcggattttctctgcaaaaatgcgccgtattttaagttcgattgaaattgggaagagaaagtgccgtgttttggcctccgttttggcttccgattacaaaagaaggctttgtttggtggtgaaacgcgaattggcactgatcgccacgctgcgcgacagtgagctcaaagcgagacaactcttgcaggcactcactgcttttggcttcgaatcgcagttta

SEQ ID NO: 73772 - DNA, 348 bp, Heterodera glycines
  Genomic contig location: Contig_ID=SeqID_1475; Location=6951..7298; Strand=+
  SCN-specific regions: Sequence locations=1-348
atggacgcagcatttgctgaacaaacgaaactgttcaacttggaacgctacgcacttttgaacacggccaatcactttctcgggaacactgaagtcagtgaaaatcatttgaaaaattagttttgattagagcggcgacttcttcaaacaattaattacctcttccttttgcagttggtctctgttaaattgagaaggcatttcgaagggtcgctttgcgatgcgtcgagaatggccattctcgactcgttgacaatgcggacgaaccccgaggggacaacggaacaatcggacgaacgcacaatcgacaatttaccatttgaacaactttgtcaggtaaaagtctaa

SEQ ID NO: 73773 - DNA, 1014 bp, Heterodera glycines
  Genomic contig location: Contig_ID=SeqID_1475; Location=7476..8489; Strand=+
  SCN-specific regions: Sequence locations=1-127,162-450,481-775,797 -1014
atggacgaggacaaattggcactgaaaaatggacaaaaggacgacacggggggaagggaaagcgaaaacagtgacaaacaggaggagcaatttgcagaagacaatttcgacacgaatccgttgggtggggctttttattattttcatttgcactttaaatcattcaaaaatttaaaaagcaaaaagcgaccccctaattaaaatagttcaaatgaaaggaaattaaagtcatttgaaatcaaaatataaaaaatgcccaaatacatctaattttgcaatttcattgtttttagttgagaaaggcgttatgcaaaagtcgctcattgacaatgccttcgatgtgttcgaatgcgcctcccaaaatttgaattgtcttttggccaatgccgagatgagtgccatcaaattcgaccagttcatcaaagttgttgagttggcggaaaggtcccatattttatcatttttattttgaatttgtaaatttactatcaataattattcaattaattcctcctcatttccatttgctcagattccggaccttcggtcgccaatattttggcaatccgtgccaactcatccgacacactttgatggaccaatcgcgcaaatatattgagcgataccatgccgagaaaatggaggaagttaaaatgtttttggagagcgaaacgttcactctttgcccggtgcccgtccaattcacactgtttgaccttccggtgagaaagaattggtcgtttttaagtcaatgattgacacttttgacggggttttccctaggttttcccaatggattgcattttaaaaaatgcttttcaaatttaggaatttttcttcctcaaagagttgcaacagaaacagcaaaatgatgaacaaacggaggaagagactgaacagaactcagtggagacatttgtccacggcaaatccatccgtttttcggtgtttcgacattcttcggaaatggacacggaaatattcccttattcgcctgaacaattcgacgaaagt

SEQ ID NO: 73774 - DNA, 1545 bp, Heterodera glycines
  Genomic contig location: Contig_ID=SeqID_10537; Location=1599..3143; Strand=+
  SCN-specific regions: Sequence locations=1-34,187-326,447-513,535 -549,729-756,778-1278,1300-1308,1330-1476,1508-1545
  Gene Ontology: Mol. function=ATP binding; Biological process=apoptosis
atgggcaacattttcgggaagagagagcatggacgaaggagaagaaagagtggggaagagaaacacgaagaagaggaaaaaagcggaagacggaatgaacggatgggagagggagaaggaagagacgatgaagaagaggaagaagggggaaatgggagagaagaggaggagaggcaaaaggaagagatagcgcaaagggagcaccagaaaaggagggaaggaaacagtaaaataccgaaatgtccacacgggttcagaccaatgaattatcccggaacccggtggacatttttggagtgtgtgatggatgaagaattgaagttgatgaagaggaggaagaagacaaagagaaggaagcaaaaggacaaaaggagaaggagtaagaggaagaaaagaagggggaacaaggaatgggaagatgaggtggaagaggaagaagcagaggagcagcaaaaaagaggcgacgaacggcatcaccgccagcaaagtgaaggggacacggaggtcgagtgggagacagaaaggaggaaagagggaacagtccagcacaaaagaaaaagggaggaagaagaagagactgtccagcacaaaataaaaagaggggaagaggaggaggaggaagatgagacggtccagcacaaaagaaaaacagcggaagaggaggaggaggaagatgagatagtccaccccaagaggaaaaggggcgaagaggaggaggaagaggaagacaaatcggcagtctgtccccgttggttcattcaaatgtcgaaacaataatcgtaaatatttgatttttaggcggctcaatttgtttaaatgcgcgggatgacccatttgggagggcgttgtgttgtgtgaagagggggaaacatttgaaagattacaaattgggaatggaagagatgaaggaagaggaggacaaatttcggaaggaacgaaaggacggcgatgaaaagaagcgaattgaattggccaccgaaatgccaacagcggcggtgccaatggcatttaagagaagcaccggtaaggcacagagagagagagagacattggcattacaaaaatggcattctgtagaccaggcatgcccttttctgatcgcgggacgcgtttgtcagcccgggtctaccgacatatgtgtagaggacggctttttctgtcagtacaacaaggagaggagggcattcgtttgctgcacctttaacgaagctgacgtagaaggcgagcaaagcgggcggaagagaaaagaaaattaaccaaaaaaagtaattaaaatgcaaatattaaaaaaaaaaatttccacaccaatgctgccattgtaattgatataatttagtttaaattatagctcggaaaaaaacttggtgagcggttggtcgaaagttccttgagaggagcgggatcccttaaaaatcactctctcctaaacccagtctatttttgacgggagtcaagggcgggtgcgggagtaatttgttatatatgtaatttataaaaaatattttatgctcaaattttgaaggaaaattcttattaaagcaaaaa

SEQ ID NO: 73775 - DNA, 2032 bp, Heterodera glycines
  Genomic contig location: Contig_ID=SeqID_10538; Location=272..2303; Strand=-
  SCN-specific regions: Sequence locations=1-71,93-415,439-656,678 -1577,1599-1638,1660-2032
atgggcctgatcagtgagaacatcaccgaaattctaaacggacgccatggcataaagcatccggaaacgggccaagaagtgaccctgctggaggccatccaaattggcctgtacgatcccgactcgcgccagctgcgtgacatcaaaacgggcgaactgctgtccctgttcgactcgcggcacatttgccccaccgatgtgcagcaccggttgatcaaaatgggcgtgctgaagctgccgcccatggagctggagcaggctttgaagaatggtccgcttgaggggtgtgctatgtcaattagcgcttaattaggcgattagaccagacctattaccaaatggaggggattaaaggatgaatgtcgaaaagtgatcgccgatttcctctgatagataaaaaaatatcagaaattcgttgtaatactaaacaattggaaaaattataacccgcatagaaatgctgatcattctaagtttttttttgcccgttttaggtgtgttgaacccaaccagcggcgtgttccgcggtaaatatgtgcaggatcccatttcgctccgcgacgcgctcgcccatggctacatccaatttccgagtgcgcagccgctgctcgcactgacgctgaccgactgcatcgtggacggcttcatcgacgcacatgccggcgagtttgtggaccgtttcggttcgtccggcgagcgattcacgctacgtgacgcgctggaccgccaacgaccgctggtcaaggacaacgtgcgcgaatgcatcaacacggcgaccaaccaacggctgaccattgcggaggcaatgctagcgcatgcgctcaacccgcgcagcggcaaattcaccgacttggccacgcgcgcggaactgtcgctgcgtcaagcgtacgaccagggactcatccaaaagtcgcagacgctgaccgaagtggtggagaagggactgctggatacgcaggggcacttcagcgaccggggcaaccgcttcacgctgatggaggccatcaactctggactgcttgacgcggaggtgcggcacattgtgtcggagcaggaccaggaagtgatttccatcggggaggcgttggagcgcggcctgttgtcgccggacggcaaaattgtgctgggctgggccgcagacggggcgcacccggagcgccaactggacttacacgaggcgcaccgccagggcctgttgacgcgccgcgcacggcacacaatctttgacgtgaagggcgtcaaaaacgcggagctaggcaccacgctgagcttcaacgaagcggttgaagctggaatcatgcaggtacaggaggagattttagacccaaaattggcattttctcaggtgcaaaccgagcgggttttggaccaggcggtacgccagacgttgtcgctcagcgacgcctcacgccaagggttggtcgactcggcactcgccgacatcctgatggcaccttgcggcttgtccgagggtggcaccgaagtgtcgctgatccgtgccgtttccaaggtggggcattggcattgtggcacttttcactttttttttcttggtttagcatattttgcaatttctattttagttttttcaaaaatttctcaattgggacctcgaaaaatttggtttttatgaaatacaatttttaaaaataaaaatttcgcaaaataaacgctctttttcatccagggcctcgttgacgcgtccaaaggcgtggtggtcgacccgcgcttccaacgcgagctgtccgtgcgcgaggcgtacgaccgcggcatgttcacctcgcttcgctcggccatgcatctggccgcgctgctcgacgtccatccgtcactgatgacgcccgtgaagaagaagccgtactcgaagaagcgtatccaacgcccgggccagccagcactggcagaggaccaagtgaaggtagacgagagatctctggcactcgggacgacggcttattggcacttttttgggattaataagcttccccgccttcttgattcgtccacaatcatggcacaacatttagactaa

SEQ ID NO: 73776 - DNA, 1433 bp, Heterodera glycines
  Genomic contig location: Contig_ID=SeqID_10539; Location=202..1634; Strand=-
  SCN-specific regions: Sequence locations=1-288,315-357,379-497,529 -803,826-1006,1029-1220,1242-1433
gcccaagagcaacgacaagctgagcgtgtggaagaggtgcacgagtttcagccaccaccaccggtgattccggaaatgccgcgcatcacggaacatgaggaggaaccccaaatgttccaggaggttggtccagaggggatgtatgatgatgatcatgaaaatccagcaaaagattcatgtcccctaatgtgtaactgttactgtattagtcttactgtaatgatcataaatcttgatcaaaatcatcaagttttaactgcgagtgattggaaagtgggatggatcatttaaataattttgagaatttcaaaaaaggtattgtctgggatatgattggagaacgtatccgaaaatgattagtgattataggtgatttaaaaaaggaaatttagtgggaatcgggggattttgggcaatgaaatgtttggggattattgtccatgaagaaatcccaaaaatgtccttaatatcatggacttcaagggttgggatatatgaaataattccaaaataatttcttcattttccgcaggaaaccgtcacaaagacccaattttacgagatggaaggcattctgcacaagcaaacgggcgaaattctcacctttgttgaggcaattcgacaaggcctgctgaatttgagtgcgggcggcgaattctttgacattgtcagtggccaaagcgtttcattggacaaagcggtgaggaaaaattggattaaaatgtggcttgtgattaattctagagcattcgcggatctaatgatagttcgagagtctcgacttatagaaaatttacattcataacaaaatattttgttataattctataagattttggatttggtcctatgtgttttccttttaccattcagaaaaacattagtgtttttgaacttgaaattttaaaaaaggaaaatacagaaaaattttctgtgaaaattttggaaagtatttttatgaagatatgcaaaaaaatttctactttttttgaaaaaaaaaatacaaaaatgagagggagcgaggggactgaagtgccccctgtttttcattcatgccattgattcacggattcttgattctttggaaattcgaaaatttacgagaaaatatttttgattgtaaaaactttctatgttttccaggtagacatgggcctgatcagtgagaacatcaccgaaattctaaacggacgccatggcataaagcatccggaaacgggccaagaagtgaccctgctggaggccatccaaattggcctgtacgatcccgactcgcgccagctgcgtgacatcaaaacgggtgaactgctgtccctgttcgactcgcggcacatttgccccaccgatgtgcagcaccggttgatcaaaatgggcgtgctgaagctgccgcccatggagctggagcaagctttaaagaatggtccgcttgagga

SEQ ID NO: 73777 - DNA, 401 bp, Heterodera glycines
  Genomic contig location: Contig_ID=SeqID_10543; Location=1413..1813; Strand=+
  SCN-specific regions: Sequence locations=1-185,207-224,248-333,355-401
atggcggatgaacaagaagaaacgcaagtcgctccgcctcagccagttttacacacagaaaacgtctcttccttcttggatttgcaaaccgagttcatcaaacgtcgcgatgccgccattgcggggaagtcgcagtcattcgccacggagccgatgcaccggcgcactccacgaaataacattttggccataagcaaagaggaaaaggcacaagtttttaagtgatttaaatttaaattaaattttagaaagcaaaaagcgaagtttcaacgctaagagcacagcgaattcgtcaaaatgaggaagcaatcagaaaagaggagcaacagagggccaagcagcagcaaatccttcagcaaaaggcggcaatttatgaacgaatggcaaagggcgaacgattg

SEQ ID NO: 73778 - DNA, 886 bp, Heterodera glycines
  Genomic contig location: Contig_ID=SeqID_10544; Location=1173..2058; Strand=+
  SCN-specific regions: Sequence locations=1-231,253-553,577-886
atggctgatccaatcgactcgaaatattttgattttgtgccagccactgaagagcagcagggtaatggggaaaatcacaataaaaaggaaatgcaattaaaataaatgattgaattcaagaacatacattaaaaaggaacaatgtgccaaagggtaaaaatgcgacagttttatgcaaaaaattctaaaaaaggcagtttattactatttttattttacaaaatttacgggttgaaaatctgtaataaaatgaataacgattttcaaaaaaattccaccggcatcgcttatgatgaatgatctcagcaaactcgctttatctttgaaatcctaaaaatgttcaaatggttgaaaatttaatatctaaaagattctcaaagattttcccatcatgtacttgaaaattaaaaactgagtttcatttaaatgggtatttgccaaaacaggcacttctgctgatgtgttcggtttgggccaatttgtgcccagtggcgccgtggtgtcgtcatcatcaatcggtgctgctgctggtgatcatcaacagcaacaaggacagcagcaacagcagaacacggcgatggtgggccaatttataaaagaaacaaaaaatggtggccaagaaaatttaaatcatttttaaaaatgacaaaaaaacaaaaaattatcaagcttgaattattaggtttaaataaattattcttcgaattgttatttttagagcccggaattttgaagattttgggcttgggtatgggcttagacaattgaccaggctagggctgccctatcaaaaaagcccgtttaaccgagcttcccggtcccaaattttctggggcgcccgcctggctcgggctttttccataatttgtggaagtttagttataaa

SEQ ID NO: 73779 - DNA, 180 bp, Heterodera glycines
  Genomic contig location: Contig_ID=SeqID_10544; Location=2616..2795; Strand=-
  SCN-specific regions: Sequence locations=1-180
atggaagccgctcaggcttttgaaatgccaaaattaggcttgctgaattatgccttgatttggcttgaaggttgtgcagaatatgccttgatttggcttgaagattttgcagaattagccttgatttggcttgatgatgtgcagaatttatctgctgctgctgactgcgccaaaattgtt

SEQ ID NO: 73780 - DNA, 1621 bp, Heterodera glycines
  Genomic contig location: Contig_ID=SeqID_10545; Location=722..2342; Strand=+
  SCN-specific regions: Sequence locations=1-167,189-289,315-691,713 -907,929-971,993-1271,1294-1621
atgatacgatctctgaaaaagtcaaagtttgagggtcggataaaaaactttaaatgttccctaaagcagacaaattccgaggacaacagaaaacattctgatcattttgatgaaaaagaaaaattgaaaataattaaagaatttgacaaaaggagagaaatattgaaaaacaaaaacatttacaattgtaagcagcggaggctaattgaacgagaaattgccagggaattggggacataccttcacaaaattgaagaatggaaaagggaatttggactgataaaaagggcaaaaaaggaggacaaagaaacaaagttggcactgattgaacagtttgacagaatgaaaaatgagcgcaaaatgaaaaagggatacaaaaatgccgagaaagtcggcattgaatgtgaaattgccaaggaattggggacacatcggaacaaaatttacaaatggaaaagcgaattattaagtgggtgaaatagtagtgataaatagggattcgttgtttaggcacaaaaaatgtcgtaaaattggcatcaaataggcacaaaaataggcaaataaaatgttttattaatacatttttaggtagcaaaacaaataaaaaattaaattttagaggatcaatttttgggaaaattttcaactgcattttttttttttggtcgatataggggtgtatttttcttctttattgcatttttaaaggatttttccggaaatcctggaaataggaaccaaaatggcaaatcgaataaacaatttgaaatgtaaaaagtttattctttataggactttttgacattgctaaaatgaaaaaaataaaaacatttagtaatttgagaatttttttaggtccaccgacaaaaaagttttcaatgcagcaaagaatggaaattgtcgacacctttgaaaaagtgaaagagttatttgtgaaaaaattcaattttaaaccaacggtagaaattgaagaaaaaattgtggaaaaatttgggatttgcagacggtcaatttatatttggaaaaacattttcgagctgcgcatttgccgtaagaaatttttaactaaaaaatatatagttgctaaaaactgccaaaatcatttcttaggggtgcattttgaaaaattttcgggtcgattcttaggggtgtatgaaaatttttttaggtcgattcttaggggtaaatttttcgtttttacataattgcatttttgttaataattttgggcaaaactccaaatagtttaaaatagttttcaaattttttttaaagtttttaaaaatgtaaaagactaaaaaatggagccctaatcatgtaaatctttttttagcgaagcataaatactctgaagcggaaaaattggaattaattgaaaaattcgacgaggccaaaagcaaaaacccaacgataagcgacgaagaattggaaaaaatgttaccggtcaaaatttccacgataaaacaatggaaaagaggcaccaaaagaaggaaaactgtgaaactttaggctaggctttatcccagagtggccaagtgtccttatttctaagatttgtccttattgggaggtgccattttggcacgacctccttgctttgtgcttattcttggatttgaaa

SEQ ID NO: 73781 - DNA, 1337 bp, Heterodera glycines
  Genomic contig location: Contig_ID=SeqID_10547; Location=153..1489; Strand=+
  SCN-specific regions: Sequence locations=1-76,98-172,194-225,247 -424,450-452,497-557,595-1203,1225-1235,1257-1337
atggtgctgcttttctctgttcttctgtttttgctgtctctcgtcaaaattggtgattttaattaaattagggtaatgaattatttattttcttattattttcaacttgtgctgctaaatgggcgtcaaaatgtttcgtgggctttcatggcacagtgccggacgaggcttttgccaaaatgttatatgaaaagttcggaataattgccaatgccgacatgaaagagaaggaatgcagtggcaccactaattatcttaagcctccatccaaccgctagattgcttttgaaacggctgcctgtaaggaattggtatgcaaaaaaggtgaattaaaacacttgcaaatttcagttaaatgaatatgaaaagaaattaaaattcatcaaaagtaaaagaagaataaaaagaaaacccacaaaaaacgtttaaaataattaaataattaaaaagcgaaaaaatcttaataaaattgttttacataatcaattaacaattttcttaataccattcgaaaaatattctctatgaatctataaaaatttcaaaaatttcgttggttataaaaaagttaaataaaatcatttttttaaatttccaagtaacttttttttgtacttaatataattttttgattatatgtgactatcgaatgggtagtaagaatgtttgatttagttgactttgaaaaaacgatgacgacttttttgtcaaaaaacttcaaatcgttggcaaaactttggcccaatacaaatcgtcctttgcccccccccccccccaccttaaaagattcagaaattaaaaagcaaaagcagatttgtaagttcagatccgaaggatgccaaactgttgttcgtgttcaacatttgcaacaaagtggacctggccggagtttgccatggggaaaccttgataaattactgcaacgaggcgaaacatcacttgtgatgccgttaactctgtgccgttcgttccgttcaattcgttttgacatttttcggcatttttctgctgcatagttttgacatttaaattttcattttttgatcatctttttattttaattaatgttcgtttcgctctgatttactatcacagttaaagtcagatcggttttacgggaagtggtcaaaccaaggaaaatttgactgtcccaaatacattctacgaatttattattaatgtttaaaaaacatttccatttcgttatgttttccttctctccatcgctttttgattcatcttcattttacatttttacaattgtgtcatccaagcaaaagcccttcctttttttgtgattcatttcttccatttccccgttggttatattctcccga

SEQ ID NO: 73782 - DNA, 66 bp, Heterodera glycines
  Genomic contig location: Contig_ID=SeqID_10547; Location=1570..1635; Strand=+
  SCN-specific regions: Sequence locations=1-66
gggtaaatattgatcataggccccaaactcaaaaatgcttaaaaacggtcagaatcgatgtaaaaa

SEQ ID NO: 73783 - DNA, 305 bp, Heterodera glycines
  Genomic contig location: Contig_ID=SeqID_10548; Location=49..353; Strand=+
  SCN-specific regions: Sequence locations=1-305
atgttcgaaaactttcttattttgaccattttctgttgctttgcaaatgccattgcccaaggccaaaatgtaagcaaatttagttgatgaaaaaatggaaacaatattatttgaattgttaaaaaattgtaaattgttttagggttattactgtcagcaggttggcggcttctactcgtgcataagctgcaatgagccgtcgctcgtcaaactttgtaaaattttcttacccgaaaggcccctgggattaaaaattgaaatggcttttttcgtttgtttgctttcataattacaatacttaatga

SEQ ID NO: 73784 - DNA, 617 bp, Heterodera glycines
  Genomic contig location: Contig_ID=SeqID_10548; Location=413..1029; Strand=+
  SCN-specific regions: Sequence locations=1-287,336-366,388-437,463-617
atggcggatcaaaaagtgcaaagcattaaagacgaacagcagcagcagattgacttgacgcctgccgcacaccatccggcacaacagcagcacatcactttcacattcaaatgccatccgacaaatgaaagccgaggagaaaaagcggcggaggacggcgaagcaaaagcaatgccaattggagttgtggtgagttatgccaatgttgtcctttttgcccaaaatgccaagtcggagcttgaaaatgattaaaaatgaaattaataattaagggcaatcatttcatcaatatatgaaataataaaattaaaaaatcattaaaaatataaatttttctccgttgacgacacattactccaaattatgaaaaataaccaattttgctgaaggtctttgacttataatcccatttctttttcttttttttttggttttgcaaatttttttaaattattttaatttcactggttatctggtaattaaaataattaattgttttacaatattctcagattctccttactgttctcggtgtgctgctcgtcgaggccatcgttggctttttggtatttttgtgcatttcgatgagaaaaggcatttgaccgatggacagagaa

SEQ ID NO: 73785 - DNA, 105 bp, Heterodera glycines
  Genomic contig location: Contig_ID=SeqID_10549; Location=230..334; Strand=-
  SCN-specific regions: Sequence locations=1-105
atgacggatgaggagaagcgggcggtggagcagcgtctgagccggaagaagaagcagctgaaggaggaagagacaaagctgcaaaaggcatggaaatttgtgaag

SEQ ID NO: 73786 - DNA, 341 bp, Heterodera glycines
  Genomic contig location: Contig_ID=SeqID_10550; Location=220..560; Strand=-
  SCN-specific regions: Sequence locations=1-341
atgttttttaatttttttgcggatttggggcagcaattgatatcaatcagtggacaaaccggaggacaaatagggcgacaaatcgtgggacaagtcgggggacaaatcgtgaagcatgtcggtggacaaatcttgggggatatcggggaggtagtccaatgcgcggtacctctgacatcgggacactcgtggctggcggaactgtcgcagttggttgtaaggccttcaaggcttgggaggtaaaagttgtaatttccaaaatagttttgctgtttttttcaaaattaatttattgaattttaattcgttgttttagggtaaaggattttaattttgtttaa

SEQ ID NO: 73787 - DNA, 286 bp, Heterodera glycines
  Genomic contig location: Contig_ID=SeqID_10551; Location=733..1018; Strand=+
  SCN-specific regions: Sequence locations=1-133,156-213,243-286
atgttttttcaaaatccaattggtaggtttctgcacaatacacaaatgtgcttttcttttttaaatctcataaatttgtaaattttatgatcattccgattaaggcatttgagtttattcactttagtagtaattttcagattattcatcagaaaagtttcttcttaatgatttttattaaaattatcttttccttcattattcctacaagactataattaattattttactattattttttgttttgaccaatgctgtttttatacgaaatttattatcaaaaaa

SEQ ID NO: 73788 - DNA, 884 bp, Heterodera glycines
  Genomic contig location: Contig_ID=SeqID_10552; Location=292..1175; Strand=+
  SCN-specific regions: Sequence locations=1-32,57-122,320-455,499 -528,596-619,651-884
atgttgaattttcaattcaaaggtcggtctacataaatttttatttatttactattcttatcaaatgtgcattattagatgagtaacaaattatctattggtctatgcggtaattttatgagttcattcttatttataaaattatttttttggaattataattttatttatatttttttaatttttttatataatctcggcatcttcactcagtcttaatatcattaatttttctatttttttagtatattttaaatattttcagttttatttatttgtatttttgaggtttaacattgtatttttatcattatctttaataaattcgttctgcttttccttttaatcttgacatcgtgaggctcttctctctcgcactcttgagccggaagtgttgttataatatgcatttgtaaaaatttatttatcacaatatttctgcatctaaaaacctctaaaatttaataaatcaatcattatttttttttgtaaaattttggaagtcttgaattgtcataatttgcaaacattttttctattttaatttctcatttaattaattttcattactaatgtataaaattattttattttacacatttattcagcttttgattacttattttttgaattttattataaattaccttatgtatttaaatatgcatttgaagtttggctgtccataaagccatgtcggaaagccgttctgcgctcgacgctcaaggcttttggagtatttactaatctagatctttattaacttctttatcttaatgataaaaaaatatgaatatcaatttttggtactttcctgttttgaaggcgcacaccatttggtacttgtacatttacacctcataaatttttttttgtttttaata

SEQ ID NO: 73789 - DNA, 1333 bp, Heterodera glycines
  Genomic contig location: Contig_ID=SeqID_10552; Location=1278..2610; Strand=-
  SCN-specific regions: Sequence locations=1-73,207-321,354-454,477 -548,570-727,892-972,1094-1213,1235-1333
atggccgaagaagaattttgcagtaagctgttgtacgatcaagatgacgatgagaaagccgcggttaacattgaaaataaatcaaatatataataaagaaatatttataatatttttaattaggtttctaaattaaaatcaaattcataaaatttttaaaaataaataaacaatatatgtgtttaaaaaatcaattaaaaataaaacagaactatgataattaaatgaattattttttccaatgacagagagtcagagtgcattaaactcattaattagctttataaatgagatgccgcttcgaacaaccggcacgaatacatttatatcaaaatattatttttaatataataccattgatttctaataactgtgaaaacattaattactttgaataggtcttaataaccacaaggaatgaagataatacaattgaaaatgcacccaattcttcgaaagaattcttatgaatggtttcgaaggtgaaaaagcaaggtgattgaattgaaatgattgattgcctcaaaatcgaatcgcattttttgttgaatatttacaattatattaaaaattaagaattcaaactaccgcatatgctctaattatcacccatggggaattatttttaaaccactcagaaatggggggataattggagactgcgggattaatagagactgggcgataattcgagcatatacggtaagtaataaaggccaaagacaagaaataatagaaaattttataaaattcatatgcatttttaataaataattaaataaaagtttaaaacatttttatacattaaaaaaatggaatataaaaaatatacggaagtaaaaaatatatttaaaataatgatttaaaaaatgaataaattctataaaaaatgaatttcataatgcattaaggaataagaaaatatagaaaaccaacaaatcagcttttcaaaaacttggagaattcagcaagaaaaaaattaataaatataataaattaatttataaactttattaaataacaaaaaactttaaaatgcataaaattacaatcatttaaaataaaaatgaaatattaaaaataaaataattttgaatgttgaaagatggctcacaaatgaaacaaaatattgactcagagtactaaaaaatcacggtcaaaccaggccaatatattttttgaattgcacttatcatttcattttttcaggcagaaaaaattaaataaattaatagtgaatgctataaaactacaaaaaagtgggtactttcctgttatgaaggcgcaccccacgaatatgatgtccatttcgacccattcagatctcaataaa

SEQ ID NO: 73790 - DNA, 1784 bp, Heterodera glycines
  Genomic contig location: Contig_ID=SeqID_10553; Location=316..2099; Strand=+
  SCN-specific regions: Sequence locations=1-415,437-437,459-631,662 -780,816-992,1023-1294,1320-1354,1377-1611,1638-1784
  Gene Ontology: Mol. function=GTPase activity; Cellular component =nucleus; Biological process=small GTPase mediated signal transduction
atgatggaagccgaacacgcccgcgatttgacccaaacatttggagtgtttacactcgaacactgcaaggcgatgaccggacgaataaccattcagaagccgcgaacagacgcctacaatgcgcatttgcctgaaaacaaccatcgatttggcatttcattgaccttctgcgaaaggatcaaaagttatcagatgatgacttcgcgaagtgttcaactggacaagaaccaccgcaaaaggcaaagaaatatcgtgaagcagaccgccgaattctcacgatggttcaaaattatttgccacttaacaacgcagacaccaacattttcccaattcatcaccctttcaatcatctatttatcattacatttttgatcggaatttctcgaaattatgaaatgagaccgtgatttgaaacaaataaattttttaaaattttcttggatttttaatttcactgtctttttaaacttttggtatggaaatggcccaaatgcattggtagggaattggcggtagggaatcggccggtagggaatcggccggtagggaattggctggtagggaattggcggtagggaattggcggtagggaattgggtcgatccctcggcccagactttttagaatgttgatataaatttttctttttcatttctttaatttaccgaccactaatgtttcagttatatgtatatactttttccttaattttccattccatctctttttggtaattaaataattaatgtgaattagcgtcgatcacctgattccaccgactttattattttcaaattatatacataaaatattttcctctcacattaatttggtggactaaataaaatttaggtttgggtatttgacgtggtgtttaaagggcgtggcaccattttcgattgactttgtacaaatcagaaataaatatgcaacaccactccaatcggttgagcggtgcctttaacggattggccatcgatggcggcagaacggccacactgtcacaacaacaaatccaggcaaatttaatttttacgagtaactcttctctggcatttcggttcatttttactctcatttttagacagaaatccaacgttttgagtcagttcatccgcgcatttatcaaatttatgatttgctgaagaaattgcgttcggaccaaagcaggcaagcggaactcattgaacaaatccaagagcaagtgatcggcattgaaggtgatcgatcatcgcaattttttgattaaatcccaaaatatgaactttccatcattttttttaattttcagatgcatttgtcaacagccaagaatggacaattggcaggacaattcacgaaattcgagtggtaattgtttgttttgtttttataatgaagttctcttttacatttttgaccattttactccgaattacagggagtaataggttcggaggacagctgcaaaaactcactgattcactattttctgacgcgcaattggaactgggaggatgcgcctgaaggcggacgcttcaaaaaggaggtgttcatcgacggactcagctacctgttgctgatcagggacgagggctctcgtgagccgaacatacaggttgatttgaattctttaaaaatatttgtttattttacagtttgcccattggtttgatgcgttgctcattgtttttgccatcgaaagccatcaaagctttaatgcggcacttgaattgcacaaaaaagtgcattattttcgtccgttagattcgaccgatgtgccggtttatctgatcggaatgagg

SEQ ID NO: 73791 - DNA, 291 bp, Heterodera glycines
  Genomic contig location: Contig_ID=SeqID_10554; Location=643..933; Strand=+
  SCN-specific regions: Sequence locations=1-239,270-291
ggcgagagtcgatggatcagcattggcctcgctctgtcaacgcccacctcaacaatcacgccagtcaccagcaacttcaacactcggtcggctcgccgtacatggtcgcctccatcccctccacgccctcctgctccgcattggtcggcccccattgtgccgttgtcgaacctttgacgccgtcggccatttcatccgcattcagtcacaacaatttggccacaaccgctgcacatcaccagcagcaacacaacaacagcaaccattatgcaagttgcaacagcaccaatg

SEQ ID NO: 73792 - DNA, 169 bp, Heterodera glycines
  Genomic contig location: Contig_ID=SeqID_10555; Location=844..1012; Strand=+
  SCN-specific regions: Sequence locations=1-169
ggcgagagtcgatggatcagcattggcctcgctctgtcaacgcccacctcaacaatcacgccagtcaccagcaacttcaacactcggtcggctcgccgtacatggtcgcctccatcccctccacgccctcctgctccgcattggtcggccccccattgtgccgttgtcg

SEQ ID NO: 73793 - DNA, 409 bp, Heterodera glycines
  Genomic contig location: Contig_ID=SeqID_10558; Location=853..1261; Strand=-
  SCN-specific regions: Sequence locations=1-267,300-409
atgtcttcctcgtgcatcacttttctgatcggtgccacgggaatggttggcaaaatgaccagtgatcagtcggattcggattttttggcatctcttatttaaatttaaatcccaattttttaattgttttttttgcagaataaccaaccgctctcttcgccactgtgctttacttggcccctctccgcgtcccattccccggctttgccaacggacgctttcgattgattcgtttcaacgtttttggccaatttccggtcagatttgataaaattaagaattataaattaatttttaaactaaacacaaacataccatactctgacacttcaaaaaaacagtaactgaatgattatttccgagcagttttttttgatttctgttgacaatctgtgtccgtaaaattaaa

SEQ ID NO: 73794 - DNA, 3287 bp, Heterodera glycines
  Genomic contig location: Contig_ID=SeqID_1476; Location=138..3424; Strand=-
  SCN-specific regions: Sequence locations=1-68,105-149,171-266,290 -330,465-484,520-559,581-634,657-676,751-846,868-883,917-1023,1056 -1081,1103-1145,1173-1198,1227-1232,1270-1435,1464-1486,1560 -1693,1715-1748,1793-2020,...
  SCN-specific regions: Sequence locations=...2056-2074,2098-2194,2216 -2238,2260-2474,2502-2538,2570-2655,2693-2907,2953-3072,3213-3287
  Gene Ontology: Mol. function=delta(24)-sterol C-methyltransferase activity; Cellular component=mitochondrion; Biological process =ergosterol biosynthesis
aattctatgaatctttcacaacaattctttaatttacttctccattttagacgacatgatctggtaagaaaattatcatttttattttttcaaattatttaaatggcaattttttccattttttgtcccaatgtttgcccaactcctcgggttacctgggaaactgagaaacacacacacaaatcgctgcatttatctaacatttatgtatgacattttttggaaagcaacagaaatttaccaacaaaaatcgttaaaattgttttagttttatttgttaaattagatttgttaaaaaaaaattatgttcataaatccattaatttcaactaaaaatttcataaaactttttaaatattaaatcgagaaatttaagtttaaaatatgtatcaaaaaataaatttattcaatatatattaaagtttaagtaatttttaaaattatatttttgaatatatttttttgctttttcgtttaactaacgatttaaaaatacaaaaatcataaatatttattttacaaaaatcgaaagcgtaaaaagccacgcaattattgcgtaaaatcaacaaagtaaagtcgggagaggactgtcatcatcagagcacacaacagcgacagagcgctgcttttctctcccaaatcgattgaataatcaatgttcccaatttcattttgctttttaaaatattattttcaaatttttaactaaaatgaatattttctttttttatgaaaaattctataaattttcatttttccaagttttatgataggcttaatcattttatgagggtgattaggctaatctaacctaagatttaacttagattcccctttcaacatttttctttaaattaagaaaaagaattcgaattcgaataagaattaaaatttattttataaattttttttaattcttaaggtagcatttgtcaatgagcatagtcgtctttatgctgaagcgcaaatcagtggtgattatggcgaatgcattgcacattattattccgtcatgtcaaaggcaaattaaataaaaatataaaaaattattaaaagcattttattacttaattacctcgtcaaaataaataattaaaaaaatctggcgctttaatcaattttatctaattagattaaatgtatgactttaattaaataattctttcaatttcggtaaatagaaagttcgttaatttggaatttattaatctttttttaaaatatttgatcgcttttttcctaataaaatttttatttcattttcatcttcaggtgatcaatgagtatttttgcggcagttttcattttgtgccgcccattcttcccccggaacatcaatcggatgaaaagtcgccatgtttgtgcaacaaatcgtccacaatggcactgcctgtcgcattgcggcaattgcatttgcgcattgggcaaaggtgtggaattgaaaaataaataaaaatgcattatataaaatatttgagggaatttgaaaaaaataaaattttatatgttataagaaaacaatttaatttaagggaatttgaaaaaatttaaattaaatagtataagcctaaatattggataaaaatacattgaaaaattatgcaaaatgcatgaatttttaaaatttacttttctaacagattttatccaaatttggctagagtcagttgatttgtctaagctatgcttcttcagcataaagataaacaccagcaggggatctatggagtttccataattaaaaatgcttaaatttttaaatgaagaaaattaatctttttaaattataattcattttcttacacaatatattgaaactgaaaatgcttaatgattggttaaattgcaaatggtttcaaaaaattcagccttgaattaggcccgggaaagcattgtttggacatcggctgtggcattggtgacgtcataaagaatttggcatttaccggagcccattttactgggctaacaattgccgaaaatgaagtattttaacccaaatctaaaaatacttttcaacataaaatatttaaatttattttaaaaaattattttccttttaggttcacattggaaatgccaactttcgttcgcttggcatcgacaataattgcttcctgcttttgggcgattgcactaaaagttctgcacttcaccattttttttctctctatagtccttacttcattaccgtacttaaaatatttttaaaggacacaattcgtaattcactttttcataaataaaatttaaaatttagctctttctattcaaaatgaaagcaaagatgccgcatttgcgctctattcactcaaatatatgccaaatttgggccatatttttgcggaattggaccgtgtgatgaaacctggtggcaaattgctaatttatgacctgttaaaaacggacaaatttgatgtgagcaatgaaaaacattggtagggaatataaattctttcaataaactttctttcaatttaaattatttatttaaaattattgtcttacattttttttgtcattttaaagcttttaccgattttttgaatatttatttttaatattaaatccattttgtaaatcacttttaattttaaaagaatttctttggattttttttattcttcttttcatattaagctgattttttccgagtttttaaatttaattcttttaattttgaatattttttctgtttttctttaatccattttaaattttagcaaacttctgtccgaacttgaatttgcctgtggcatgccgcccctccattcccgtagcgaactgttagctgaagcagataaagccggcttccaactgatccaagctaatgacttgcagcatgagagtggcatgccattttaccattgcttttcacattcgccgtttttcatgtggctaatgcggtaaaaaaaaattatacacaaaaaataataaataattaatttaattggttttattcatttgttcagttctcggctcacagaaaatttaatcaaagtggcgcaaactctcaaaattttacctcgcggttttcatgagttcaacaaaatttttattagaggtgggcccataaaaaaattttattttttctattttaatgagttttttcaataaaatttattcaaataaatttcaaattaaaattattattaaatctaccgcaatttatgaaattttataataaattttttttaatatttaattattaaggaactgtggtcaaaattgttgaggctggccaacttggaattctttctggctccgaaatattattattttgcaag

SEQ ID NO: 73795 - DNA, 846 bp, Heterodera glycines
  Genomic contig location: Contig_ID=SeqID_1477; Location=354..1199; Strand=+
  SCN-specific regions: Sequence locations=1-277,299-302,325-332,371 -586,608-846
aaaataaaacaggtcaacaactgcgacgtacaccgaccaaagaggaaaagagcaactcaacccccgaggggaggaaaagagcaactcaacccccaaggggaggaaaagagcaactcaacccccgaggggaggaaaagagcaactcaacccccgaggggaggaaaagagcaactcaacccccgaggggaggaaaagagcaacttcatccatcccctgagggtaagaggtggagatgcatcacaattcttcacttaatcgacgaataaaatgttgtgaaatttgaagtggtacaacaacagacaaaagagagaagaagagtagacaaaattgtcaaaaaaataaaataaatgataaaaatttgttaaaatatgcttaaaatttctaattttttgggatgatatggcaaatatttatattttcgatggaaaaaattcgaatttcattttgtccggagttcttagaaacaattttaaattccaatttgtccatccatgtctttgatacttaaacaaaaataccgtacctaattgttatttaatgggtttttcaaattatttatgatcatcaaactaaaaattcctttatgaaagaaattgtagaaattgaaatttttttttagaatttttttcccaaatctttcacgggcattgttctttcggcacacatttgtttgaaatcgaatcgcgcaccaatccgtcggcacattcacaagtgcaaggagggcatatcatcagagtgcaaaattccgggttcggattgtcacagctcggctcacatccattgcatttcctatcgccaggcttctcatttggagggcactttaatccgaagacaattagtgattaa

SEQ ID NO: 73796 - DNA, 501 bp, Heterodera glycines
  Genomic contig location: Contig_ID=SeqID_1477; Location=887..1387; Strand=-
  SCN-specific regions: Sequence locations=1-67,113-171,194-427,449-501
atgttccgaatcccctgcttaattttatttttcgttattctaccattgataactgtacagagtttccatgatagtgaccatgatgatgatcgtgatgacgaccgtaatgatggacgttgtatggtaatataatgaattaaaaaccaattaattattaataatccattgtactaaaattattaaataatttaatcactaattgtcttcggattaaagtgccctccaaatgagaagcctggcgataggaaatgcaatggatgtgagccgagctgtgacaatccgaacccggaattttgcactctgatgatatgccctccttgcacttgtgaatgtgccgacggattggtgcgcgattcgatttcaaacaaatgtgtgccgaaagaacaatgcccgtgaaagatttgggaaaaaaattctaaaaaaaaatttcaatttctacaatttctttcataaaggaatttttagtttgatgatcataaataatttgaaaaacccattaaa

SEQ ID NO: 73797 - DNA, 832 bp, Heterodera glycines
  Genomic contig location: Contig_ID=SeqID_1478; Location=580..1411; Strand=-
  SCN-specific regions: Sequence locations=1-16,40-169,191-348,370 -445,467-598,621-786,812-832
atgttccaaagtccttgctttttcttatttttaattgtgttgtcctcttgtgtaattggactaactgctcaggctaatgacaatgttcgctgtcgggtaatatttcttaaataaaatcacctttttaatccattataaaacaaaataaaactcactgtcataaatagagtattttatttttaaattatagtgcccgttcaatgagaggccaggcaacagaaaatgcaacggatgtgagccgagctgtgccaatccgaacccgggattttgtacactgcggctgtgcccgccatgcacttgcgaatgtgccaatgggttggtgcgcaacttgaacacaaacagatgcgtgccgagaagacgatgcccgagaaagaaataatttgaaaatttcaaaacgattttcattttgaaacaatttttttcaaatgaaaattaacatgcatttattgtcatcaaatggaattcatgaacgcttggataacataaaaaaaaaaatttcgacggtgacattaaaatgtgagataaatttgggctctattccagtttatgcgtccaatcaatgatttcatattcattatttttcgcgtatatgcagaataattttttgtctgttgcatttatcccagaattctgctatacaaaaacttctgtagacttcaagctttcgattgataccaaaaatgtatggattgacaaagtaagaaaaaagttatgatctaagaaactgaggatagtctctgattggacgcagagccgaaatttgaccatgatctttttgaaggtaagaaatatttatatatattttaaaaatctattggatatttttaataaa

SEQ ID NO: 73798 - DNA, 1491 bp, Heterodera glycines
  Genomic contig location: Contig_ID=SeqID_1479; Location=2049..3539; Strand=+
  SCN-specific regions: Sequence locations=1-330,352-354,382-430,468 -480,521-555,591-849,1010-1023,1049-1322,1348-1351,1378-1439,1461-1491
atgaactgctccagcgctgcaatgttgatgctgttgatgaccatcttcactgtgctgtccaatgtcaacgaggtagcagccgaggaacacgagctggtcaggtaatgatggaggatttgtgagattttcgtaccgattaatttacgggatttgcggaaatcccaaagcttttcatttcttcggttttgattcccggagactttttccattctgaatctcagggaaaaatcacatccaatggcatgaaaatatattttctccgctttagccgcattaagcgcaacggctacggatacagcagcggttatggtggtggctgttcagcctggtaagaaagaaaaaagcattttgaacattttaataaaaaaaatattaaattaagccaaagcagctgcaccacctgtggttacacatcctaccatgtaaattcaaaaattttaaaattttaaaattaaatattaaattttcttaaagaccgtgcctgcggctcccgctcccccgccaccaccgccgcctccgcacctgcgcccgtctacagccaggtgaggaattttcaaaatttctaatattaattttgaataaaatattttgaatccactaatttctggattatgaactaattacttgagagaatgtggtgggattaagtttttgatgggggatttcagtcttctgagtactaaaaaatgatttttgttttttggctttcatttctttttttgattaataacatccatgatccctaagattgctgaactacatcaaatttttagccaaaaaaaggcataatttttgtcatatttcattcgttcagtcttcctactcctcctgctccacctgcgggggcagctcctactcctcttacccgtcttcctcttactcctcttatcccgcttcttcctcttcctattcgtcctaccccgcttcttcctcttcctactcctcttaccccgcttcttcctcctcctactcgtcctacccgtcctactcctcctcttcctcctgctccacgtgcggcttgagcggctacagcaacagctggaacaacggtggcagctcgtccaacacgtggagcagcggcggctcgtccatgtcggcgggcaacggcggtggctacggctacggcggtggcagctgctcggtgtgcggaaagcgcaagtgagcgatgcgcagcgcgcgcagcgctgtttccgcacggacgcaacagcggcgagggcgcgcggacacggagaatgaactgacggaagaccattgaaattctcccaaaaatcttgaacccatccccaaccacaatacccatccaatccgtcccacattttgttaggctcagaaagcacacattttaaatggcataattattttaaaaattttaatttaccaattggcacccaaaacagcaccagcacactttgtttatttaattgtttaaattaatttttgtttcaataatgttattttttgtttgtgtgatcacaattctccaccacccca

SEQ ID NO: 73799 - DNA, 2183 bp, Heterodera glycines
  Genomic contig location: Contig_ID=SeqID_1479; Location=4463..6645; Strand=+
  SCN-specific regions: Sequence locations=1-80,102-105,161-241,277 -394,416-478,524-1055,1078-1125,1147-1782,1804-2183
atgaagctaattaatgcatttgagtttgctgtttgctccattttattaattgctgctcaattatttcaagtttccttttcgtgtgaaattggtaaattggaaatgaaattaatttattaatttttattcataattattcaatttttttagaaaaaattaacaaagcaattgacaatttgtacataaatttatttgagcttcaaaaaatggataaaagtcagcaaaattattttgaaaatgatcacaaaaattgggaaaacattttgttgaaaattgaatcaaaattattgtacagttcaatttgtacgattttgaagtctgcagaaatgccaaaaaatgcgcataaagaaaaggacagattgaaggaatttttagagaaatacaaaaaactttcatcagaattttcagattctatgctaaaaaattgcgaattttggaaagtttggagattagtggccaaaaacttcggtttgttgactaattttaaagaaaataaaaataaaatttaggaaaaaatataaaagtggcaaatggtgaaataaatttcgaatgccaaaacagaaaaattatccgacgcctcgaaggtgccgtagaagatccatttgctggagacattttaacgggtcatttaaatgcactttcgcaattattgacgccaaaaaagggcgacgaaaagccaattcaaattggaaaaatgagggaaaaagaaaataataattggtgaaataataaattttgacaaattaaaataaattttcgatttttcagggattttaacggattttttaaaaaagcaaaaatgaaaagtgagtcaaatattgcttatttattacgcaaaaaccgcgttgaaaaaaacataaaggggataattgaaataaagcaaagaattgagcatcattttggcactcaatttttggagaaaatggaacagttgcgaccaattgaaatgacattcggtgattatgatagtaaatatattctctaattatatccccaaatctccattaatccctcagtctccaattatcccccagtctacgaggaggatgaaaaataatcccccatgggggataaaaagagcatatacggtaacaagatcttttaaactatcaacaaaagtcgcatagaatttcaaaaactaaattctcggaggcataaatgccatagctgggctcagaaaagttcattcaattttcaaaaaattgttaccaaaaatgttcaaaaaatacgaaaactttttgaaaagctgagtgaaaaatgacgagtttttcactgatattaggtacaaatttaaagcaattttttggggagggtgcggctgtgaatttttgtaaattattgtataaacaaatcattaaaataattgtttcatggctatcccaacatacataagaaaataggaattttggcaacaaatttcaacttttacaattatcgattttaaattatgtagatataattgacgaccaaagattggccaattcatatgtaaaatttctgcaaaaagaggaggcggcgaaattggcacaacaaaatgaagcgcatttattattatcaacacgaatgttttttggccaaattattagcattttttcaatgaccaattcatatggaaaaatgaaaacaaaaaagcgaaaggatgtcgaaaatatgaagagaatttgtgcggaaattgaaacaatttggaacaaaaatttttacgaaatttgtacacaaattgaaacaaattcggcatattccgtcgagagcatttccaaattttggcacaaattggcgaaattattcaacaaaattccatttttgaaaaaatgcgaaaagtttttgattatttacgaagaattaacccttgagaaaaccaacggacttgaagaatttttgtggagggcaaaagaccaactgatgtcagagcatgccaaaaatgtgatcagactgaccgttggccaatcagccgagtgccaaaatgcactcagtcgcttcttggcaaattcacttggccaaatgaagggtgccaaacatcggctatataaatttttcacctcccaattcattggcatcacatatttcgataaattattgcaagaaaatgcgaattttgcgcaagtgttccgttctggtgatttttttatattttcggatgaatattaccgtaattcaaaaataataatcatttaattgcctttcca

SEQ ID NO: 73800 - DNA, 1633 bp, Heterodera glycines
  Genomic contig location: Contig_ID=SeqID_1479; Location=6709..8341; Strand=+
  SCN-specific regions: Sequence locations=1-164,187-534,585-721,1163 -1175,1309-1331,1356-1358,1537-1547,1601-1633
  Gene Ontology: Mol. function=ribosome receptor activity; Cellular component=integral to endoplasmic reticulum membrane; Biological process=signal transduction
atggacagtgacagtgaaactgatgtccacacgagagcactttttatggtcgattatttggcattttatcaatggtaaatagccaattaaccaagacataatgggctaaattaatgaggaatttttttaggaaaatttaattaaaacactaatcgttcaatgagtttttttttaaatttaattttaggctcaaaaattggcaagaaaaattgtcaaagagaacacagccttctcttgaacagcttctgttccaaattgaactgtacttggattttcttgccagcacaacagaatcggcgacgggcgaagcggcaaaaatggaacacaaacagaaaatgttggcactgaaaacagcgaaagacgcatttttccccgatgaagccgaagtaattgtaattgacggaagaggagagaatacggcaaatctattagcaattaaaatggaattgttgctaatgcataacgaaatcatcaaaggattgatcgaaaatgaagaacactttttggacaaagttaaaagtgagtgctgacgcgtaatgaataattaaataattaattaattcatcattaatgattggttaattgttttaaatgtttcttagcaatctttattgaccaaaaacgactgcgtataatgattccacgtatgtcacaggaataccaaattttaatagacaatgctaagggggaaaagcagcatgggaatgaaaataaaaacaatggaaaagaggatgaagaagaaaagggggaaggaggagaaataggagacaaaaaaagaagtgagaaagaagacgaaaggggaatagagaaagaaaatgaaaagggaatagagaaagaaaatgaaacggaaaaagaagtcaaaaaaagaagtgagaaagaagatgaaagcataggagaaaaaggcgaaaatggaagagacgaaaaagaaaaagaagaaaaaaaaggaaaagaaaaggtggaacaaaaaggagaaagtgaagaagacgaaaaggaaaaaggagacaaaaaaggaggagagaaagaagacgaaaaaggaagggaaaaagttgaacaaaaaagaggaagtggaggaaacaaaaaggaaaaagaagacaaaacagaaaaagggggagaagaagacggaaagagaagagacgaggaaaacgaagacacaaaaggaagagacggaaaggcaaaaggagacaaaaaagaaaaaggaggaggagaagacgtaaaggaaagagacgaaaaggaaaaagaagacaaaaaaggaagagaaaatgtggaacaaaagggaggaagtgaagaagaggaaaaagaaaaagaagacaaaaaaggaaggaaacaagttgaacaaaaaggaggaagtggaggagacaaaaaggaaaaacaagacaaaaaagaaaaagtaggagacggaaagagaagagacgaggaaaacgaagacaaaaaaggaagagacggaaaggcaaaaggagacaaaaaagaaaaagtaggagaagaagatggaaagggaagagacgaaaaggaaaaagaagacaaaaaaggaagagaaaatgtggaacagaaaggaggaggagatgaaaaaggaggcgaaggaggtggagcagaaaacaaaggatgcgttgattcagatggtgaaattagcctttaa

SEQ ID NO: 73801 - DNA, 3108 bp, Heterodera glycines
  Genomic contig location: Contig_ID=SeqID_10564; Location=13..3120; Strand=+
  SCN-specific regions: Sequence locations=1-548,570-824,846-1788,1810 -2174,2210-3108
atgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcttaatatacgacaactcacatgtcgtgccgtataatccttatattctgctgcgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctaaggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccacagttcctcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccatggtcaattgtatacggccttctctcgggcaacagacggaaacaatgtccgtgttcatgctcccaaccgggaaattgatgcccaaggccgagccaaagtgctgaatattgtagctactaatatgctcaagttacaataa

SEQ ID NO: 73802 - DNA, 267 bp, Heterodera glycines
  Genomic contig location: Contig_ID=SeqID_10565; Location=338..604; Strand=+
  SCN-specific regions: Sequence locations=1-79,134-148,172-267
ggcctttaccgaacgtgcggcgtgaagagcaaagtggaatggatctgtgtacaatttgaacaggtcagtggggcttttcatttttaaaataatttaaatgtttatatgaattaaaatttttcattttttttttgccttttaatataaaattccaaaatttcagatcccttcttccgatgttgacattgacttgtccgatgtgcacccaatgaacattgcatcagtagtcaaattgtacacttttttattttcaattacctaattcaa

SEQ ID NO: 73803 - DNA, 974 bp, Heterodera glycines
  Genomic contig location: Contig_ID=SeqID_10566; Location=574..1547; Strand=+
  SCN-specific regions: Sequence locations=1-406,430-470,492-688,710-974
atgtccgtgtccaacttggccgctgtgatcgctccctcgctgatgtggccgtccaattatggcacccattcggcagcaattagtgacgcccatcggcaatcgaaagccgtggaaatgctcacacgacatgcacatgtgagtgggtggggataaaatagcgaccaaaaagccgccgatgaatgatcagaaaaaagttttactgatcaaataaggtttgggaaacccaaaaattgatcatttagaggcgccatttatgatcaatgtgatcactgacaagcaaaaaatcagaagaaattaattattgggttgctaaagagtaattttacggaaaaaatgtgatcagctctataaattgatcatcaaaaagagttccgagccattttttgatcatcataaccaaaaagtattaatttatttgtttttagagaatcatagaggttgaccaaagagtgaccagaccctttattgatcaattttcaagcaaggtgatcagaggaccttgttggtctgagaacaataattgttcatcaaacactctgtgatcagtttgatgtttgcctttttcagtcccgctgggtgccattgcacttggccaatttctgcaacttttgcattgtttcaattagcagaaaattggcgtagtacaaaggttcccattagggagataaaaatggcgagaaattgccattattcatttttggaataagctggattatggggagaaaaattgcttgggaatcaatggaaaaatttcaaatgattgcttctgacttcaaaatgggtgaatttttatcccctccggcgatgggggggcacaaaaaagtgggcggtgtcgcccgggggcacttcttctgagacgacgggataaaacctgtgaaatgaatggaattggtgcaaaatgttgggtttttttgcaatcgcaggtgtcagaaatgaatgggggaaaagaggggacaaattagcgacgcgaacga

SEQ ID NO: 73804 - DNA, 881 bp, Heterodera glycines
  Genomic contig location: Contig_ID=SeqID_10566; Location=2429..3309; Strand=+
  SCN-specific regions: Sequence locations=1-290,403-776,798-855
atgcttccccttatggtacaggaggtgtttgacgtgaacttcgcgctcgattggcgcacctttttcgacacgcatccaaacgtgccggagccgacgaatgagcacagcagcgttggtgccatcgaccgaggtatcagcggcactcctcgtcccgagttctgcagcgacagcgtcgacggcgataacaagccgcgtcgccaggacgccggcgacagtcgtcatgccatcgtcggcgaccagcggcgcggtgccggaacgctcgctgcagttgatttgtcggcggaagacattgacgatgaactggtcgaagatgatgatgacgacgagaacgaagaggtggatgaactgctcgaggatgatgacgatgacgaggaagaagaggaggaggaactgatcatgacgtccgctgctgatcatcgccaccggcacggaggacagccgcagctgtcgggcggcggaattgccaaaaacggtgctggtgaaggagcggcacaaatgccatcgccggcggtggacgagaagaaacaacaccaccacttccactcggtgtttgacaagcgattgctggttgatagctactgtaagtggagagaaaaagcatgattgagattactgtattgggtatggtccaagccaaagaagtagtcatagccttgacttcgggagggggggggggaattaaaaaattcaatttttaggagtgtatttttctttttttagaaatcctgaattaggaggtgtgcttaacaggaatttgtagccgttttttgccaaaaaatgactattttttgtcattttgtccccgtttttcaaaaatatggtaaaataggggttcggtggtgcctttaggcgccgctgggaaaattttggaaaatttttaa

SEQ ID NO: 73805 - DNA, 881 bp, Heterodera glycines
  Genomic contig location: Contig_ID=SeqID_10567; Location=298..1178; Strand=+
  SCN-specific regions: Sequence locations=1-58,81-100,196-287,309 -814,861-881
atggaactcccccatttacatgcctggcgtttactgtttacatgccaaagtgtgcgggtaaaagaacaaaaacaaatagaccaatgatggcagaatgaccaaaaaataatttatccatttttcaattttcaatttttaaatctaaagatattttcaaaatgaatttcatttattttacaattaaaataatttatacataacgcttatcagtggaaaacccttacataaatccccaataatttacgtgatggatttagtaaaatgtttcattgatgtatcgtaagctaaaagtcttcctccttcaaaaacgaataaacaaattcaaaatgcgcctgcctctaaagatacaaatcaaaagctttttgatgcaaaatcttaaccattggaccctccaaataaactcaataatttttcaatttttcaaactttggactaaaacgtccagccctggttctaaagtaatttacattgtacaaaaacttgcagaggaccgttttttctccttaacattgacgcacgatgaaagaatttattttcgtataaacaaaactaatcacaaaaatagtttctttgttctcagctgggatattcattctttggctgaaagtgcgtcgttggaaatgggccacatttctttcaaatccaaagagcgcttagtcagaagaatggcaatggtggaagccgttcaaaaggctcggggagaaattcgagtggaatttgtcttggtgcttgtccattttgtcgatcacgaattatgcttcgacagattgggcaattgttgtttttatcaagccttaatcacagctaatggatcatattttattaagattttgtataatgaaaaaataataaaatttaaagcttcatatttaattttttaa

SEQ ID NO: 73806 - DNA, 653 bp, Heterodera glycines
  Genomic contig location: Contig_ID=SeqID_10567; Location=1193..1845; Strand=-
  SCN-specific regions: Sequence locations=1-209,262-461,485-653
atgcattcaattgtagtcatttttgcattaataatcacggtgcaaagtcaatgtatgtgggatggatataagtattaaaaaatagttgatcaagcatttttaattttttttatatgtgccagatattttttgttaattttaaattttgaaatttctactattttgttgcaaattttttgaaaacaaggactaaaattgaatcggcccccatattttctaattttttttcttaataaatttttttataaatgattatttaaaggttcaccaccaaatgaaagaagcaaaaacgaaagtccaagcaatgaaaagcatcatcaaaatgcttcacagtcaaaccaaaacgaaggcggtgtgagtcattcattggagaaaaattgtccaatttgtcttgatgagtttgaggaaagcgacgggcggcaaaatcaaaagaatgagccaataaaatgtggcgtaagttaagcacagattggcatacaaaagaaaacaaatcccaattttttagcatgtatttcataagcaatgcttggacaaatggtaattatgggtagaattaaaaattataaaaccaaattcttgcgtaaaagtcactcaaaattaaatatttgtacaaccaatgcacttgcacattcaatgaaacatcaaaaaataaa

SEQ ID NO: 73807 - DNA, 405 bp, Heterodera glycines
  Genomic contig location: Contig_ID=SeqID_10567; Location=2188..2592; Strand=+
  SCN-specific regions: Sequence locations=1-60,82-405
atgagttgtgaagtaaatgaaagcaatgagaaggattataatccagcagatttatcatttgcttatttatgtgcatattttattctgaaactcgaacaaaacgaagacattttgctgaaggttgagagggtagccaaagaacaatggatggaagcaagcttgtatccagcaaacaaaaaaaaaagccgagccaaagtccaggcggaagaggacgaaaaacgatggggaaagagaacggatgaggcgaaaaaagcactagaggataaaatggccgagattttggccaaagcgaaagaagaggacgagagagtggcgaaagagaaagaagagacgacaaagaaggcgaacgagcgagcagttgtgtacccggggagggaatgcccggatcgccgctcggtcgattga

SEQ ID NO: 73808 - DNA, 873 bp, Heterodera glycines
  Genomic contig location: Contig_ID=SeqID_10568; Location=972..1844; Strand=+
  SCN-specific regions: Sequence locations=1-100,196-806,853-873
atggaactcccccatttacatgcctggcgtttactgtttacatgccaaagtgtgcgagtaaaagaacaaaaataaatagaccaatgatggcagaatgaccaaaaaataatttatccatttttcaattttcaatttttaaatctaaagatattttcaaaatgaatttcatttattttacaattaaaataatttatacataacgcttatcagtggaaaacccttacataaatccccaataatttacgtgatggatttagtaaaatgtttcattgatgtatcgtaagctaaaagtcatcctccttcaaaaacgaataaacaaattcaaaatgcgcctgcctctaaagatacaaatcaaaagctttttgatgcaaaatcttaaccattggaccctccaaataaactcaataatttttcaaactttggactaaaacgtccagccctggttctaaagtaatttacattgtacaaaaacttgcagaggaccgttttttctccttaacattgacgcacgatgaaagaatttattttcgtataaacaaaactaatcacaaaaatagtttctttgttctcagctgggatattcattctttggctgaaagtgcgtcgttggaaatgggccacatttctttcaaatccaaagagcgcttagtcagaagaatggcaatggtggaagccgttcaaaaggctcggggagaaattcgagtggaatttgtcttggtgcttgtccattttgtcgatcacgaattatgcttcgacagattgggcaattgttgtttttatcaagccttaatcacagctaatggatcatattttattaagattttgtataatgaaaaaataataaaatttaaagcttcatatttaattttttaa

SEQ ID NO: 73809 - DNA, 1053 bp, Heterodera glycines
  Genomic contig location: Contig_ID=SeqID_10569; Location=143..1195; Strand=-
  SCN-specific regions: Sequence locations=1-23,177-235,333-374,396 -760,782-839,861-1053
atggaggttgggtaaatttctactttaattatttaaagtaaattattatattaatttattaaataaatttctactctattaaatagaattctattttttattaaataaatttctactttaattaagtaaattttttcctttttttaaagtaaattattgatttaatttaaataaatgaaaagattttctgaaggcttttcaaaaaaatttttttgcctacaaatttttgttcaactaaaatttgaaattaaataataatatgtaaatatttttttttactaaaacttgaaagaatgaaaaaataaataaaatttcaaaaaaaaaatataattcattttcatttttggctatctgagatttcttgagttcggcaccaaaattttccagataaaatgttgggggtcggcattccataattgcttccattagggttaagctccaacccctcggggtagaaattctcggggatcaattggggtcagggagcgtaaaattgtcggtgatccggggaccctgatcggaaagaaaatgcccaaaattttatttcgactaaaaattttcgcttttttttacagccctatttcgggttcggctcaccgtcagccacacccgtgctgcatcatcacaacaattgcaccaccggcaccatcggggccggcaattttccctcaaatacgccctccacttcatcggactcggccgccggcacaattgggcctgtagaacaacaacacctccaattacagtaccaacaacaaaacggtggcggcggctgcagcggtgtacggtcattgagcagacatcgactggtcatccgggacccatttgacgacgactgtaacaacaacaacaacaacaacttcgtcgaggacgagcagtacagcaacggcaacggttgcctgttgaacggcggcgcccattttggcatgccaccctcatcttcggcatcatcatctgcctcatcatggttttccaacaacatgatgtcatcatcggcggcggcacaacagtgccgaccatctgctgcatccgcaccaccatcattgatggatg

SEQ ID NO: 73810 - DNA, 1174 bp, Heterodera glycines
  Genomic contig location: Contig_ID=SeqID_10571; Location=1078..2251; Strand=-
  SCN-specific regions: Sequence locations=1-89,116-755,780-869,891 -893,916-1120
atgacaactgctgctatcttccagcaactgttccgcaagtgcatcataatatctgacacaataagtcaggtataattatacaatgagacattaatttttaatttattaattaatagtctattgaacagagattgaatgtaataaattatgaaaataaatactcatttggtgggttctattcggggatacgattttacatggaaatccaggcatttggccgggttttgttgggccgtgccaggcattttgccggatttgttggcccgtgtcaggcattttgccggatttgtttgtccgtgccaggcattttgccggatttttgggccgtgccaggcattttgccggatttgttggcccgtgtcaggcattttgccggatttgtttgtccgtgccaggcattttgccggatttttgggcgcgtgccaggcatttgccgaattttgggtctgcatttgcccggttttgaggattcatgccaggaattttccctgatttgggctcgccatgtgatccaaaaatacgtaaaattggcaattttttggtctacaatctgttaattaatagagccagacgaagcctattaataccgtaggacgccatttttttgaaaaacggctaaaaattaaaccgaataggcctagtccttgactagtccagtttttcttttttcaaaaattctgattgcagtacacagtgcatgaacgccctgaatttgttgcggcttgggattttgttggcacaagtgctgtgttcgtggcaccaccaccaccagcagcagtgccacctccgcttgcttgcttcttcaatgcgggcaaaacgtcgacagaaaaattgcgggcacctgatgaagaaataaaataaaaatttgaaaagacattttatgttaaaacaaatattaattcatttaattaagaatagttaatttaggataaaatgccaaaaatataagtaaaaattttcaaaacaattctcgtaccttctctcttgctttaaaaatagtaaatgccgaaaaatgtacaaaaattaaaatttaggaaaaataggcgttaaaatctttgtgccctaaaaattggtgagtttctgatcatttttaggatttttatgagtggtctaaatttgcaaaaaaaaaaaaatattaaaaatgtagaaaattaaaaatatttaaattaataaa

SEQ ID NO: 73811 - DNA, 1664 bp, Heterodera glycines
  Genomic contig location: Contig_ID=SeqID_10571; Location=782..2445; Strand=+
  SCN-specific regions: Sequence locations=1-142,190-296,351-555,578 -580,602-691,716-1355,1382-1538,1590-1664
atgaaaaatccgcaaaattggcttcatttttctatgcaaactcctcaacgcaaagcttaagcgagctgagcacttccaccacacttttgtatcggtctggtgagaaaaaaaggggtaagttttttttgttttgttttatggcttaaatttatttaaaatttttgaaaattttttacattttttttttttgcaaattttgatcacgcataaaacgtctaaatgtgaccggaagctcatcaaattttactgggatatttgcaacacacaaaaatttttatttcctgtaatttgctgtgtttattaatttaaatatttttaattttctacatttttaatatttttttttttttgcaaatttagaccactcataaaaatcctaaaaatgatcagaaactcaccaatttttagggcacaaagattttaacgcctatttttcctaaattttaatttttgtacatttttcggcatttactatttttaaagcaagagagaaggtacgagaattgttttgaaaatttttacttatatttttggcattttatcctaaattaactattcttaattaaatgaattaatatttgttttaacataaaatgtcttttcaaatttttattttatttcttcatcaggtgcccgcaatttttctgtcgacgttttgcccgcattgaagaagcaagcaagcggaggtggcactgctgctggtggtggtggtgccacgaacacagcacttgtgccaacaaaatcccaagccgcaacaaattcagggcgttcatgcactgtgtactgcaatcagaatttttgaaaaaagaaaaactggactagtcaaggactaggcctattcggtttaatttttagccgtttttcaaaaaaatggcgtcctacggtattaataggcttcgtctggctctattaattaacagattgtagaccaaaaaattgccaattttacgtatttttggatcacatggcgagcccaaatcagggaaaattcctggcatgaatcctcaaaaccgggcaaatgcagacccaaaattcggcaaatgcctggcacgcgcccaaaaatccggcaaaatgcctggcacggacaaacaaatccggcaaaatgcctgacacgggccaacaaatccggcaaaatgcctggcacggcccaaaaatccggcaaaatgcctggcacggacaaacaaatccggcaaaatgcctgacacgggccaacaaatccggcaaaatgcctggcacggcccaacaaaacccggccaaatgcctggatttccatgtaaaatcgtatccccgaatagaacccaccaaatgagtatttattttcataatttattacattcaatctctgttcaatagactattaattaataaattaaaaattaatgtctcattgtataattatacctgacttattgtgtcagatattatgatgcacttgcggaacagttgctggaagatagcagcagttgtcatccggaaccacaattggatgtgagggtgaaattttgcaaaattttatggaaaattgaaaattatttcacaaattataaaaaataaaaattattttttaattttaaatgaaaattaattttcagaacgatggtggtaccaaatgtgtgctgaatcctgtcttttgtactgacgaagaggagggcggcaacacgaag

SEQ ID NO: 73812 - DNA, 856 bp, Heterodera glycines
  Genomic contig location: Contig_ID=SeqID_10573; Location=645..1500; Strand=-
  SCN-specific regions: Sequence locations=1-165,204-343,377-488,510 -776,805-856
atgtacaacaaaatgcgaacggcggaatggacacgacaacggggacaagtgcactgtttgccaaaacaggtgggaaaatgaaatgcaattaattaagcaattgcgacagcgaaaaacggagcgacggaaatgccaaaaatactaaaatattacactgaaaaaagcaattaaataataaataataaaagaatttgtttttttaagtggattcattgcacaactttctctctccaaatgttgttctgctgccagtcgctttccactcattggccgatgagcagcacattcaagtgggaagcaaaagaaatgatcaaaaaacattcattggcatttaaatttccatgtccaattcccctcctccctctttcagcttctcggcatgccccaaacggtgattcccatcgcaattcatcccgaaatgcaaaagcaattcgctgtccgtccgctgctcatcgaccaaacaatggcggtgagtcatccgcagcaaaaacagaacgggcgacacagcggtggcggcacagtgccaaaacacattggcatcggtcggctgccgacggaggacaatggcaccaccagcggaggcaatccgccgcatcagttggacgacgcggacgataatcactaccaattccaattgccgctcgcttttcggtcatcgctggtccatccaacgacgacaacggcacaaaatgttcagcaccatcaattacttcagcagtcgcaactcaacgccaccattccctccatggaatggtcggtaattggcactaattgcgtaattaaaattaaattttatttttttaagtgtttccgtcattcatcccaaaagggagcaacagttctccgcttctgttga

SEQ ID NO: 73813 - DNA, 1227 bp, Heterodera glycines
  Genomic contig location: Contig_ID=SeqID_10578; Location=297..1523; Strand=-
  SCN-specific regions: Sequence locations=1-305,327-405,427-485,507 -563,588-864,887-1227
gccaccaccctcaatgtggcgtccaattcgcacaaccaatcgctgctcaccatcatgatgagcaacaattttgtggagctgaaaggggccgtgttcaagaagttcggcaagcccaatctgttccaaatgtcgtgcagcgatgtgcgcgaacgtttcctctcaatcattttgttggttgttgttgtgctgcgcaacatgacggtcggtggtttctgcttttcgtaccaaaaaattcattagacgaaaaaaaagaaaagcaatttttaaaaaatttgtggatgagtaaaaatttaatgcaaaaagtgaaaaaaaaaatttttttttttctctgaaattgattcggcgaaatattttaggcagtcaattggaaattggaacatttgaatgacatgacaccggatttggtaataatattattatgtttttgtgtaacttttaaatatagaggggatatgtggcagtgacatttttaccaaatatcgccgaattattctatttttgtcaataattttttgccgtgattttttttctacatcaataaaaaaaattgaggcgcgggagagtatttaaaaaaaaaattttttttacaaattccccaaataaattgtcagatgatgatcatctttgccgaacacattgttgattggttgaagcatgcgttcatcaccaaattcaatgagatcagtgcatttgtttaccggggtttgtttttatttttacttttttttccccctaaatttaaaaaattcgaccctcttttaaattaagaatacacaattacgattgcttatgatgtgctgagaacccatgaaacggactcattttccgacttctctgaccaagtgagttcaactacatttttgccatattttttgttcttcaccagtacaacaaataggaattaaaatccggatttgataggatttgctaccgaaattaatattttccaaaaaaaaaaaatttatgctgctctcaaaattcaaacaaatctgaaaaatcaagacgcttgtaaatacactgctaaaatccgtggtatatattgtaaatttaatttccacaactcttttaggtgagccgacgaatgggatttgtgccgattccggtaattgtcttctttttttcgttttttataattcttccccctttcattttaggtcgtcattcttctcattagggtcatttgtcagtcggtcgactttgagaatcctctttcagttgccgcattgg

SEQ ID NO: 73814 - DNA, 2094 bp, Heterodera glycines
  Genomic contig location: Contig_ID=SeqID_1480; Location=9151..11244; Strand=-
  SCN-specific regions: Sequence locations=1-239,261-2010,2071-2094
atggacggtcgtggtcagcgacaacgtcggcccatctgtcaatggcgccgggtgtgtcgtgcgtgtggacgtatcgcctacgtggccacacatcagtgcccacatgaccagccagccgacgatggaatctgtcggcgctgcaatgggccccacaccgtcgatgagccttgctacatccagcccattgacgacggctcagttcgacaacgtgcatcgattgctgttgacaacgacgattctgacgacgacgaggacgatgaagaattgccgcttcgtctgtgcttctttgacgctgagacgtcacaggatacgccattacagctgaacaaccgcaccgtccagaagcacgtgccgctgctcatcgtcgccgaagtcatctgcgaacgttgtctgcaggctggcatcagcgtgaacgatggccttggaagacgggctcctggctgcgtctgcatgacaggaatggtgagaggtcaactgtttcgccagtggtcttcgccaccctttgccaatgcaccgggagacaacagcgcttcgccagttggagcaccagcattcaaccagcgccgcttcttcttccattcgtttgacaacgacggcaacgacccagtggaccaatttttggattttttgctgcagcatggcccaaagaaggcacacacggtgtgcatcgcccacaacggtggaaagtacgatttccatctcgtacttgaggcactacaccgccgaaaccgtccacccaagcatctgtgcaccaccggattgagatctactcgatgcgtctgtccgggcgtaaccaaagacgaatcaccttcaaggattccatcaactactttttttgtgccttggacgcgttggtgaagagcttccaagtgccggaccatctggccactgtgaagcccttcttcccgtatctctacattcgacgacaacatctgtcgcagcgcctcaacggtctaccggctcaagagttctacgcaccggacacgatgaaggcagagaaacgggcgcaatttcaccgttggcacgccgacaacaacggcaatggattccagctacgcgagcagctcataatgtactgcgtcaacgacgtggccattttgagggagtcggtcatccgattccgccaactcatcgccgacaacactcaaggcctcgacccattcctccacgcgtcaacagctgctggtcttgcgctggcaacttttcgccgctgtttcctgcccgccaatcgtctggttcactcacccgagggcggatacctgcgcggacgccgtgcttcggcagaatcgcagcgctacatccgcttcttcgagctggagcacccggaggcgcaagtgcaatgcgccagctggtcggtcggagaggcgcacattgatgacagcggctaccgcgtggacggactttggcgacgagaagcgcctctccgtcccctggccattgaatggcttggatgctattttcacggtaaacggatttttctcgtatacaaaatatcttaaaatttaggctgtcccgtgtgctttcccgatcggcagcaacaattggcggcagggcggacagcggaagatctgtacgaacggacggagcggcgcctctttgagctagagaatgaccacggctgcgaaatccacaaggtgtgggcctgccagtggacggagcggctccgtcacgacccggacctgaaacgccgttacgatgccgtgttcgtcccttgcccgctggacccgcgcaacgacgcactgaggggagggcgcactgaaccgttcaagctgcaccacgtgtgcagtgacgacgaggagatattgtgcattgacattgtcagcctctacccatacgtgatggtcggttttttcttttaaaacatgcgcatattcatgatgaaaagctgaaagccaatcgcttccctgtgggcaacccacgggtcctgacgcgcgaggtgctgctccgtccaccaacgacacccctcccgtggaatgcaccggaaaggttctgatgttatgatttattgtgattttatttatttttgtaatatttcctttaattaaatatttattcattatgtttaaatttgtacaaaatagtgtgaccaataaa

SEQ ID NO: 73815 - DNA, 441 bp, Heterodera glycines
  Genomic contig location: Contig_ID=SeqID_10580; Location=232..672; Strand=+
  SCN-specific regions: Sequence locations=1-377,399-441
atgaggcttttgaaaattttcatctgcgagccctgggtaagtcccacaacttttgttcgtacacatgaacaaaaatgttaattttctactattcagaacgcgttgaaccgccaacaaaaaaatgatttcaattacatgaaattagcttccctaatgaccccgccgtattcacatcgccaagctcttccatcttgtgaacaatggaaatttattttgaaaaatgagaaacactaccaacaaaaaatgtatgccaaacataaaaacaaaaaatgatatctgataaaaaaaaaattgtgtcaattttaagcgtatttaactaaggaagtgatttccgcatcaaaatccatctttcggcgtccattaagtccttccaactcgatgatgacaaacacagcctgacaaattggcattttgttagaatcggataaatcccttccaaaa

SEQ ID NO: 73816 - DNA, 370 bp, Heterodera glycines
  Genomic contig location: Contig_ID=SeqID_10580; Location=1562..1931; Strand=-
  SCN-specific regions: Sequence locations=1-128,151-370
  Gene Ontology: Mol. function=adenine phosphoribosyltransferase activity; Biological process=nucleotide metabolism
atggatgaagaaaagctgaaaaacgaagtggccaattgcatccgctccttccctgactttcctacaaaagatgttctgtttaggtgggcggtaattttgaaaaaaataaatttggatatttcaagggacatttttccattgttttcaaatccgtcgctgatccgatcaatctgtgcccacattgtgacactttatcgacaaaaaattgatgtggttgtggcgctagaagcccgaggtccgtcttacttgggaagggggtgaggagggctaattttttttgaaaattccaggatttttgtttggcccaattgtggcgcttgagatggacgtgccatttgttcctgttcgcaagcgtggaaaactgcccggg

SEQ ID NO: 73817 - DNA, 966 bp, Heterodera glycines
  Genomic contig location: Contig_ID=SeqID_10580; Location=2217..3182; Strand=+
  SCN-specific regions: Sequence locations=1-52,74-256,278-579,601-966
  Gene Ontology: Mol. function=3-phosphoinositide-dependent protein kinase activity; Cellular component=plasma membrane; Biological process=insulin receptor signaling pathway
atgtccgacattgctggtgcttccagcagcgctttttctgccgatgcttcttcaacaaagaaaaagggcgattttttgtttctcgctgagttgggcgaaggtgagctagctgaactgctttactagggatgccatcgtcaaaactcaaaaatccggcatacaagttcgaaagttttttttttttcaaaaacggcaactgaaaaaaatcgggaccgacccgcaaaacacggacaaatgccgtactttttgaggcaaaatggcattcctgctggctgcttgcttgatttcctcgttggcctctactgagggcaaagaaatttttcatgtaaaggctgacaaaacccgaaaattttgagaaaaaggcaaaaatcgataaaaatttttgtttttcccattttaaggctcctattcaaccgtttatttggcttcagagcgccaaaccagtcgaaaatttgcagtgaaaatgtgtctcaagaagaaaatcatcaaagaaaaaaaggtgagatggcgcacttaatcaagggctgcaaagtttataaaaataagccattttcgcgattgtgtcttttttcagggtataaaaaagatttttcaaaaaacagagggctgaatttggggtatctaacttactttcaataatttcatattaaaaatccataattctttatatctgggcgcctgtttttttagattttatggaaatttaaacattttttcaacgccttaggcccaccttttaggtgcagcaaattttccgtgaacgtgacattctccgacttttgtccacgcccgcaaatgcgtgcccatttgttgtccatttgttttgcacatttcaagacgatgagtcgctgttttttgtgctttcctatgcgcccaaaaaggaccttatggcccggctgaaaaagctccaacggttcagcgttggccagtgccaatttgcgatggccgaacttttcttggcactcg

SEQ ID NO: 73818 - DNA, 1423 bp, Heterodera glycines
  misc_feature (14)..(14): n is a, c, g, or t
  Genomic contig location: Contig_ID=SeqID_10581; Location=50..1472; Strand=+
  SCN-specific regions: Sequence locations=1-220,243-541,564-694,719 -877,899-900,922-1027,1049-1423
  Gene Ontology: Mol. function=3-phosphoinositide-dependent protein kinase activity; Cellular component=plasma membrane; Biological process=insulin receptor signaling pathway
agcacatccatgcnctggacgtcatccaccgtgatgtaaagccggaaaacattttgttgcgcgaggacgggcacattttgttgtcggactttggctgtgccaagcaaatcattgcaaagcgggaaaatgtggcggaggaaaatggtgacaaaaccgacggacagagaggagatgatggccagaaagcagagaaaagtgctgacagcaaaagcagcaaaaaacgggaggaggaggaggcgacaaagctggcactgagacggcggtgctcatttgttggcagtggcgcctatgtgagcccggaggtccagttttgttcaggcatttttttgatagacatgggcaccagcagggatttaattacatcgaacgcccacaaatggttttttttcggaaatctgaaattcgcgtgccaaaaaatgtagtcgcccaaaaaaagtggcacaccaaactgttcaaaatcgggattccgttacatttctgctgggtacaatcggcggatgaccaaaacaacagggcgccagttatgcttttttggattaccggaaatttttaatttttaggttctgaatggcaaggaagtgacgggtgcatgtgattggtggtgggtttgtttatgaaaattggaaattaacgcattatgctgcattttttatttaccgttttaattgagccctcggggggttttttttaacttcccccctcccccccccccccccccagtatggattctttgttggagttggagaaagctacataattgagtaggcagcaggcctatttctccaatttttcaatccctcatttttcctattgaaagaaactactgtttttctgggtcacctccaacccgcccacccatgggaaatttttttgaatttccaaaccatgaatttttcaaggaaaaccctatccaaagaaattttctacttaaatgttttttcttttttggaaaattcattggtaaaattttcacgcgagaaacggaggcgggaaagggtggaaaatcaaagtattgtagaatgcctgctgttttcttttttcttctcagtggagggcggctttattaggggacaaatcaagcactttctttcgatcataaaaaacacacattctctcccgcagggcatttggcgtcactttgttccaactgttggtcggccggctcccattctcggccgacagtgagtatttgctgttccgacaagtgctcgcgctgtcctacaaattcccggacaatttcccatgtgccgcggcacgccaactcgtccaagcattgctagtgcttgagcctacgcaacggattggtgctgcggagatgggcgaacccacgacaatgcggtaccatcccttttttgacggcactgtttgggaaggcattgagaagcgcaaatcgccactttttgattcggcagagaatggctga

SEQ ID NO: 73819 - DNA, 990 bp, Heterodera glycines
  Genomic contig location: Contig_ID=SeqID_10583; Location=430..1419; Strand=-
  SCN-specific regions: Sequence locations=1-331,421-822,845-990
atgccaattccgccggttgtgctccgtgagtttgtgccgggcactccgttgggcgattgggtcgtttcaacgccaacggcaacacgaacattcattgaccggtgaagaaaaagaaatgaggcgggccgggttgagccacaagccaaaaataagaaaaaaatccgagaattttttttttttttggaaattttaaaattgcttcgtctttcacaaataagtttttttcttattttactctttagtagtgtggtttcttttttatttaaaaaaaggatagttggggaggtttcgttaaccctccccccccctttttttaaattcgatgcttttcaaatttatttttacaaaaaataactaaaaaaaatttttaaaagttttaaaagttttttgatattttcataaaatttttaaagattttttgaaaatgaagcctgattgtgagaaaaaccgattcttgaaaaattcatgtttttacgggatttataccgtaatataggaatactacaaaaaaaaatttataccgtatactaatttgcatcactatctctctcttcacagagtggacactttctgtgaacaaattggcacaatgttgggcacatttcatgccgcctgcgaccggcacaatttttgtccgccagtgtttcgccaatatgcgccaattatggcgctggagcattggcattttcattggcgcgagtttgaattgcaaaaacggacggacaaattggaggcaaaaatggccaaacagtgtgccgaagtgtttgaacagtttgagcagaaagtgttggggaggagaagcgaatttgagcaaggcataagcccaaaaagagagggcagaaaaatggacatttcatatttaaatacttatatcgtattctaaaattacctatatcgtattctaaaatagaaaccgattccttacggtattgtagggagggggcgcggtggagggatggaattcggcacaattttttttcactaaataaa

SEQ ID NO: 73820 - DNA, 1299 bp, Heterodera glycines
  misc_feature (701)..(701): n is a, c, g, or t
  Genomic contig location: Contig_ID=SeqID_10584; Location=818..2116; Strand=+
  SCN-specific regions: Sequence locations=1-159,245-411,438-488,510 -601,625-676,729-919,941-1053,1077-1256,1278-1299
atgtactcaaaatatttttttgaaaattttatgaaatttttgacaatttttgttttcattggcattcactcgtcaaccgttgctgaagttattcatcagcttcctgaagacaatatttgtgccaagttcacagttcaatttttggaggaattttatcagtaaaattaattttaataatttaaaatctttttaattattattttttatattttaaataaaatttatttataaatttctttatttagacaaaattcgtcttctccaatgttcggatggattacagctgaaggcgatgtgacacttggccaacagaatggcacccattttggcattaaatgtttggcattggcactgtccgattgggacttcgtcgtcgaccgtgcatgcttaatgcaaacaattttgaattgctttaattattattattaattaattaactaactaattttcacaaactttcaaagatagatataatttgaatattgtagttaactaaattaattttaattccacaccttaaatattcaaccaatcatttaatttttatgccattattttttcataaaaaaattgggttaattgtgaggcttataattgttttcttgtaaaagaaaattgtgttaattatgaggcttaattaacctaactaactcaaattaggccattaaggattttcaatttttattgaaattttactctanataattttttattaattatttaaaaaacaatattggaaacatttttaggacattggcaccaccaaattcccatcggcgttttattgcaagcccatggcatcaacaaaatgatcaattgaacaatggcacaaatcaaacagctgatcaaaatgtcagctacattgtaccattgaaaagtgctgaagtgcgcagtccgcaactgatcagtgtacggaggcaaatataatataaaaaatgatttggaatacgtaatacggcatggggactgaattggccagactctgacagcaaaaaacgcaaagatttttctagcggttgagaaccaagaaaatatattttggagacatcattaattgttggaaattttcttaaaattttggaaactctcctcttaatattatttattggaaattctgcaacaaatattgccatatttctcgaattttttcaaattctggcaaaaacatgagaacttcttggcttggccatttttaattatatgtctttaaaagaattgagcttattaaccccaatttatgaaaattcttttcttggcattacaataattcttaaatggcctttttaatatttttgccaa

SEQ ID NO: 73821 - DNA, 2259 bp, Heterodera glycines
  Genomic contig location: Contig_ID=SeqID_10587; Location=458..2716; Strand=+
  SCN-specific regions: Sequence locations=1-502,535-710,732-757,780 -1280,1302-1313,1338-1476,1500-1540,1571-2259
  Gene Ontology: Mol. function=GTPase activity
gaaagagtactttggctgatcgctttctgcagttaaccaacgtgatttctaccgaatctgatgcccaatacctcgacaaacttgaggtcgagcgcgaaagagggatcaccgtaagtaaatgaacggctaatttatagaggtggccactcgaataaaaagtcaaaatcaatttcaaaattcacatttatgttcgaatctacatcgaaaacattgagagatttttttagatcaaagctcaaacttgctccatgttccataaggtaaagaaagatatgcgtatttcatttttatattttatttacatttaaggattttatgctcaatttggtgtaagttgaagactgcttgccttgccttttgtcgtctaatcagccattcattcggatcgcggtcataatgggtttttaagcgaaccaattgggtaaatggttatcatttgattggcttatgaacaactttagaaattacaattactacctaattattagtattagcaaatcagtaaagaaaattaatgaatggatggcagttggatgataaaaattatcggacactttttttcacatttaagcgatactcctggccatgttgactttgggtcggttagtactttgattttcatttatttttgtttttttagcttcgaggttaaacgttctctcataacctgcgacggagcaattttgctagttgctgctaatgaagtgacgaaaataaaacattttctttaattttacaattttagggtatccaagcgcagacccttttcaattttcattcagcctttgagaataatttgagcatcattccggtcatcaataaaatagacatgaaggcaaatattgccaaagttgaggaagaattacaacaatcgtttgggtttcatgccgacgaaatttttaaagtgtctgcaaagacgggaagaaatgtaccgaaacttttggaggcaattattcagaggtagaatgattgtaagagaaaattgtagtaataattatctgaacaggataccaccgccacaagttaaccaagaaggaccgtgccaagcccatgtttttgattcttggtaatgttcagataaaatacattacagtgtttttttcttttttaattatttagtttcgatcacttcaaaggtgctcttcttttcgtcgtggtcaaacaaggcattttgactaaacatttgcccattcgattcttcagtagcccagaaaaagaatacgtcgtgtcagagattggcattttgcatcccgagacaacgccgacgaacgtgaactatcttttgggaaagagctgttattcaaatcgagtttccttttttaggaactttaccctggtcaaatgggctatatttattgcggaataaaatcttcgagggatgttttggtgggcgacacacttttccacgcgactgaacgtattgaaactgtgaaaccatatgtggaaattggcaatgttaaacccacggtttattctggacttttccccatggaaacaacggaatacgagcgactcagagtaaaaaagcgaagacatagcctattaataaaataataataattaatattaagaatgcagttgaaagtctccaattgaatgacccttcggtgaatcttcagatggactcgagtgtggtttttggccagggatggcgggtcggatttgtcggcaatttgcacatggaagtgttcggacaacgcttgggtaatattcgttgtgccttaaccaagtgagaaaatatttcaaccgcagagcaggaacatggcgaattggccgttttcacctcgccaagtgtcaaatatttggcaggttggtatttaacgatgcagaaacacactgacaaaggtccttcagatatcgttgacaacgaaggcattcggaaacggcgacacaaaggacaatcgcaaattgccatttgcaagccatccgattttccggaagtgccaacggatgtgctaaggtttaggcatccttccaaattgacattgaaggagtatttattgttggtaatatatttttccactttgagatttttggaaccaatgtatttggtcagtattgtgacacctgccgaatatttctcgaacattgaaagactttgccaaaatgcccgcggggaagtgcttgagacgacttacatagacgaaaagcgaatgattctgaggtggcggttgccgttggtggaaattatcgtcgatttttttgacaaactcaaacttacaactagcggatttgcttcgtttgatcaaaaggatgacg

SEQ ID NO: 73822 - DNA, 1377 bp, Heterodera glycines
  misc_feature (95)..(95): n is a, c, g, or t
  Genomic contig location: Contig_ID=SeqID_10588; Location=969..2345; Strand=-
  SCN-specific regions: Sequence locations=1-27,53-506,528-779,801 -805,834-834,875-1175,1200-1343,1365-1377
  Gene Ontology: Mol. function=cytoskeletal regulator activity; Cellular component=cytoskeleton; Biological process=peripheral nervous system development
atgtcagatgccaatgagtttggatttggacgacgacgaagaggaggaggcggaggacgaagaaacggctgagggcgaagcgcacccccacaggngcaaagaacgacgaaacgatcatcgaaaaggcactgactgcggcaccggaaagggacctggtcgacttggccggcattttgggtgatcgaccatcacaaattaaaacaaatttggcattccctaatttatttttaggaatgcataatgtgctcaaccaacctcaatattacaacgcgctgaagggcaaaggacagaatgaggagaccggcatttccttcagcggagtgatcaaagcgtttcagcctcgggtggttccggacgaaccggacaacgagacggacgtggaggagtgcaccaggcgagcgaatgctgcatcattttatgacacttaattatagtaattatagattgggtcgaccccgggacttactggcgaataattcagtcccaaaaatacaaaaaaaaaacataacataaaacggatgtgttcaggaggttggagagtggcgacgtcaaattggaggaggtcaacctaaacaacctgaaaagagtgtcaaaggaacgcattcggtcgatgctccgagcggcgtgcaaatccaaacacctgaagaagctgtgcatggccaacacggccatctccgaccaggaggcacgggtaatgaataggccggggagcagttcgttccccctccttttgaaaaatcttcggctaatttttgaaagaatcgctcagtttctctaacttttaaattttccgggggaatatgactaattattgaattattattaataaaaatgattttgtgcccaatagaaattctctttttctgcgcatattacgaaatttgctgggcttttgggtgtaatttgtggaacaaaaatggagaatttaacttaaagttaagccattagtcgagcttatcgagcacagcgactcactgaaagtgctgaacatcgagtcaaatttcatcagtcccgaaatgatcgccaaattgctcagggcgacgctgcaaacgcaatcattggtggaattccacgccgaaaatcaggcaattcacaacaaataatgcccccccccctccttttatactgattattgcatttcagaggcaatccgtgctgggcaatcaaatcgaaatggttttttgttccccaatttttgatcattccctccctcccccatacgtttaggacattatgctcagcgtggaggacaacgactcgcttctccgtgtcggtgtttcgctgcaatcgatggaggcgcggaaccgcgtgggggaggcgttggagaggaattacgagagacgtaagtcaaataacacagaaaaacagatgcagaag

SEQ ID NO: 73823 - DNA, 971 bp, Heterodera glycines
  Genomic contig location: Contig_ID=SeqID_10589; Location=536..1506; Strand=-
  SCN-specific regions: Sequence locations=1-286,325-330,352-765,795 -918,940-971
  Gene Ontology: Mol. function=cytoskeletal regulator activity; Cellular component=cytoskeleton; Biological process=actin filament organization
ttattacgcggaagaaaaaacgctggcggccccaaagcaaccattggccaaaagggcgggcggcgtcggcggattgaccagcggtgccggaaattgcgggggagagaaatattacgggagggacctgagcaattacgacgacaaagacattgagggattgctgtccaatttgaacacggacgaattggaggagttgaacaacgactttgacccggacgtaggaaaaagaaacggagggatttaacaaattgagaaagtcacctcatttttgcgggaggcaaaaatgcctttgccctcccccagtgggcttgtttaaatttatttgttttcaaaactttttgtcataaaaaatactgcagtttacgcatccaattaaggaacatcctcagtttcaaaggccatcattttttttcttatttggtcaatgccgacatttttggtatcaaacgaaaatttgaagttttctttgaacaactaaattctgaactaaatgcaataaacaaaaaattgttgttgaataaaattcgaaaaactgaatttcttgttttatcattataattgttttttttaatgtcagtatttgcttttttcttttttttaattcctgacaatgagactttaagctatcgtttgatatcaaaaatgtagttcattggctaagtaagaaaaaagtcattgcttagaagaattgaccagaattgacaacattcgtaatacggtcaccacgaaaaccttcagattggtcttcacggatagacgacataattttcaaaaaatttatttttattgttttcttggctctaattcaaatttaaattcagaattcgctgctcccaccctcccaacggtgtcgcaaccaaacggacaaaaagccgaccggcccctttaaacgcgagaaactgctccaatacttggaggagaaggccaaaagtgaaaaggactgggaggaggcagttccattcgccccgggc

SEQ ID NO: 73824 - DNA, 1853 bp, Heterodera glycines
  Genomic contig location: Contig_ID=SeqID_10591; Location=449..2301; Strand=-
  SCN-specific regions: Sequence locations=1-21,43-201,223-345,367 -371,407-441,473-566,588-798,820-1339,1361-1628,1650-1805,1827-1853
  Gene Ontology: Cellular component=endoplasmic reticulum membrane; Biological process=response to stress
atgctgctgttggcatcatggcttttcctcctccccatttttctcattgttcagccggcgccgaatgtttcggcgtggacaaccgtcgcgccaacggtggcactttttgttttttgttttggcatggcactcgtatatggcacagcataatacagactgacacagacaatgacaatgcccttttattagcgtggcaaagggttgaatttttaaaaaatttaatcgattttttgttgggtggcaaaaaagggtaaaaaaattttatagggtggaaaatgaaataaattgagcctagcaatttccgagggttaaatttttttataaggtgcaaaaaatgaaatatttgggctgatgtttctttgcctctcttctaaaaaacttaaaattatattttaaaaatatttttgaccccgacaattttttttaaattcccctcaggggattattattatttatttgtttttaaatatttgatttgtttgagaattgtcgggttttccgtccccttaaaaatgatccaccaagagagtttactgtttttttttcaattttgaggatttaaatggatttaaaattttttttattttgcgaattttcggttttttggagggctaagggtcaattttttttgtttttttgaaaatttttatgccttttcagcccaacatttactcgacggacaaggtggcggaacagaggcctgcagcggcggacactttgctgctggtgtccaccatcgacggctatatgaatgccatcgacgcgcacaccggggcccacaaatggcgcttccacgaaggtgccgtgccgtcctcggcggagggccgatttgaattggttttgatggcattatccccggctttattccaatttatgcgtctaatcaatgaccattctcagttttgaaggccataactttttccataattggccaaagcatacatttttggtatcaatcgaaagcttaaagtctctggaatttaccaatgcaagaaaagggcaaattgtgagattagaaaataattaaaaatgcgaaaacattgaaagtcattttttcaagtttattcaaaaataattttttgtcttttttattagcccccaaaatttagttattcaaaacattgaatggacgcataatagagcctcatcctctcctttggcattcgaattttggcatttttggcggggtcgaggtgatgcttttcggcacaatttgcgcagagtggcgcttattaaattgtttcgattgttgacttttaatttacaaaaaactgtgattcgtctagggccctggacggaattgggattcttcggatttttccgggatcctggtcccggctttttctaaatttccaagccttccacccaaaatttgcatttttttcctgggtttccgacaaaaaccgggacttggattcaagtgtcaagattcacattccggcaaaatagggaacccgtgcccaaattccgtatttaatcctgatccccgacttttcaaaattttggggctctagattggacatcggacgggtaaccggggttttgctttttgtctaaatttccaacccgtcaaaatatgcattttttaattttattcaaaatatttcattttttgccaccccctcggcattttttttaatttaaattttccaccccaaaattaaaaaaaacatttgcaggccccctgctgtcctcgccggtgagcatccagcgcggcttcaccttcatcccgaacccgcgggatggccaactgtatttggtggtcgaaggtcggctctccaagttgccgttcaccatcccccacttggtccgcgtgtcgccgtgccgcagcagtgacggcgttttctacgcag

SEQ ID NO: 73825 - DNA, 2236 bp, Heterodera glycines
  Genomic contig location: Contig_ID=SeqID_10591; Location=3434..5669; Strand=-
  SCN-specific regions: Sequence locations=1-198,232-362,386-607,680 -769,796-1562,1613-1848,1870-1877,1906-1944,1978-2131,2160-2172,2195 -2236
  Gene Ontology: Mol. function=14-alpha-glucan branching enzyme activity; Biological process=embryogenesis and morphogenesis
cgaactggtgaagagggacgactccggttggtggcaaggacggctggacggacgtgagggacttttccccgcaaattatgtgaccgaagcgtgagaagattatccaacagaagggaagtgactcacaatcagctgattttgatctaaccgtgccctttattatgcaggcttttattatttcatatgactaacttttcaattcggaaaagctttctttgtcttaccttttttgactttaactttttcaaaaagacaatttctgctctaacttattttgttgcccattttacctgtgataaatctgttaactcttagctaataaattatgtttatttcgaagatgaataaatctgatctcgatcaattgtttttattttattttacagttaacggaacattccgagctgtaactaggaaaatgcatataaatgacatatcattggatagagcagggtcgacttctattgtgaatttttaattttagcggtgcattccgcctgcttcaaaagttacagggcctcaaaagtcgaaattttgtgcttgagggctcattttcaagctttttcactttacatcgatttttatccacttcataatgacagaacacatttattttaaacaaataaataattttaatgcatttttcatatttaaaaatgtatttttaaaatctttaattggttaaaaactcgtggctcgaaatggatgcactgccccccatattttctgcgaatttttcgagaaatttttcaattaactaattcctggctgaaattttctgttttttaaaaattttctggggaaaacgatacgtaggagacgagctgttcccctcacaaatttccccccgcctctgtcgccaaaaattttctcggttttagttttttaaattctattttttatgcttttgggaaacaacctgctcccgatggaacggatttcgctcctttattaattgtttttcctttgtctcctttttgatgaataattaattgtctgggtttttaggcaacgaatttggccaccccgaatggttggacttcccgcgtgagggcaacaatcaatcctaccactattgccgtcgccagtggaatttggcggatgtaagcatttttctactataggaaaatggattttaatttgctcgagactcggaaattttggggattgctaaattgacagataaatccgaagcattcggagcccagaaaaatgttgtcgcctgggcgcgatactcactccaagccgaattcctgggattattcctaagatttttagcccggtttaaattaaattttcggggttgaaggttgaatcactgtccaattccgggcccacgcctagctggcagcggcaaactgtccggcgccgaattgtcctatatacctcttcaaaaaaagttttccaggacttgacacttcgctacaagtacttgaatgcatgggatcgggcaatgaaccatctggagatggattccgaatttttgagtcatggacatgtaagttggggactaatttgcattcactctttttcggcgagttggggggggggcttggcaagttcaaaaaggtaaaaaattccccccaattaaattttttgaaattttctaaatgtatttttataggcctacgtgtcctggaaacatgatggggacaagctggtcgtgttcgaacgtgctggcctcgtgttcatcctgaacttccatccggagaaaagttttggtgattacaaaattggcgtggagatgtccggggtgtaagtcgtctaatatcaaagtttttcattggttttagaattttaaataaaaaataatgctttttcaccataaaattttaaaattgaaatttctttagcaaatcaaaattcaaaaaatgacgattttttatattttttaatagtaattatgggtgggttttgtaagtttacataaatttggcttattcgaataattaaattttttattttcaaatttttaatggatttaattaaaaggggaacattttcctatttccaaatttaaatttagctactgtttggcactgaacagtgaccagtccgaatttggtgggcacaaccggttgaagcaggaccaatgctaccacacatttgccgaggggttggcaaaatttcgaaaaaaaatttttttttttaattttttaggtacgctggacgcaaaaaccatctctgcgtttacataccgtcccgtgtggcgattgtgttgaagaagaaatagaca

SEQ ID NO: 73826 - DNA, 1676 bp, Heterodera glycines
  Genomic contig location: Contig_ID=SeqID_10592; Location=289..1964; Strand=-
  SCN-specific regions: Sequence locations=1-118,180-250,272-571,619 -862,884-1089,1136-1302,1324-1418,1444-1479,1505-1590,1625-1628,1655 -1676
atgcgcattttactcataatatggcgagaatcattcagcgagtcgcattatttattgcatagaaaattggctgaactgctcgcatccgatgtacaaaatgtggaaaaagtggtaattcaaaatttaaaatttttaataatttataaatattaaatttaaaaaatataaaatattaaaatgagaatagcccatttcagccaatttcttcatttcgcaatttattattattatttttgcatttattttagcaataataataatatgcctttttccattaattaagttggtactcgcggtgaattcaaccagtgactttcagcccacagaagaacctgctgaatatgaaggacgacttttagtgtggacgaggacggtacttaaaaggtacaaaaatgcaccataaaatattatgtaaatttttaattacgcagcaaaagtcattttatattaatatattttggcttgatttttaatattagatcatattttttatttttatcgagcgaaattactttcaccatctactgttcttaccttaaacagctgctgaaaattaattattatggccaccaaataaataaaaatattcgaaataattattttaaaaattaaatttttggccgatcattttatttaaagctaacctttttaaatggtactttaatatatttatttagtgaacgcaatactacggtatacacttaattacatttaggccagaacacggtcagcaggtgtccatttgggaacaggacattactgagttttttttgccaaatgccaacaaagcggactcttttcaacttggtaaggaagaagaaagaataattgataaaatcttttttttttttgctaaggaaactattaaaattaaacattttataacttttagaggaaatgggcgaagaggacaaaaataaatttttactcttttgcgtaaatttctaatttaattaagtttgctaattttaccgaaaggtactgcccgggaaaattattgaaattacataacatatttgttaaaaaagagttcatttttcgtaaaacaaataaacgattcggttatgaggtgccaggaggaaaattgagatttttttaattctgataaatttgaattttaaattattatttttttgcagattttttgacgaattattatggcatcatccagcaattgtttggcttccaattcaatgttggcattatggaaacatcatcatgggacttttcgttgagcatttttcgcgcattgccaacaatcaaaaaatttgccatctcacaaagcgcaactccaacaatatcgcaatggcacaatttgggttatgaaaaaatagttggcgcaatgccaggtgagacatttggcgttttgtaaattccacggtgcttcgtcatttcgcgacaagtgcaaaaagggcacttcgcgacagtgcaaatttaaccgaaagagaccgggcctcatcagtacggtgtctctttgggttaaataatttaaattaattattatgtgtgtttcggccctaaaccgtatacacacaaagccacagcaatcaagcaaagcaaataaattttattaagcaaaataaatataattttatttatattggtttatttatttatttatttaagttaaaattttttaaactaattttatttgaatatgtttatcattgaataaa

SEQ ID NO: 73827 - DNA, 861 bp, Heterodera glycines
  Genomic contig location: Contig_ID=SeqID_10593; Location=310..1170; Strand=+
  SCN-specific regions: Sequence locations=1-1,26-32,56-82,104-297,319 -454,482-674,715-861
gaactggagaagaaaatgaaaatcaaggtggtcaacaacaaggaggaggaggaaccaataacggacgtggcaacaatcgtggcaatgaaaatggtggccaaaatggcaatggtcagcagcaacagcaaccgcccgccggcggtgccacctgcacgaacagggccaccggctgtgacgtcgcctattgtggcaacacagactttgcccgggcacattgtgccggcacatgcagaagctttttgaacgagtgcagtcatttggcttcggtgccagacccaagtgggtgctgaaatattaagcatagaaataatttatcattggaaaacgaaaattgtattggcatcgaattttttggtcagttttctagattttgggacaatagttgaaaaggatatattttaagtggtgccggcaggctttatgagggaaaaacattgccaatattttaggaatgtaaaataataataataataaaaaaattcaggcgttgcttgtggcaacccggcaggcgattgtgccatgaacccaaacgtatgcagtgtaagtttacagcatgggtttttttaatgttttttacaaattacataatgtattacatatgaatttaggacgatgttttggcagtgtgtggttgtcctagaaaatgtggtcgttgttctgatcacacaacatacattatgcaaggcaaatgcagaaatgtgctgtgaatgtactgtagcagatcgacgagaggaaatgcattaatggatggcagatgcatactgtagtggcgtttttgaatttgttttacatacaaaagcagccattcattgtgtcaaatttttaaatttttacatacataaaattacaaaggatgaatga

SEQ ID NO: 73828 - DNA, 5044 bp, Heterodera glycines
  Genomic contig location: Contig_ID=SeqID_1481; Location=1254..6297; Strand=+
  SCN-specific regions: Sequence locations=1-273,295-404,427-639,664 -1573,1596-1778,1800-2257,2279-2299,2332-2599,2622-2626,2648 -3016,3038-3905,3928-3929,3952-4011,4033-4046,4069-4945,4967 -5018,5041-5044
  Gene Ontology: Biological process=embryogenesis and morphogenesis
atggccgttgtcaccaaactgtgcagcaaaattgagccgaccgacgccaacattggcgagtgcagcagaaaccttggtgatttgcttgaacatgacgatgagagagtggcagagtgtgcactgcgatgttttgccgcaatgaccgatcgtttcgtgcgacgtcaaatggacccaatggcgttggcctctcccagcagattggtggcgcatctcttcgaccttattggttcatcttcgacagcgcacgaaaatgctcccactgaattatcttcgaatggggaaaactgcagaattcggaagagaagttccgctttcatctctatggttttctcactctttgtcaatctgtgcaaaagttctttcgccctcactgaagaaattctttcgtgagtttccaatttatttttcttgcatttttaattctcttttagctcgtccaaattggttcctgctttgaaaatggttctcaatggaaaggatgaacgttgtatcaacgtaagtttgtcaacacttcttgttttttattttggtactttgttttaggattcgttgcgtttcattgaccttctaattgtcttactctgtgaaggacggtctgcaatttccaaaaaccgagttttattaaacgattcgggtacacaaactcctctctctctctctttctttttttttatccaaattcttttaagttgctcctcccgcttttgacaaaacgcatcgcaatttaattgacgcaattcgattgcgtgacacggacgcgttaattgatgccgtcgaaaatggaacggttgctaaaaaccgtaattctcaaagactcgtggtttcaggttgacccgaactttgtcgacgacgttggccaaactctgctcaattggtgttctgctttcggcacctccgacatggtcatttacctttgtgacaaaggagcagaccccaacaaagggcagcgttcttcttcgcttcattacgccgcgtgttttggacgagtcgaagtgagctgcatttggatttattatttgctgtaataaccaattatacttcaagattgtaaagatccttcttcgctacggagcgaaccccgacctgcaagatgtgctgcccaatggcattcattggccaataatctaaaaaacaattaaggaagagggacggactgcgctcgacaaggcccgagaacgaagcgacgaaggtcatcagcaagtgtgcgagattctccaaaaccccggtgcttacatcagcgtaataccaacgagcgcacaaatgcacaaacattccgatgcacaaggccaagtggacgcaaaagtggcaccggaccatgacaaaattgactctgaattgggagagaaattcatccaacaattgttacccctcttttgtacaatatttagggtattttcttatttcttgtctttgttttatggttttacattcagaattcgttgactgttggtgtaaggcgaacaacgttgactttgattcgcaaatgtgtgtttcatatttcggcaaaagcatttttcgaaattaccgaagcgaaaatgaatacaaatggagaagaaaatggaaactttgtggagtctttggttggagttctaatgggcgtctttgaaagtaaagaaaacaatttggatgcaaagcaacaagcactgatggttggtcctagaactgttgccttttcccaataaaacgatttagacaattaaatctgtgttggttaaaagccccgatttttggactgaacagctggtccggcttggactgtctgagaaaattgagcagttggccatggaggcggtggatgcagcgacaaacaatgcttcttcatcttccctcagtgcggcgaatgttggtccgaatttcccagaattgtccgcttctgaaaagcaattgacccaaagaaggaccatttcgactgattgtacttctctcagaaaagaaataacgaatagtacgacagacaggtgatatcattattacaataatggtaacaaatctgcaagccttggtctttgctttaagtccatcgtccccttctgtgagtctccgttccgagtcagccgcgccatcaaacgatgcttcacattactcggtaattatccatcaaatttgtttcttttaagctcaaacctcgacccacttgcccaaatggcggcaatggtcaattggtgtcccgacgaaaaaaattaaaaatttcgcagctattttttctaagcttaaaaaatgtgctgatcacgaatctgaacttagattttgaaaatcattgatttttatctatgatttttcatcaactacttgatatttcaaatttttttattgtttttaaaatttattttacaatgaatttgggttagaaaaatgcactaaacactaatttgagttctaatttttcaaaaacaatatcttgtctatcatttctcatcaaacatcagaaaaaataatccacagccaagcggattcgaaccccttattaagggccaataataaaatttcaaaaaatcgtaaaaaactaaaacttaactcctccaaacctcattcgaaagccctttttgagctctacaacagctgcgtatgagttttttacaccagattaattgtctaaaattttttgggaaaatcaagtatttaatgaaaaatcatagataaaaatcaatgttttcaaaatctgagttcagattcgtgatcagctatcttttaagtctagaaaaacaagctgctttaacatttttttttcgtcgggacaccaattcttgaccattgcccaaatggcttttgaacataactcatttcaaaattacagaatgaagaaatcgctgttcatgctgataattcaacaccatcgccgaccgttgaaatattacacagacataatgcaccaaatactgaggaagaactctcaccttcaaatcacggagacggggccaactctccacaatttgataatgaattggtggaggcagccactaccattgccaatgttcttggagtgcaaatagtgcaagacgtttctgaatcatcatgtgaactcaaccagcaacaacagaggcaacctcagaactcagccaaggacggctcggaagatgtgtggacggtggaggagaaagtgttctatcgctggaaggactggaggctgatccgctccaaagattctctgtttttgtggtgcgacgctgtcgcattggagttgaggtggtttggttttgtttgtcatccaattattttgttccatagtgatggctcgaacggatggctgcgctttctgatgaatggcaggctgagcactttgtacagcagcggtacccctgaatatggggcggacaatgccgaaaaccgcaccgaattcgtcgaaaagttacttaaagctcgggcaaccgtgccagctggatcgcagaccaaatcggtcctttccgtgccacgctctgtgacattggaaattcaatcgggaaattggaatttggcatcacccgaagtcggcacactgttattgacaaatcgagaaggcactcaacagaaaatggtcgtgaaagaggaccttccagggttcatttttgaaacgacgcgacatcaaaaacatctgttttcagccgattcaactttgggtttatacttttaatcaacatggaattcagaattattcaataataatgtaggacatgattttgtgacgggttgggccgcgcggggtggcggaagacgccttcgctactttaaactggaggttcaaaaacagaaagtgtacgaattggcgcaagagatttgggacgcttacctgaaaaaagctcgggatgagcccagagaattggtcttggaagttcagaaattttcgaatttgctttgcaaattgacgaaatcaattgcgaaaatggaagagaaagattcttgtgccaattcaacagaagaagtaagttcaactgaagaagtaatggtttcattaatttctaaacttttattttagctgcgaacaattcttgccaaaatccgtgacattttaattgacgagcgtcttctgtccgtatttgaaatatcagtgtcaggattggtgccctctttcctgggctttattgagcaggttcatctcaaccgaagtggagttctcgccaaatctttcgcagaggtcttcgacttatttattaataatagtattcccatactttagattttctctgatgcaaaaaaactttctctgttggtccgtaaaattgttctcgtattggaatttgttgagaaattgcctcaatatctctacgatgtccccggcggttctccttttggctttcaagtgacccatttgctcattttcgaagctacaactcgattttagttgcttacgcgacgtttgcgctttcgttttgaattggaaaatcagggaaaaggcaacaaagcttcgaatcaatttgcgaatatgtaatggaattcggcttgaaattttacttgtcaaatttcagaacaaatcgctttttgaagagtgaaccgcttgtgtcagttgcttcattgaagtcgtatttgtaccaacaactcacgaattccaccaagtcaccaaacagcttatcaggaggcatattatattcttattttgcctagtttttcgtttttgccgtttagtcactccaagcgatgacccgcttcaccagccgaatgtgtccagtgctctctcgaatctcagctttggtcgacctcccaccgctgcttctttgagaatggcgcgcaaactccctaaaacagcggcagataaaagcgccggcgtttcttccgtcactggacataaacacaatgtcacgtccggcggtgatcttttgtctgctcgttccgcttacgtcgctgctggctgtttagagaaagtcggcgggaccatcaaagtgaaaaaatcatttgggtccgggaaagcgacgaaaaatacgacaacgaagaaaggaggagcaaatttaccgaagagttctggcgaagcgccgtcgaaaggacagcgaaatgcaaacggacgggaacagtcgacattaaatgaagtgagccaatgtcaattgaaaaatcaaagcatgaaattcaattttaaaaa

SEQ ID NO: 73829 - DNA, 817 bp, Heterodera glycines
  Genomic contig location: Contig_ID=SeqID_1481; Location=1362..2178; Strand=-
  SCN-specific regions: Sequence locations=1-499,522-631,653-817
  Gene Ontology: Biological process=embryogenesis and morphogenesis
cctttgtcacaaaggtaaatgaccatgtcggaggtgccgaaagcagaacaccaattgagcagagtttggccaacgtcgtcgacaaagttcgggtcaacctgaaaccacgagtctttgagaattacggtttttagcaaccgttccattttcgacggcatcaattaacgcgtccgtgtcacgcaatcgaattgcgtcaattaaattgcgatgcgttttgtcaaaagcgggaggagcaacttaaaagaatttggataaaaaaaaagaaagagagagagagaggagtttgtgtacccgaatcgtttaataaaactcggtttttggaaattgcagaccgtccttcacagagtaagacaattagaaggtcaatgaaacgcaacgaatcctaaaacaaagtaccaaaataaaaaacaagaagtgttgacaaacttacgttgatacaacgttcatcctttccattgagaaccattttcaaagcaggaaccaatttggacgagctaaaagagaattaaaaatgcaagaaaaataaattggaaactcacgaaagaatttcttcagtgagggcgaaagaacttttgcacagattgacaaagagtgagaaaaccatagagatgaaagcggaacttctcttccgaattctgcagttttccccattcgaagataattcagtgggagcattttcgtgcgctgtcgaagatgaaccaataaggtcgaagagatgcgccaccaatctgctgggagaggccaacgccattgggtccatttgacgtcgcacgaaacgatcggtcattgcggcaaaacatcgcagtgcacactctgc

SEQ ID NO: 73830 - DNA, 4173 bp, Heterodera glycines
  Genomic contig location: Contig_ID=SeqID_1482; Location=106..4278; Strand=+
  SCN-specific regions: Sequence locations=1-889,911-1571,1599 -2188,2229-2823,2852-2913,2956-3462,3484-3517,3539-4068,4092-4173
  Gene Ontology: Mol. function=ligand-dependent thyroid hormone receptor interactor activity; Biological process=embryogenesis and morphogenesis
atggagaacactgctcgaacaaaggggagtcttcaaattcgcaaagtatgctttataatggaaaagcatcctaattattgtggtatgcgatgaacaatggtcgagcacccgatccccccccccccctccgtaagacggacaaggaatagaaaaaattcctcaaaggattttaacaagctctattaacctgcctaatgattatcaaaacaatgtcaatcttaaaaaagtttgaaaaactacaaaagttggactattcgttgtctgatggtcaaagccttgcacaaatgtctcacgatcaaccaaactttttcagctgaaactcgtcaaaatgtgcctggatccagccacaactcatcttcgcaaattcaaaatattggttcaaatttacgcgttaaactgggaaattacgccgaagttttccgcaatatgatgcagcaagtaaaaaataacaaaaataaacataaaatcaaataaacatttaggtgttggagtccggtgaaaattccgacatttacgacgtggacgaattcgacaacgacatttacgaggacgagttacattttatcgagtgcgatggcatttcatccattttttcttctgctaatttgattcactttagcgattgtgaacatcccggaagtgatcatggaggagggatcagcatctcttccgactcttcctcaattgctgatcgttttgcagagcatgttcaaaatatcggaagcacttcggtctccacggggccactgggcacaagcggtggcggagctaacgctgcgtcatcgatgttcagcgatgccacaacggcacttcaatcccaaattgagtctttttcgtccgttgcctctgcttttcgtcgtcagttttccacctcttccacttccgccaaccaatcaataattcccaacacgggagcctctcgtgccgatgcttttgcagccatccgtgccgccattgagcgaagtgaaaacataatcccttcgttaccaatcgatgtgatcatcggatcatctcctgtcaatgaagggcgaaatcatcgatggcgacaagccctactggacgaattcaatgcttttattccgccttcaatgggcagtcaaagtgatggacgacagcgaagcaacgaagaaggaaattgtggacgagcggctcgaacaatggcaaataaaacggcgatacaacccggtggttggaatgacgattttgtgcttcgtcgtcagttcggggcactcatcccagccttcgaccctcgccccggtcgaaccaatgtcaatcaggtctaaccaagcgcttccatttcaccgtaaaaaacactgcttcagacacaagatgttaaattgccggacagtattcaattctgtacatacagacgcaaagggtcgttgattagagaggagcctaaaggagggggaacttcttccactgccaaagaaaagtccccgattcgattgtttatcaaaatgactggcaaagaccaagtgaaaaatgaggaggaagaattggtggaactgaaggacgatgactcatcactgttccgttatggtgattcccaattgttcctaagtttactcttattaaaaataatgcacttaagtgcaagacttgctggtgacgagtcagaaatgcggacaatcgccgaatgtgtttagcgctgatgcgaattctctgatttgggaaaacacttttacgctgatttattcggttaatgagaatgaggcggcagaatgcccaacggaggacacggagaaggctatgactaacaatttggacgagacaaatcctttggttgaacaggtgggcggggaagcgtatccagggagagggaagtttctatctgtattttacaatttctcaattttcaatattaaggcattgaacgtgatcaaaatattacacgaactttctcgctcaattagcaacttcgaccaaattattggtgttgaagtcacttttccgactcttcctgaagaatcatttcacagtacaaaattgtcgcaaaaactttgccaagaactgactgatccattagtggtttctgcaaaggcgttgcctaattggtgcaactatttgggtgcgttatttaaacataaacctttgaattataaacattcgaatataattttttagtacacaatttcccatgtcttttttcgatggacatacgaacaagttttatgaacacgacaggtttaaaaatatattttttctattttttaacaaaatatttagcttttgggacctcacgggcaattgcgtatttacaaagtcgacgcgatcacttacttgaccaaaatcgttctgctacttcttcagccgcttccaacatggcaggccttcgaagagaggaccattaccctgagtacagaataggacgagttaaacatgaacggataaaagtgcaccggtcggcagaactcttcctggaaaatgccgtcaaagtgctaaaatttcatgcgttgcgaaaggccattttggagattgaatatttcggcgaagagggcactggcctcggcccaacgctcgaattcttttctttggtttatcggcattaaaattcaaaacaatgtatgatgtttgaggttgctgctgagttccaacgacgggacctttgcatgtggcactgtgaggacagtgttttggaaaacgaggcgaacgatcagaaaggcggaggattcattgggtcgaaacctaccggtttttacgtgcactcaaatgtcggtcttttcccagccttttggccgtcaggctctaatgaacgagttttaaatctcttccaaatttttggaatattcattgcaaaagcaattcaggtgagcttctttttcttgcttttcatggccccaaatttcaggacaatcgtcttgtcgacttgcccctttcgaaaaccttcctcaaactgatcacttcgcctaaggttttcttgttttgtttgtgtatttctttatacccattttgcagcttgcctcaggcgatgggccatcaattgaatccgttttggatttttccgatttcgcactgattcaccccgaaaaggtcgtttatacaacaaatttactatttaagcactgcctattttagatgcgattagtaactgctctgctaaaattcattgagcaaaggaaatccatccaatcggacgaacactttgactctgccgaaagggaaaaacagttcgacgaattgcgcgttgaaatgggtgaagccaaaataacagttgaaggtggaatccagcccccacattaattgtcttatcaattattctgctcatctgttagatttgtccctaactttcgcggttaatgctcccgctcgatgtttcccctacgaatgcgttgaattaattccaaacggcgcttcggttgaggtgaatggttccaatgtcgaattgtacgtgaaaaggcttgtcgactttcatttgaatgaaggaatccgtgagcaggttcatttaacatttgcttttctggacttggcttttccttttttagcttttcatgttccgcttcggcttcgacttggtttttcctctttcatctttgacttgctactcgaccagcgaacttcaggtgtcaaatttctcagcaacagtagtaattcatcttttgctcttacatttagactttgatctcgggagaacagagtccaagatggacacgagaagatttgttacggtattcggaaccaaaacttgggtgagaactgaccacagtcacacgattccaataataacccattcttcaacagttacactcgcgactcagtcggttttctgaacttcgtcgaagtgctcatgggtttcaattcggcggagcgtaaggccttccttcagtttacgaccgggtctttttctctttccttttttcgcatttttgggtgtttttaggtgctcttctttgcctcccggtggcctcgccaacctccaccctcggtcggtcttttcacttccctttgtaaatgcggaaatctgtttttcagtctaactgtcgtacgcaaagtcggttctggagatgggtcttatccggtacgatttttcgctctcatagtcagtgtaaatttcacattcagtccgtcaacacgtgtgtgcattacttgaaactgcccgagtacagcagtgccggaatactcagagatcgtcttttggcggcaacagcagaaaagggattccatttgaattga

SEQ ID NO: 73831 - DNA, 716 bp, Heterodera glycines
  Genomic contig location: Contig_ID=SeqID_1484; Location=747..1462; Strand=-
  SCN-specific regions: Sequence locations=1-398,420-517,674-716
atggcaaaggataaaatgccaataaaagaggaaggaattacaaatttgctggtgttggaagagaaattcgaccaaatcttcgctgggattcgctgcaaaaagcacagaaaaaaggaaaagcaaagggataaaatggacaaagagaagcgaaaagaacggacgaaattggcaaagcattgggacaaatggcgaaatttgctccttttgttgtgagtggccgttgcacacaaagccaaaaattgtgataattggtgacgcagtcaccgatcattgttattgtccccccccccccccccctccgtcgtccgtcgatcattcgtctcttttcgtggctaatcattcccaatccattaacaaccaacaggttctaatcgcaataggcaattcatccgttgtacatatgtacatatacctatccaaacatctcatatcccttttgataaaaatgtacgaaatacgaaatttatcatttattccctttttctttttctctttcccttccttccttttcccctcttctctctcctttgtctctctttcctcttttctctcccccgtccctctctctctctctcctctttgtctctctcctctttgtttctccccttttcctttcctctgtctcttttctcttctctctcccctgtctctctctctctctcccttttctctcctctttatcattcatctaaatatttcttctctaccataataaa

SEQ ID NO: 73832 - DNA, 128 bp, Heterodera glycines
  Genomic contig location: Contig_ID=SeqID_1484; Location=1842..1969; Strand=+
  SCN-specific regions: Sequence locations=1-76,104-128
atgcctgcgttcgttcttggatttcaaacaaaagtgccaatcttcgctcttcaagtgttgtcgttttcacgcggccgccccctcaaaaacaaagccaaaccaacggcagtggcaaaggagcaaacgca

SEQ ID NO: 73833 - DNA, 618 bp, Heterodera glycines
  Genomic contig location: Contig_ID=SeqID_10601; Location=1200..1817; Strand=+
  SCN-specific regions: Sequence locations=1-63,95-354,376-618
atgatcaaatattccttcacttcttcccaaatgtcttcagcacgtactcttcggtaagatttattttaatgcttttccttttttcttatttctctgatcagatttcagtgggctaaacggtcgatcagtttcccttttttccagcaataataatatcattatgaccatttttgagcttctatttgcctgaacaacacttttgctctctctgtctgatcatcctaaccgttttctctctatctgaccaatctgatcacttcttctctgtctgatcactttaatccctttgcttttttccttttccatctctgatctctctaatcatttctctttttcagtcactctctccattttgtgctctctgtgctccttctgctcgctttggccaatgtgctgacagtaaatgccactccgttgaccattctgacccgcgagatcagtcccgaggctgtggccaacaaattattggcgtcgttccccgaggggttggaccacatggaggaacagcacttgagagaggcgcgattctttggccaacgatgaaaaagagaagcgaagggacggacggaccttttgaagaatgatctctcaaattatgaccagttttttggcaattca

SEQ ID NO: 73834 - DNA, 593 bp, Heterodera glycines
  Genomic contig location: Contig_ID=SeqID_10602; Location=11..603; Strand=-
  SCN-specific regions: Sequence locations=1-593
atggtcacttcgctggcgtttgtgccgcttgaggaccttacaccggcgctggcagccctagaagatcatctgccgggtgaacttgagggcgttctcgattggtttgttgagtttaatttttttttcaatttcattattgactttaaaggtttgtaatcaactacgttgggcgacttcgcaacaatggcacacgcactcgtcttttgtttcgtcccgaagcatggagtgtgtatgagcgcacaatgaacggcaccgaccgcacaaacaacttcgccgaagcgtaccatcgcacgttgcaacatgcgatcggacaaggacacccaacaatatggaaattcatcaatattttgcgtgagcaccagaaagtaatcgacgttgacttcgaacatttccttgccggaaatgctccgccgccaaaagcaaaacgctaccgcgacacggacacaagaattctaaggattttgcaccgttacaatgaggaaaaaacgcagccgcaaatcgacgatgatcaccaatacggccaaaatcaaaataaccggaatttgatcattgaaatgcttagggggatttccagcctttatcaaatggattaa

SEQ ID NO: 73835 - DNA, 614 bp, Heterodera glycines
  Genomic contig location: Contig_ID=SeqID_10602; Location=714..1327; Strand=-
  SCN-specific regions: Sequence locations=1-57,79-614
atggacaatttcgaaattaaatcacaacggaactataaaaaactcgagcacaatggctgcttgtatgtttttcacaaattaaatgcagattggaacgtcaaattctggcgctgtgaacaccaacacggagaattcaagtgccgagggagaattcactcgacactcaatgatgtcgtgctgaagactattggagagcacacttgtcgccacagcgcggcaaatgtcgtcgcacagaaaatcgtcacgggcataaaacgacgtgccgctgagacgatggaaacgccagcagcaatcagagcccacacgcttcatcaaatcccgactccagtaatggcaagcattccgacaaaaaacgccaccaaaaaagtgaaatcttttttttttactttttcatttttgatttcaagctggtgaagcgagtacgccatgaaattgaactgccgccgccagtgccgagaacgcttcaagaattggaactcccagagcagtacaggatttacaaacgcaccgaagaagcgcaagagcttttccttctcgctgattcaacgccctccgtgccaaacatccacaatgctcaatcaacttttgcctattccatttggtgcgcaacatga

SEQ ID NO: 73836 - DNA, 95 bp, Heterodera glycines
  Genomic contig location: Contig_ID=SeqID_10603; Location=1088..1182; Strand=+
  SCN-specific regions: Sequence locations=1-95
atggaaccgcaaaagtttagtttacgaatgccgcggcgaacttcgtcgacaaattgtcactttccgaattacgtcgacatttggacacattatga

SEQ ID NO: 73837 - DNA, 77 bp, Heterodera glycines; identical to SEQ ID NO: 68612
  Genomic contig location: Contig_ID=SeqID_10603; Location=628..704; Strand=-
  SCN-specific regions: Sequence locations=1-77

SEQ ID NO: 73838 - DNA, 520 bp, Heterodera glycines
  Genomic contig location: Contig_ID=SeqID_10604; Location=203..722; Strand=+
  SCN-specific regions: Sequence locations=1-363,409-520
  Gene Ontology: Mol. function=DNA topoisomerase activity; Cellular component=nucleus; Biological process=chromosome organization and biogenesis (sensu Eukarya)
atgcagtatcgttattgcgactttgacaacaattacgtttcgctggggccatgccaaacgccgacattggcattttgtgtgaggcggcatgacgcaattgggcagttcaagccccagccgtactgggtggtgcaagccgaggtaatccccctcccatcatccaccgattcctgttgagtcatggccaaattgcaaaagtgaactcattaatttcctcttattgttagtatttttggaaattgcaccgaaaaaaaagattggattaaaaaaaaacgctttgtaaagatttattagttttttgaaaaacttagctattcatcataaaaattatgaaaaaaaatcgctagggaaattcttcaattttatttcattaaaatttgttttaaaattttctaatttcaacacatttattcaggtcgaattgccaaatggtggccaatcgctgacgttggaatggtgccgaacgaggcaattcagtcgcgaagctgcgcaaacactgctcgacaagatgaaagtatcg

SEQ ID NO: 73839 - DNA, 793 bp, Heterodera glycines
  Genomic contig location: Contig_ID=SeqID_10605; Location=196..988; Strand=+
  SCN-specific regions: Sequence locations=1-82,104-165,188-279,301-793
  Gene Ontology: Mol. function=transporter activity; Cellular component= secretory vesicle; Biological process=locomotory behavior
atggccgcctatttcacccattgcgacattcagccggtgcacaagattttgacactgcgcaccgccgccaatctgagcttcaaaaacaaacaaatgcgccactgtgcttcgttctgtcgacgctgcattgaattgggtttgaaaacaaagggacatcaaagtgttaacaaaatttattgcatttaaagctcctaagccggaaattgccgcccaaatgcgcaaaatgttagcggtggcggaacgcgacaacaccaacgcgttcgaggttcagacatttaaaatctccattttgcaaacattgtttccactgtgcagctcaactacgacgagcacaacccgttcgtgctgtgctcgcgctccttcgtgccgctgtaccggggcaagccgcagacaaagtgtcccttctgcggcgcttcgtatgcgcccacatttgccggctctgtttgcgacgtgtgcgaagtacgtcgtttttgtaaaaaggaaaaaatgccaataaacagatattttgtttcggtacaaaattagagcgatgaacctgggttccaggcctggttttttcctggacccaggtccagattctgcttattttcggcaaactggtttttttcttgacccagatttttccacctgtctaaaatctgttcattttctaaacaatttccatgtggaaattagaatgtttccctgaaacgaatgaatgtcaaaccaaatttgtcctttttataatgtgcatcactatttttcaggtggcggaaattgggcgagagacgtcgtcgaatttgatgatttctaa

SEQ ID NO: 73840 - DNA, 80 bp, Heterodera glycines
  Genomic contig location: Contig_ID=SeqID_10608; Location=962..1041; Strand=-
  SCN-specific regions: Sequence locations=1-22,45-80
atgttcacgccagaggggtgtgttttggatttggcaaataaaatttacggccattttggaatcgtggataatgtgaaatg

SEQ ID NO: 73841 - DNA, 584 bp, Heterodera glycines
  Genomic contig location: Contig_ID=SeqID_10608; Location=1143..1726; Strand=+
  SCN-specific regions: Sequence locations=1-307,335-340,362-444,481 -531,553-584
atgggccaaatgcttggtgtggcggtagcacttggtgcctggtttttcatggatcgatcaatccgcagatgtgaaatgcgagccgttatgtctcgtgaagaaaaacctcccatcaaacacttgcttgcgctgcatggacgttctgatttagtggattgcttttacaacatattggaaaaaaaagtaatgacaaaataaatggaagtgtgggctttccgcttatttgttagttttttaatttccttttttttttttgattttttggaaaggaggtgccaaaattgcattgaattcaccccttcgttcctattttaattcataactaaaatttgaaaaactttaagaacacaaaggccatggagtcggtaaagcagcaattgagcgacctcggcttggaccacgtttccgacgcatttgtggagggctacaagcgagttgaaatggataataaatcaaaaaataaatattttaattaatattcaattcctaactttacaaaacatttagcacgaaaatggtttgtgcaaaatgtgccaaaaaagtggaacacatcgatgagctttgttactgcatggaagcggcaa

SEQ ID NO: 73842 - DNA, 118 bp, Heterodera glycines
  Genomic contig location: Contig_ID=SeqID_10608; Location=2219..2336; Strand=+
  SCN-specific regions: Sequence locations=1-41,63-79,101-118
atgtctttcccatggagcagaagtagcaacacaaacactggaaagcatttaaatgtaattcacaattaaattaaaaaagttattttcaattgcttatttaattgattttcagaaatag

SEQ ID NO: 73843 - DNA, 1083 bp, Heterodera glycines
  Genomic contig location: Contig_ID=SeqID_10610; Location=681..1763; Strand=-
  SCN-specific regions: Sequence locations=1-356,379-752,790-1003,1026 -1083
atgcaattagaaaaagacgaaattgtgccaaatattgtggactgtcagaagccggagatggtcaattgcacgcatttcaccagtgagtgcgaaggtcaaggcgggagagcatgttgctacatttgcaacacggacggatgcaacaaaagttggaaaaagtaaaatattaaccggacaaaggaattcaattaaaattgaaaaagacccattaaatgatcaatcatccgatctctaattctaatataatattatagtccccgcttaaataataatggaaaaaatttgataccgtaattaggaagttacggtaatacgaacaaatacccccccccccaacttttccaaacatttatgggaataaatgataaataaaaaagcaccccgaaatcgaattataaaaggtgatcctaaaaattagacatacttttcacaatattttttggtttttccttttccttatctttttttcaaatttcgaatttgcctttttttcgcaataataccacaaaattataccgactttttccgcttttgtaattttttttggcaatttttatgatttttgaatccactttttgatgattctcgtatgcttttaaatttggattttgagttcaactttctcttccactactccgacgagtacttcgaccaccaccaataaattgtcctctacgcctcccgcggaaatcaaaaataaattgcaatgtttggcatggaatatttgcaatttgttagttttttataatttgaaagttaaaatttatcattttccaaggcacatgaaattgaagcagtcaaaggtttcgcgacggttttcaattggtcaaaactgcgaggaaatggccaaagactggggacagattgaagaagatgaaaaaatcggagatgaatacgaccaaagtgccgacaacaatggccaagtgtttttggcggattttttcgttgggcgaattaatgcaaagatttaattgattttcaacaaaaaatccaattgatttggtttaattgaaagaaatgggaaattaattcaataatttaaaaaattcaattgcccggggcaatgacaaaaaaaataataaa

SEQ ID NO: 73844 - DNA, 138 bp, Heterodera glycines
  misc_feature (14)..(15): n is a, c, g, or t
  Genomic contig location: Contig_ID=SeqID_10613; Location=3705..3842; Strand=-
  SCN-specific regions: Sequence locations=1-30,53-138
agcgctttccccanncacaacagaactcaattgataatgttttgtatgttttaaaataacaaatgagggccatatattaccaagccacgcatgcacaccatagccgactgtccaccctagtttatatatatgttatat

SEQ ID NO: 73845 - DNA, 1191 bp, Heterodera glycines
  Genomic contig location: Contig_ID=SeqID_10615; Location=400..1590; Strand=+
  SCN-specific regions: Sequence locations=1-22,65-93,132-482,504 -526,548-1124,1146-1166,1188-1191
atgtttaacccttcgtttgcaattccttttatcattattatttgcctcctttttccattatcattatcaaaaacaaatctatcggtgagtttcattttaaaaattgtttaaattttaattctttttaattaggttgacgaagaagacaattagcctgcaaaattgcgaaaaatatcgttaaggttcaaaaaagttatggccagaaaaatttaaaaaaccaaattttccaacttttttggctcgaactttttttaaaccgaacaaaattttttggaattctgcaggctaatagagtatcagaagggctatcgaatgataccaacaatgttggatttggttgacaaataaaaaagttattgtccaaaaacatgtgttcgtacgaaaacggcctggcccgaacaaaatcaaatctgtgaatttacagcgaaaaaaatatgaggcgcaccttggcattgtgtattttttaagaaagaattggcaatgtgaaaaattaagaagaagtttgaaaaagaataccaaaaatatcgcaagtatttgggcattttgtacgaatatttgttcagacaaaacttcggacttcccggcgttaagccaaaatttgtgtttataatagaccaaacggaaataattgttcatttgttcaagtggtatattacttggccaaaattgcatgtttttattttgattccaatttgcgtgaaaaatatattttcattattgcaaaaccacgattaatgaatgagaaaagattgaattttgaggcaccaaaaagtgaccaaataatgtcaattaatgaatcgattttgcaattagcaattgatacgtcctatgaatggccaccaaatgaaagtgtggacggattaatgcgacaaatttttcatcatcgaatgcttttgattttggccttatcacacgtaaaatttttaattaagtggcaagggcgattttcggggggttgtccttaattaattaacgggaccgtaacgggcgagaattctgttcacgtcatccagcataatcgatttactgtttaaaatttttgacttttttggctccggcgccaaaagtgatcagaaaaaatcgatcaaaaacccgaaaacccgataaaagtggtcatttttttcaaaaagagggctttttaaaatattcaaatttcatttgatgcataaaaaatttattcatataaaaata

SEQ ID NO: 73846 - DNA, 654 bp, Heterodera glycines
  Genomic contig location: Contig_ID=SeqID_10615; Location=1717..2370; Strand=-
  SCN-specific regions: Sequence locations=1-69,91-581,610-626
atgccagaaggaacggagtgtaggagaaagtgggataaaggatctgagaggaccgctaaaaggagcgcccgtagctcagttggttagagccacggcactgattgcttggggtcatgggttcgagtcccaccggccgacttaccttaaatgaaactaatttttgaaaacaaaatatccattcctggccttgagtctattttaggagtttttttttctccaaatccactaaaaatgggagagccatttaatgtaacggccatagctcagtcggtccaatcattagacggtttagaatgcccatgggttcgagtcccaccgggcgagttacatttttgtatttggcgaaaataatttgagttggatttacctggtaaatggtattttagtctttactaatgaattttttgaaaagcgacatttaagcgaaaaccggtcggcccgcaggggtaattaattaataggtgagtgttaatttgaagggaaatggaatttgatgcttctcacttgggaaaacacttctcttttatgtcattcatttacatcaccatcagttaattttcgatcggagtaaatatttgatcatttatataaatcaatttttaattttttgctgcgttatctgatggatttttttattattttttaattaataaa

SEQ ID NO: 73847 - DNA, 902 bp, Heterodera glycines
  Genomic contig location: Contig_ID=SeqID_10616; Location=290..1191; Strand=+
  SCN-specific regions: Sequence locations=1-444,473-668,690-902
cataaatttgtgttcccgaagtggcaactttatgctcgtttttcaccgcttgtgctcggattcggcattgaaccgttggcttacaagacattcaaattgcttgatgctaatgaaggtgatgcacgaaatggatcagtgataaactatgaaatcctgcttaaatgcaatatcagtcctcataaaaacgaaaactatgtaatcgggagcgaattttatcagcatattggaggagaagccggttttataatccaagtaaaactgtacgacattgagatggcacgcttatgctatgaagatgaatatggcaatgaaaatagcatttcaattaaaataagaaaaaacacgaggcttttgaggtaaaatttaataaatagaagaaatatttaaacagtaaaattgaaaaatttttccaattcttggtgtaatcattttcgcaaatttagcaaaattaaaaaaaataataataattaaagattacttctaagcaatgaaaattttattagaacattcattgttgaaaaatccagtttcattaaactcatgaattcgaacttgatatgcgaggtgatgttgaagttgttaatttattaccacattcaaaagtcaatgtcgaagctggcacgagctcaaatagcagcaggttaaacgcatcgataatttgtacgaattttagaaatggttatatttaaaacctaattttaagaccacaagccctaactgtcgatgataaaaaggagataaacccattcaaacactgatcaaaaagcaatagacttgtggatcggctaagtggatgtgatcagatggaaaagccgtaccccccccccacaaaagatagatcatttatgattagcatgaacagtatataaattgttgttgtcattatgtaaacctttttttaa

SEQ ID NO: 73848 - DNA, 353 bp, Heterodera glycines
  Genomic contig location: Contig_ID=SeqID_10617; Location=52..404; Strand=+
  SCN-specific regions: Sequence locations=1-353
atgcatcatttaaagacattgccgctgctggtaggtatggtacaggagttgaagagcttaaccaattaatgttgctttaaatttgccagaattttcactgtgtacaccgagaattataaatttaataaaaacaccgtcgcgatagtataaaaataccgtattcaatttaccgatacgataatataccgtatacatattttgcagtgggatgtacgagatcgggaccgagccggcaaagcctcggtcatcacaaatcccactcccggtagtcaaccgataagcgggaatgataagcattgataagaatgggagagggggtctgtgagtaaaaaattatggatgaaaatgataaa

SEQ ID NO: 73849 - DNA, 1267 bp, Heterodera glycines
  Genomic contig location: Contig_ID=SeqID_10617; Location=680..1946; Strand=-
  SCN-specific regions: Sequence locations=1-80,157-178,201-221,250 -339,377-1058,1080-1195,1217-1267
atgaatttccttatttttaccttcatatttttatatattgttaatgtatgcaatggaatgcataatatactcaattccactgattatgatagtaattataataagcctaatcatactaatgataatgatcagaataatcaaaatgatcatagcaatggcttggcaataaattactataataatttgttaataaacaatgacagatcggcacaaaatcaacctgataataataattattattatcaaccaaatttggacaatttaacacaaaatttgcacacatttgacaatttgtccacaaacaatggcgacaattatgatgaaatgggccaaaatggcattaataataacaacaacaacaacattttggacaaggtttcaacacaaagtgcagatttcaactcttatttcaacaattttgtaccaaattggcacacatctgacacattggtcacaaacaatggcaacaattatgatgaaatgggccaaaatggcattagtatcaataatgaaaatggacctggaaacaatttggactcaaatttcatcgatttaacttcaaatttggacaacattggcatattggccaacacaaacaatgacaacaattcgggccacaatccaaatggcattaatggcgcattgaaaattggcacaagcagagacagaaacagaatgccaagccgagcaccatcgtcatctgtaggaacattaaaacggaaaagatctcgacggcgagacccatcacgtcagactaccacgatacatattgacaaacaaaattttcgtcaagctgtccaagaagcaacgggaggaccatttaaaccgtcgatgatgcaaaacatgaaaaatttgttgccaccaccgcatggattgaccttgacattaccaggaatgcggacaacacgaaaacagttgatggacattttgttcaaaatttcaaaaaaaaaaatcattaaaaaaagttataaactgagtaactcaaaaaaccaagttttttttttgttttgaacatttttgataataatcttcttgaaattttttttaaattttgtagctaatagaaaacatttagagctatcaaatgatatatagaattaaaaattttgttgctttagaaaatttttcagttgatggttttcgcctaacggcatagcatcggttgaactaggtggctcctccacgggtcggggtcactttggcgcggaatattttggcgccgcaaattttaaagtgttataactattttcttatcaagccaaataaa

SEQ ID NO: 73850 - DNA, 1311 bp, Heterodera glycines
  Genomic contig location: Contig_ID=SeqID_10619; Location=686..1996; Strand=+
  SCN-specific regions: Sequence locations=1-120,146-312,350-449,483 -663,687-964,990-1186,1224-1311
  Gene Ontology: Mol. function=extracellular matrix structural constituent; Cellular component=collagen type IV; Biological process= extracellular matrix organization and biogenesis
atgactgcaatcagcgaggatgtttttgtgtgggcgaaaaaggttcgtaaaattaaaaacatttttttaaatttgacaatgtttataaaattcacttttttaaaggaatagtttaaaatggtcaataaaactttaaaaaatcaaatatttttcaagaaccatatatgaagggggttcgcaaaaatttttttaaatcgtaaattttaaggctctcttgggccaccaggcccccaaggtccacccgggacggcaggaattcgcggcttccctggcccagatggactccaaggcctcaaaggacaaaaagtgatgaaaatttaaaaagatttttaatttaaataaattttttcagggagcccaaggtccaccaggctcggctggcataaaaggcgacagaggcccggttggcatgccaggctttgccggaaatgatggcactccaggacgcgtaaaataataatttttgtttaattttataaattcgaaattttcagcccggcgaggcaggcccgcctggtccgcctgggtgggacggctgcaacggcacggacggatttatgggcctacccggcgtacatgggccggctgggcttcccggatttcctggacagcctggaacggacgggcccaagggtgagccggcacttggctatgctggcgctcctggcgaaaaagtgatggcggaaatttttttttaatccaaaaaaaattttcaagggtgacggaggagtgccaggagttcccggactgcccggaacacctggccgagacggatttcctggtgagaaaggtgaccgtggtgatgttggactgccagtacgtgaatgaatgccaatttatcaaatttaatcgtaaaaatggtttttttcagggccctcgaggtccccctggcgaacccggtttgcccggaaacccggggattggcacggttgggccgaaaggcgacccggtaaaatttattacgaaaaaatatatttaaaaaataatttcagggagagcagggcctagttggactgcccggaccgcctgggcctgccgcgtatggcctcggtgcaaaaggaacaattgttggccccgaaggccaccctggccacaaaggcgacaaagtgagtctgattgggggcgggataaatattattggacaaacattcaattaaacagcatttgggaattggtggaaagtttgattttattattagtgaaattaaaaataaaaattaatacttgtgtagttttcagcaatattaatcaaattttttaattggcgcaaaaaacatttgctaatgacatcaaattaattaacttgattaa

SEQ ID NO: 73851 - DNA, 118 bp, Heterodera glycines
  Genomic contig location: Contig_ID=SeqID_10620; Location=233..350; Strand=-
  SCN-specific regions: Sequence locations=1-28,50-118
acacggcgagtcaattttgggctccaagtacaattaagttggttttttcgtcttagtggtctgtgagttagtcaccaaaaaggggctctaagttcaattcctccttgtgtttgtgtat

SEQ ID NO: 73852 - DNA, 711 bp, Heterodera glycines
  Genomic contig location: Contig_ID=SeqID_10622; Location=638..1348; Strand=-
  SCN-specific regions: Sequence locations=1-155,179-335,357-711
tatcctggccacgctgaaaaagaccctgttgtttctccggacgacgcactgagcggacccgaggataggaggtaatcaatgcaagaacgaaaacgatgtggggggatatgtaactaacatttgcttttttcaactgttgttgtattggtaattgacccctctccgcccccgtccccttaagagaggtcagcggcaacaaaaagtgcacttgcactaaaaattgctaatcaattgtttgcggtgtttttaaaaaaatgagcagcggtgccgatagaatttttcgacatatcgttaatcgattttcaccaaaaattgctattttatgggcgttcgcaaaaatttcgcgttattttttggaatttttgtgagattggatgtggaggggtatcaacaacaacaaaaaaaccgagatttttagctgctatttctctttaaaatttcgagtgcggataggtcttggggttgatagtcttgttggtctaactaacaatgaatgttatgggaaagtcaaaacgggtggaaaggcacatttttcaatcggccgaaaatgggagaaacattgtaaaaaatttaaaacatattcagcgagcaaatggaaagcggaattgtggaggaaaagcagcaaaagtccaccgcatcagcaccttcacaagaagacgagacggtccagcaacaaaacgggagcgaaaattcagttgagaggatggaaag

SEQ ID NO: 73853 - DNA, 1168 bp, Heterodera glycines
  Genomic contig location: Contig_ID=SeqID_10623; Location=158..1325; Strand=+
  SCN-specific regions: Sequence locations=1-121,143-505,530-1030,1052 -1138,1160-1168
atggaggagaagaacaccgagattcgagggcacatgtgccgaacattggtcaaatcgcgcaagtgcaattaccactggcaattggacggtgcgttttttctgtttgttaatttcagtttgttcatatgaactcttttcatttgtcagcggatgatctgcttattgacgcgatgtacaaagcagaaacggacggaaacgcaatggacattgaggatttgatgaacgcggcgcgcaaatttcggtttaaaatgcatttttttaaatgtattaaattcaattctttttagccactgtcctttttaccgggctcgtcaaatgtacgactcggctgaccttatcctgctgccctacaattatcttcttgacccaaaaattcgcaaaatccattcgattaaagtaaattccattttttttctttttttatattttctttcgtttccatttttaggtaaaaggcaacattttgatttttgatgaagcgcataatatggtgaaagcggcagaacaaaccccaaattctataaaatttattatttgttaggaatcaattgcagaagagtcgatgtctgttgatttctccaccaaatcattaagtgttgcaattcgggaggccaaacatgttttggaaatggttgtggacgaggaggaaaatttgcgtgacgaaatggtcaccaaaagtgttgatagtttggccattccgttgtttattttaggaaagaaatggcatttcattcgccgaattgaccaaaaaggagaaaggcaaaggccaaaaggacgacgatgaggaggaacagcagcaattgaagaagaatgacgtggcccatttgctaagtgatcgaaagagtcggcactttcccttcttttaatgccttccgtcgattaagcgcttctccacaacttcgaggagcaaatcgatgctttggtggcggcgggcggaggcgccgtcatcgacagagtgccgggccgagtctattcgggttttttcggatttgaaattgcaatggaaatttatgttttctcaggtgaaaaaatggttgaactgatgaagaagtcacagataatgcgtgttcatcgggatagaatttgcgctttgatcgataaaattggtctttttctcgccggacatggtgacacttcagaagtgaccaaaagaattaattaatattga

SEQ ID NO: 73854 - DNA, 340 bp, Heterodera glycines
  misc_feature (85)..(85): n is a, c, g, or t
  Genomic contig location: Contig_ID=SeqID_10623; Location=1417..1756; Strand=-
  SCN-specific regions: Sequence locations=1-138,162-252,295-340
agtacctgcaggtattcattgctacgccagcgttgaaacacctcaaattggttttgattttgcggttgtcccccccccccgcccncattttttctcgtacaataattgagtttcacttccgttacgggttttgcgctttcaattccattttccccaacttccatcagttctttgtgctgttctcgcgggtccaaaatgttttccttttgctcaacaaaaagttgaaaatgacgagaggcatctgcaaaaataaacaaaaatgtgtacaataatttaacaatttccattaaaaaatgcattaattcatttcaataattgaagtcagtgccttcatcgctct

SEQ ID NO: 73855 - DNA, 1450 bp, Heterodera glycines
  Genomic contig location: Contig_ID=SeqID_10624; Location=534..1983; Strand=+
  SCN-specific regions: Sequence locations=1-799,821-1220,1261-1450
atgtgtcgctctgccaatggccaatacctttgggatcaactcgaacggcaaaagcgtctcctcgtggagccgaaagacaaaagagaagtgcccgcattgttcagagagttcgatgccgccgtgcgcgaaaatcggccgtcggttggaaaaagtggcggtgcacttctgttcgctgtttgccgtggaaaagttcgccgcccttttctctgctggtcctttgacctatatttcagctgagtgagggcattgacttctccgactcgcactgtcgtgccgttgtcatcgttggcattccctttccgcccctttacgagccacggatcattctgaagaaggcgtgtttgacggaacagcgcaggaaaggccgaaatgtatatagagtatttcattggaaaataataattgggtttcttttccgctttcagtcgcttaatgcggacgaatggtaccgaattgagggcatcagagcggtcaaccaggcactggggcggatcattcggcacaaggaggcgagagtcttgagcactaacagcaaaagggtataactagtcccttttacccaatcccttttaggactttggagtcgttgtattggctgattcgaggtcacttccgcattcgttgattaattgagggcattttcgagtgtttaggtatgccaacctcaatcggcagatgttcccgtgttggatccgaaattccatcaaggagctgtcaaatacggctgcttttggacaaattgttgtccgtttcttctcagaacgtggcattctcatccaaaaatcgcacgacgcaatggttcaacaacagcagcagcaaaatgaacggaaacgacggagaacagaacagacgacggaccaacaccaaagacagcacccttcacttggggggacactccgaaacggaaagtcccaactgaatttggcactgctggacggaatttctgatctttacacgattgacgacggattgtcgacgccgtcgacctcacaaaatgcaaacggaagggaaaaggacgaagacgaggagaatgatgacattcaggcaagaaggagtgaaccaccgattatcaccgaatttggacaaacttatattttcaattttgcaggtaatatgcgttcagaaaccaatggacaacaaatcgagcagaacgccaaacccaccaacgatgaaaatactgcccgaaattcaatttgtcggacagcaattaaatggggtcaaacgggaacaacagcagcggcgaacgatggacagagaggacgaattgcgactgactttaagtgagaagtccaaatggaagagggcgaaactgcgcatggccgagctgaacccggcatattttgaggaaattggcgagcattgaagaagcaacgggcagcagtgaaacgggcaccaattaacacacacttaccggatgacctttttattgttcatttttactagtggaaaa

SEQ ID NO: 73856 - DNA, 210 bp, Heterodera glycines
  Genomic contig location: Contig_ID=SeqID_10624; Location=1..210; Strand=-
  SCN-specific regions: Sequence locations=1-68,91-210
atccgaacgagcgcagtgcggagattccaaggtgaagccgaacgcactgaaaagacgctaatggaaagcaatggacagaaaagacgaacatttcccattgcactgtttgaacattggcaacggggccaaagtgccggaggcgagaacgatggaccgagtgccacgtttctattcatatcataattaaggaaaacagcagagccaccagta

SEQ ID NO: 73857 - DNA, 2976 bp, Heterodera glycines
  Genomic contig location: Contig_ID=SeqID_1486; Location=1925..4900; Strand=+
  SCN-specific regions: Sequence locations=1-140,162-261,283-530,552 -1174,1197-1571,1615-1641,1663-2204,2226-2806,2828-2855,2877-2976
attgagcggcatgttcggctcaatggaaaagtgcacaaaatggtagtcgactccggctcaaaattgacaatcgtgagaaagctcatttgggtcaaattgggccaaccgtttctcacagaaacaaagctcaagggtcgttcattcacagggaacattttcacatttatggggaagttcaaggtccaagcagcattggacgatggaatgcccctcgatttggaatgttttgttatcgattcgagggacacactcgatttgatgggacttccatggataagagcatttgaacgcgcctacaaccaagtggtggcgacaactttgtcaatcgaaaatgttgccgacagtcgttggtgcaaccgatcaaacagcacgtcgacgcaattggagatggatttacagaacacatttccaaaaatttttgaggaaacattgggactttgcaccaaaatcagggcccatctcaaaattaaagaaaattcatctcccgttttttgtgcagcacgaccaattcccatcggcgttaagcaagaagtggacaaggaattggaccgtctcatcgatatgggcgtcctgaaaaagaccgactacagcagttgggcggcaccaattgttgctgttcggaaagcaaacggaaaggtacgtttgtgcttcgatttcagcacaggactaaatgccgcattggaaccacaccaccatccactgccacgacctgaacaactttttgcgcagctctccggcgcgaaagtgttttcgcaaatcgacttcaaagacgcatacttgcagatcgctgttgatgagcagtcacgcaagtttttaggcgtaaacactcaccggggtttatttgagtgcagtcgtttagccttcggaattaaaagtgccccaggcatttttcagtgggtcatggaccaattgagtaacggaattcccggagtgcttggctacatggacgacttcatcatcgcctcccgttcaatcaaagagcattatcgaacgctttatcaatttttccaacgaattcaggaatttggtttccacattcaactggggaagtgcaaattcctcgtccagcagatcaaattccttggccaaattgtgacaccaaatggaatcaaaccggactcgtagaggacaaaagcactgcaagacatgcctcaaccacacgatgtctcaactctccggtcgtttttgggtgccatcaattattatgggaaatacatcaaaaatttgcacgaaattcgtgcaccattagactcattgctcaaaaaaggagctaaatgggaatggacacgggaacatcagaaatcatttgatgaagcaaagtctgtgttgctgtcagacttagctcttacacacttcaaccccgatctcacaatcatcgtcaccgccgacgcgagcaacaaaggaatcggagcgacaatttcccaccggttcaacgacggaaaagagaaagttttccaacacgcagcacgaactctcaccaaaacggaacaggcctattcccaaattgagaaagagggacttgggctaattttcgccatccaaaaatttcatcaatttatttttggacgaaaatttattctccgtactgatcaccgaccattgttgggaatttttggctcaaagagtggcatccccatattttcagcttcacgattgcagcgttgggcactgattctgctcaactacgacttctcgattgagtttgtcagaacggactgcacaggacaagccgatgctttgagccgactgatcagcgaccaacgatcatgctcaaaagacgaagacgtcgtcattgcacaattgttggccgacacggaagcagatgtggcacatgtattcaacacgcaaacggaacaattgccactcaccgcaagggaaattgccgaggcacagctcagtgacccgctgatcagagaagttttagagtgtacaatgggacggtggccaaacaaaggccttaatcccgaaataaaaccatattttactgtccgaaacaatctgtccataatctcagattgtctcgttttcaacggacgtacgatcattccacaggcactgcgcgatcgaattttgaaggcacttcacctcgctcatcctggcatcgttcgaatgaagagcctagctagagaattggtctactggccgtcgatggacgctgacattgaatcacttgtcaaaagctgtgttccatgccaagaagccgccaaacaacccacaaaacatcctctccaaccatggccatcaacaacatccgttttcgaacgtgttcacattgatcttgccggaccatgcagtaatggtaaaacttacctggtggtaattgacacttattcaaaatggcctgaaattttccagttaaacaatacttcgtctcattcagttatttcacagctacaatggttgttcgatcgttatggtgttccaaaaacgcttgtgtctgacaatggaccccaattttcgtcatccgtttttaaggaattttgcaaaaataatggcattaaacacattttcagcccgccatatcatcctcagtcgaacggagcagctgaacgctacgttgactacttcaaacgccaactcaaaaaatgtagtggtgaccgaaattggcttagcaaatcacttctctcatatcgctcaacaccaattgctgttttaggccaacgctcaccagctgaattgtttttaggccgaaaattgcgcacaaaattgtcactcatgaggcccgaaaccattccaaagcaacaacatcacgaacacacgtccaaaatgaaattgcaatttgacaaaaagcacaatgtaaagccggtacagtttaaaattggagagcaagtccaatttctcaattaccgaaatggcaaaacactttggctttttgggcgcattgtttcaaataaagggcttatttacgaaatccgttcccctcagcttggcaatcgaattgtcacgcgtcatgccaaccaaatccgaacaacaatg

SEQ ID NO: 73858 - DNA, 890 bp, Heterodera glycines
  Genomic contig location: Contig_ID=SeqID_1486; Location=5595..6484; Strand=-
  SCN-specific regions: Sequence locations=1-126,148-308,341-579,647-890
atgatgcgggagataatgacgaacggacccatccaagttcaagtggattggtatgtggatgcctatttatatggccaaaacagcacacaggtcaatgtttacatggtaagttggtgttgaacaatgatcaaatactaaatgctgataagcaaaaattcaatttccgacattcaaaatcattggaaatatttgttttaagcattcagaaaaaaaattctgtagtggaacctaagtgaccgacgataagaatgtttctcggctctacttgaaaactgagcttattgtaaatcattaaaaattcaattatcttttattttgcatatttttaaaagagatgtctaatcgtgaaaacgagtttctgggcgctgtcaaggctgctaggcagaacttgacattcattttggtccattccgaattcctaacccgaactcaacaatcgattattgttcgagtatgggttgggtattctgaaatggtattggttgaaaacggatatcgaatccctgcgagtattcgtacatgagtataaaatttggttgagtgaatattcgatattctatttactgcatgtagattgttaattaaaataaatgatttaaataaaatttaattgattaaaaaaaaattcaaattttattaaattaaaattgtttgtcttttggtaggcatttatcggtggattttttgtgagtcttctgtgcgtacactaacccatcaaattgtaaaaattttattatacaaaatccttttagcacaccatcgtcaatcagactgacaagggtgattaccaagaaggatcattgaaactaatcggatggggcgaggaaagcacggacaaaggcgagctggtcaagtactggttcggcgtcaatagttttggcactgagtaa

SEQ ID NO: 73859 - DNA, 1819 bp, Heterodera glycines
  misc_feature (1755)..(1755): n is a, c, g, or t
  misc_feature (1765)..(1765): n is a, c, g, or t
  Genomic contig location: Contig_ID=SeqID_10625; Location=615..2433; Strand=+
  SCN-specific regions: Sequence locations=1-54,78-326,366-880,904 -1414,1452-1691,1713-1819
  Gene Ontology: Mol. function=translation factor activity, nucleic acid binding; Cellular component=ribosome; Biological process =regulation of translation
tgttttttacataattaaaatgaagagatagtacgccaaagtgagacaaattacaaagaaaaagagaaacgacgagatagtactaggcttttctctgcacagtggagttgacccatagtgtattgacacatgtctcgttttttgactcggtgtgttaacaacgcccaaaaaaactaagcccaaattcttggtgtcatttttaaccatttgtaatggatcaaaaaaaaataagttagaacccaaaaactcggcctggtgcgaaaacgaatgcggactccgaccgaatgttcaaaccaaaaagtttatgtttttttggcgttcttgttttttaataaaaataaacatttgcattggcactgggaacccaaaattaacttgctgtttgttttaaatgttctgaaattaattttatgatgtgtggtgtaattgttttgtattcttgggtttttatggagttctaattttaaatccgtgctgaaaacgtattatttcgctagatggttttatattagttttgaaaatgtagtgtccaatttattagcatttatttagctcgataaaattctaactcagttagacatggaccgtaatttgaagaggaatgaagacagtgcgattagaaatgagcaacggataaaggctaactttcaacttgcacaattagtggtctgtttgttttttttatttccttaaaaagcttacttttgtttagcctgatgttccgttaagagaggacgaacatttgttggaacacagctacgtattttcgtattttatgcgaccgcagggaaaattcgaccccgaagattatgcgatgttagtagtgagtgaatggttgaaagcaaacaccgtcagagggaattagagaatttgttgggttgggggaaaagcgggggaggaggaaggacagtcattgcttaaatctaaataacttcaggtacgtgcaaccagtctcaaagatcagttcagtcgaacagttttggcaagtgtaccgattcatcaaaaggccttccggtttgtttatttattcagggaagagcacgcgcttgtaccttttgtgctgtacttattcggacttcctttctctctattttagatatagcggaaaaggtcgacttccatttgttcaaagagggagttaagccaggtcaaaccattcgattcgtctcttttgtctctatgattttttggttttcagtttgggaggacccatcgaatagaaacggagggaaatggattctcaggtaagctacaaaatgccgtagcttgaattgtatgccactcagtttttcgtcccgcttaactgcttatagattgaagaaagggctttcctctcgcatttgggagaatcttctgctcgccatgattggtgagttacaatcaccccattaacgcttcatgactttttactgccaaaaagtggaaaattgaatttttaaaatttttggcataattttctgaaaacaaatgaaacggaaattttactgcctataaaaaacttagatatttttgaatgcttgaagttattaagcattttatggtcttgtgaatttttatgatcgtgcaagctgcaatagatccgtaatttttttgagttgcgcttttctttttttgaggcgaacaatttctcgtcggtgacgaagttgttggcgcggtctgcagcgttaggaaccaggaagagtgtgtttaatgggaaaagcaaaggaaaagcaatttttctttggtttagcattgtgtcgctaaggaatcgaccgnccgattctcncccggtgccactttaaaggcgcactttgcggagagtgctcaatttgccaacaaa

SEQ ID NO: 73860 - DNA, 350 bp, Heterodera glycines
  Genomic contig location: Contig_ID=SeqID_10626; Location=1..350; Strand=+
  SCN-specific regions: Sequence locations=1-350
atccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaagtaaagtac

SEQ ID NO: 73861 - DNA, 1155 bp, Heterodera glycines
  Genomic contig location: Contig_ID=SeqID_10627; Location=174..1328; Strand=+
  SCN-specific regions: Sequence locations=1-24,47-297,319-548,591 -872,894-1155
  Gene Ontology: Mol. function=electron transporter activity; Biological process=dihydrobiopterin reduction
atggcctcccaagtcgaccgcgtgttaatttatgggggccgtggggcgttgggcacggctttggtggagcatttccattcgaaaaacattgtgggttctaaacagccgaaccaattcaaagaattcattcattgggcaatgcttttggtctgtccctccattcagtgggttattagcgtggacttggccagcaatgaaatggcatctcacaacattttggtggaccccctccagggagtgcaagagcaggagcattctgtgctcgcggggttcgttttgctattctctgtgtatgtttctcggagttgggcttttgcagcgtcgatggtgcgctcggtggagaaaagctcgacgctgtgctttgtgtggccgggggatgggccgggggaaacgcggcgcacaaagactttgtgaagaatgctgatttggtgggcctcaatgtttcaattccgaaaatggcatttcctattggcagatgtggcgtcaaagtgtgtggagttcggcattagccggttagaaaaagcggcaacggggggcgggggggggtcattttttaaattaattttttaataaaaaacaatttaatttatgaaaaacgctttttgaaataaaaggcatttcaaaacattatctagctgggttgtctgtcctcaaccgaattgtcccattggctgggctttaaaatatcaaatgcttaattttttatcaaaaggaattggattgaaaagccgaattttgtgcctgagtttgtattcttgtgattagttaaagttgacctcatctgccaataatgaggcccttttagccaaaatcggcactcgctttctcaaaaccaacggccttttgcaatttaccggcgctgcggcagtcggtgacttttttgtgtcatttttaacggttttcttcaggcttctgactcgaccccgggaatgattggctacggaatggcaaagggtcggtcgatcaactgacaaatgagcattccttgatttggatgtttcattttaagcggccgtccatcaattggtccgaagtttggcggatgcaaaggctgcggggcttcccgaggggacgtgctctttcgctttgttgcccgtcactctcgacactccgatgaaccgaaaatggatgccaaaggccgaccattcctcgtga

SEQ ID NO: 73862 - DNA, 705 bp, Heterodera glycines
  Genomic contig location: Contig_ID=SeqID_10628; Location=795..1499; Strand=-
  SCN-specific regions: Sequence locations=1-293,315-452,496-516,658 -666,688-705
atgctaaacatatccgcttacttctattgcagttctctctgtttccaactattcatccacagaataatgatcaatttgccaagtgttcagttgaaaagttattgatctagaaatatcgcatacaggccgtatactagtcatacattcctttagtacatcaatgggtactaaaagacgctgccttcccttaataatgccttagttcctttgagacatcaaataattccctcctaaacgataccagcgctgtcattaaaattttcaatgtcattacatttttttctcattaattgcctctgtaaatacaaattttccagttgagaagatagttgtggtagaatttgtacctagacccttcattatatttaaaagatttatgtggttgtttttagtggatggggatattaaataaattgaggagaaaagttttactatttattgtcagtaacaccataaattgaatttaattttagatataatttacttaattttaatcaatactattgtatttattatttttattatattttaatacaactttaatttaatttttttattttatttttatttaacatttattttatttttaattttaatcttttttatttttattttactttttatttgaattaatttgaattttattttactttatttattattcagttaatttaaaggagttgttcagaacctctatccaataaa

SEQ ID NO: 73863 - DNA, 377 bp, Heterodera glycines
  Genomic contig location: Contig_ID=SeqID_10628; Location=1974..2350; Strand=+
  SCN-specific regions: Sequence locations=1-377
atgacaaacaatgagatggctgagcaatctgcatttcaatcgaaattaatgttactacggttgaagaaggttacccatttaccaattgatactgacataaaaggaaatggtgagaaggaagctgaatttgtaagagagtgcaaagagaaattagagatcttaacccaataaagatagctgtgaaccaagaagagtaggattgttaaactatgcttgaacaatttgtgcgacatatttctttacgaaattacagactttaacagactttacttcaataatgatgtacttgattttggagaatatttgggataatcgttcaatagacgtaatggccatcgaggattgaaaggtgtatcatgttttgatcacctacgaaa

SEQ ID NO: 73864 - DNA, 1711 bp, Heterodera glycines
  misc_feature (1661)..(1661): n is a, c, g, or t
  misc_feature (1686)..(1686): n is a, c, g, or t
  Genomic contig location: Contig_ID=SeqID_10629; Location=45..1755; Strand=-
  SCN-specific regions: Sequence locations=1-7,33-378,416-673,713 -762,784-838,892-1172,1218-1272,1294-1471,1497-1711
atgaatacatattatcatgtccattttttaaagcattccaacaatcaacggccagcagatggtgccactgggaatatgaacggtgctgaaacgggcaaaagccgtaccgcttcgtcctcattttcgggctccagtgaatcggtgccaaacagtggtggccgaaattatgatgaagcacatgagcaaggtgggattaatcggtggatggataatttaggtgtatcaatcccatgcaatatgcctattcgtttgttgcccttgattatattgaaagttttttttttgacaatttgaggcatcaacactttttaatatttgttttgtgggttttaaaaaattttaagaaagttttcatatgcttttttcggcctttttgacaaataaaaaagtataattataatattatcatatttaagacttccatacatttcataaccttttgaataattttcgatttttttataaaaaaaacgcattacaattcaaaagaattcataatattgaactttaatctcgtaaaattaccaaacaaataaacaaaagtagagcgggaccgggacttgccgggacaccaaagtcgggaccagaattcccgactcagtccaggtcccgttctactctactaatgacaatttttacaacccaaaaattattcctaatgaatactaaaaactaaaaaaataatattatatataaaattaacaatattatacaataagttttaagagtccgagtcaaacatcgatcccgtttatttggcattgaaagaagcaactgaaaaatatggaaataaaggtgagaaattattattaagacaataaaagtgactcttcaatagaatttaaatatataattttctaattaaaaaattattagttaataattttttatcgcagctggcaaaaatcgacgtttttcgcaaaacattggttgtggcggcgcaggcactggcgattcgaccacaacaccaagcagttgctcgcgcaacttgtctcaagcgtcgctgctcgactcgggcaccttttcggttagtggcgactatggcggcattggcatcagttccaacaatgccagcagcacgcgactgttcgtgagcggtggatcgacctcacaacttgaaggcggtcagcaaaattcattctgtacggtcgtaaatgtttaatgcacaggcgtaaaatttaactaaaaaatgaaattatttaaaaaaagataattttccctatattaaaaaatttacccacatctatgcaatttcttcagccaaacatacaattttatttgtataaattttcatggaattctgatcgctgcctttgcatcagtttagcctagaaatgctattaagtcaatactatatataaactgttgcttcataaaaaaaaatactggctctttttttttaaattttgttaattttaagacattttaaacacctattttacggcatttctacggcattacaagtaattagaattataattattaataaaaatttagccactccaaaaatacataagaaaattagtacaatttaatgtacttagtataacacaatgtttaatcacttcacccacatttacattgtttttcatatgcctaattcaatctcaactgtcatttacacacgaaaaccttttgtttgtttattttccattcgatgntagctaatttaggagcgatattttnctttatttttgttataaaaaataaa

SEQ ID NO: 73865 - DNA, 651 bp, Heterodera glycines
  Genomic contig location: Contig_ID=SeqID_10630; Location=381..1031; Strand=-
  SCN-specific regions: Sequence locations=1-651
atgaaaagtgcacgaaggcgtgccagcattggccatctatcaaattggcatgtcgacagatgccagccgacgacacaaaattcgctgcgccatcatcgaactgttcttgatcaattgatagatgatgacgattcgtcggcatacaaaccggttggacgccattcttccatcttgtgccagccggtccaccgactatttttggacaaaaatggtagtggcgatcgtagtgcaaagctgcagcaagatggtggtgttggtagcggtgttgatactgtaaaacaacagcgacaacaacggtactattacagtagtcagcccaactcgcgcaagacgtcggacaaataccgtagtaataatgatgacggtggcggtagcggcacatatggtagcgtcggcaacagtcctcggcacatgccatcgcaacccgcagtgacactttcgcgcttggcacgcacgttgccctcagcaattgtgccggccatcgcttcgctgcgcggtactgtcaccgcttcgtgtgccatggggatgctccagcagcagcagaatcgtcgtcctgttactgctcggaccggctgtcgactgcgccaacactcgctgcagacgttcccattgcaaccgctacaaaagcgttcagagccacagcctgtcggg

SEQ ID NO: 73866 - DNA, 273 bp, Heterodera glycines
  Genomic contig location: Contig_ID=SeqID_10631; Location=4..276; Strand=-
  SCN-specific regions: Sequence locations=1-273
atgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaggagctgctcaatcgtttgattctcgctccgcacattgacacgtgtgatgaagtcaacgagatcatgatgccgaatgtgccaggtcaa

SEQ ID NO: 73867 - DNA, 1632 bp, Heterodera glycines
  Genomic contig location: Contig_ID=SeqID_10633; Location=113..1744; Strand=-
  SCN-specific regions: Sequence locations=1-107,130-143,165-200,222 -364,415-561,583-1126,1148-1632
atgttaaagcgttcgcccaatgattttcgtccgcttttccgtttgaacgaccctgaacaactgaaagaggagagacgggcggaaaaggcacaaaaccaagcgatcagacagcagcaaaaccatggaggacgcccgggccgaagaaagggggaaaaaatggaggtggactgagaaaagagacgcgaacgatttgaccagcgatttgtttcattgttttcttccctgtggcgaagaccaaactgaactttcagctttttaatttattcattctccgcttgcatttatatttatcccaaggactttatttattatgctcgaaactggaaaatgaattttaaataagcaactttttgttcatactttctattttatttttaaattggtaaattttctaaatttaaaagattaaattttggtaaaatgtttccactaaatccaaactttgctactgtcctcggcgcacgcactgacgcgggtaatccgtgcgcaatgactttgccgtccattttcgaatatttggcgcaagaatctctgagcgggtcgatgaagcagggcattcgcagtgttttaaatgtaaaaagcgggtcaaagtcggattgtgattgttttctccccgttttgccactttaattggtgccgttgtccctaattgcccattttcagctgttttcccatttttcgggccgtcgtctctctttcgtcgactctcattttgacgagctgtttttgctgcttcatttgttgctggagaatcgctttctcaaacgattttgttgtctttttttataaatttcagcaattctcaaattaagccgcttcattttccgagaatttctatgggatgaaaagggttccgtggcgaatgaatgcgtcgtccttttctcggctgggccatcgctttcggtcgctttttctaattgtaagttcaaaaacgtttaattaattaatttgagaatttgttcctactaaaatccttcaggttgttttgccttacattcacgacaaattcgaaagattaagtgaacaaattgaaagtgaaagggatgcaattcggcaaaaagtcagtgcaaaacgaaacaatccgaaaaaaggcgaacgacgcacttttgcccttatctgaaaaaccttattaatttggttttaatttccctcggatttgcccccttgctcttcccggggtccggacaatccgtcagtgaaggacaatccgtcagaaatttctcgggggaaccgatgcggggggggggggggggggaacgtgagtgcccctgttcttcctgcccctcccccaatccttttcccttcgagggatggcgtcgtcttttccttcgcttttatccgtctctgaaagcccttctcttcctcgtcacgttgctcttccaattggccttcgtcttttccttctcttctgtccccagcctttcccttcttttggccaaatgtcgtcttgagaagttaactctctccgacgtggcgcaattcgacgctgagggccaattgccttttcatttgcggaggacaaagtgagtgatcggcggggcgcaaatagaaacacagaacgccgacaataccgtacccaataccgtgctcatcgcggcacttctaaaaatggcaaagtttatccgaaataaa

SEQ ID NO: 73868 - DNA, 129 bp, Heterodera glycines
  Genomic contig location: Contig_ID=SeqID_10634; Location=749..877; Strand=-
  SCN-specific regions: Sequence locations=22-129
gaaccaaaaacaaaggaagttttatgaatatctcaattggaagtctgctcagaaagcgaaccaaaacgagccaacaaattctgttgatcaatttggatgatagtaaacggttatgttatagattttgaa

SEQ ID NO: 73869 - DNA, 1212 bp, Heterodera glycines
  Genomic contig location: Contig_ID=SeqID_10635; Location=1025..2236; Strand=-
  SCN-specific regions: Sequence locations=1-72,94-192,219-504,570 -667,719-1022,1070-1212
atgtctccaattgtttttactttcatttttcatctgatcacttcaccgacaaatgcattgcctggcttaaatttctttaaatgtacgttttaagctgatcactggtttttagaattattaagcaaacatatccaggggaagtgtaattaatgttcggtgtgttaccgtatcgtcgtccccctgtcccctccctaattaattaattaaattatttatttgctttaacagccatttacattgacgtttgctgtgagctccaatttctctattccccttacggaaaagcgcggaacactttgctggacgaattctatttgtcatattttacagcgaaaaatgaaggaattcggcaaaaattcaaatcaaaaattgaaatttacacgcatctttacattctgagatggaaattggatcaaaataagataattttgcttgacgagaatatgcccaagggattaaatggatatcggaaacataaagccaacttagcaaagtaaaacaaacaaatattattaaatcaattcatttaaataatattatttaatcaattttccatttaaataaatattctttaatcagctttcatttttggcgttaggcgccaattggaaaattttgaaaatttaacgaaactttatgagaaaatcattatttttcaatttgttcgttttttaagaaatagcttaaaataagaacattttaaaaatcaaattcaaaggcatacaaataattattattcttaatcttattaatttagtatccaatttttcttcgcccgttatgaactctttgacgaggccatgtgcttattgttacgtctcaaattcgaacttttgcgacttttaaattcacaaaatttgccatataataaaattgagagaatttttgatcacaaagaatgtgaaaatgagaagagagcgaaggcaatcgttgacgaattttctgaacaaattaaggaattccttctgagtgaccttttacattcattggggcaaaggcaaaaactgctcaaatattttgggtaaattaaaaaatgcaaaaaaaataataaatttaaaaaaatatttaagcgatttatcgacgcaaaaaaacagaagagaattgggagaagcgcaaatgaatttcatcgacctcctcggaagtgtgcgggtggcaatgatttgcgattggcaaatgaaagaattggccacactttgtgagcagataccgtag

SEQ ID NO: 73870 - DNA, 865 bp, Heterodera glycines
  Genomic contig location: Contig_ID=SeqID_10636; Location=270..1134; Strand=-
  SCN-specific regions: Sequence locations=1-153,176-286,308-313,344 -643,665-678,723-805,827-865
atgcagcaaaatgtggagagagatgggcaccaaatttggttggaaatgccaatcatttcgccaatatttcccgaaaaaaatgtggccaatcgaatcgatgtgaccacagcaaaacaaataaaagatgaatttgtgaatggtaattaatagtggaaaaatatattaaataataaaagacaaaaaaatttgtatttttcgcttttaaaaataattttgacattttgcattttaagcatttaatttaatcaaaaaataatgcggaaaaagaagagcagagaatcagcaaaagaagggaaaagggaagcaaattcagaaaaaaacatttttaaaataatttttaaatcattgagataattttgtgtataaaaagttacaaaagtaaactagccaaaaaacaaaaccatgcttatttataaatgtactcgcacaaagacagataaacattaatgatgacatttaacatttatttaagcattgcttttacgaaaaaaactaaattattttgaagaaaattttttaaaataacaaagttttttgttaaacgattccaaattgttctacatgacaattgaactactcagctaaaaaaaaatatgcgacagtggaaaatgcgttgatgacgcattattttccaaaaagatttaattatatcaaaataagttgaaacattagaaatagttttttattatttttttaaataattttatttatttttaaattttcaattgccttttaaattatgtaaaaattttgagacgaatgtacattatgtgataattggggttataaactgtgtgattttgcatatttatttctgctcatatgctatgaagaaaggggctcaaaaatatcatttctacgttaa

SEQ ID NO: 73871 - DNA, 132 bp, Heterodera glycines
  Genomic contig location: Contig_ID=SeqID_10636; Location=3562..3693; Strand=+
  SCN-specific regions: Sequence locations=1-30,60-132
ggtcccggttttgaccagttttgaccgggaccggggaattcccggcttttttcccggttttcccagccaaaaagtcccggtttttcaaccaaaaaagtcccggtcccggtcttgcccaaatttcccggtccc

SEQ ID NO: 73872 - DNA, 1690 bp, Heterodera glycines
  Genomic contig location: Contig_ID=SeqID_10636; Location=1239..2928; Strand=-
  SCN-specific regions: Sequence locations=1-194,283-679,701-821,843 -1003,1034-1113,1136-1454,1483-1486,1512-1659
atgcgatttttaggtaagaaaaatcccagaataggtacttaaataggtaaaaaaaaatctcaaaataggtattaaataggtacaaaaattccaaaataggtaccaaaataggtaaataaaattttttattaacgatttttagtggaaaaaagcaaacaaaaggggaaaattttggttctatttctttgtaaacgaataatttaaatatttttaatatgttcttagaaaatattgacattttaaattaaaaattttgttacataaaaaaacaaataaatttttgggaaaaattttccaattcttaggggtgtattttttgattttattgcatttttgttaaggaattctctgaaaatccttaaataggtataataggtagaaaaactccaaaataggtaaaaataggtattataaaagtcatcgtagacacccaaaaccaagtggaaaatgcttttttcgtgcttatctgtgcgtattaaatgcgcaaaattttaggtatttaactaaaaatcgcatccctagtaattaccccgggaaatgaaacggagacccaaatttaccgcgtcggaagcgagacgcccgtgcccactctctcccggccccgtacaaacgaatggggcggaaaaaccattaatatgacttgatgaaaaattatttgtatcttagctcaaaaggaaccaaatttttaattcttaatatcattcaatagccctaagaactctccataagtctacaaaatttcaaaaaattttgttgagtatcaaaaaagtagggccaaagatgggcgaaaacaaggtttttgagttcctctagccacaacttttttgaaacttaaataaattttttgaaattttgtagactgatagagaataatcgaatgatatcaagaattaaatttggtttacttttgagctaagttataaataatttttcatcaaatcatattgatggtttttaaataacgacatatcaccaaacgaatgaattcggagggatgaaaaacaaaaataaaataattataattaattaaaaaggacaattattatcagtttagagaatggtggcaattatgacgatgaagcaattatgagaatattgaacaaaattgaaaggctaaataaaagtgaagaaaccacaaaaaaaggagagaccgacagaaacgaaaacgaagaaaatggcaaaaaggaggcggaaaaaagaaggcacaaaatggaggaagtgaaaaaagcaatgaccgttttgtggagtaagaatttcgatggcatttaatcatttaattgtaaaaattcaaatttaaacagaccatgccattcacttgaaaatcctcgaacttttgctgaccaaaaacgaattcaacagaatctatcaccactcggacagagaagtgatgaacggaagcaaattgagaaatttcagaacagcttatacctatttggaattatgggcgaaaagtgaaaaataaataattatttattaaaaattgctttaataataaaataataataataatatttagggaggaactttttcgatgcccattttggccatttcaattcccaagttttgtttgttatgctgaccaaagtgtttttgctgtttccgggcgatgtttcggtgccatttttggtggagaaattttatttgatttactcaatttggtaatttttaattttaataatataataataaa

SEQ ID NO: 73873 - DNA, 666 bp, Heterodera glycines
  Genomic contig location: Contig_ID=SeqID_10637; Location=297..962; Strand=+
  SCN-specific regions: Sequence locations=1-441,463-519,553-666
atgaacagagagtccaccaaaccgtttctgtatatgcctgtcaacaagatactcaccgtaaacacaatgtttggacataactatgtaatgaaaatgttggtcggagagtcaaaatgcgtaaaaaaagtaagtgcaacaatggactgaaattggcacaaaaatgggcaaagtcggcacaaatactaaaatactcaaaaaattttcccggcagcacctatcggcaccgccggaccactattttaccatatttttgaaaaatggagaccaaaacggcaataaatagtaatttttggcgaaaaacggcaaaaaattttgtaaaatacacccccccctaatttgggatttcaaaaaaacgaaaaaacaccccctaaaaatcgactgaaaaaagaaaaatacacccctaaaaatcgaatttttgataaaataatgctaatttttaaaggagccgctgcagccgccgccaaagattgactacacaaactgtgaagcgaaagctgacccggcggcgctgaaacgggcattaattaattcataataattatttattaattagcctaagccctaattaattactcttcaggattacaattacaccgagtgtgtgtgtggcaaactttggtgaattttgagtcgattgaattcgataaaaaaacattggtaaattta

SEQ ID NO: 73874 - DNA, 1093 bp, Heterodera glycines
  Genomic contig location: Contig_ID=SeqID_10637; Location=1232..2324; Strand=-
  SCN-specific regions: Sequence locations=1-186,213-229,251-546,569 -595,617-1093
gcatttgccaatgcttcatcccctgctaatttcattgttgtcatattgtctatgttgtctttcgatggagatgactccgttgtgccatttgatctgacgaacgaattcactcgggaacaattggcattgaaaagaactgactattgctatcgtcttctgttggtccgttgtccaattgtgcgcgacacggacaaatgggcaaaatgggaggaggaagcgattgactggcaatttaatcaccaatggaacataatcgacattcaaattaataatgagcgtaagatgggtcaaatgcttattaaaaaatgcgaaattgttgcttttttagacgtttcacgcaatgatgggcccaagtgatcaggagaagtgaatgaatgatttgctgagaagtgatcgaaccgatcaatttgaattgcggtgttggagaatgaatttgagcccatttgaattatatataatattgttctttttgttgcggtgatcaacttttatttgtgttatgtgtatgcatttaggataaatttagtgattttctgaaactgtaactagctttaagaatttaaacaaaagcttaaggtctatagaagcttttgtataactttatttttagctaaaggcaatagacaaaaaattatactcggaaaagttgaatttcgtattttttcattgtaatttcttttttaatgccagtatttgctcttttcttgcatttataaaatctcgagacttttgtctttcgcttggtaccaagaatatgggtattgaccaagtaagaaaaaagttatggcctaagaaactgggtatggtcattcatgggacgcataatctgacatgggacgcataaaaccgactagaacccaacagttgttattgatgtattgtcgtgctcattaatagtgcttatatttttaggctctaaaaatagccaaaataggggtagactttaggtcctaaaaattcccaaaaatcactttttactatatattaagcgagtaaaagccatgcccctttatggtttttgaatttgcgtcaaaaattcagggagcggttcggtgggcaattgattccattccctcgttgaatttaaaataaa

SEQ ID NO: 73875 - DNA, 764 bp, Heterodera glycines
  Genomic contig location: Contig_ID=SeqID_10638; Location=17..780; Strand=-
  SCN-specific regions: Sequence locations=1-5,28-764
atggcaaaagcaatgtaaaattaaaatgccaattttcaatttcaattttaaattttattttcctttttttcagtttcatctccggcgacggttggctttgtgtgttcgatttgcttgagccttctcaattgggccttggaattgcacttgtcagccaccgttttgacttttacgtcgacgaacacttcaagacgcggcgctgggcgctcaaagccatggaaattaaagccaaatttgaagcggatggcacaaatggatgggaaattgtcaattgcgctggaaagcctttgccaattccacaaaaagcgttgccaaagaaaatcgtcggattcaaggacatttcaatcaagtgaaatgaatgattaattttttgttttctgtttgtaaaacgattccttaattttcacagatacatcgaccaaaatgccatcgcttttctccaccgttttcgtcaacttttcacctcccgtccaattaatttggccatctacacgggtggtgaccgcactttggagttcattttgcgcaaattttggccaatgatcgcgaaaagcatttgtgccatgcatttgtatgccagaattttctaccgtttgcgacaattcatgccgtcaattctaaacgattgtccatcgcttcgtattatcaattcattttctgatggtttcttcgccgaatttccttgcgatgacagtgccaatgcttcgaatggacaagcatttgccaaatggctgttcactcctcgtcctgacaatgtgccaaag

SEQ ID NO: 73876 - DNA, 1189 bp, Heterodera glycines
  Genomic contig location: Contig_ID=SeqID_10639; Location=778..1966; Strand=-
  SCN-specific regions: Sequence locations=1-133,170-225,249-369,392 -406,481-745,830-915,995-1035,1059-1068,1090-1189
atggacaatcagcagggaaaggatgatgtgttgtcgtccaatgcatttgcatatcaacaaattgttggaccacagaatataacggcagtgagtgtttttttatgaggtggacaaaaaaaaatacgaatttgcgattatttgaaaaaattaaaaaaaaaaaaattaaaaagtgcttggtttaatcctattagatttatatattttttacattttttcgggtaaatcataaaaaaaatttttttttatttcctgattttttttataatgaattccataaattttttcaaaggcactccccccgttgaacagcaataaattgaattcttcacccattcactataaggccattgaaaatcaatcgcagctcgaggcaaaaggtgaattaaaaatggatttttaaatatgcaaaaaaattaatattaatttaaaataatgaattatttaaaaataatttcaattaataatcaaatttaaaaaaaactaattgtccacagcatcagcagtaaaaagtgtgaaatcaaagccaaaaaatgggacaacaaagaaggttgctgcttcaacatccgcatcaccaacaaaaaatgtaaaataattaaataatgggttaattaacgaacattaattaagcaaccgccaaagggagggcgccaaaatttggtgtgttccaattgtgatggcagttcaacaacattgtggagacgtaatcaacatggggagccagtgtgcaagtgaaacaagcaatttaaaaaataaaatttaaaattaaaattaattaaataacataaaaatttaaaaattaatttaaaattacaaattaataaaaaaaaaattctaaattgacacattttagtgcttgtggtctctattataagctgcataacattaacaggccgttgaccatgagaaaagaggtggaaaatatagaaaatttatttttttaaacacttttatttaatttaaaatatttaaatttatatatatttttgaaatttttgactgtccaaacgcgcaaacggaagccccggggcggcatcacaaaaatggaagaaagtctaatgaaagcgcggaaaaatgctaatggtggtggaagccaaaaaaagagcgggaaaaaacaggcggagccgctgaataatgtgaatttaaattgaatatttgtttgattattaaattggttttcgactttaataaa

SEQ ID NO: 73877 - DNA, 1410 bp, Heterodera glycines
  Genomic contig location: Contig_ID=SeqID_10639; Location=2459..3868; Strand=-
  SCN-specific regions: Sequence locations=1-162,187-191,461-571,633 -847,869-1081,1122-1322,1408-1410
atggaggctgccccagtggagggcaacaacagcacaatgaacaacaacaccggcacgttctatgcacagcagcagctgcacaacagcagcaactcatggaacagtcaaacaccacaatattacattgaaccgttgcattcgtattttgctgagtaaaaaatcatttatttatttatttatttattttttgcaaattttaatatatttaatgtttaaaaattttttacaaagtttgaaatatgttttaaattcatgttattttcatttttttatattttaatacacttttaaatgatctaagaaattaaaatatttttttgaaattattaaaaaaatttaagaaatagaaaatatgtttttgaaattcttatttatttatttaaaaaattattaatttttacgtcctttttaaattttcaatataaataaaaaattttctttatattaaatcatattttttgcagttcatcctattttggtcagccttcgtcaatgcttgggggctcagcttcgctcgattcgctcaatgcctatggccattttggcccactttttgctggacaacagggtgaattaattattataattatccatttttaaatcatttaaatcaattaatttatataatttaagaaattgagtattctgctaatttttcaacagcattttcagcgtttatcactggcggcattgaagcagcagcaccgatgcaataccatcagcaacatcatcatcacatggttggccaccatcatcagtccgcagcacttggcggtaaaattcaaaaaaaaattttatgattaaattcggggtgggcccccgcccgaactttcgggggtaaaaaaaagtcgggggagtcagggtttgtccagatgcggagcgcccgggtcggggtataccctgaaaaatggctacatttttgagtgtaggggtcggataataagttttcgaggatatgggccacggtatatttcaaaaaatagcctaaattttcggggtaggcgtctgggtcctccctctaccctaattaattaattcaatttaataagttttattccacaattttttttattgttttggcttttttaaaaagttttttaagattttttaaaaattattttccaaaatatcttttttataaacatgtaaaaagttgtctgaattgaaggtggcggcgattttctgatgggttcgctggttgttcatccgcttccatcgcaacagctggccgcagctgcaaccgctgctgaccgcgagtgcatttcatgtggtggccgtttatatgaggctgaatcggtccgcgttgatgcgcgcgggtattccaatcaatcaatcaatcaatcaatcaataaaacaatcatttaatcaaacaattaaaacaatcacttaattaattaatcaattaataaa

SEQ ID NO: 73878 - DNA, 194 bp, Heterodera glycines
  Genomic contig location: Contig_ID=SeqID_10640; Location=47..240; Strand=-
  SCN-specific regions: Sequence locations=1-194
atgactgttttattactaaaattttcaaaagtgagtattatccatagcttattgtttacaaattcaaattttagcgtcaaaggaaatgccgccccatttggcactgcttgccattggcaaattcgttgattaacggacaaaatttgccgccgccacttttcggcacgttcaaagcgatggcgacgatggcatag

SEQ ID NO: 73879 - DNA, 437 bp, Heterodera glycines
  Genomic contig location: Contig_ID=SeqID_10640; Location=458..894; Strand=-
  SCN-specific regions: Sequence locations=1-437
cggaggagctcccaataatgtggtcgcattgccccgcactggtggctcatatccggccactgcggtaatgtgcatcaattaaacaattaaacccaattagtgtggctaatttcaattaacacgcaatttttgcagatccgtcaaaaacgtgagcacacgcctatggcgtcggcaccatttgttgggccacttttgccaaacgttgctgctgctgcggatgaattgtcacgtcattactcaatgtggatttgacggaaaacacaatgataaaaatgccgaaatacaccgttgtaatattcactttttgcgtgctttttttgcaataccaaatttcacacgttttttgtagctttgtattttttgtctgtgttttttaactcaattttacaaaccacttaaagtgtgctgcttttgtttggtgtttgaacaataataaa

SEQ ID NO: 73880 - DNA, 535 bp, Heterodera glycines
  Genomic contig location: Contig_ID=SeqID_10641; Location=380..914; Strand=+
  SCN-specific regions: Sequence locations=1-47,69-154,179-183,210 -220,242-485,507-535
atgatctctacatttcgtgctccaactgtttgtatttacgtgaaaaggaaaacaatactagatctattatctcaacagcagtgcttcgacaaggagttaatcttattatgttgcgctcggaacataattctgagtgtaagccagaaattttggaaaaattaaaagccgaacaaatggaccgagaacaaagaaaagaaaatatacaatgtatatctgagggaaaaatttgcacaaaattattcggtatgcagacaattatattcattgatgaaacaaattgagaggagcaattatcagctatcaatttacgggattcccgacaaattgaaaaaggaggtaaaaatttcatgagcttagaattctattaaaaacagacaataattggggtgtaaacattatgatcccgaacttaacttttttaattatttgagcttagaataatcagtggtgattttcaggtttaaaaaatctgcataaaagtccaaaaatccaaacaattaattaactaaatgtattcgaacaaaataagcaacaa

SEQ ID NO: 73881 - DNA, 1416 bp, Heterodera glycines
  Genomic contig location: Contig_ID=SeqID_10641; Location=1444..2859; Strand=-
  SCN-specific regions: Sequence locations=1-349,371-971,994-1039,1061 -1200,1222-1416
atggaaattgatatgataattgctccttatatttatttgttgcttctttgtttgaatacatttaatttttacgagttgaataacggacgattattttggcactttttcagctcttttgttagtaagtaccggatttgcgatttgaagcatctaaaaatcctttctcgaataatcccgtcacgtgtgctccgttcccgttttccgtcctgcttttgggtactttcctgtttttaaggcacacccatttattaatagacttacatattttggaggcataaaagcaaaacaatttctgccaaattggaatgtccatcatttcattgtttttttcctgttttttggagtccttaaaattttaattggccaaaaatgggatgatacaaatcgcaactgcgtcgatttgagtttagcattcataacattgactttgacttcacatgaatatataaaggtggatgaaacacaatttcacgcttgatttttgtgcaattttttttattaattcaaattggcacttctttcgcctcgtttcgatgttttagtggacaaacatttcgatggcaaaagcgaactgacaattagaaatttgataaaaattagcaagatgcgaacaaatgcaacagtgtttgttgagaagagacgatttccgttgccgaaatatccgctgccacgtctacactcgcacactgaacggggaagaaaggacgaacaaccacgcagaggcagaacatcaccgtcttcaaggcgccttcaactgccgtcatccatcgatctggcacttcattgacgttctccgccgtgagcagaagggcaccgatgggaagtatgcgtcatttcttgctggacgtgagccaccgcagaaagctaagaaatacctaccaagcggctgatgagcgcctcttcaatttggtgcagaattacatcccggtgaacccgaacaatgaaaatgatcacaattaccacataaatccaaattttcatattattttggaatttcttcgtggcatttcgcgcaattatcatatgaacccgtgaattgttgttattttttcattttgttaaattttacttatatttgaaaaaaaaaatctttttcctttttttgcaacatttttgaaatttacgtctttccctttttaatttttggcttcgcgccaaaacgtgggcgccaaaacgaccctggcgccaaaacgtgggcgccaaaacgtgggcgccaaatcgtcggcgccaaaacgtgggcgccaaaacgacccagtcccgaaatttggcccatttttgcgccaaagattcaccatttgaaatggttgcacactctgacaaaaaatggaaagccaaagcaattgagttgtgattatacgtcaaaaaccaaaagaatgatcaccaatttcaaagaggtgtggccacattttcaataaa

SEQ ID NO: 73882 - DNA, 1121 bp, Heterodera glycines
  Genomic contig location: Contig_ID=SeqID_10641; Location=3036..4156; Strand=-
  SCN-specific regions: Sequence locations=1-20,42-225,247-259,281-1121
atgaaccgacggtaatgagttataaaattacatatttcattgaactaaacttttttaaattcaatttcagttgggtgtgtaatgacgtttggatggacattttcctgcatcttgaccatgctcaactcggcctcaaaatggcacttctttcgccacggttcaacgcgttggtcgacaaacactttgatggcaaaagcgaattgccacttttgagacaaatcagaattgcaaagaaaggaacaaaactatctgtggctacgaagagcaatccgttgcccatcaaaatccgctttatcaaccttcgaatcgagtaaatcaaagaattactaaatgatacatctaaatgatttccttttcagatacattggccattccgtcatcgaatttcttcgttccaaccggcaaatttttgagaaaggcacccatatggatttatatttggatttggataatttgcattatgacaacaaaggcattgtccagccaatttggaatttttttgctggtgaaatttggcccattttcgtgccaaacattcggcatttgattggccatcatttgggcgatttgcgttgtcacatttcaccgacaattttcaccgattgcaaccaattgaattcaattgtctccgataatttgttgcccgcggcgattgctgatgatgggccaaatgcaactgctcgtcaagcattgaccaaatggttgaacacaccgacaaaaaatgggcagccgaagcaattgatttgttgtggctctgcgtcagaaaccaatgaatgtgtcgtcaacttcaaaaaggtgtgccaatattttcgtaaaattttggattaaatgccatttgcttttcgtttcccattttttaggaatttctccgtgccaactcttctgccagttacataatccaattcaaaacttacacctcaattgcgcagtttgaattggtgaacggacggactaaagaaaagctgacattgaaggcagaagatgatgatgatcatgtatatacacatattaattgcgtgttggagcgatgccaaattgggcggacgattcaatgggaggacaaaaagacggacaaattgaacaatgtcatcatttcgctttatggaaattgcattgggtga

SEQ ID NO: 73883 - DNA, 750 bp, Heterodera glycines
  Genomic contig location: Contig_ID=SeqID_10643; Location=860..1609; Strand=-
  SCN-specific regions: Sequence locations=1-85,110-750
atgagtcgtgtgcacagctcgccaaagcccaacgtgcttttgatgctgctcagcaacggcaccgtttggctcaattacagagtttgtccttaaaagtccttaaaaagcatttttcccaatttgaattgtgcccttttccattttcggtccgtgttgaggcgccatgcgaatttcgtctgtccgacttcccaatggacaccgttctttgctctttggtctcgcaaatcaaaatacccttttcactctgattttgaggtgttcgagagttactccttcaacaccgctaccgtaaccatcgattggctaccgttggccgcggtgactctccaaacggcggagatcagtgcgtccgactttgagctgacccacacaaaacactacaaacacacggaggtaagcagcaaacaaaggataggaatcccgtattcccacacttacagtactacaaggcaggcgaatggtatcggcttacggtagaggtcggcttccgtcgtcgttacggctattacgtgcttcaggcatcagctgcccattatcccatttattgcttatcatttgctgtttaaggtgtatgccaacatgtacatcaacgtgttcctctcctggatcgccttttgcatctctcttaaggctttgcccgcccgagtgatcctttcagtgaacacgctgatgtcgttgtgtctccaggcaattattggaaaataccaatgccaaaatgcccgttctgatcacttcagtttggcaatgtga

SEQ ID NO: 73884 - DNA, 1339 bp, Heterodera glycines
  Genomic contig location: Contig_ID=SeqID_10645; Location=650..1988; Strand=+
  SCN-specific regions: Sequence locations=1-899,925-1108,1156 -1202,1233-1339
gcccgcgagatgcaagcccgtgccaccataaaattggtgttttgcattgcctatgccatcctttttctgctcggatcactcggcaatgggtcagaaatgatcaaatgccaatttccacttggcaatttccttctctgctcggctgatcagtcattggtcccaatttgaggttggtcattgtgatgatttgcaacgttttgtccacgttgtcgcgcaatcggaggaagacgagtcggaagatgctgatggcaagtgcggaacacgtgttcatttatgtgctcggtcagttttatccccgtccaatgctttttcctccgcttaatccctctattttcttttccgatgattcttcccctccatccggaaaattggcatcagaaaaagggacaccgaaaaagcttattcgtgcaattcaaatgaaaattgcgatttggttgggataacgaaatttcttgatatcgatgccgaaatttgaacccgaaaattaattgttttgagtataatttaccgtctttgtccaatactctccggcgatgtccaattcttacaaattattttccgatttttttatttccaattcgccccatatgatcccccactttccgtccttcctcccaggtctgtccatcgtcgatctgttcgtcatcctccatcttccgcttctcatcttcgaaatgcgcgaaggccaatggcccttcggcgaatttatgtgcaaattgtattggtttggagaaagtgtgaacaaattgttgagctcatttttgatggttcgttgattgggtcaagggttgctcgatctcagctctcaaatcggggaatttcccggctttttggtgtttcgctttcgacttttggccatttagtttctattaaaaaagattttttactcccttaaatttcaaatatagttttgtttttggcttgggcctttcttttctcggttctctcgagcagtccttttctgtttgccgtttttcttcaaactaataaactgttcagacggtgcttagctgggaccgttatttggccgtttgttcgccaatcaaatcgatgaagtacttaataatctttatcaattaattgctgggttataaaacaatcgcaaattttaatcaataactcattaattgattgactaattattttgttaattaaggatgcgcaccaattcaggtcgtccgtcacttccatcgtttccgatcacttttctcttcactttcccaagtcccttcagtggccatcaccgttctgatcagttgctccgcgttcgccactcttctcctttaccccgtcctgaaagaggccaccgttttgcgggtcaacaaactcaccggagtac

SEQ ID NO: 73885 - DNA, 278 bp, Heterodera glycines
  Genomic contig location: Contig_ID=SeqID_10647; Location=1357..1634; Strand=-
  SCN-specific regions: Sequence locations=1-278
atggtgagaaggaagctgaatttgtaagagagtgcaaagagaaattagagatcttaacccaacaaagatagctgtgaacaaagggaagcggtcgattgccaaactatgcttgaacaatttgtgcgacatatttctttacgaaattacagcctttaacagactttacttcaataatgatgtacttgattttggagaatatttgggataatcgttcaatagacgtaatggccatcgaggattgaaaggtgtatcatgttttgattacctacgaaaataaa

SEQ ID NO: 73886 - DNA, 683 bp, Heterodera glycines
  Genomic contig location: Contig_ID=SeqID_10647; Location=2095..2777; Strand=+
  SCN-specific regions: Sequence locations=1-292,314-515,641-683
atgctaaacatatccgcttacttctattgcagttctctctgtttccaactattcatccacagaataatgatcaatttgccaagtgttcagttgaaaagttattgatctagaaatatcgcatacaggccttatactagtcatacattcctttagtacatcaatgggtactaaaagacgctgccttcccttaataatgccttagttcttttgagacatcaaataattccctcctaaacgataccagcgctgtcattaaaattttcaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatgtacttaattttaatcaatactattgtatttattatttttattataatttaattttttaatttagttttatttatttttaacatttattttcttttaattttaatcttatttttattttactttttatttgaattaatttgaattttattttattttatttattattcagttaatttaaaggagttattcagaacctctatcca

SEQ ID NO: 73887 - DNA, 1358 bp, Heterodera glycines
  Genomic contig location: Contig_ID=SeqID_1489; Location=5665..7022; Strand=+
  SCN-specific regions: Sequence locations=1-14,47-404,426-790,820 -972,994-1005,1027-1316,1338-1358
atgtcgcacaatccgaagaaagcggagaaagaaatggaaaaagcaatgtgaatattcaaattttaattcccatggctaatcacttcgctgtttcagcttcatctctgccgattgttggcttgaggtgttcgatttgcttccgccatctcagcttggactggaaattgcgatgattagtcaccgatttgaccgccgcgtggacgaacacttcaaaacacgaaaatggaaattgggctacatgaaaattcgaagcaaaattggacagaatagcgcaaatgaaatgataattgtcaattccaatggaaaagaattgccaattccgcaaattccgttgccgaacaaagtcatggcattcagaagcattgcgatcttgtaaaaattaaattttaaatggtttctgccattatattttctgattttcagcttcttcgacgaaaatgtgatcacttttctcggccgttttcaacgtttttacgacatttgtgaaacaatgttgtacattcgcgctgaaaatgttcgcattttggagtttattgtgctcaacactttgccaacgctcaaggacaccatcaaaaatcgattgcccagacctttgcagtgttagtttcgaaggcgccatttttcccgcttttccgcccgacgacagtgccaatgcgtcggatggccaagcggtggctaaatggctgttcacgcctcgtgccgacaatttgtggaaggtgctcagcattgtgaattcaacgatggaacagtggttgacaaatgtggaacaaatcaaagcggtgatttgcccaatttaattcattttttaaaattttttttgtcttatttttaggcattttcggatgcttcttctcctgtttctttcgtaatttactttgaatttccgccgccctttccgattgattccattgcgtcatttaaacggaccaacgaattgaccagggagcaattgacattgtcaccgtttgaagaagaagcaaatgttttgcagctcatgcgttgttcatgtgaagaaggaagtgaggaaaaatggcaaaaggcgctgaaagaattgttttgttttcatccacaaaaccaaattgacatttggatcggagacgacgaatgcgacgatgggtgaattcaattttaaaaatctaaatggtaattcttacatttttattttttaaggcttatcggtgcttcttccgccgggccgagtggtgatcagaaagagcagaaaaaatgaatcgatggttgattgattggttgatgtgattatgtgatccaaatgttggacttagccatttaaatattgttgtatttgatttttgcttacaaatccattaaaataagttaggctttaccaataattttaa

SEQ ID NO: 73888 - DNA, 483 bp, Heterodera glycines
  Genomic contig location: Contig_ID=SeqID_10648; Location=301..783; Strand=+
  SCN-specific regions: Sequence locations=1-19,43-311,333-371,394-483
atgaaaaagaaagtgggaaaatttgatttaaaatttgtgaacgaattaaaagaaatggtcaaaacaattgacgaaaacgatggacaaaaattggaaaaagtgaaggaattggtgaaaaaaattctggaaatgtttgaggaaaagaaaaaagcatatggtgagaaaatggcggaagaaaacgaatgaggacaaaaagccaacaaattccgattgaagggcatttttgcggatagctttattggcatttagactaatttttgggactatttttttttgagtgattcgtagggcgaattctaattttttttcgattttctgggccaaggaaatttgattttatgattgaatttttgaacgccaacattttaaggattttaatttttaaaaattatagaaatatgttctatcagtagaaaagaatctggaagattattaattatataaaattggaatggttccatagggatttggcattttatttta

SEQ ID NO: 73889 - DNA, 611 bp, Heterodera glycines
  Genomic contig location: Contig_ID=SeqID_10648; Location=1813..2423; Strand=+
  SCN-specific regions: Sequence locations=1-453,475-611
atgcttcgtccggcactgtcacaatgtaagtgcgcccgtctctgactagtcgactgtttttatgttcagctgacatgacgcaaattttttactgatttccacaatgctcaatccatgttccttggcttctcttcgctagaaataaaaaaaaaattgttcaccaaaagatttaactgatgacaattaagcataattaaccaaatcactataaattaaggtcttggattttattttaaaaaaacacaattataaaaaagttttccaaaatcttgagatttcgtacttaagcctccaacttcataagcatattttgtgacagatttcagcttggtagtaaataatgaagtctattatacatggagggtaaaagttcggagatttagttcagatacatttttttaatagtttacccattgtaaaattcagtttctttgaccaggattcctgttaaatcagcacttatcccatcctattagtcctgtcctggtgcgtctcggaaataatggcaaaatcccagccctacttgtttcggtccaagtgttttaggataattaacaatttgccgtttatccatggtaattagttagtaattactcaaccggaccaattca

SEQ ID NO: 73890 - DNA, 675 bp, Heterodera glycines
  Genomic contig location: Contig_ID=SeqID_10648; Location=2438..3112; Strand=-
  SCN-specific regions: Sequence locations=1-187,211-290,326-419,475-675
atgaattttgtttggcttttgttcaccgttttgccacttttcgttatggtgccatgcactgaaatgttgcactgtgagctgatgcttttggatgtgactgaaactgatcctccgccagcagatttcccattatttttgccatcacagtcatcgcttccttttacaagggtataaaaaaatacaattatttccaaaatgttttcaaataaattggggataaaattaaaaatttctttgaatctataaattaaacaattcgttaatgctatatatttttttcgagttttgactaaaatttaatttgataaattatgaaaaaatatttgaaactgaaaatttttcgaggtctctaaagccgagacttttcgagtcgagatagatatatttttgacaaattgggaaggggtaaaaaatttgactaaaaattaaaataattattattttctagatttattccattttttaaaatattttcctggagattaagatagaaattctcgtcaaagtcacaacattgtgttaccatgccaagtgctgtcgccggggcgaatacagtaaagaatttttggtggaaacaacggcggacagaaccattggagaagtgacaacaaatctgttgggaatgttggaattcaggtgcaggtggatgcataaatattctataaaattaataaa

SEQ ID NO: 73891 - DNA, 536 bp, Heterodera glycines
  Genomic contig location: Contig_ID=SeqID_10649; Location=251..786; Strand=-
  SCN-specific regions: Sequence locations=1-536
atgttctgccagcttttgctctttggctttttgcttgcaattagcatagtcaccgtctgcgctgctaaaagggaaataaatttgtccatttatccgcctcccatatccaacgactacaattaccgtataaaaatttgctgtaatcaaaacagtaatagtggagcagctgttgaagtgccatcttcacttcaccaacagaagttaattgccgaacatactctgtgtggaacgaaaaattcagagcagaatgtgaacgaagggcaattccccgaaaatggtaaaaatggaattaatcagtcccgttaccaggaaaacaagggatgccaaatgtcgcaccccctaaataatttttttttgaaaagtaagtaacaggaacatttggctgttattcgccctcccctttccgaagaaataccccatttgaattttaaaatttttgatttaattcagagaaaattgctgaaaatttgaaaaaggcaggccaagttgtttatatactagcgctttccgagcgtctcggtctcgagtccctctag

SEQ ID NO: 73892 - DNA, 916 bp, Heterodera glycines
  Genomic contig location: Contig_ID=SeqID_10649; Location=923..1838; Strand=+
  SCN-specific regions: Sequence locations=1-25,47-221,244-310,359 -397,420-569,601-916
atgaaaatttatttcccttcacattatatgcatatgcataaaaagatattcagcgataatgtaagtgtaaatcacatgaaatagggcaatacatatagatgaatgaatacgaatatgcgggcgagcatttttacaaatgaattttatgtgcattgattttgcatttttctcagaatatacaacataaatttattccgaatcatattacgattagggatgggatttatatatatttttaaaatacatattcttgctgagaaatgcacgaaaaagacctttgtagcgcgaaattcttaggtttaatctccaatatccattaaaaaatatttgactcttttttatttagtaaatattttggcatttttcataaatacaaatcctatccataattatatattcataaaactattaatgtttctatattttatagttcgatttgtccgtaacccatgtccgccatcgtcgctgacgatacacaacccaaacatcgaccaaataaacagccgagcagagaggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatga

SEQ ID NO: 73893 - DNA, 725 bp, Heterodera glycines
  Genomic contig location: Contig_ID=SeqID_10650; Location=3570..4294; Strand=+
  SCN-specific regions: Sequence locations=1-139,161-335,357-725
atggctgttgtccaggtgacttttgataatgccgtcatttggaagtgtccacccaaaacccctttaggactacgcgaggcccctggtcattggcaaaacgttggccaaaatggcgccggctgtcccttacatcgcttccgttgtgcttttggttggcttactgatgttcaattacaacgacgttggactgaccaaagcctttgaaatggtcttcagtttataggtgtcgatcatttgttaccgtagcattttaaatactgtataaaaattttatggaatatcaattaatggtgcgaaatcgtataaagttcattgcagcaaatacttttctctttttcaatttaaattataatttgggtaattaaactttctttatgtcaattaggccgtcgttctttgtaaattcgatttgaaatgttggacaatcgcaatttctctttttccactactcgaaatggcattctgctcacttttctgaatttgatgttcactgttaactcgaagggttttcttctgaccgcttctctcatgtttcttgtcgaaattggcatcgttttccaaatcattcgattggtcccatgtcggtggtccttttattgcttttcgcttttcaaatcaattttagacacggatattgactggtccacttacatgcagcacgttggagtttatgaagacggacagagaaattacacacaaattcggggggacacaggcccaattgt

SEQ ID NO: 73894 - DNA, 2640 bp, Heterodera glycines
  Genomic contig location: Contig_ID=SeqID_10652; Location=325..2964; Strand=-
  SCN-specific regions: Sequence locations=1-161,184-374,397-1409,1431 -1825,1847-2123,2145-2221,2252-2467,2489-2640
atggcatgggacaattcgtgccaagtttttggacaagagtggaaaggaaaaatctatggaccagttggtctggaggatgtgccagtgaaaacgaatgtgataagtgcagaggcgcaatttgagagttggctcaggaatctcacggagagattcggccagaccttgaccaaactgagagccaaggagtactggaaggactgccatctccaaagcaagagggtattggttgtgagtaaccaagaagccgctgagctggtagccaaggaatttgaggaagaaggctcgagctggttcgtccattttggtgacaaaccgttgcgtgaaaagatgttcccggccaattggaatatcaaaattatcttcaatttggagctgaggagggaagaaagagaagaattggaagtgttcaaagaagacataaaagatatggcaagggcaggactggaagttcatttggcgactcggaaaaatgcacgtttgccacgagagtttgaggaattcgccgagatgcaaggctgtggaatttaccaatacgaaaaaattggagaactcgcagcggcgatcagaggaacaccggccaacacgggaacaaatcccgagtcaggagagtcagcccagaagagtacaaccggatggaggcgagccgtaaccaaaagtctgacaggattgaccatgctggtcatgttattgatcacgctgttgcaaccaatgatgatcaatggacaagtcattcggccggaacgaaacggcagatggattcctgtaaatcccttcggaagaccactacgaatggaggaactcgttggatttgcggagccgacggtacctcggatgagcctcgacaagagggggcaaatcacgcccactttgccgacaacagcggcggatatgtccattgcgcatatccgggaatggtacaaaaaggcgcggatgcaaacaagtggtacgactcaaacttcggcagcaacgacgacagtgcgtacgagtaccagtgccagtacagtaatgactactctacgaactcccgaaacgacggtaaccacgagaacgacgacgaaaacaaagggagtcaccacgcaaccacagcggaagactacgaatcaagaaccaaggatggactcaagacggaggcagtggactcaaactccaagccgtcactggactgatcgaatccgagcaaccacggaaggcccatctcaagccagtgccatgccaacaacgacaaagccgaacccaaccgagggcacggtgaccgatgaaacgaaaccggcggtacgacgactcaatcgagaattggaggaagttcaccgtggagccgaccccatttattggtgtgcccacaaaggatcatccttgtggagaataccggacgcggataaatcaccattctgcaaaccaccgccagggctcacctctcagtggaaaagattgaccatctcactctacatgccgtatcggaagccacaagaagtgaagaaggcctacagatgtgccatcaaacgaacgaaggagtatttttatactaaccttctgggggatcagttcgttcgtacggagaaagaattcttgccagtacaaaagagaatctgcatggccatgatcgaacagcacaaatgcccgtacgaagataagccaatgactccgattgaaggaggaggatggagcagcaacaacccactgaacgaggaatttccgggaagattctcaagtctaatttcgggggagcgagagagcgtaacgctgaattgttttgtcgagaaggcgacgctgttttaccgccctcacaattttgagttgatcagcccgctctactcacacttggaggattgcaactatttgaccggaaactgcaacatggcagacaacacaaccctaaattgggaaacggagtgcaacgagagctgtaagccatgcgactaccatttcgtcgaaagtatggacggagagcacacaggatcaacggattgggcaggcggaacatggatatccaaaagcaaggaacaggcgctaacgtttagcaaagaggcgaaaatggaaacagcatgcaacggaaaaccgattcgcttgtcggaccaatcgtttggaatcctggaggatgagtacctgaagatcgtcaacgatcgtggattgggaaaaagagccatccaggaggaacaactcgcagcacaattaaccgcaggacaactcgccacaagccgatcaatcgcgcagcttttttccaaggaatgccgaagaagttccagaggaggaaatccgaccattcaggccagacgacttttacgacgcaaggatgttatggccaggtggctaaacgaggacacgatgcaaatcttctcgtgcgctgagttttcaatgcaaaatgtggaatatcaagcagtcaacaactgttaccgctacattccggtccaaatccgcattgacaagaagacgctcaacgcattcctggatccggagcttcacatcctcacagcgtcatcaccattcgcagattgtggaaatttttgctaccattatctgcagctgagccagagcaattggatcaaaatcgacacacgctccgctaccgatgctatcgaccgtgtttatatacgcatattttcggtaatggttatttgtagtggtcccataaaaaaggaataa

SEQ ID NO: 73895 - DNA, 598 bp, Heterodera glycines
  Genomic contig location: Contig_ID=SeqID_10653; Location=511..1108; Strand=-
  SCN-specific regions: Sequence locations=1-86,109-313,336-598
atggccgaaatgcaaaaaagttatggccaaaatagacttttactggccatttggtgcagtgcgccatctttttttgaaccaaatgtaaattgaaaaaataataatgaatgcttaaatttactgacatctacttcttttgtagatttcacttctctgaaaacaaaaaaactgcctcctgcatggcgccaacacgtcggtgccaaaaagatacggactctcgggcggcaaatttatcatttcatcaccacaattgtgcaacttgcatcatttaaaatattcactttcacagctaattaaagaaataaatttgtcgtaagtccattttttaaattgaaaagacacaaatttcgttttgcttattctatcttggacaaagcatcgcaaaattcagagggagaagctatacttattaaagcaaaaaaatacaaagttttagtccggagcctacaaattagcagtcctttcggaaccgataagctgcggcagtctcatgcgcaatgattttgaaaactgatatgatccagatttcatatagtttacattactcccattggcccttgtaaaagcattttctttttttataatgatataaaataaa

SEQ ID NO: 73896 - DNA, 276 bp, Heterodera glycines
  Genomic contig location: Contig_ID=SeqID_10653; Location=1689..1964; Strand=+
  SCN-specific regions: Sequence locations=1-241,263-276
atgaacagatcaaacagctttcgcctattctcaagtgttggcagttgcaggtattctaatcgattttggtatggaattggcggaaggctgcatttaaaaaaggctcccggacaatccgacagtggacaatccgacagtgaggacaatcggacagaagtggacaattggacagtggacaatcggacagtcaaatataaaatagataagaaaataccggtcgccgcaatggaccgattgtgccatatcaagaaaaaacaaaataggcaaataaactaa

SEQ ID NO: 73897 - DNA, 990 bp, Heterodera glycines
  Genomic contig location: Contig_ID=SeqID_10655; Location=339..1328; Strand=+
  SCN-specific regions: Sequence locations=1-67,89-106,135-138,160 -391,414-527,572-654,690-742,910-990
atgacattacatcctataagctatagactttaccactgtaagtcgaaatgttattcagtcttcggtattaaaatgtacactcttcaagtatgctctactacttatgtaatttttaaaaaattagtaaaaatttacaaaaagttgtaagcaagaaagctcaaaaaacttagagtgaacagttttgactctaatttttttcaaattcaataaaatttttcgaaatttagcagaataatagagaaatctttgggctatcttttcgtattaagcacggagtcaattaatttaagtttgaacaattttcatgcatttaaacgaccttacattttttggatgaccataaaaatatgacactattaattctttcataacttttttctgaacgaacgaattttaattttgtttatataattagatagcccaaagatttctctattattatgttaattttcgaaaaagtttattgaacttcaataaagttagggtcaaaattgttaagtcaaaatttttcgtacttttttggttacaattttttttaattttactaattttttaaaaaattacataaatagtagagggtactttgagtgtcgctaaatactaaatttcattaatttgacaaagtttaagctatttatgattaattatttagccaatttaattaaaataataattaaatttaattattacaaacattcagacttttgtcacttcggctcaccacgaataggagattatgcgaaaaagaaaggaaaaggagaaaaccaactaagagaaagaaaaaatgagaaagagaggaaaaaaagtgtaaaagaaacggtcaatgacaaaagaaaagcaattggcaaaaaagaaaaagcacttcagagaaggagccaagcaaaaaaaagagcaaaaaaggagaagcaactcaaaatatttacatcaatggcgtcgtctgaaggtgaactttccacgtggcgagactccgactttccggcatcgaactga

SEQ ID NO: 73898 - DNA, 283 bp, Heterodera glycines
  Genomic contig location: Contig_ID=SeqID_10655; Location=1280..1562; Strand=-
  SCN-specific regions: Sequence locations=1-283
  Gene Ontology: Mol. function=inward rectifier potassium channel activity; Cellular component=mitochondrion; Biological process =synaptic transmission
ccccccccctttcccccccccctctcctttttcccctttgctaatttacgtcccctaatttgtaagggtattctcggttcgggttttgccctgaaagttcaacaacatcagcgccaaaagcatttgattcgaaggcgcgtgccagctgcccgactgattcagtgcctttggcgtcattactggttggcttctttcggcatttatgccgttacgacagaattcctttgcttttcctcagttcgatgccggaaagtcggagtctcgccacgtggaaagttcacct

SEQ ID NO: 73899 - DNA, 2611 bp, Heterodera glycines
  Genomic contig location: Contig_ID=SeqID_10656; Location=1..2611; Strand=-
  SCN-specific regions: Sequence locations=1-4,39-53,97-106,138-270,293- 348,388-678,700-1069,1092-1662,1692-1971,2060-2060,2082-2105,2152 -2194,2217-2456,2478-2611
  Gene Ontology: Mol. function=delayed rectifier potassium channel activity; Cellular component=voltage-gated potassium channel complex; Biological process=potassium ion transport
ttgatgcttctcccccctccctctttttctgtcctttttaatcgtttaatttctttttaatcatcggctgaccaaaacaatgagattatctttggtcattttattattcgctttcccttttcttctttttaaattttcctgctaaataagggcctcaattttgtccttatttataaaaaaatatttcgatttgaagggtccaaatcttacaaatttattccttatttgtaagatttgcccttatttctggatcaatgcaattttttttttctgatttcttaaaattgctaattaattttggtcgccgtcggaccaaaactcataatcctttgaaaaattactcaacgcaatttttatttaaaatttaaaatattattaaaataatttgagaaattatggcgtcaaaacactttctccttactccaacagaaattattggccgtcggccccaatgaatgcgccgaatttggcgccgcttcgctttcttcgcgccgattcactcgccgaagccgccgctcgaccaattcgtcgtctccaaaacgccccgcggaacaaaaaagggaattggcgcacttcgccggtgcgaacacttcgccaaacgattcgttttttgaaacggtgagtcatcgcggcaaactcgaaaaaaggcaacaaaagtgaccaattggttaagttttattcaaatttaattatataatttgccaacttacgccgtccgttctccgcaatttcggcattgaaattacaaaatgataagaaatattcatagaagacgttttttcattctttttgcggtttttcttttgaccaatattacttattcacttattaaatgcttccactctttctcttcgcattgattcgcccaatcgcttttcgtgccaaatccccgccaaatccgcctttgcctttcccttcacttccctcgtcagttgcccactaatctcttttatgtagggcgtaaatgccaccagtcccatcaccggcggcacaaactctcccgccgtcggcactcagcaaatcgctaatgatcggcgtgtcgttttccacgacattctgaaaagtttggaattcaatttctgtaagtgcagtgcgtccgtttccggcccggcctctgtcttcgattgtgagagtggcctcgtcgtccgtccgcgtccgtcgccccttcccgcggaggcggcgcgtcaaccgaagagttccctcgccactgtccccgccctttctttgcttcagccgcctcccctccgcttttcccgcaaccgttccgattcccaagttgccccctcaatttttctgttaatttttgaaatttcttttcggtccggaaaatgtccttggttggcaagccgttggtctacaaaaactacagtaccgatcaacgctttcgacgagttcagtccaaaatgcacaactttttggaacggccccggggatggaaggcggccagctaccatttggctgtgtaaggcattcttttgcattcgtcgctccccactttatccgctttatccccctcccccgacagtctcgtcatggttctgacgtgtcttgcactgagtgtcttctccacaatgcccgagtttgaggagcagtccacgctcatcctttattacattgtatgtcttttttggacaaataattgacataaattcattttttgccaatttcaattaaataaaatttaggaaattatctttgttttttggcttgccatcgaatacatttgccgcgtttggagtgccggctgtcgcagtcgttaccgcggtcagtgccatcttttcgtcgaagcatttccatcccccgcaggcattgccggccgaattcgattcgcaacttcggcatattgcataattggtgggaacgagctgcaaaagtaattgcgtttataagctaacgacactcttaagatatcatcgtgatcactgcatcacttattgtcctttgtatgggtgcaagggaacaggtgaaaatgagagagcaacagagagagagaaagaggagagagaaagggaaggagagaagagagagagagataagagagaggggaagagaaagagagttgagaaggatggaagagtggagggtgccagatcgaaaaaagaaagttttaaaataatattttttatttgttaaattaaattaattttaattgccgtgttggcatctttctaaaattgccattcttctcacttttttaatggaaaagaaattctgaaattttctttaaaaatttaattcggaagtgaggggaatgttcaattataagaaacgtcaatgtcaaaggtcgcatttgcacaggctcagctcccctccagtccgcttcaccatcgaatgttcgccgcgtcggccatccgcggacttcgcttcttccaaattttgcgaatgcttcgcatcgaccggcgagcaggcacttggaaactgcttgggtctgttgtttgggcccatcgacaggtgccgttttcctttgttttgctttgccaatgccacggcactctttaggaattgctcaccacactttacatcggctttcttggcctgattttctcctcttttttggttacctttgtgagaagagtacaacgacaagtacaccacttttgcggatgccctg

SEQ ID NO: 73900 - DNA, 345 bp, Heterodera glycines
  Genomic contig location: Contig_ID=SeqID_10658; Location=1038..1382; Strand=+
  SCN-specific regions: Sequence locations=1-127,149-345
atggccgtccgtcccctccttccgtcctcctgccattttccccgccactttgccgttctcccaaacccccgtgcgcatttgccgcgcccgtgtctgatcagcaatgatcgaccgcatcgtctcgctggcgtagttcagtttgggtttccgtcgttggcgaatgaatcgtcgcacaatgccacaaattctcttttggtaaaaagtgacacagcaaagagaaaggaaggcgtggaacagaggcgacgccatcagaagacaatgcgaaagctgcaaaaaacaaaagcaaggccaatgagaaactgaatttttagcagtgccatattagggtgtaatcattaccgaata

SEQ ID NO: 73901 - DNA, 2598 bp, Heterodera glycines
  Genomic contig location: Contig_ID=SeqID_10661; Location=1015..3612; Strand=+
  SCN-specific regions: Sequence locations=1-56,79-123,147-470,494 -1089,1114-1199,1221-2190,2213-2236,2258-2317,2340-2372,2394 -2430,2453-2598
atgccatcatcgttgaattcaaataaaaaaagaaatgctaattaccagggcacttcctcagtcaaggaaatcgacgaatcattaattgaaacgacggtaattagggcacagagaacaaaggtccatattcagttcatttgtaccactttttcttcactctattttgtttcatttgatacaaatttagccaccaaaaacccccaaaatcgacggcaatggcagtgccggacagacgccgtccccttcgcgccctcactaccaaatgaacgcactcgaggccgcactgagtcactatttcagcccaaagaagcgctcccccggccgtccggcgcaaaggtcaaatcgaacggacaattgacgatttttggaaattgaaatataagtcaaattcgctttttgggagttacagctttaaaatttagaaaagtgcaatttgatgatacatcatcacattcggaagggtctgatggggaagaagaagttgaggaagaacgaaagtcggaaaaatggaccaaatgcgattccaacagaagcgatttcgccgctgtcaaatgttgctttgaagtcgtgcctttttatttattggacataatgtattcatttagaaattggacaatcatttgccttggaagttcaaaaggaatctaaacggagaaacattcggcagacatttctcccaatggtttcactttttggagagcggccaattcagtattttagtgagcagttagttcattattgtttttcacatttttttgggatttaaactgttattccaacattcatttttagctccatgggcttggttcaaaacgtcgaattttggaggattttcgcgactttctgtccctccgaaaccgtcggtcgttcgtcggtgatggtctcaacccttccgacacaatgccaaaaatgattgaccgaatgacggaagagctaaaactgaagggaatggccaaaacgaaggaaaaatctgtcgaagcggcggcaaaaggtaaaacaatcagaaaatccgtcccattttttctcttctgttatcaaattaattttgttaattgggctggtccgccactttcctttctcaaaatgccatcctttgctgtggttttggctagaaatcgaaaatattgcgaaagcgaatcattcgcaaaaattcttttttttgttcctcacgaaatattttgctttgtaatacaattttatttttgccttttcccttcgtttagctttacgaaatgctgtcgatgctcagctgcgttttccgattgttttcattttgctgaatatcgactcgccccaactgaggcccgtcagacaaatgccctttttggtagcaccaaactctgttcagatctcgggaacatcagaaggccctttccgtgttggccaagtcgagcaaagtccaactgatcgcttcggttgaccacgtcaacgctgcgctcatttgggaccaagtgcgacattctctcataatttttttcaaaattgagctatcaaaaagggttttttgtttgaattttcactttttgcgcctctttttgccttttttctgtccaccgtttccccatttccctttcagtcccttcgcgatgcgttcgcttggcttcacttcccaatttcgactttccattgctattgggccgaagtgatggccagtggaactgagttgctcggccttgacgacaagggaattgcgaaggtaccattagtccaaaagtgacggccatcgaccgaatggtcggactttttcgtctctcttcctcagcacactctttcctcgttggacgccttttggggggcgaccacttcgaacatgcgcaaaatcctagcccaactggcgctgcacgccccgtccagggaggaccgtggtcgcatggatgcgctgggcattccgaagttctgtcgcattttacggtaggcagatcgatggaaatgccaatatttctttaaatttaacggcaattcgaattcgtgggttcagagatgagttcgccaccacttcggagactgtgctcagacagcagctgatcgaattttgtgaccatcgcatcatccaattggacaaaaacagccacattcacttggtacgaacattttaaatgaacggaatgaaataaatggcaaattgcaatcaaaaaaaaacagctggtggaccgtcaattgctcaacacttttctcgactcgaaaattggcaatgaatgaaaaaagaagagaaaagaactgacgactcaatttactctttccttttatttgattttgtttactcttctaccgattaactctttgaactttaatttttcagtttaaattctctgtttggtattatttgtatttattattattcggtaacaaagagaaatccctaattttgtgaaattattaattaatatttgaattgtaataagtgaaagggaatacatttttgaagcatttataacaacaaaaaataacaaagatttgatcataaaattggccaaacttttaaaaaaacggaaattctccccccgtccctccgtttataatgagcaaatgaaaattcaattgcctaaggcggtgactttattcttccgtttgatttgctcccgaagaaaggcaaatgta

SEQ ID NO: 73902 - DNA, 1308 bp, Heterodera glycines
  Genomic contig location: Contig_ID=SeqID_10661; Location=3586..4893; Strand=-
  SCN-specific regions: Sequence locations=1-98,124-1308
  Gene Ontology: Mol. function=glycine-inhibited chloride channel activity; Cellular component=integral to plasma membrane; Biological process=cell surface receptor linked signal transduction
tcaggcctttgggaccaattggaagtggtgttcaaatttcgtcgtctgtacggcttttacattctccaagttggctcgtcacttcgagtgccaatccgtctcccctccccctccccttttcccataggctttcatgcccacttatctgtccgtgttcatcagttggattgccttttggatccaaacttcggcacttcccgctcgcattaccctcggcgtcagttcactgatggcactgacttttcagttcggaaatatcgtcaaaaagtaagtgaatgttcaaaactctgtccaatcagtgagcaattcgacttgaaatggctttttcaaattatttgccatttcttttctcagtttgccgcgcgtttcctatgtaaaggcattggacatttggatgttcggctgcatgggcttcattttcctttcgcttgtcgaagtggggcagagggagggggggggggacaaaatttggagggggcgaaacggcgggtgccaatggaattggggggggggacggcaaaagaatttgattacttatgaaaggaacaaaatggcacttccgaattcgaaagtttctcccccctaaagttggccgtcgttggcttttttgacaaattggaggcgcgcaaacgccgaacgcaaaggacaaaagagtttctgatggtcaactcggacagcgagcagcaatggctgtcccggatgaaccgtttttcgcgccaatcgatgcccaatacccacgcatttcgaggtgatcactgatcagaagggggggcaattgggaactgtgccaatgccatgccaaacagcagcagaaaatatggccgagaaaagaggttcgaggggtacaaacggcggatcaatggacaacggcacggccaaatcggtgacactgaaagtgagcggcacgagggaacgaaagacgagcagaccacgctggaagcgttcaatggccgaggatggggaagaggacagttggtacatgctgaacggagaattcatcgacgatgtgagtcgggcggtcggcccctccccggcattcagtcgcccgtggcagggattgggtcggaccgatcggaaagggaagtcccagcggattgtccgctcattccctttttgtattggggggctttgcttcggtctccccggagaccgtctcaattccctcgccttttccatgctttagccctcttttggtgtccaatgtttgtgctttttgttaagctctccgccaaaatgttccccgctcttttcatcgccttcaatgcctgctattggttttattacatttgcctttcttcgggagcaaat

SEQ ID NO: 73903 - DNA, 1188 bp, Heterodera glycines; identical to SEQ ID NO: 10662
  misc_feature (1009)..(1009): n is a, c, g, or t
  misc_feature (1097)..(1097): n is a, c, g, or t
  Genomic contig location: Contig_ID=SeqID_10662; Location=1..1188; Strand=+
  SCN-specific regions: Sequence locations=1-156,180-557,593-624,648 -762,784-1162,1186-1188
  Gene Ontology: Mol. function=Rab GTPase activator activity; Cellular component=soluble fraction; Biological process=positive regulation of cell proliferation

SEQ ID NO: 73904 - DNA, 962 bp, Heterodera glycines
  Genomic contig location: Contig_ID=SeqID_10663; Location=10..971; Strand=+
  SCN-specific regions: Sequence locations=1-453,475-962
atgttgcgcgaaaatgcggaaataattgtccgggcacgggacgagggcgaagcgctggtggcactgaacgaattcaccgacaaaatcaccgattctaccgtcaaaaattccacgcaggtgaggggaatggatcaaattggtacataattgttgggatggatggaatttggcacataattgcgagtgatcaatttgcaattttttttttttgcagattttcatcggcgatctgatcggcaagtcgtacaaacactttgcggacacgttcaccaacgaaaccattgagaagctgaggctgaaacatcggctgaaagtggtgcagaatttggaggacagtcaggtgggcaattgcacaatttgatgagtgccaatttcgaaggtttttggtcaactttttttcatttgcatcatatggcggtgcctattgacaccgctggagggaaatttagacgaattttataagaaaaattccctaaattttcaagaaaaaatcctcctatttttctgttgtaaatctccgctgaacagatgaagtccatcgtgaagagtgtgggccgcgagtgccgtctgctggccgacgagctgtgccggctgtacagcgtggtgcgtcaggaacagctgttgacctggagaggcgtccgtctcactggaagcagcgcgacggggaacggcgacggaacgcaacggcacgacaaaaagacggcggcggagcgcaaggcgagcagcgccagcggtcgcgcgggcgtcgaacggtgcgaaaaacagctgaaaattaaatttaaaacatttaattgcttaatagaagactaaacgagatttttggcacagtttatgagactgggttttgtgatataacttaaaagtaacacgaaaaattcttaaaaaatatacgaattttttccgtcattgcacaaatttctgatgtcaattttatataaaatgaattgggtaccaaaaaacca

SEQ ID NO: 73905 - DNA, 728 bp, Heterodera glycines
  Genomic contig location: Contig_ID=SeqID_10664; Location=197..924; Strand=+
  SCN-specific regions: Sequence locations=1-34,61-97,119-230,257 -274,299-335,362-728
atgctctcttctgtcccaattttcaatactctgctgatggagatgatgatgatgatgatgctgcttcttttggttgtgatgtgtgttatgccaaaagtgaccacattttgtgtccccgagggaatggaatcaaaacggcgacttcgcaattaccaataatttaatttgttccttcaaccaacaccaaaattccttcttctatttttgtatttcattttgtcggcacatgcaatttttaggaaatatttttaaatgtttgaatttgccttattccaatttatttgtttattttttgtttcgcttgctctctctttctctctccgcactttttgcccatttattttattattattattttttagtaaaacggttttcgtttgttccttttccttaattctctcccctctctctctctctctttctattcctactgtaatgatactgtaatgtgtttgatcaggttgtttttatcgtgccgagactcgatcccttttcattcaaattttaaatttttcctaccgacaaccttcttatacagtatccattacagtagtattcacctttatctgttgctgctgctgatgttaacgcgagtgtatactgtaatttgttctgtgcctttgttctctttctcttctttctctctaatttacaataattgtcagagttcagtctccctattacgcgttgtatacttttaggcacaatttttgcaaatttattttaaa

SEQ ID NO: 73906 - DNA, 280 bp, Heterodera glycines
  Genomic contig location: Contig_ID=SeqID_1490; Location=1073..1352; Strand=+
  SCN-specific regions: Sequence locations=1-280
atggatatttttgacgaatttattgttgttgacgaaaaagcattcaatggtctgaaagccgaggattgtaattcatcagcagcaggtgttaacgtttatgtgccaccagcttggcggagtcgccggtaatgcatatgctccagggatggatcggatccgactcccgaaaattatgagctccggaatcttggtttctaaaaattttgggccttgaaattacaatttctgtaattttgtacatcatactgtaattccgatttccagatgtattgaaacctag

SEQ ID NO: 73907 - DNA, 1385 bp, Heterodera glycines
  Genomic contig location: Contig_ID=SeqID_1491; Location=997..2381; Strand=+
  SCN-specific regions: Sequence locations=1-110,133-279,302-311,361 -517,540-760,782-1016,1039-1280,1305-1385
atgcaaattgccagtggcagtggtgttggtggcacaacggagcgtgacgccgggtctgaccgggtgctgaggagtgcaaccaaggcagaactgatgaaattgcaggtaaaatttgaaggagttttaaacgaaaagccttttttcgggtgtaaattgtcatttttttttcaatcaggcaaaacagcgtcgtcaaatgggcaagcggacgggaggcgcgccacgcggaccaaaaattgtggcaggtgcatgcgcgtcacccgagcggaaaaaacgtcaaacgaaacattacaataaattaaaccgagcaaatgtaaataaaaaataaaaaatttttcattttttatttttttgaaattttaagatcaccgtgaccaatagtgccccgaatgttccaacaataattagaacgcttgaaggcgagaggagttaccgcgtgaaagctgtgttggcgtcctatactcatacgaacgggaaaacagcgtatttcctcgactggttgcgtaagtggttgtgatacaaattaaaaaaatttttattttcatttcttctcacatttttgtcactatttgtttggttatggacgagttgtcaccgaatagctcctccataatcaaacagtccggggtttgaatgtttgttgccgagttgtcgctgaatagctccgcgcaagcgtttaaattccgttccccctctttctctctctctctcttttaattttatatcagagtcgtaaatataatgattattaattaggcgcaaggggtcaagagtgttggattcccagcgagtcgtgtgattgtcttgaaatggcaatagacttcacaaagaaggcgaatgtccacgatgttctccgtggattacttggcgagccaattgctgaaagtttggccaaagaaataatggcgagtcccaaatttatagaaggtcattcattttttttttttttgaattttgaattttcacaattattctttaagtttgtgaattattgggccgggaccctgcgacggtgttgaaatttgatgaattgaatatttcttttgctccgtcgctcaatgtggaggatattcaatataaaaaagtttttgttgttaaaatttttaaatttcacttctttttttttccaggcagttgggcagttgggcgaatttataaaaaattgtttggaagcggcaccggcaccagagcaaagcgatagtgaagacgaatgaaaggaaaaggctaacaataacaaattcaatcatttttaacatttctcaccaatttgctcttacataacacattcctcactatatttcctctcacaacaacataaacatttctcacccatttctcactaatttcctcataaacatttctcaccaattttacaattttcaccagaa

SEQ ID NO: 73908 - DNA, 398 bp, Heterodera glycines
  Genomic contig location: Contig_ID=SeqID_1491; Location=3258..3655; Strand=-
  SCN-specific regions: Sequence locations=1-398
atgaagagacgcgttgctacccttgctactgctcctgctgagcaacataaaataattggtcccgagtcgcccaagccacatgaagagacgcccaaaaatgttgagccgaaggatgagttggcaacaaagaaacgcaaagtggacgaccgagagttgtggaaattggcaaaaggcaaatttttgctgaccacctatttgtgccatggtaatacttactaataatttctgcaaattttaattaaaatttttgagatgattggaatcgtctgtacaacaaccagcagaaagtgaagcgcctggagggggaccgttttgccttcggctttgagatgtgtgaggaatgcgtgtgggccaactgccgcgcaaccgatcttttggcgccaatgaagaaaaaatga

SEQ ID NO: 73909 - DNA, 778 bp, Heterodera glycines
  Genomic contig location: Contig_ID=SeqID_1491; Location=3829..4606; Strand=+
  SCN-specific regions: Sequence locations=1-709,731-778
atggttcttgtaagcacattttgcgctcagcttctcaactgccctgtcaagtcattgcgcgaccggctcaaccacccagaggatcgggcgcttgtgcttaaacacatcattgggcgcaaagcacgcaccacatacaacgaccgtaatggattgaccaaaactttcttcgtcactggaatttcggtgcacggcgccgcctttcttcccgcatatgggcaattgcgcaacccattcaacatcaatgtggcggcgcatttttatgcacggcaccgcataaagcttcacttcccgtatgcaccgtgcataattgaacgcttttcggggggaggggaggaccggcactatccaatggaacttcttgagctgattgatgacaacatggacatggacatcaacaacaatgagcattggctgggccgtcttttcactgaaattgacgaaaaacaatcgtcgtcaaactcatccgacacaacaatgcgcctagtatttgagggagacatggatgaagacagcggacgcaatgaatgctcacagagtactgtaccgttatattagttttgtttttgctcactaattatgcatttttcttccttaaaatgaccacttccatctattaatttgaaattgcattttccattccttaatttttcaaaaatcgtgtcttctttagcttaattatgcactttttctacctaaaaatgacatcttctaatgcttaattatttcataattacatcttccattcactaataatgcacaaatttttaattaaaaacta

SEQ ID NO: 73910 - DNA, 4649 bp, Heterodera glycines
  Genomic contig location: Contig_ID=SeqID_1491; Location=4748..9396; Strand=-
  SCN-specific regions: Sequence locations=1-645,669-1247,1269 -1354,1377-1387,1409-2702,2752-3729,3758-4287,4309-4371,4393-4649
atgcaaaatcagcctcccaagcatccctttttgttttccattgaccaaattctatcggtcccaagcaaaaagccgcgtcgcggctttctcatcaatgaattgcttggagaggtgcttcaagagggcggcggcagcagctcatcatcatcaaagtctgcaaaggaatacgtcaaaaagctggacagcaccgttgagcatgtgccccgcttccagtacagcaaagtcaagtcgcggttcagcattgaggatgtgccagaagcaaatcctgagggactcctggccggcatcttccagtactgccttgacgcagcgatggaggagagtcgtggacgtggaattgaacccacgcatctcggctgcatgatcagcagtccgttgctcaccggcggggacatccccatcccggttcgacaaatcaccgacaacaccgtaaacaccatcctcaaccagttcaccaaagtggcacagagcaagcagcagcaaaacgtcacactgtggggcgagccattcactgtggtggtgaccacagttgaccgttctggactgcccggccgaagggtgctgaagggcggtgctcggcgaagtctagcaccagtgcatcatcgggtgacggaaacttgtttgattaaggtccaacatcacaataaaaaataaatttggtaacaattttgttaagatttgcaaccccgacggacactgcctcttctacgccttgcaggcgacaatggtggccaaaacgtgcggttggccccgttggagattttacgactacttgcacagtcggaggggacaacagggatgtctgaggcgggatgctttacaactgatgcagcaaattggtgtacggaccggtcggaacacctatgatgctgagatttgtgtgccgcgtgtggtcgaccactggaacaacacgcaacagcagcaacgatttgcagtgttcatctttggatcatcgggacaatacaagcccttgtacaaatacatcaacgatcattacgacactcccattgtgctctatttgaacaaccagcattttgatggtgtgcagaaattgcatggcttgtttggacaaccctactgcctcgactgcgaaaagccttatgagcgtccgtcaaggcacctcaattcctgtaaggcgcgctgtttgctttgctcacgtgtcgggcctgcattcccgtgtgttccattgggcggctttttccatcaatgtgcgggttgcaataaaaagtttcgcaataacgggtgcctccaacaccatttggcatccaacttttgcgccaagtcaaagcaatgcaaggactgcggtgttatatgggacacacgagtacataacagagatgggagaaaagtaaacattaaaaataaaataaaattttgtatttcttgctggatttagggtcacaaatgccacgagacctattgtcagctgtgcaacacatttcacaatcccgagcgggggtgcttcattcagcccattgagccaaaagagcaggacccgtaccgcattgtggctttcgacttggaaaccatgcagcatcagccagtggacccccagcagccagagaagagagagcaccagcccaacttcatcgctgcccgagtcgcgtgccctgagtgcattgagagcggaaattggcggagggtaacagcgggctgtagaatctgtggtccacatcgaactgtcgctttctgccatcggccctttgaggacactcgtgtggacaaacgtgttgtggcggacaacccactgcaggcatttgtggattggctcatcttccaactaccagccaaatacgacacatatgcctactcacactttggcggacggttcgatatggttctggtctttcgcgagctattccggattgggttcaacccggagatgcttcgacgggtacactcaattatgatttttttgtctaaaaatattttaaaaatgtcagggcaacaaaatgtatgagatgaaggtacgcaagcagaagaggcgcaacccgaacattgtcttccgggactctttcaatttgatgccgtgcgcgctggcggcactcatcccctcctacggtctggacgtcgaggacaagcccttcttcccccatttggccaaccgacccgagaactacggccgtgagattcacccgacgcccgaagactacttggctagtggaatgatgcccagcaagaggcagaaatttgacgaatggtacgccgagcatcgccatgagccctttaaattggatgaggcgttagctaggtgtgttcaaattattttacaataccaataattttgttggatttccagttattgcaccaacgatgtggaaatattgatggcagctctggtcgcctttcgccgggaattcttcgaaatttcacggcgccaagactacgttgacgggattgacgataaggagaaccacgacgggatcgatgtgttgcgtgagtgcatgaccatcgcaggggcatgcatgcgacacttccgcacaaaccacctgcccgacgagcacttggccattgtgcccgagcgcggctatgacaacgcgcagaaccaaagcctgctcgccttacgcttcttccactggtacgccaaggagcatggagtgcaagtgcagacagcccacgcggctggaggggaaaagcgcattgggccctactccttggatgggtggattgaggcggaaaggcgcgcaattgaagtcaatggtaattgagttaattatttttcaccattattataaaatgggcaattttaaggctgtacgtgtcacgggtgcaaaaggtgttaccccaacgacaacatgctgctccccaatgggaagactgcgggacaagtgcgcgaacgggattccaagcggatggaatttctgaggggaaaggtcaaccggatggacgtctactgggaatgcgaaatccatcggatgctggagaggagcaaagaaatgcgcaaggcatttgacgactacgtcgatgatggcccgctggtgatccgcgacgcgtttatgggagggcgaactggaccactgaagctgctgcgcaaggctggaccgggagagaaaatctcctattatgacttcacatcgctctacccgtacataaagtgagcacagttaaagttgtaacaaattaacattgtttccttcacagcttcacaacccgttaccctatcggacagccaaacgtgcatgtgttgaaccaggaagtggattggcgcagtgcagcggacaacccctaccctttggcactgctcaaagtgtgggttgtgccaccccgtcgcgtcgacgtgcccgttctgccggttaaagttggagagcggctttgcttccccctgtgcatcacttgtgccaaagagcatccgactggtggtgtgaatcccaactaccactgcgagcacaatgacagacagcgggggtgggtgagcacgtgcacctccattgagctcaacgaggcgttggacgagggttacctcgtcacaaaggtcttccgcgtgttggagtatgagcaaagtgacgacaagctcttccgcccgtacatcgctgagtttatggcccagaagatccaggccagtggatttgacaacagcatcagaggcgatgcggagaaggaacaacagtttgtccgagagtgcgcagagcagttcgacatcaccatcgacccaaccaaaatggcggtcaacaaagggaagcggtccctggccaagctctgcttgaacaacttatgtgagtactgtcgtccattattattatatatttttaaaaaattagggggtcgattttcgcttcgcaactttggactcgctcaaacactcatcactgacgacccagcgactttggcggagtacctggacaacaaatccatcgaagtgacatcaatcgacgagttggacgagcagcacatactcatcacctatctgcagaagaaggactgggtggatgagcactcatgctccaacattggtgagacacacacactcacaataaattgttaatttttataaaatttcagtcatttcactatggaccacctcagcagcgcgcctcgttctactcaaggcaatgcagaaggtgttcagatcaccgggctcggatctgttgtacactggtaagtcaaactaccaaaaaaaatttttgtgcacaaacatttattttagacactgacagcctcatcctcgtccacccggaggagcggtgcccgctgaaaactggtccccatttgggccagttcaccgacgaataccccgaccacgacattgtggaattttgcagtggcggggcaaaacaagtgcattttcagttcatttttgtttacttttcaattttaccaccttttagtacggtctttgtctgcgacgcaagggtgcggaagagggagcccaattggaacatgtgctcaaagtgcgcgggctgacgctaaattatgatgtgatcaacaatcaggggatgcgctatgagaacttcaaagaggaggtggtccggtacgcgacaagtggtgaatacgagccgatatccatcacataccccaacttccttcgtgcaaacatcagggagggaggtcgggtggtttccgtgcctttgcaaaagtgctatcgcccatttgtgggaaagggaatcatcggggccaatttcaatgtgttgaattttggacacacattgtaa

SEQ ID NO: 73911 - DNA, 661 bp, Heterodera glycines
  Genomic contig location: Contig_ID=SeqID_10665; Location=439..1099; Strand=+
  SCN-specific regions: Sequence locations=1-9,32-94,119-248,274 -322,379-627,649-661
atgcatttcatatttttaataattttcattgcttttaaaattgaatccggcaaaatccgaccaaattttggcgaaatattcggcaacgcatgggacaataataaaagagaagaaaaagcgatcaaaattgaacaaaatgagcaaaatgataactcagcgacagttgatcaaatgggtgagggaaatggaacgtacccaaatgatcaaaagaaaagtgaaatcattagcaaatttgatgcaattaaacaaaagttaagagaaaaagaaaattttcacgaaaagaacagaaataaaattgctagattattaggcgcaaatcgccataaaatatataaatggaaaaaagaattatatttaaataaaaataaaattttttatgagaagaaaaagagagaattcattgaacgatttgatgaatttaaaagtttatatggccaaggaaaacagaaagaatttgtgaaggaattgggcatttcttatgacacatttcgcaaatggaaaaaagaattggtgccaaaatacaataaaagtaagataatttgtttttctttttttagagaaatttgagtgaatttattattctccaccttgcgcagcgggtttcaaaatttggtcgacttttgcccggattcaatttttaaatcaatgaaaattactaaaa

SEQ ID NO: 73912 - DNA, 843 bp, Heterodera glycines
  Genomic contig location: Contig_ID=SeqID_10666; Location=718..1560; Strand=+
  SCN-specific regions: Sequence locations=1-19,41-502,524-553,586 -642,664-707,729-843
atgaatttgtggcttttgttatttttaataattttcattgcttttggaattgaatccggcaaaattcgaccaaattttgatgaaatattcggcggagaatgggacaaaaatgaaagtgaaaaaatgttgataaaaattgaacaaaatgagccaaatgtgaaatcacaagcagcagttgatcaaatgggtgaagaaattggaagtggtccaaatgatcaaaagaaaagtgaaatcattagcaaatttgatgcaattaaacaaaaattaagagaaaaagaaaattttcacgaaaagaacagaaataaaattgagtggaaaattggaaaattattaggcacaaatcgcgacaaaatatacaaatggaaaaaagataaatttaaataaaaagaatttttatgaggacaaaaagagagaattcattgaacgaattgatgaattcaaaagtttatatggccaaggcaaacagaaaaaatttgcgaaggaattgggcatttctaatgaaacatttataaaatggaaaaaagaattggtgccaaaataccataaaagttagaaaatttttgtattatttttaattttttttttcgttttaagcacaaaataaatattccaatgaggacaaattgagaaagatgcggaaatatcgcaaaattaaagaaaacaatccaaaaattagtgacaaaataattgctgagaaattgggaatttcattttcaacactgaacaaatggaaaacagtttcattttcgaattgaatgattttgaagtgtttagaggatttttgatttgaatggctttcgtctttatattatttttttttcttttccgatatttttatcataa

SEQ ID NO: 73913 - DNA, 847 bp, Heterodera glycines
  Genomic contig location: Contig_ID=SeqID_10667; Location=522..1368; Strand=-
  SCN-specific regions: Sequence locations=1-19,41-295,317-504,527 -557,587-642,664-847
atgaatttgtggcttttgttatttttaataattttcattgcttttggaattgaatccggcaaaattcgaccaaattttgatgaaatattcggcggagaatgggacaaaaatgaaagtgaaaaaatgttgataaaaattgaacaaaatgagccaaatgtgaaatcacaagcagcagttgatcaaatatgtgaagaaatggggacagacccaaatgatcaacaaaaaagagaaataattcgaaaatttgaagcaattaaagaaaagcttaaggaaagaggaaaatatcaacggaaagaccgacacaaaattgatgtgaaaattggaaaattattaggcacaaatcgcaacaaaataaacaaatggaaaaaagaattgaatttaaataaaaagaatttttatgaggacaaaaagaaagaattcattgaacgaattgatgaatttaagtatttatatggccaaggcaaacagaaaaaatttgcgaaggaattgggcatttctgaaagagtatttataaaatggaaaaaagaattggtgccaaattattataaaagtgagagaatttttaaatttataattattattttatcttttaagcacaaaataaatattcgaatgaggacaaattgagaaagatgcggaaatatcgcaaaattaaagaaaacaatccaaaaattagtgacaaaataattgctgagaaattgggaattccatttgcaacactgaacaaatggaaaacagtttcattttcgaattgaatgattttgaagtgtttagaggatttttgatttaatggctttcgtctttatattatttttttttcttttccgatatttttatcataaataaa

SEQ ID NO: 73914 - DNA, 935 bp, Heterodera glycines
  Genomic contig location: Contig_ID=SeqID_10668; Location=40..974; Strand=-
  SCN-specific regions: Sequence locations=1-225,248-286,308-401,423 -801,824-935
atggcgaggctggtctgctttgcgaccatagccaaccgtgtcggtctgctttgcgaccatgacacagtgccggtctgcttcgcgaccatggcacacatatcggtctgctttgcgaccatgatatggaaagcaagcccagacttgctctcgccaagagatgcatgtggctgggccgctcaatggtggcgccatgaattccttatcgttgctggccaacagccggtgcgaagctggtcccgcactttgtcaagaccagtggactggtgagaagtaacgtaggaaatctgagttcatcaaaataaatgtggactgccttttgaggattgtggttcaatggccagtcccttaaaggattgtagttcgcactatgctgatctttcccctactggggaaagattcgacaaaaaatgcataattttatctgcattcttaatgggatgtgtgagcgatcaatttctgcactcaatgaccttttgtgcgaaattggacatgtttgattcgcagcggcatcactgtggcaaacaaggaagatggaccttaatttttcacatttcaatgtttttgataaatatttgattaatgtggtttattggttgttttccccaaatattttgccgcatgtacacatcattgcttcatttttgttttcagatgccttcaaaacaacacgctaaaagaaagaaggagcaagagcggtaccaaaggcagatggagaaatctgtcagccctggtcgctcacccgtccctgacggaagtgcagatgagaatggggtggcatcacacccgggcaccacaacgcccaatattagtgctttgcaattaagcacaccggcttcttccattggaagtaaaagaaggggaagacccccaaaagccggagcggagtcaattatgacttcgcaacacagtgtgtcatctgctgatacacaaatcac

SEQ ID NO: 73915 - DNA, 1592 bp, Heterodera glycines
  Genomic contig location: Contig_ID=SeqID_10668; Location=1039..2630; Strand=+
  SCN-specific regions: Sequence locations=1-409,431-770,792-797,819 -969,991-1078,1100-1592
atggtcgcaaagcggaccggcacgtgcacaaatctcatcatggtcgcaaagcagaccgataagatttgcaaacaaataaaaaatgtaagtctcaaaatgggaataggacaaaaatctttacaattgactcaactgacattttttttaaagtttactttttttaaaagtttacgtacatataaagtttaagtcaactgtaaagacttcttaaattcatagagcttacacgtgccaaagtgtacgaaacttatttcctaactaacctcagatttgggttagtaaaactatttactaagtgtacactttgccataattttgttatatgtgtatctgaaaatattttgttgtattcaactcagtcaaaccgatgaattttatatattttaaccggccaaggaatttccttagaacattttttaatttacaaaaaattagtggaaatggtttcgcccatcaatgcttatttcaaaaaatcacaataattgattttaatagaatgcaaccaaaagcttttcagctaaaaacatttgaccggttaatttgagaaaaattgaaacatgcacaacaatccacctttgccattgaaatgttagtcctcagcgcatcgaaacgttgcaaaagcagtgccaatttgaggcgagttcagcaaggccacagaaggggaaaatgtccatccaaacgtcgttgcgcacgtgctgaaagtcacgaaaatttttataaaattgcaaaaacacaaaacaatgaaaaaagcttaaagtaccaggcacttttaaagaaaatacataaaatgtttgttgaatttttaaaatttttattttcagagccattttgataatttgaggccattataaactcttgacaagctaagtctaaaaatcaaagaattagtttggccgatgccatcagagcactgggacatctgagtcgaagtgaaaatggacatttcagttccaaagaaataatggatggataaaataataattaattttagatttagctcgtcaagagctttcgaatgataccaaatttgagcgtttaaagggtctagagccccccttttccttcaatttttcgagttttaaaccggttcaaaaaccggtttaaatgcatctccgcatctaattttaagcttttctgtcattctcagcacctaagaaaacctataaacatgtttttaggatttttttttgagttggtaccgtattcggcaattttaccaaaatatctgttggattagtaaactttttagtattttcagactcatttgagaccattaaacttttgtgcacaaaatccttcaaaaaaaacaaaaaaattcacttttacaaaaaattggaatttgaaaaaaaaatttctgaaaaatttttgaaaattcgggccgttatgatttttcgggccgtggccaaaaaaacagaaagaaaacccaaaaaaaacttgccgaatttataaaaaaaattcgttggtccatcaaaatgtttgtccaccagcgcatagaattggagcgaaagcagtgccaatttgagccgagttgagcatggtcaaaagatgggagaatgtccatcaaatgtcacatgctgaaaaatttatgaaaa

SEQ ID NO: 73916 - DNA, 128 bp, Heterodera glycines
  Genomic contig location: Contig_ID=SeqID_10669; Location=31..158; Strand=-
  SCN-specific regions: Sequence locations=1-128
atggacattctcccatcttttgaccatgctcaactcggactcaaattggcactgctttcgccccaattcgatgcgctggcggacaaacattttgatggaccaacgaatttttgtataaattccgccag

SEQ ID NO: 73917 - DNA, 372 bp, Heterodera glycines
  Genomic contig location: Contig_ID=SeqID_10670; Location=609..980; Strand=+
  SCN-specific regions: Sequence locations=1-157,179-182,205-299,366-372
atgatgagaagaggtacaaaagtgattaaaagaggtacaatagtgattaaaagaggaagaacagtgatcagaagaggtacaacagtgattaggagaggtacaacagtgatcagaagaggtacaacagtgattagaagaggtacaacagacagtgattaaaagaggaaaacagtgatgagaagaggtacagcagtgatgagaagaggtacaaaagtgattaaaagaggtacaatagtgattaaaagaggaagaacagtgattagaagaggtacaaaagtctaacttgttatgagatgtacaaaaataatttcataattttaaatataattttatagagttaggtttatttaaaaattaaaaaaaaactaaata

SEQ ID NO: 73918 - DNA, 637 bp, Heterodera glycines
  Genomic contig location: Contig_ID=SeqID_10671; Location=3960..4596; Strand=+
  SCN-specific regions: Sequence locations=1-280,302-637
atgccaaattctcctcctccgtctaaacgtccccgccgcttttttattgaagagttgctccgtgagccattcaatcagctttcgccaccgcgcaaatcaccaaaagattacgtaaaactgctcaactccgaaactgagcttgtcccaaaatttcaatggctgaaaaataagtcgaactttatcatcgagaatgtgcctgctaatccagaagcccttctaattggaatatttcaagaatgcatggatgaggcaatgaacgcgtgttgcgctttcgaaaactcatcggagaacacactcagggcctcgatccctttttggtgtcttcaacagctgctggtctggctttatcaacgctccgacgttgttttctaccgttcaaccgtttggttcacttctgagggaggatacctccgtggacgacgagcttccgccgaatcccgccgatacatccggttcttcgagcttgaaaaccctggagcccaagtgcagtgcgcggattggtctgtgggagagtccaacattgaagacacaggctatcgtgtggacggcctctggcgacgagagcctccgcatcgtccactggccatcgagtggatgggttgctactatcatggtgttttatcgtcttaattttcaa

SEQ ID NO: 73919 - DNA, 1350 bp, Heterodera glycines
  Genomic contig location: Contig_ID=SeqID_10672; Location=611..1960; Strand=-
  SCN-specific regions: Sequence locations=1-110,135-411,451-577,599 -1350
atggaaaaggatttggagcgatattacaacgattttaagcggcctccgttcgcgcccacttttcatcccacggatgaaggtggggggaagcaataattcttgaattaggcatttttaatttttttttttttttagaatttgccgatccgatcagttatgttgccaaaattaagccacaggcgcaacaatttggcctcatcaaaatcattcctccaccggtgagtcgtctcgtccgtttatggaatgaatgaaaacgaaattaatcgacgatttctatgccattcacaagttttgaaccaatccaaaatttttttttttatttgtggacttttattgggacaaaaaacaggtcttacctttccccctgacattagaaaatggtaaaattggagagagaattttggcccgatgaaaaataaaattaaaaatttttttgcattatttttttttggttaaaaatgcgctaatcatcacaaacaatgcgaactcaggttttacaaaatcattgattttatctgattctttcaaaacaattttttttctctggggttcaaatccgcttggctgctgattgttttccataattattagatttcaaaaatagtattgaaaatttattttgccaccaaaaaatttcgaaatcaagtgcattatcgataaaaacggggatcgtcccgggactcgcaatttttacagaatttggattcagttaattaaattagtcatttttgcagagtttggcattcaattcaatcaaaatttactatttttacagaatttggattcaattaattaattaatcattttgcagagttttcggccccccttttgcattgagccggccaagtttgaatttgtgccgcgcgtgcaacggctcaacgaaattgacgcgctgttccgcttgcgcatcatttacatcaacaaattggtccatttctggaagtactccaaggaccagcagttccgcatcccgtacattgacaacaagtacattgacttgtaccggcttcgtcaggtttccaagaatttttttccgtaaaaattcaatcaatgttttacaattccatggtatatatgagcgaagactcattaatggttttaccaagatttccgggacccaaagttcacataaaatgatgtcaccgccatgagtattcttaccaagattcctggatccggagatttctaacttcccaacatttctgtatacggagatttctgaaaaaactatcatttccatgaatgtcctgccctcctggtacacaatatccacgaaacatggaaaaattttccgaaaaaatccgctaactattaaatttaacaagtgtttaagtcatggattcgaataaa

SEQ ID NO: 73920 - DNA, 76 bp, Heterodera glycines
  Genomic contig location: Contig_ID=SeqID_10674; Location=326..401; Strand=-
  SCN-specific regions: Sequence locations=1-76
atggaaccctttcaacgcttttttgcaattgtttgtgttcttatagcatacggcatgtttgaatctgtacaaagcg

SEQ ID NO: 73921 - DNA, 797 bp, Heterodera glycines
  Genomic contig location: Contig_ID=SeqID_10674; Location=1796..2592; Strand=-
  SCN-specific regions: Sequence locations=1-96,147-217,260-349,372 -389,411-474,503-549,587-797
aactcagtgaaaaccaaatcgcacctccggcggtggattatgtggtgataacacacggacatcctgaccatgcagggaatacaaatgattttccagtaattaaaaaataattaaaaattcttttctttttttatttacaatttttaggatgccgtccattttcaaggctttatgtcacattatcggactaaatttaatttctcgaatttatttgaagtaaaaaataatgttttaattcatattaattaatttttttaaacagaatgtcaaacaccaattgacagaaaatgtcgcattgattagcacacccggacacacctcagaggatatcagtgttgttgtcacggttaatattaaagcgaaaattaaaattttacaagaaaacaatttttgtaataaatgttttttattactttctacagaatacgcttcgttacggtactgtagttgttgccggcgatgttttcattgcagtaaatttttttttattaaaatttttaatgagagaaaaatagttagacttaatttaccaaacagtcaaataaatgcttttttaaaaatagtataaattaattaaaatttaaatcttctcagcatgtttttattcaaattaatagggcccggattcattacttctatattcggtaaggattaaaaaaacattttaggccgaagatttgagtcgaccgatgatgtggcgtccattggcatggaatgacgaggttcagtcgcataaccggcgaatgattttgtgcacggccgattatgtggtgccggggcatggaaaaatgttccac

SEQ ID NO: 73922 - DNA, 1068 bp, Heterodera glycines
  Genomic contig location: Contig_ID=SeqID_10675; Location=410..1477; Strand=-
  SCN-specific regions: Sequence locations=1-73,95-155,178-186,215 -239,261-326,348-454,549-1027,1049-1068
actgttgatgccaaaagttgggacggaagtgttgagaaagtgaccacgttgaagttgagtacttcttcttcttcagcaccagcaactgctgctgatcgtagcacaagcacagctgataggtcaattcagaagcaattatttggacggataattattgaagaacagaaaccaaaccaaacaaatcggtaaattatttgtataattaattaattaaggtgggcaattatcttttgtagatatcattttagagatatttgggcgttcctaaaaccgccaacatgggcatttttggcatttcataaatctgcaagtcagaaattgtctttaaaatacaaataaagacaaaatatttgttatcaaacaatcaaaattctaaaagtaattatcaaaaatattacttttttgtctcttatctgtgtaacttatgatatgggttatatcaatagcaatcaactataaaattttaaattatataatattcgcaatttattttttcgaaaaaaaataattaatcttattagatactaattatattttaaaatatttttcactaattgtaaaattatgaaggggttatgaacctcccaaatatttttaatatcgttcacggtcaatcccgttatttttggttccgaatccgggttttttaattcagatttccataaaattctgctcattgatgcgattagcaatatgcatattacatgaaagtattttttcatttagaaaaattgagtttaatgacgatgaaaaagagcagtcatttttctaccaagtccaaggcaataatgatggaggaattggacaaagtgcaaatattgaaatattgcgtgaggtaaaataattacttttaattagacccaaaattataaggtaattatgataaagggatatgcgcgacaattggacgctgattatgtgtttgtggccagcataacgttgatcagagatggcgcaaaaataattttggttgacacgggaatgggcactgacatcaacgggaggactgatctgatcagaagttggtaaaacaaatagtaaataataattgcttttacaaccattaaa

SEQ ID NO: 73923 - DNA, 1594 bp, Heterodera glycines
  Genomic contig location: Contig_ID=SeqID_10677; Location=418..2011; Strand=+
  SCN-specific regions: Sequence locations=1-239,261-808,832-1594
atggacatgtcatcgcagcggaaggttcacgcagacgaaggacgacggctggcaaaggtcattaagtcaattagtgggcaattaaacggaaccatagctaatgaggtatacggtaccacaaaattttgaatggtagatcattacggtatcactggtataattttgtgtgtgtgagtgaaacgattccaaaaaattagtgattatggggcatcacaaaatatttggtgtgagtgatacggtaaccaacatttttgtattatgattttttcagatcataggtgaaattttgttaatttttctatcaaaattattgaaaatttaccaattttttaaatttagaggcatttatctagctggctaaactagaaataagtcaggaacaaatttttagtcttttcttcaaaaattgtctgaaagttttcttcttttttcggttttgtctctgccatggtcccaatttttcattttttttccccacttcaaggcgtacaacatcgatgtaagtgaagcgttttgtgcccaactccatgtgccatttctgtccgccaatccgttgttgttcatcccccgcgtcgtttcccccgccccaaaatttaaaaaaaaagaattttcaagccgagaaattaaaaaaatcttaagaaagttttaataagaaaatttcaaggaaaaattgaaaaatttctcagcatttttggtgttttttgaaaattcatcataaaattttgagaaaatcgctgaaaattctcgaaattttcttatgggaaacgacgggggcgggaaacgacctgctaccccactttttcaaccagttcatggagacgagtgccaaaacggggcacaatgtgcatgacgtgttcgctgaactgagccgacgcctggtgaaggcgtgcgacccgcagcggcggctgcgaccggcgtctgcaaacggaagcggtggtggcggacgcaaaagcgcagcagcagcagaggcggacggtggaatcccattgaaattggctaataatgctaatgacgacgagggcggcatggctgagcagtaccagcaacaacaggcattgtctctatttgggcattggcacttttggcacggggattcccccctctgcgggggtgtagcacatggtatccggactttgtccgaaggcaaaaatattcgggtcgcgattcgggcggcaaccgaattccagggcccataacatgcggatcttgtccgaccattttttagtccacctccgatatattagacagatcacgaaaatccgccgcctatctccgaaaatcctgtcccagaaaggtcctggtcatcggtcaatacggtgacgggacgttagtcaaaaaccatcaaaatgggcgttagtcaaaaaccatcaaaatgggcgttagtcaaaaaaccatcaaaatgggcgttagtcaaaaaaccatcaaaatgggcgttagtcaaaaaaccatcaaaataattttatgcgtagctgatcaaaacgggcgttagtcaaaaaaccatcaaaataattatacactatacgattatgccctatatgcatgcaccactcaattaatgcaaccacttccaaaatatttgccgcactgattatta

SEQ ID NO: 73924 - DNA, 870 bp, Heterodera glycines
  Genomic contig location: Contig_ID=SeqID_10677; Location=2100..2969; Strand=-
  SCN-specific regions: Sequence locations=1-68,97-164,190-365,387 -411,434-476,499-547,569-870
atggttgataaaatgactgataacgtgcacaattcattttgttgggttcaattggcaattatgtgaggaatttaaatttatagaaatattaattaactgataaaaagagaattccttcggtcaattatgattatttaaacgatttgtctgcaaggccaagattcaaaaaaaattaaaaattaattaaatcccgaactgtgatatgcgttccataaaatatttttttattgctatctcatactctttcaatgtcttcaaactgagccaaggcctgtaaagcgtcgagaaatcctgacagccttggcccttggcagcatcctggcgctcgtcttaactccaattgtcgttggttcagttgtcacgggatatattatatcatataatattcacggacacaatggaagatgtcagttaaataaaaataattaaaaatgggatttatttttaaaatcaaaatttgggagaaatgacaaagtaaaaattctaaaaaatttctaatccccagacgcagagcaactgaaaattttcttcccgcttcggctgtcgattggggactttgatttcagcattgatcagcaaaatttcaacaatgcatacctcttcaaaaagattggggagatttggaatatgccaaatcttgatgagatttgtttcataggttatttaaaaaaaagctaaattagtacagaaaaatttttagatcacgaaggaactcggaagaggcacacgcggaccggccaaatcgaaatgtttatgtactacgctgtcaaaaaagacaactttaggatttctctttgttgaattgaaaaaatttaaatacaatttaactttgttggatttaaaaattatctgttgttgaatttaaataaa

SEQ ID NO: 73925 - DNA, 1333 bp, Heterodera glycines
  Genomic contig location: Contig_ID=SeqID_10677; Location=3018..4350; Strand=-
  SCN-specific regions: Sequence locations=1-184,210-295,317-352,392 -404,426-994,1016-1060,1085-1147,1169-1273,1313-1333
atgggcgttagtcaaaaaaccatcaaaataattttatgcgtagctgatcaaaacgggcgttagtcaaaaaaccatcaaaataattatacactatacgattatggcctatatgcatgcaacactcaattaatgccaaccacttccaaatatttgccgcactgattattaattaatgccaaactatcatcaacaaaacaaaaccaaatatttacgcaaatgatgacggcacaaatttattaaaatattcgataatgccaaccaatctccaaatcaccaaaaaatataaacattttattcttgatttttcattaataatgtaaataagcataaaactctcatttagttattcatgtaatttattaaatataacgaataaaaaattaaataatttctttttaggatggaaattccaaaatctgtttatataactattattttttttattcgttttattctctataaagcgaaatcaaaatccatctataatatctggaggaggtagaacttcaaattttgattcgtttataaataatgaaacgatcaaaaatttgctgattaaatatgaaaagggacaaattcattcaattaatgaattattagatctaattaacgctcaatcttcggtgaaaattagtaaaccaacattagagcgctacatggcaaaaatcaaaaaaagtcttggagctgcttattttgtagcaaatcaaaacagagttgctgactggtatgataattacaatacagctaaagaaattaggcttgacttaatggaatttttggaaaccgaaatcgatttacataatagaaatgttgaagggcacaattggtggcagatgtttgagaattctttgccaaatctaacacagtacattaataaccacaaacaccctgctatggatgcatcggaacattttaaatgggcatctaatcttgacttcctatgtgctgcaaaattgttcaaattaaatgttatcgtttgtagcccaaatccacaaaattccaaaaacaaaattaaattcgtatggaatgtttatacaccgaattcaaaaaaaaacacggtaaagaaaatattttgcaaaaataattccttctctaggtattagtagaccaagatccagaatacaagtcagtttttatttattatgatggaagtggccattttgaagcaattttaaatccaataccaactgcagactgaaatatatgaaatgaaaaagaaaagagaattaagttatgtgttttatgattaattcttttaaacaattaatttgggaattttttatgtaaaatattaattttcttataattttttgcaaaattctttggaaataaa

SEQ ID NO: 73926 - DNA, 2573 bp, Heterodera glycines
  misc_feature (972)..(972): n is a, c, g, or t
  Genomic contig location: Contig_ID=SeqID_10678; Location=381..2953; Strand=+
  SCN-specific regions: Sequence locations=1-101,129-230,327-348,377 -1060,1083-1185,1216-1380,1409-1986,2021-2132,2154-2187,2212 -2233,2258-2573
caccggaattgcttctgaagacactgtaaactttgaggaccaattgcgtctttcatcgtacaatgcatttaaagaaatattctttcgctacaaatggaaggtaattaattaattagttaattaattaaaatgcaaatccaaattcaacaattaaattcctttttttaaagctggaaaatgaaatgaaaacccaaaaagtgcgcgagtataacgaggaggttgaaatttgcataattaattcattaaatattttttttgccaaaaaatcaaaattaaatcataaacaaacaataaaaaaaacattttttacaattttaatttattaacaaaaaagggtgcatttttgtgaatttaaatttttttcttaaaatttttacttggtattgcctatttttttaaatttcaaataaattatgcaaaaaaaaatcggtcaaaaatttatttttaatgtgaaattttttgcaaaaattttttcacaacagtatgacgcttggaaagtgcagcatggtcgtaacaagataaccaaaagtgtgtgggccatcaaatatgatcagttgaaggatgatcaaattgcggacaaagtgatcaatgcgatggcattggcggctgatcaattagcggaaacaattaaaaaaatgaaaaatccatggaaaaagccaaccgaagaagaattgagaaggggaaaaaagggaaaagcggaaaaacaaacggaaattacacaggccgaaaagcaaacgtcaggaaaacagatggtgtttctgttcggggacagaccgacaccggtaaacagcaaaaaagacaattcctgggaaatgagtgcccattttttgcgccaaaattgtttttcgaattatttttcgatagtcctttgcagggcaggatggcattccgaggccccaaaaattttcggaaatcggaattccgaaggtcaaaaaatttttcggaaatcggaattcccaggcccaaaaattnttttggaagtcgaaaatcggaattccgaccccaaaaacgtttttctgttcgggaacagaccgacacagataaaaaaaaaacaattaggaaaaatcttattttttgactaatttttttaccttgacaaattttgaattgtttcggtagccctaaatgttctcgattagcctataaaattcaacaacaaaaaaaagttatgggcaaatatgttggaaaataaataatttttttttttaattttttggccacaattcttttgaaaacccaatgaaatttttttgaacttttgcaggttaatggagaacattttcgttttggcacttttttaaaatttgttaactgtattgggaatttttcatgactaaaatctaacccttgttgttagcatacactttttattcaaaaaacactaatttaaataaattaatttgaaattggcaggccgacgcctcactgttcgctcaccttgtccaactgtttgagacaccattgaaaattccaaaactggaaaatcacataaaaacggtgaaggaacagtccaaccatgcccagcatgtactgctccaatatgttgaagaaatcaaagagcaaattggatgggaacaaatgaaacacagtagtgaaaaggcggtcgaaaatccattcaattttgaatgggtggaagatgcgaaaaaaatggaaaaatataatggcaagtttttggggaggcgggataaaaataagtacaataagtgcacatatgtagttccatttttaataaaccaaggaggacaacaaattagtgagttttgatggtaaaatgcaacaaaaaaaggggtcaaaaaataaaaaagtgtgggtcaaaaaatcaaagtatagggggtcgaaaaccgaaggattagaaaccaaggatgccaggcattccgaggccctaaaaattttcggaaatagaaaatcgaaattccgaggctcaaaaatttttcggaaaccggaattccgatcccaaaaacgtcggaaatcggaagttgaaagcggaaatttttgaaaaaatataaaataaaaataaatacacagttctcatgatgttcaaaaaaaaaaaaatttatttcaagctgaatttggctctgtgccatcatcactgttcaatttttaaattcagcctattagcgacatttggcgggatttttccatttaaaaattactttttttttaatttggccaaaaagcagcatgtacaaaaattaataaaattattttttacattttaggtccatttgacatcaaattttaaaactaaaatgtgattctaagcctatttgggtcatttttatggcatttagcgcctattatttttccaaaaaaaaagcatttaagaattttatttacatatttgggcgcttttttttagatatatatatatgtacaccagggatggcacggaattccgacttccgagttccgacttccgacatttttggagtcggaattccgacttccgacttccgaaaatttttggggcatcggaattgcgacttccgacttccgaaatttttgatgaaaagtcggaatttttctgagttttttttttcaaaaaattagcaatttttgtacaatttatgtta

SEQ ID NO: 73927 - DNA, 630 bp, Heterodera glycines
  Genomic contig location: Contig_ID=SeqID_10679; Location=558..1187; Strand=+
  SCN-specific regions: Sequence locations=1-81,123-412,436-578,600-630
atgattgagttcgatggaatgttcatggtatttcctggtgctgaacggatgcatgaacgggaagagtttggtgcggacaatgaagaggagaaggaggaggaggaaaacgaggatgaggaagatgatggaaatatcacggaaattagagaggaaaaagttaagacagagaagtcagagcaatcgataagaatgcgtacaccaaagagggaaaagaaaaaaggagcggcggaaaacactgggaaaaaactgtcggcgggaggggaaaagaagacagagaaaaaaatgctgagaaaagatagtagcggcagtggtagcagcagacgacaagagcgaccagggaatgagcaaaacccggaggggcaagagatgcagactgtttataatgagcaggaactcaagtccttcgcaatgtactttgaagagaaaacatggacaactctcatgaataaacagatgttattcgaggtacagtatatgtacagtatgggattatatgtggtatttggctatagccatgggcttctaggccaatgttattgcatggcttctagctcagctcaaagttatccctatcgtgtcttctcgaccatgttttatgttatacatgtccacctaccgtatttgctctaa

SEQ ID NO: 73928 - DNA, 2371 bp, Heterodera glycines
  Genomic contig location: Contig_ID=SeqID_10681; Location=565..2935; Strand=-
  SCN-specific regions: Sequence locations=1-210,233-970,993-1527,1549 -1564,1587-1862,1898-1979,2003-2184,2207-2371
  Gene Ontology: Mol. function=structural constituent of muscle; Cellular component=muscle thin filament tropomyosin; Biological process=pole plasm oskar mRNA localization
caaaattgtggaattggaggaggaattgcgcgtcgtcggtaacaatttgaagtcgttggaggtcagcgaagagaaggcattgcaacgcgaggattcctacgaggagcaaattcgcaacctcagcgcccgtcttaaggaggtggcacaatgcccgcgggcaatctgacaattcggcgccttttgcttaattatttgttgctttcgatctgttaaagccaaacaaaggctttgaccaatcaacaaaatgaggaattgctaattggattatcattaggggatagcattcgaaacaaaaaaacaaaatttaaaaaccaaaatttacaaaatgcgaatgtttcgaagtacaagcagttttgctatgcttttgcaatttcgatattggataaggttttcttaaaatattttgagtgattgtttgctgtcgcttatgctttttgtaagaaaaattaggggattaaaaatattttttggttttaatttttggccttttcctttttaggctgagactcgcgcggaattcgctgaacgttcggtacaaaagctgcagaaggaagtggacagactggagggtgcgctcttttggcccattttttttacttttttttcctttgcctttttttgcaatgctttgggagggaaaagccatgggacaaaaagaggcaaaattacgcgggggaatgaccagcagaaaatgaacggatcaactgattgtgaatgggttccgcttcttcgtttaaatttggcgttttgctttccgcttttccttttgtcttttccttttgtctttgcttttgcgtttcgtccgttcgttcatttttcgtcgcttttccctaacttttgtccgtccgttcgacagatgaattgctcgtggagaaggaacgcgtgcgcaatttgacagcagaaattgaacagactgtgcaggagattcagggctcttgaactgttttggcttcttcagaatttgtgacgatgtcaaagtgtggccatttgtcattttcgtccgttctctttttggcattttgtccgttttttggccgactgtcctatgtccaaattttcgttaagactttcattgtccatcattcgttatgagcttatctagctttttgctttcttttgcgtaaaatttacactatcgcgaaattgggtgtttttctccttttcctaacactttatctctcgtatttaattggcaattaactaattaatctttgtcccaattgccgtgccattgcttttaaccccattaacaattttgcagatgaacgtgaacaggcagtgaccaacgggaacgttgtgcaagaagaattggaccgattggtgcatgaattgcatgccgtttgaggggttccctcttctgttgacggatgggtgccaatttgagtcgtaaaacggaaggataatttgccaaatgaatttgattgggggcattaataagccttttggcacccatccatcccccattttgttaatgcatgaattcgtcgactgctgatgaacggccaccgtggaattaattttgtcactaattcatttgtattcctttgctttcgatgggatttgttctaacccattaagtttgaaagattcactgtatcgattaaccaataattagggcgaggtttatgttttgaaattccaagaatatttaaataaattttatgaaaaacgcaaaaatatttatgaaaatattgaacaaaaattaaaaaggttgcagtgcaaaaaaaaagaaaccgtacgctaacacaatcaaaaattattcattgtttaaagttccaaaaattctgaatttcgagaaatacggaaaatttaccaaagattgctaaaaaaaaatgccgaagtatgttttttttaaaaaggcctaaaaatatatatatatattttttatataaattatggatattgacgtgaaagcgaagaatttcctacgctaaaaaaataattcctgcatttctcagcaaaacaaagaaagcttcatgaaaatatttaaaaatatataaatcctcaattactaataaaaagaaataatgataataactgcgtgattatcgttattttttgggtttatttgtgaccattgggttatttcgttgatgggccaattagttttccgacggtttttgtcattgtcgtgtgtccaccccttgacattctgcaacaatattttgctgttttgagttcaatttgaaatttgtttgatttttgcagacgaattggtccacgagaaggagcggtacaaagcaatttcggaggagttggactcgactttccaggtgaataatgattgtatgaggaaaagaggacaatcattccatccctttggaggagctttccggctactgatctgttcggtcaacggatgcgagcggaa

SEQ ID NO: 73929 - DNA, 1223 bp, Heterodera glycines
  Genomic contig location: Contig_ID=SeqID_10682; Location=146..1368; Strand=-
  SCN-specific regions: Sequence locations=1-86,112-608,630-711,735 -1038,1063-1223
atgggaatgacagacaatccatcaaacggaacttgtcaaggccgaggcggacgtggccgcactgaaccgccgcattgtgttggtggaggaggacttggaacgcacggaggaccgactgaaaatcgccactcaaaagttggaggaggcgagcaaagcagcggacgaagcggaacggtgagaaggcgcgcgagcggaaaaccgcgaaaaaatgcaaaaaatgccaaaaaaatagttaaaatgagtgccaatgtgaagagagagctgcgagtgtgaaattgaatgaaaatctgcagagtttgtgtgccgaagttggccgaatgtgccggagggattggtcagtccctcctcccaaaatcccctgtgggcaatttccatttgctacggtttcttccccgggggttcattcccccccccgccgcccctcctcactttttatttggctttgctttgtcgccccaatgacgtgggcttaaggctgaagccgaagtggcgtcactgaaccgtcgcatggttctgttggaagaggagttggacaagcttgaggagcgccttaaacttgccaccgaaaaaatggaagaagcgacggccaattgcgacgaatcggaacggtcagttcaaaggaaagggaaggacagagccaacggacagagagaagagaacccctggccaaatgggacaaacactccgctaattgggccaattaattatttgacagaggagggaggggtccattcgtacttttgcgtactgtacgtattactgtggtgctgtgtgtatgtgttgtgtatgtgtttgtttgtctgttgattttagattgaattggcatagctttttaattccttggcattccgcccgtcgcttttcaaatgctttttttcttcgcttttgcgctttgctttttgtccgctttttgtccaattcctttccgtcgtccaaatcagcgcccgcaaatcgatggagacgcgttcgcaggcggacgaagaacgcgcaaacattttggaggtgcaagtggaggaagcgaaagtgatcgcggaggacgcggaccgcaaatacgaagaggtgagcgaagggaagcgacggtggagggagagacagacagacgagacgcacttggacaatgcctatgccaatggctaatatggctaatggcaatgccaatggctaatatggccaatggaaatgccaacggcaaatatcgccaatgccaatggcagcatttttag

SEQ ID NO: 73930 - DNA, 901 bp, Heterodera glycines
  Genomic contig location: Contig_ID=SeqID_10684; Location=514..1414; Strand=+
  SCN-specific regions: Sequence locations=1-147,191-265,287-334,356 -384,406-901
ttgctgccacaaatgctgattactgcgaggaggacaacctgtacactgttcaatgtgatcaacgacccaaattggcaccaattgtgttgaaagttaatgggaaagacattgtggtgccagcggaggaatatataattgatgtgtgtgtgaaatttgatttaaaaataatcaattttaatgaatgaattaatcaatagttgaatttgccggatggaaaatgtgcccttggattgtttgggcaatatggcgccggattcacgacggtaaaatttttagaaaatttttatgtaaatcggtgattttgggtaaaagaatttttatgcaaattgtgattatgggaattttgaggaaaattcgattcttttttcaggaaaatctcttaacaaaaatgcaataaacattaaaagaaatggtctttcaattttgttacaaaactttttggcacttccactttggcattttcagcccaatctgtgctgattgagctgttgattcattcaattccaggattggggttgatccataaaactttccggcacttttggcatttctacgtaaatctgtgctcattgtgccgttgttaagtcatttattcccaggattgggtttttcccaggattggcttatccctaagactttttggcacttccattttggcatttcactcacaaccaatctatgttcattgagctgttgactcatgctgattcaattccaggattgggtccttggcgctcttttcctgaacgcatattgcacaatgttcgactacgacaagggccaggtgagcttcgcgagctccaaggacacaatcccgtacagggatggcgaggaattcaacgcgtcattgcacgtccattcacgccaaattctcctacatgaacataaggaggaattgtga

SEQ ID NO: 73931 - DNA, 333 bp, Heterodera glycines
  Genomic contig location: Contig_ID=SeqID_10684; Location=1656..1988; Strand=-
  SCN-specific regions: Sequence locations=1-77,99-170,194-218,241-333
ctgacctgacccaccattcaccatcattgatcacggatgattttgagaccaaatttggcattttgatcatcattgaccttttttatttatgtttttgtccgtcccatgagccagcaattgttgatcatggatttagcccaattatatgtatgtgactagtatgactgcttgcatttacataaaatttaaagttatgcagctaattatttactctcacttcccccattaatgaaatgatgtaattaaacgagaccaggcttgatcaacctgctgatttaaattggtatggatttgaaactttgcattaaacgtcactctgacacatttacattt

SEQ ID NO: 73932 - DNA, 3551 bp, Heterodera glycines
  Genomic contig location: Contig_ID=SeqID_10685; Location=1..3551; Strand=-
  SCN-specific regions: Sequence locations=1-117,145-332,354-484,506 -536,560-669,691-1225,1247-1566,1600-1843,1874-2214,2237-3171,3193 -3551
  Gene Ontology: Mol. function=protein tyrosine kinase activity; Cellular component=mitochondrial inner membrane; Biological process =transport
caatttccaagtgatcacaatggagtcgtgcaaccgattgagcggtgtcgaacacggcgccttcctccactatttgcgcaatgccagcgtgtactttgggcccgggtgcaacaacggtttggcagggaaaaagggcaaattttacccaaaaaccattcagaaatgaatgtgatcggacgattggcttcacgatggaacggtggggaaggcattccccgttaatccctttgataattgctttttgtagtgccaatcattgcgcacctttccggcgacgacgccctgtcggacagaacaagttggccaaaaaaaagatacttgatcccatgaaattttgaattaatttttcaaaaattcccccccccccccctcagttttcgataccctcggctctgtcgcgctgacttcggccacagaaatggcacgtgccgcgctgactcttctccaattgtacgggtggaaacaggtgaacagcgaaggtttcctgctgctgctcatctccggatttagtattaaacccgggttaacgagtataaatcctgatttatttttccataaatattttttttgcaattaaaaaaaataacagaaatttacaaatgctcatttgtcagaatttaccagatacataactttaggcattttgtaaaacttaaattttagttgaagcttttgattttaaagttaaaactcaaattgacttaattatgtaattaattcgatttttaatcaataaatttttgcatttaaaataatcaattttaaaagaaaagaaaaaatcgcatttaaacaaaaggaagatgaaacgattttttatttttaacctgtttaacgaaactcggggatataaaatgtccgatctctattaataaactcggaaatgagcacgaggccatacaaacggaatgccaagaataaaacaaacagacaattaatgagttgacagatcggtttggtgaaggcgagcattaactttgaacgcctttcgttgcattcgctgaagaattttttgaaggattcgcaaattgaaagtgagcgattaaatgagggaattcatttgagcgaattaggggagaaagtgatactccctcctcctaatgacccaattagttaacccatctttcaagtaaatgtcgaaatcgaattggacccgtatatgacggcggacgaaatcattgccacaggcaaattgaaactgttgcggaatcgcgcgagaagtaagcggacagagaaagcacaggcaaaagcaaagaattgggcggatggacaacaaagaaataaactcattagcccacgggaaaaccaattaaaatgattggaaatgggtaattaaagacgggcaaaattgtcattcccgcaatagttataatcgtcgagatgggcatggacctgcactcgtctcgcaattttatgatcgccgcccatcggtcgcacatgaaaacgaatgactacgtctatctgatcccatggcttgcccatgtgagtcttttccgcttggattcacacggtgtgggagaaggaaagggattcagttcaaatggcgagagtctcggcaaatgcttttcctttatttatattttcttttttattaaaatttttgatcaaaatttgcttgtccatttgaatttggctgattgtctcgacagatgcacgaccattacccgtgggaagcgacgaacattgagaagcaggagacaaagacggcatttgacgacacaattgtgatcacagctcatgggtacgacaagaagttcattgaggagtttgagcatcgcttcaacaaagtgacgggaatcatcagcagttatgtgaggagggagaaacaaaaaaaagagggggtagagagaaagccagacagaagaaacaggcacaaagagacgggcccagagggtatgatagctaaagttctgttcccccccccccccccccaccactacagtaccctcatgaccaaaatcctgggaccgtccccggctgaccatcgagaaaatcagtgaaatatcccaaaactctctgtgcatcgcccattccttcctgcaacacttacagtacgccacgctgtcttacatgtccctgtacgatgcgctgtttctctacgggttggctgtaagggattcggtggaggagtcgcgcaaccaaaacatctttttggacgggcgatacatttggaagaaaatgaccgcacgacaatttattggtcgggagaaggcaaaatcaactaatgatcagggaaagggtcaatcaatagccaaatgattgttaattcgccaaatattggccaaattggtccaccgttttgaatttgtctcctcaggggtaacggggcaagtgctgatgaacaacaaggcgatcagagtgcccagctatgccacttaccatgtgaagaacggcacaatgcgaattgtggtcgaactgaccgcgcgactcagcgacaagcacaaatgcgcactgtcggagaacgactgttcggagcatgtgagcaattcgggaacaattggaaaaggggactgatcagcaaatgaatgtttgggaattgatgattggatagttagagtagtagtgactgagactgatcagagaatggcaagggtgggcaaatcagaggcacaactgacggcgatgcttttctctcttctcgcgcaggtggcgcacgagacgatgagtcactattggggctcctacgacggatatatgccaagcgacatgccaaagtgcggctttgacggcaatctgtgcgactataccaacatttacatcacaatcggagtgttggccttcttagctgtgagcattccgctcggctatttgctttatttgaaggagtgagtgggggagggagatccgaagggatcggccgacacgacaaaaagtggcatttaatgcacaataaaccagcaattagagggcaatcgaattagccctcaaaagaggtaatggtaaaatccggcaccaacaaagtccgttgggcgagactttgctgggattatcagccgaattcgttgtcggttgacccttaggggagagagtgatttgggttaataatttccattgtcatttattcaggaaggagcgcatgttatacgacatgacgtggcgcatcccacgggaacagattcgactgttggaggagaggggaatggttggcattggcactcatttagcaaattaattgggtggggttggagggggattgaattgaccggtacgaatagcccttgaaaagggtttggtagtcggtcatcagaatcaattaggaaatgctttcgttttccgactcggccaaataaaacaccgcttaatgagtaagcttttacgcttcttgcagaagtcgggctccctgcacagcaaaacgttgtcccacgactcgtcctccctgggcggaagcctcggctccgcggcaaaggcaaacgcgcgtttgtccgccaaacaagcgatgtccaacggagtgaaatgcgcgtacaaacggtacagccaaatgcgcagtttgtccttcaacaaaaacgaattgaaacggctgaaggagctgaagctgatggagaacgaaaatctga

SEQ ID NO: 73933 - DNA, 1962 bp, Heterodera glycines
  misc_feature (4)..(4): n is a, c, g, or t
  Genomic contig location: Contig_ID=SeqID_1493; Location=58..2019; Strand=+
  SCN-specific regions: Sequence locations=1-98,120-121,156-347,405 -549,571-611,634-758,792-952,973-1203,1225-1371,1435-1456,1486 -1497,1557-1694,1742-1862,1898-1932
atgnatactgtagcggcggcgtcatgggcgacccatttgaatttggcgccgcccgctgaaagcattggccaaatgttgtcaaaaggggagggccaaatgaagcagcagcagcaaacagtcatggcaaataataacaacaacaaaagcagaaaagtgccgaagcgacggtcgccgtcttcggacgcattgacgcgatgttcggcggcaccagcggatgccgcgggggccaacggcggcgcagggcattggacgcccggtaaggaaaaagagaaaaaatgagactttttgccattcgccgtgggaaattttgacttttttgattaacaataagtttttccagaatgatcaaaattttcaaaaaaaaaaaatttttttaaccaattatcatttaattttatttttttggtgccaataaaatgcatcgtttggtggtggcggtgccgaaagaaaccgccggaaaaagcagtagtgaacgtgttttttaatgagatgctgtaagattttatgacctatttttcagaaagccgtgccgtagggcaccgccggaggaaattttagaaaatttattcataaatttgtttgtcgcttttgcaaaaaaaatttcacattccatataaaaatttaaaaaaatatgaaatctcccttaaaaatggctgtaaataatggtgggattcaaatttttttttttaatatccttctgcctaagggctaaaaggcactgatgacaagaaaagaattgaaaatttgccaaaatttaattatgtataaaatttagaaaatttccccaaaaagaatacatttaggctaaatattaaatggccagcggatcatttactcattttttggtctctaaaatgccatcgtttgatcagttaaatttaatttctcaattcttcagtcattcaacagtataagcatggcccgtcgcaacaacagcagcaaatgggcaccgcttcttcttcttcttcttctgttggcattggcattaataataatggtctatgaaaaaagaaaatttaaagcaaaaattgttttaatttgtttttatttttagcgaaacaattaaaaaacgtgcataaaaatgtgatggaattggcagcaggtgaacaaatattatattatatgtactctaaattaaattaggaagaattattgaattttataacttggacttccaaccaaaattaagaaaatcttttaagattattaatatatttgttcaaatgccaattataatagatttttatgccaaaaataaggaaaaaaacacaaaatcttcaaaatattacaaaaatttgcaaatcttaattttgttaattagagcttaaaagaataaatattacatgaaaatgcaattttatatcctttttcaattttattgattttctaaattaaattcattatttttaataaatattttatttaaataattttgtctttgaccgaattaataattctccccaattttccccattttccctttttgatgtcacttgttcctcctcttcatcttcccattttccgcttcttccccctcctcctcctccttttcttccgcatttttcttcttcttccgtccctccgcttccgtcgttgcccaatttcaccgcccctccgcttctccaattgctaatgttacgcggccgaattggcggtgccattgacgagcatggcatcttgggtaaacgattaacatttaaattaaactaaattttttatttttattttaatattaaaatttcaggtcctccattggatctccaaattgatcagccaacaacaaaatttgccgattcaacaacaacgacaaagacaacgacggcacatgtgccaccgatcatttcacaattggtgggcactgacagcagcagcagtagcagcagcagtagcaacaacatcactgaacagcacaaattggacgcaaatggaggcaaaataaaaaaaattatttaataaataata

SEQ ID NO: 73934 - DNA, 2860 bp, Heterodera glycines
  Genomic contig location: Contig_ID=SeqID_1494; Location=1188..4047; Strand=+
  SCN-specific regions: Sequence locations=1-95,117-1551,1585-1818,1914- 2434,2468-2825,2847-2860
atgtttttgcgacggactgtcaatgcgtggcatttcgcccactgtttgaaaaatgtgccgcgcacattgtcctgctacgttctgttgctgttgatcatccactgggacaggtacaaagtgttttggtgggcggcacagcctgccgggcagcagcagcagcagcagagccaggcgcccggcacggcgccgacgacgccgcaggcgcagaacggcgccggcgggcgcgaccacgtgttcatttacagctcattcctctacaacagaaggtcagtcaaagcgaggacacaaatttggaaatggcaaacagagctgatcagctttatccatcatgtggacgttgggcgggtagtgtgaattttcatcgaaatttttgaatttttctgtttcgagtttgggttttgcatttgccactttttaggatataagaaattctatcctaatgatccggttttttttcttctatttattaattcccgggactttaagctttcatttgataccaagtttaagcaaagtaagaacaaagttatggccaaagaaacagaagatttggactcataaagtgcgctagagcccatggcacacagctgtcagctcaccttatccattgtttttgggttttgttgatccgtatttttcgcctctgctggtttgactcagtctgatcagcatcaggatgaatgaccgaaacattggcatgactgttttgagtggagttggcacgaaaagcatttttaagttttaggcctccctcaaatttttcggagcctggcaaagtgcaattgattgtactctttttggcacataagtttcatcgaagcactgacggattggtttgtgttgtggccaaaaatgcgatttctgttcagaaaatggcactgcaaaaggtaaatttgatctatgagcatttaaaaattgaaatttcccttttttttgcattttgtcccttctttttaccattgttttggcactttgtcctttttttctattttttggcatttttccctttttcattcttttttgacaattttaccccttcttttgataatttttggcattttcgtcccttattttgccatgtttttttggcattttgtcttttattttgccatatttttttcggcattttaccccttatttttccattgttttgccctttcccataggaaattgttcattcattgggcatttgtgccttggatttgttcgtgctcagctgctctgtcgacggactgcccagggacagtacgctgtttgaggacagtaaccgctcctacgcctcgtaccgtaacatttacagtttggtgttgacggacgggccaaggtcacagagacagtccaccaaattgacagtaagtctaattcatttttaagtattgattcttgtaaaatccatgagggaaatcccctaaaaatttcgtgggcgggaggggggggttcggttgagatggcacaaaaatattataaatcggagtctgtgattaggtgctaaaactatgccagaattgtgccaaaaattgcatttaaaattccatttttcattgcttcagctttttttaattaaaaaaattttaaactatatttcggttatttaagctttacccaaaagtgcccagctacaagtcgcgtggactcgttctgtgcataagccgagtgtttctgttcgagaaatggcaattgctaatcaccgccctggagacgtatcgcctgtttaaagttaaatgaggaaaatttcattttgttttttaatgatttttaatatctgacaaaattttaaaatgcaatttaatttaacaacttttaaactaatgcatttccttttaaattgaaaagaattttatattttttattaatattaatgaatatttattaaattattttaacttattttaaattatttataatttttttatccatttttggtcgatttggtggtggcgtacgtccaaagtgccattttggccgtttacgagctgatgaaggcgtacgagcgggaaggactgctgcgggttcgacccggcattcgttttccgcaccagcgcggaatgccatgggacccaaacgcggaaacggagtccgacgcaaattaaaaaaaagatttaatactctagaattttaacaaaatattttaattgccctaaatttcaacaattatcaaattttccaattaatcggggctaaattgaatatttgaatacctctgagcctaaaaccgcgaaaatatttcattttggcatcatagcattaagcaaaattcgccattttagcatcttttcgacaaatatggataattttgcttaatataaaccaaattttgcaattttgtatcgttgatagcccaaaattttctttattatcctgcaaaatttcaaaaaatttggtaaacgtttgaaaaagtagcatgaaaataaataatacatattttggccataacttatattaatttgataattttattttaaattttggatgctaatagagaaacagctggggatatcgaatgacatcaaaaatctaaatattattaaagtaaaactatgccatattttgtcgaaaaaatagctaaaatggtgggttttacgaaagcatgagccttaggcaaaattgcagattcaacggccaaattctgcttgcccacgactgcttctacgagtaccggcacagtgcccaattcattgggctcatcgactgggacgacttgcttgtgccgtcccggcactttgccacactgccggaggcatttgcggccgcttctgccgcccacccggacaccgcctactttttggtcaacaagctcgaggcaagctttgaggagcagctgggtacggtgtttttgtgggggaagaaacggtatttgtga

SEQ ID NO: 73935 - DNA, 3427 bp, Heterodera glycines
  Genomic contig location: Contig_ID=SeqID_10686; Location=29..3455; Strand=-
  SCN-specific regions: Sequence locations=1-547,571-591,625-919,942 -1336,1361-1807,1829-1861,1896-1933,1956-2152,2174-3327,3349-3427
atggaattattctccgatgcagtttcactgcccgcccggctgcttctcgtgcactccgatccattgccaagcctaccagtgcattcagccccaaatgatgccaatggtccgctgctgttgccggccaatgttcatttccagaagccaacccgacttaaaaagtgagttatcctccgtcttgtttcatccattccaattcactgcttttccattagctgcgtgtgatggcgaggaggcggtcgcggcatgtcttaacggactttgtggccaagggtacttttgccagcgcgggaaattttgctgtcgatgtccggtgggaaaatccatcggtaattaaatcacaaagtgtcgtcatttgcattaaatgaacgcgatgggaacactcccaaaatcaactccattttataatcttttcagaatctctctcataaaaccgttcttcggatttgccttcgtaattaatccgttttcaggacgttgtgttaatgggctttgtccgattggttacgtttgtaattcaaatgacttttgctgtgccgtcggtatcactacagggtaaatgagaaaatgatttcggaaattgggtccaaaagtcacaaaacaattaattaattaattgttggctgttgttgtaataattgaacaaactcaaggggtgccatcggaccatgtgtaaacggagaatgcccggaaggatttgcatgcggagaaggggtaagaaaacagtgtcaaatgggcttttgtctccacaattaactccgtaaaaggacctttgctacccgaactccgtcggcacttcgcttgtggaagaaccgaaggccccgacgcggaatttcccattgaatgttcgcgctaaacgaccgtattgggccacaaaaacacggaggaggggcgcacaaaagggacggaaaaacggaggcacaaaaagacggtggtggggaaggcgcgaaaatccgtgggaagtgcgaaggacacgcggcggatggaccgacggagtgtgggaggaaagcggcgagggatgggcagccgaaagtaacgaactccgataaacaaattgtgtagggtaagaagcaagtggagaggaaacgaacagaacggccaaatgcagcagatcgattgatcggatataaaatctattgtttcgattgagatttgtgagcaattaagcggctctaacagacaatttttaatacaagatgggacaatgaaaaactagtgcccttatttgttaggtgctttattcgagagtatctgccacggttagagaaaattctcgggttttttggaggtattggtctcgaaccgtgtctctgtttatttgtttaacgaatgaatattaaaaattttttcaaatttttccacaatgacatgtaacattctgtgtgtggggtagacgacgattggcgagtttaacgaaatttaggctatagtttacggtttattgaatttgttgcactaattttaaaattgttattttcaattctgtttgaatccgggttcggggttcgatgggcctaaatatgggtcggatccgagttctctggccctggaataaataaaaagtcgaatttggacgccaaatacatcataaatttcatggcgtcgggaatgaatttagtctcggatggctcaaaaatgcagaaacggaagtgatagaaatttaaaggaggaaccgccctccgtttcgccatgctacatatgccccttgtgtttaattccctaaatcagttcttaatttccttccacttctctgttcgtctcttcgctctgacttctttttgctctctttaaaataaaatgaacgaaaaggggagggagagtaaggaaatagtaatagtaaagtgatgtaaaagcaaacagaacagacagacagacaaagacagtcggacggattcattcgctcgttggggttggaagtgtagcagtcgtcagccactcactcattcattcaccccacagaaagccttccccccccccccccggctgtttgctcgtcgatcgattcccttttctcattctccagccgatagaaagacacgatatgcgctgaaattggtgaggtttctcagtttcttattggaccccatccatcttctactttttttatttagggattttacggttttgcggataaaaaagggctgaagtggacggggaaagttttctttctcttaatttaactctttattaggtaaaggggtgaagtcttcgaaaaagtcgtttcaaaccgcaatttttgctcatattttcgttaatagatagtctttacaaaaatctcaaaaactaaacgattggagagttccgcctaaacaagttttattttatgtatcaagctaatgctaagcaattaagtaaaaaagataatgaccaccttaaaaaagaaagttcctaatgtatttccacttgaatcaatctacctatttgatttttaatggctaatacagtacatagttttaaagattttccgaaaaattatcattttggtccgcacttacgaaagttataattttctaaactttggtgctctcaccagacggactgtcccgccgcaaaatggccgaaatatgaaaaacacaaagttcagttgaaactgtggaaacataatttctttgaggctgaaaaattaattttccctttgaccctaacaaaaaaaaccaaattatttaattttgtgcatctcatgtaaatctgcacttctttgataacatttaccaattgattaaatcatagatttgttacacgttaaattgctgtctgtgatagcaattcaattttttccatatttgcaaatcaacaccaacatcacgacgagcgggacactgaacgaagggagtggcggtggtaccggcactgctgcccctggtcaaaataatacgaatggtgacatcaccggaggttcttctgctgccgctgctgttgccgggaacgtccatcggtgtcaatcgcccattatggaagcagaagttgccgaagacacgtccaacaaaatgttcccttctcatgagcaatcgcaacaactacagcagcaaccacaaggagtcaagaaggaaagtgttggttcttccaattcgacgacttcttccacacgggtcgcttccgttgtacatccaatagaaaccacgaaagattcgaaacccaagccatcggtcaaagacaacacaacgatcagtccacaggcgcttaattcaatgctaagcggctctcctctaataacaactccgtccattgcgcctcagcagcgtcatgcgccaggggactacacagacgcagcggtgactggcgggaaaacgcgcggaggtgtgccccatcatttgcatcagtaccagcagcagcaggtggtccctcatcagccgatgctcaaccaccgtcatccggcgggttcccctccatccgtcgcggctactgctgttgagggaacgacgatgag

SEQ ID NO: 73936 - DNA, 858 bp, Heterodera glycines
  Genomic contig location: Contig_ID=SeqID_10686; Location=3602..4459; Strand=+
  SCN-specific regions: Sequence locations=1-137,181-592,617-858
atggcaatgggcaaagagttggagcaggcaaaggaaagtcagaagcagaaaaggggcacaaaaatggaagaagttgccgagtgccatgctgacaatgaaactgaagcaacgaaagggccaacggaatatttggaagaaagggaaggacggaaagggaagcgaagggaagggaaaagaaggcgaactccgtccgaagcagcagcagaagaagaccgaagaagcggacgaagaagcgaatgcaatggccagcgggggctgagtgattagccggtcattatcgagtggagtcatcgccgattagctgcagcggtggccattgtttcagtgcaaacaaaatgggggaggagagatggactgtggcaagaggccgtgccccaagtgccctctctcctgaaactgaccccggcgatgatccaagcggccggggggggggagacggacttcctccttcacccatcgccacttttgtgcccctcccctccacccgcttggcccatttctgtccccttttcgtcctccccccccccctcgtccatttgtccttaatcgctttttccttcgctccccgccgccgtttcaatcggcttttattcctttctttgctttgcttttcatttgccatcggttgcgaattgaccaatgttcggatgtgattcattaactcatcgaagaggaatgaatgaatcatcattctcattgtttcacaaatttatttaaacaaatttgagtttaattgaccgatggaacaaaaagaggttgaaaatgatgaaattgaacaatataattagcaatttgaaagcaattaactgtaatttgatgagataaatgaagaattttgaagggacgaccaacgaagga

SEQ ID NO: 73937 - DNA, 593 bp, Heterodera glycines
  Genomic contig location: Contig_ID=SeqID_10687; Location=5..597; Strand=-
  SCN-specific regions: Sequence locations=1-53,101-330,389-532,582-593
atgactttattagtaatagcgtgtttggcgattgccgtattttcgggtaaaagataataattaatttatgttgaaaatatttttaaaattttattttttaggttcatcaatagccaatcgacatagctttgtggagcattatgacgcgacaaacattcaagtacacacaatggttcttataatttttaaatcaaaaatttcataatctcagaaaatcagagaagtatttttgtccttaaataggaagagggtcctgaaatggtaaataaaaaaatccgcaaaattataatttttaatgcaatagaaatattcttatttttaagctgaaacaaataaatttttttgattttttaaaatctttattaaattaattaaaattataaaaaatgccattcttataacagctgcgcgattccgtgccgaacgatcttgtgccatggatcacggggccccgcagcaaaaaataccaattcaacattggcaaacagtcatggatggctgcgcgagaaaaatgtttggcacaaaatgccggtaaatttaaaaaaattgtaataatttaaaaatatatatatatttaattacagatttggtga

SEQ ID NO: 73938 - DNA, 1954 bp, Heterodera glycines
  Genomic contig location: Contig_ID=SeqID_10688; Location=1729..3682; Strand=-
  SCN-specific regions: Sequence locations=1-285,321-351,373-453,488 -762,784-1235,1273-1355,1617-1636,1658-1662,1691-1729,1752-1954
  Gene Ontology: Mol. function=aspartic-type endopeptidase activity; Cellular component=lysosome; Biological process=induction of non -apoptotic programmed cell death
tgacccgacctctgaatttggtggtgagatcaccattggcggcactgatcagcgacgatttgtggccccaatcacttacacaccggtcacacacaaagcctactggcaattcaaggtatggtagtttgccatcatactgtagctttatacaaaaccaaacccatcagagagtgaaaattttggaaaccttattaaaatttttgaaaatttcacgacagaaaattttattttactaggtcatatgcctgtctttacatattggatttctgaaaactaatgttacagtatttttgtataataaagaaattttatttatttttcttggccatttgttttatgccaattcaaaaatgtctgtctccatttctctctcgttttacagatggattcgatcagtggaggtaatggcaaacttgcgtgccaaaatgggtgccaagccattgcggacaccggtaaaaaataattaaattttcaaatataaattaaagagcaattttaatttgaaggcacttccctgcttgctgggcccaaaaatgacattgaaaagattcagaaacacattggagcaattccgctcttccatggcgaggtgaaacttttcgaaaattttcatattttggcatcttggtactggaacaaaaatgataaatctgtcttggtttagcttcaagcttccataaaatgcaaatcctggcacaaaactgaagttcacaatttgccatataattcaaccgattccgcaaaaaattacttaggctttttccagtttaaatttagagttctcaattaaaaaaaaagcctggacctaaatatggaccgggatttcatattgaagctggtggatctggattttcaatctgactaaaacagtatgcttaattatccataaattctttgttgcaattgcaattatacagtatactgatcctattttcaaaatacagtatatggaattatagagaatattaatccaattttttctaataattggactcaatctgacaaacacatatgcttaattattcgtaacccttttttgtttcattttttttattgcaacaaaattatacagtatgctgatcctattttcaacatacagtatatgatatcatgtgaacgtattcccacactgcccgatgtgacgatcaacatcggtggcaaggcgtacacgttgaagggcaaggactatgtgctgaaaatgaccagcatgggcaaaagcatatgcctgtatgggcaaaatatttgaaattgtaaaaataaattaattttttagttccggttttatgggcattgatttgccggaacgtgtcggagaactttggattcttggcgatgtgtttattggtgcaaaagcgtttttttttctttatttttttaaattataaatttacgtttttatagaatttattttaattttttatttcagttaaaaaattatcaaataattttagggatttaaaagaaatttttttttaaattcattaatttcaataattttttattatgcaaaaacaaaaattcctttatttaaatcaatattttatttcactaataaagttttcttctttcttacaaaattttcattattttttaattttcttaattaaaaaaaaattcacatttgccatttggctcatacctttccttttttgaaattgaaactttatttttttatatttgtttaaaaattccaaaatttatccaaattttcaggtcgttactacacggtgtttgatgtgggccaaagtcatgttggttttgcgcaggccaaagacggaaatgagctaaccaaatttgattttttttttaaatttccaaaaatttttctagaattccaattgagcctcaagtgcgcgattgcgtaaggggaggcgcactttgctttgatcattccaacggagttgacgattctgatcagcagatggttgagggcgattttgtaatgacggactga

SEQ ID NO: 73939 - DNA, 250 bp, Heterodera glycines
  Genomic contig location: Contig_ID=SeqID_10689; Location=9..258; Strand=+
  SCN-specific regions: Sequence locations=1-168
atgccatcaaattcgcagccacgaaggtgaggccaggctcacttaaaaaggaaattttgttgaaatttttaggcctagcattagacatgcctggtcgcttcagtgaattcctgtttttgtacacaaatgtttgccatacaaacaatgtctttggaaacaaatctgtacaataatattttaaattaaatttatttaaaattttttatgaaaattataattataattatttgtattttaattgaattttata

SEQ ID NO: 73940 - DNA, 960 bp, Heterodera glycines
  Genomic contig location: Contig_ID=SeqID_10690; Location=314..1273; Strand=+
  SCN-specific regions: Sequence locations=1-180,209-274,297-312,359 -713,752-960
atgccatcatcagcggcacaacaaatgaacaccgcaagcaatgccagacaatacgatgaacagcacaatcaggaacatctgagtattgatgccaagctgcaaaaacaggactcgggcctgaacttgttgccgcctgagctgcaacggaacatgaccgttatgtcggatgaggtggtggtcattataatgattaattaatttatttattgggtaattaattattaatccagggattaataattcttgaaaaagtcaaaaagattattctcaaaactaataaattgttaaataattaacccagaaacaaaaaagtaaaattttataagaaaattttaagaaagaaattttttaaaattttcaacgatttttagaaaatttaaaaaaacagtaaatcatcataagcctttggtaaagttgctaaaaaatcttaaaaaaggatacttttctagaaattttcttaagaatattttcaaaaaaaattttgaaaaatttctatttgaaaatctttttttgggggtgcaagcaatacatatgaatgaggttggggggaggtgaaacaagctgctcccgcaataaaagacaaatttatgaattttgtaagatttttttgagaaaaaattgcaattattagggaaaattacttattcagcccacaccatattagatcatcaccactaatctttgattaaatgccctaataagaagacattgtctttattaaaataatacttaattttttatacaaattattgccgatccaatagtgatttgatcatttttttggcatttttcagtccgttttcgaacgggagaagcgcatggtggtgttgctggtgaacaaccaacaggacaagccgtcccaattggctgtgattgatgtggactttcagagcccaggcttcagcagagtaaagaaaaaagataattagaaaaatgaaattaaatttatcaattaaatga

SEQ ID NO: 73941 - DNA, 1436 bp, Heterodera glycines
  Genomic contig location: Contig_ID=SeqID_10691; Location=260..1695; Strand=+
  SCN-specific regions: Sequence locations=1-42,64-104,144-244,285 -354,404-445,485-793,830-852,874-886,918-932,965-980,1021-1037,1076 -1436
atggctgtccacatgcgacatgcgcttgcattcaccacggaatggggtgatttggacaaaattctgtgccaaacgccaaatataaaaccgccaaaaatgggtacaaaaaaattaattaattaataatttaattttaattatttgtcaggttcccaagatttgttgcaaaatgatgatttccttgaaacattcggaaacaaagtgaatgtgtgggacatgcgaaggcgaacattgtttcaaacggtaaaatatttaataattttaataaaataattatttttattgcattcagataaagcttgagcctaaagaggatgggcgctggccaatttgcattcgaatggtttttgagccaaaaaatttttaaatttaattttttgataaaagaaaaatttattttttaggtacaccaagctgaactaacacacgggtaatgtgctttaggaaaaaaattttattaaaattttttttgtaaaatatatttgtaattgtatttttcggaacccgtcagttgggccccgccatgtttgggcccccagcggttttttggctataactttttttctttgccaaccaaatccaatttttggcatcattcgaaagctgtaaatgtcctctattagcctggaaaattttgaaaaattatttaaaggttcaaaaaaaattatggccagaagaacccaaaaaaccagatttcccaacttttttggccataaatttgttcaaaattatcgaattttttttgcaaatttgcaggctaattgagcatctgaagtgctttcgaatgataaccaataattaatcattaaaattaagaatttaaaataatccaatcactgtgagcttttggaaaaaatttattccaatattttatataacatatctgtctaattgtatttttaaaagccttttaaattcatccaattttcaacaatatttaaaaaattaataattcaaaaaataagcaaatgtcagttaatataataaaaacattttaggtttatttgtacagcattgggaagctcaatgtaagggtgaaaaaatacaaaaaaaaaatttttttgtaaatttttatgcctttagatttcatttacataaatctaccgtacgtaaaagagagtattaccataatctatggaattgattatcaatttctcagaaaacgggtcttttttctgctgatcgtgttgtcaaattttcatctgtcactgttggagaatggcctggtaggtgtgcattttttttcattatgtatgtatcagggatgggcttttgcgtttcgctttcgcatttcgctttttttggcactttcgcgtttcgcattttggcgcgaaacgcgacttttacacccctaagattggattaaattccgctaaaatttttttaaattttacccataaattggctaattttcagtgaaacttgtttataaatga

SEQ ID NO: 73942 - DNA, 1483 bp, Heterodera glycines
  Genomic contig location: Contig_ID=SeqID_10692; Location=310..1792; Strand=+
  SCN-specific regions: Sequence locations=1-20,42-98,145-232,303 -362,467-503,601-611,651-803,844-893,1214-1400,1426-1483
atggatgatcagcatctgtatgtgtgtgctgctttccatggatttgtggcacagctgaacatttcggacccattccgaccgacactaacccaaaaagcaaaaaaaaaaaaaaaaattttataatttttaaatattactttttaacaggttttccttggtggaattgtgtatcgaaccatgggaatattacacggagacaaaatgccattgggcaaagacagtgccatgcgagtaattatttaaaaattaattaattttttaatttattgaaatatagaaattaaattttataacaaattattgcaattttcgaattccgtcaataaacatttcttacttttaatacatatcatatggaaatctttaatattaaaaaaatattttttaataattattagaaatattatttgatttcttttctcaatattattttatttctaaattttttttttgtaaataaattattgcaatttcaaattttctcttttaataccgtatgcctctttattattaaaaaaaacaaaattttttaattattattttttattttgttgaaaattgtttaattcattaatatttcaatgtattttattttattttggtgtatatacatataaaaattttatttaaaaaatcctaattttttttttcagagttacaacaccgagaggcgttttttcgcgggtcgacccttcgagggtggacctgcccggttgcaattgtcgttggatggtcgacgattattcgtgtccaacggttttctccgaaattgggatgaacacttctttcctcagttgatggagtaaattaaaaaaaattttaaaaaataattatttttattttcttagacgtggttcactgattgttctggtattttatgttttaatgagcagtttatttcttaattatatatttttacatacatatattttaataatatagcaagattcttgtaatttatttaaatatatatttatcataataaaaaaatatatatctttttatattagttgttttttccgaaaaaaaatttctaaaaatctttaaagcaaattttctgaataatttttaattaaataatatatttttttattgttaatagttttgttcggcaaaatactttcttaatgttaatttaattattaaaaataatatctaattaattacaaattttaaaatgaactttctaaatattatttttttaaataattaaccaatttggagtgaagttttttcaaccaaacaggttcacattgacccagtgggcacaaatccgatgaaattggacccaaacattggcatcaattttgagccggacgaacaacagcagcagcagcagcattctgtgaacgatcatcggaaacgaggaggaggaggaggagacaaaaacggaccagcaacacaaccacaacaacagcaacaacatttttatgcaagagaaatgcgctttctgaacggtgattcgacctctgatctgctctga

SEQ ID NO: 73943 - DNA, 285 bp, Heterodera glycines
  Genomic contig location: Contig_ID=SeqID_10692; Location=2025..2309; Strand=-
  SCN-specific regions: Sequence locations=1-167,189-192,232-285
gatttcaacgaacacggagcaaagccgagatcaagaataaacacggcgtatgacatcatcctgatcacttgtgatcacaaaaatgaaaaggctgtccacggaaaacggcacatttcattgccggacattgtgattgatgctgcaactccaaagatggatgaaaagagcacagcagaaggtgatgagagacagaaatttattaaaaattctaaataaaacaaaaaaaaaattcaagtacatttcaagattggagaattcattttcaagttcaagtacctaccttaa

SEQ ID NO: 73944 - DNA, 378 bp, Heterodera glycines
  Genomic contig location: Contig_ID=SeqID_10694; Location=1631..2008; Strand=-
  SCN-specific regions: Sequence locations=1-8,63-125,152-199,224 -227,259-266,290-378
atgatggacagtagcagcaacaacaccaccaacaacggtggcagcagcagcaacgccaacagtgtcatgccgtctccgttgtcgcgtcataatttgccacccggacttggtcttggatttggacttggcggtggaggtgttggtggtggtgcaccagcaccgccgccctccttggtcagcggcatgggcttggcaaatcgtggtggtggtggtggtgctggtgacgatgctgaacaacaacaacaacagggcggtcggccgggcagcaatgctggtcctgggcagcaaaatgggcgtggaccgtctccgcaaggtgtgtgtgttctctttggcctcactgttaagctgtacaacaacagtgccccatccgaatcctga

SEQ ID NO: 73945 - DNA, 893 bp, Heterodera glycines
  misc_feature (446)..(446): n is a, c, g, or t
  misc_feature (451)..(451): n is a, c, g, or t
  misc_feature (460)..(460): n is a, c, g, or t
  Genomic contig location: Contig_ID=SeqID_10695; Location=32..924; Strand=+
  SCN-specific regions: Sequence locations=1-127,149-359,388-521,543 -627,674-744,766-893
atggttctcattttgggaaacgacccatcattgacgacgaagctgagaattgggtaagctggcagaagtttttgggaaatctccctggcctgagggctagaaacaaagacgtgtacacgcaagtaaagaagtctgattttaaaatttgtccgggctagtcgaagactaaagggacttaaacaaagagaaaaagaggtaattgaatgaatttatataattttcaacaaagtttcatttttttaaatttttccagattttattatttcacttcaataatttggtggttttttatacataaacgccctttttgatgggttttatataacaactcagcaccattcatttaataaaaaagatggatataattatttatctataataataattgctatagcgtatcaatcaacaaattataaaacatttgaattttaatttgaacacttatntgttnaagatagtnaaaagatctttcattactcacatgaattctctataaaaaattttcagcaatttcctatttattaccaaatatttatttcattttttcgtcggaggaaatccacgtcttaaaagtggcattcgctgccctttcattgcatatttaaacggagacgatttggcaccccgtattaaataataaaaattttaactaaaatttatttttatttaaaaagatccgtgctgtcctggcaaccaacatgtcgtctcgatgatgaaaaatcataccggcactttctccgcttcgatgccaaagccttcgctttggcagagtgccgaaagagtcgccgctgcagtggaaaaccaactgaaaacaatttcgtgctctggcaatggtgatcaagctgatcaacgagatcaacgcagctcaatcatcatctggtaccaatggacaa

SEQ ID NO: 73946 - DNA, 422 bp, Heterodera glycines
  Genomic contig location: Contig_ID=SeqID_10696; Location=818..1239; Strand=-
  SCN-specific regions: Sequence locations=1-93,133-148,177-422
atggctatgcttataattggcattaaaatggatgaacataatgcgaaaggagccattgctcagccaaacttggagcccttgggacttttggtgaaaatttttaaaaattttaatatttttaaacaattttaagttttcatttcccggccaaaaaatggaagcaaatggaaacaacgcaaaggacgaggaaaaacagccgccgaagggaaatcaaaaaagtgtttattataattaattatccaccaaaataaaatcatttaattacctttttagagtgcattttaattaagaaagttttcagagaagccgaacaagaagccatttttgataaagttgcaacggggagggcgtggcaaaagggacgttttagggaatgacgacggatttgccggaggatgggaccatccaattgactcgacggc

SEQ ID NO: 73947 - DNA, 66 bp, Heterodera glycines; identical to SEQ ID NO: 53774
  Genomic contig location: Contig_ID=SeqID_10696; Location=2394..2459; Strand=+
  SCN-specific regions: Sequence locations=1-66

SEQ ID NO: 73948 - DNA, 657 bp, Heterodera glycines
  Genomic contig location: Contig_ID=SeqID_10696; Location=1343..1999; Strand=+
  SCN-specific regions: Sequence locations=1-360,382-407,430-657
atgccaatgatttttatgccgaacattggcattttataccgtttgatttcactacaaatatgcactttagtatcatcatattcatgcacttttgaaggttttgtttggacagcttatgcgtaggcaaagtcaaagaaatccttatttttaaatttttgtctctgttttttaaattttaactatttaaagataatttatgaatttaggcaaagctattccaaatttgacctgaagcttttcattatacccagtgtcatggacgtttcaaatcattatgcgcaataaatgtctcaagttgagcagtgcaatttttttgtccaaggcttctatgtcaaaacacaaaagccggacaaaattcttttaaaaaccggcatttttagccggtttcgcaatgccaaaaaccatagaaaacattcaacaaaacatttatctccctttttaccggtttgtttggtaaagaaagaagcaattcataaaaaaaatctttttccatcaggttgcctgttcttagaaattgaactcggtcacaattctgtcattcataatacatttttgtattttttttcagataacatttaacatgagaggtatactcgcccaattatcgaagtagagtaacttttttattgcaattaggagttcgaaatttgtcagaaa

SEQ ID NO: 73949 - DNA, 1508 bp, Heterodera glycines
  Genomic contig location: Contig_ID=SeqID_10696; Location=2544..4051; Strand=+
  SCN-specific regions: Sequence locations=1-249,271-1040,1062 -1299,1322-1508
atgctgatcaaaaaaggtagcaacaccaagttgatcagatcactccttcatggtgatctgatcagcccattttggctgggaacgagaggtaaatttcaaaaaaaatttctagggggttgagaaaatttttctggaaattttgagtaggcccattttatagagcacaaaatttgctaccgaattgcttttggaatagtgggtctacgatttaggcccgctgagatacgtcgacttatatttcggtgcctataaaaagtactgtatttcttaagaaaatagtgcattttacactacgtcaaaattgaggcagaaagactaaatcgttcgataattgaaatgttacggaaaacgatcaccagtccttgggaatgggacaaacgaattccttatgttgtattttcatataatgcaaccccaaatgagtcaacgggacattccccttttactatttttttcggacgtactattcagtttccaaccacgttaacagcaccaaaaagagttaatcctgcaaatcatttggatgatgtgcctattaaagtgccaattgaacatttggtttcggcaccaattgaaatttccgatgaagttttcctaccaaaccaaaaaaggaaaaaatttctaaacaaaatgccatttttgccggaaaacaaattagaacacagaaaaatccaaatcaatttatttacaaagaaaccatcaattttagacccggaggagacctgtggaatgtgccacaattcgttgtgcagtggaatcgaggagcacagcaattgtgcggcaatcactttggcggatcttcaccctgcttttgccgtgatggacaaacttcgaaatgtcaaaattgagacgctcggggagctgatctcacttatgatcgcaaaggatgtcccaattgcgcaaattcgaaattgggcaacaaacagaaacacacatggacctgattttcttttaaaattcagttcaaatctgtccccatcttcccaggaatttatctcaatcatttctctttggattgaccggtgcgactttgcttttcacaacctccaggcttcagggtgcaaaaaaataaaatttttaatccccaaagaaaataagggctatccattccaaaaagcgattgaaaatgctattgaggatgtgaaagctcgatctgtgttgggtctgtcgaaagtaattcgaagtcctttcattgtgttcagtgattcggttggagaagtaatgaaaaataagttggaggcggaaatatttttggagaggagctacacggcactctcaaacgaaattgtcaccacctattttggtgaagaagttaaagaaattttgattatggccggcaccgatgacattattggaaatgtgccaattgaagaaacgaaaaaggccattaaaaaaatttcatttcatttatccaagttttccatcaaaacttttattattccccacgcctattcatttcaaaaaaatcaagggcacatgaaaaatttcttgatttgttggatgaaatt

SEQ ID NO: 73950 - DNA, 2198 bp, Heterodera glycines
  Genomic contig location: Contig_ID=SeqID_10697; Location=1..2198; Strand=-
  SCN-specific regions: Sequence locations=1-358,380-595,618-748,810 -909,951-1590,1612-2198
  Gene Ontology: Mol. function=ornithine-oxo-acid aminotransferase activity; Cellular component=mitochondrial matrix; Biological process=ornithine metabolism
atggccagcggatttgggacatttttaccccgtgaaatttggcactttttttcgacaaacattcgccacttgggcttttacaatggtgatcatttggaccatttgcttcgtcaaatttcgccgacaattctcatcgatctcaaccaattggtttcaatccattcatttgatttgttgcccgaggcgattggtgatgattttgatgtgccaaatgcaacaatttctactggtcaagcattgtccaaatggttgcactctccgagaaaagatggccaacccaagcgattgcgttgcgataattactacgaacaaacgaacttcgattgggtcaacaatttcaaggaggtgtggcccaacatttttgtgatttttgttttggcaatcatggagtttacttgtcccgttttttttttctttaaaaatcatggaaaaattttttagggctattttactgtgctgacaaagggaggtggccaagtgtccgtgggatttcggaatgaaacttggttaggtggatagagcaccaatgggttcttaagaaaaatggttttattttctgccaaatgagcacgagtgccgagttaagacgtgccaaatttttaatgattaaataaaagaaatacctatttgcacaagagcacggtgtccagtggtgtagcggtagtgcgctagtcagcatcttttagcccagggttcggatcccctacgtataaattagtttttttatttttgtcttttacgccaagtcaattataaaaatttattttatgaaaaaatttttatttttaattttttttaaattttttaatgcgcaaaatattcaataaaaatattcgccaaaaaaatattttttaatttgacagaatatgtattacatttatgtttaatgcaatttttgatttttaatggaataaaattaaaataaatattttgataaagaaataaaatttgataattgaattgctcacaaaaagcaaaaataaaaattacaaaatgaatttacacataggggattcgaacttttgacccaaaaaaaattttgactaacgaattacctctacactaacaatttctttgaagaaaggaaatagttgttccttttctttaattataaaaaactaaaaactttggcacgtcataactcggcactcgtgctcatttggcagaaaataaaaccatttttcttaagaacccattggtgctctatccacctaaccaagtttcattttgaaatcccacggacacttggccacctccctttgttagagttgaaatacttctttttttttttgaaaaattctgaagttttggttaaatttttgaaaaattttctctcagaatgaaacgatgcggggagggggaaattaagtgaccccttacatttatttagtgatagaggacggacggttgattgttccaaacccggctttcgaaatccggaattttttttttttgctgaagcggttgctcatttttcaccactaacaggcggcgatttccgaccccaattgtgccgcctttatggtggagccaattcagggcgaagcgggcgtaattgtgccatctcctggataccttcaatgtgtgcggcaactgtgcaccaaatacaacgttttgttcattgccgacgaagtgcagaccgggcttggtcgaacgggaaagtgagtgttggctaataatggcgggaaaaccgaaaaacggagtgaaaatgccttcctcttggcttaatggctccctgttagtggcaaaatgcgtcggtgatactgtgttttttcaaataatatactgtactatgatgctaaactagcaccaaaatgaattcacagtaaccttcaaatcatatgggaatttaatcctggaaacaacaattaagttcttagaaacattcaacaaaccttgataaaacatactgtaaaacgggttactgtaaatttattcctgtcaattcacagtaaccacttcaattcgtcatgctaccgtacgtgtctcagttttcaaaaacactgacgcatttttatactgacaatttaccatcacgggcttaatcagtcagtccttcgatcaaaaattcctctcccatcatcgccgtccttcttcagaatgttgtgctgtgaacatgacggcgttcggccggacattgtcacattgggcaaggcccattcgggtgggctttatccgatttcggcggtacttgcgga

SEQ ID NO: 73951 - DNA, 83 bp, Heterodera glycines; identical to SEQ ID NO: 69364
  Genomic contig location: Contig_ID=SeqID_10697; Location=979..1061; Strand=+
  SCN-specific regions: Sequence locations=1-83

SEQ ID NO: 73952 - DNA, 987 bp, Heterodera glycines
  Genomic contig location: Contig_ID=SeqID_10698; Location=1..987; Strand=-
  SCN-specific regions: Sequence locations=1-246,268-269,291-437,459 -619,642-951,973-987
  Gene Ontology: Mol. function=ornithine-oxo-acid aminotransferase activity; Cellular component=mitochondrial matrix; Biological process=ornithine metabolism
aaagggtgccgtgtgtgggacgtgaacggcaaggagtacttcgactgtttgagcggttattctgcgctcaaccaaggccattgtcatccgcgactcgttgagacgatgcagcgccagtgccaacagctcacgctcacttcacgcgccttcttcacagacgcgctgggccattacgaggagtatgtcaccaagctgttcggctaccaacgggtgttgccgatgaacaccggtgggacaaacaaatcgccaaattgtgtatttttaaatcgccaaattgtgtatttttaaatcgccaaattgtacatttttgcatgaattcctacggtaaaaattcctacggtactttgcgagataacgaaaaaactgaaaaagcgacagtgaaaaatgagcgagttcattagaatttcttgaaaatgaggtacggtagtatggtgatttaattttatgcatgaattgaatggaacaaacttacagtaacccatttgtagtaaatttcatttaatgaatttaaatttttttgaaattttacagttcattttccattgaaaattttttacttcttattggtattttttaaaattttcttacactttgaagcttcctttcaaataatcatggcattattaatttaattagtaattgttagatatttcctcagggactgggtcgttttggcgccgacgttttggcgccagcctcagtttttttattataactttttttcttgttgaccaaatctaacaatcttggtatcattcgaaagcccttcagaagctctattagccttacaaaaaacaaacaaaaattttagcttctaaaaaagttattaagaaaaaaactcaaaaatttcgacttttttggaatttcatgttataacttttttggtaattgtctaatcgcgaagcaatagcttagaaatatcttctaaacatgttaagctttcgattgataccaagactgctggattaggttaacaacaaaaaaagc

SEQ ID NO: 73953 - DNA, 1926 bp, Heterodera glycines
  Genomic contig location: Contig_ID=SeqID_10700; Location=1270..3195; Strand=-
  SCN-specific regions: Sequence locations=1-485,573-601,624-714,737 -1106,1141-1166,1200-1260,1283-1536,1558-1655,1684-1926
atgaaacggtctacgagaaatgcgtcaaaaagagaaaataaaaaatcccgaagttcggattcgctaagacaagaaaaacaacaagaaaaaagtcaaaattgtatcaaaaaaatagatgaatatacaactagtagtaaaaagtttcaactattaaggtcaaaatcaaaatttgtcgttcaaaatatagaccaatgtgataatcccactaaggagttagaagaatgtataaaatcgtcaattaatgaagctatcgaagatgctaagagaactttgggtggcgcggataaagccggagtagttatttcttcagaaatgttagatcaaggagacataattgtgccgataacacctattagctcaaatgtggcagacgcagtcttcaaccaatttatcaaagtagaacaaagtgtagcaagaaaaagtcttaacatttatggaacaccttttgtcattactgtaacagttcttaacattaatggattaagaaaaaaataaagaataaattattattattattttttttttttgtaaaattttataaaaaatgtgaataaaatattaaaaattttaatggttaaaaatatgtcacacccttgaaaactgtcccagatttccaaggtaaattgaaaatttactcccaatttggtaaatgaaaaatatgtaagatttcaaaaaaacagcttcacgttcttagaaacccaaaacttgatatttgtaacccctacaattgaggaccatacattttgggaccctactttttttgggacttgacattagggatctgacatttggggaccctacacttgtgagcatttggggatcctacatttgcagagttgacgaggactctacattttacgaccctacagtgggacaacagttggggaaccctacagttggggatctgacatttgaagacttgacactttgggaccctacatttttttagggaccagacatttgaggaccctacatttacggaccctcgacatacaacatttgaatacccacagtttatgaccttattacatttggggaccagacatttgaggacttaacatttatgtaaccgatacttggtacctgacatttgagggggaccttaaattttgaagatttcaaacagaaaaataaaaatgatattacattttaggagggtcaaactatttgattcttttttagaaatatgaaaaaatacacaatccttgaaaaattgactcacaccctcaaaaaacttttcccagattttcaaacgtattttaaaaattgtttttacaccttattttaaatggaaactattccaacatccttaggaaatactaaaaaacaaaggatttattaaaactccccccacgaaattaattaccaataaatcatttgcagccaagagggtttgaacttaacaacggaaatctggtggactaactacttctagagaccaaccaacccttttcgataaataaatataattaactttttgagcaatatattttctaaatttttatacttcttagaatattcacggtttttgagtcgatttcaaaaataaaggaaattttggagctccggcggtgccgataggcgccgccggtgaaaattttgaaatttttagtgcattgttaacagatttagtccaaaaatgaaaaaattttgcgattttaattgttaaattttattaaatttctgtcgaaaaaatgaatatttttgaaaaattagaagaaaagcaagtcaatcactagtggtgcattttcacattgaaaactcaatctttaggggtgtatttttcccgaaacttcgggtaaaatagccgaagccgaagcacgaagttcgaagctcaaaaaacccgaagttttcgaagccgaagccgaagtttcgcccagccctggtcccgagacttgtgccacaaacccgttggcacgtttcaag

SEQ ID NO: 73954 - DNA, 169 bp, Heterodera glycines
  Genomic contig location: Contig_ID=SeqID_10700; Location=3656..3824; Strand=+
  SCN-specific regions: Sequence locations=1-50,107-169
atgtcagacaatgtattcgccttgttggatgatttcgacatcgaaaacagtaattaaaaaatcattacatatatatacatttattatatatattatattatttttagtcgacccgagcctaaattttgcaaatgatgactggatggaggaaatcggtgaatccgttacg

SEQ ID NO: 73955 - DNA, 268 bp, Heterodera glycines
  Genomic contig location: Contig_ID=SeqID_10701; Location=3805..4072; Strand=+
  SCN-specific regions: Sequence locations=1-31,64-268
atgaaccgacggtaaaagaattttaacagtcacacaaattcatcatttatttaactaaactgttttccataatttcagttggatttgcaacgacgtttggatggacattttcccatcctttgaccgtccccaactcggcctcaaattggcacttctttcgccacgtttcaatgcgttggtggacaaacatttcaatggcaaaagcgaattgacaatttggagaactatcgaaattcgtcgcaaggacaaaggaccagaaccgaaatga

SEQ ID NO: 73956 - DNA, 1141 bp, Heterodera glycines
  Genomic contig location: Contig_ID=SeqID_10703; Location=651..1791; Strand=-
  SCN-specific regions: Sequence locations=1-309,331-493,529-578,609 -636,666-834,857-867,891-914,947-1097,1120-1141
atggactttgatctgttgataaaaaagttgcagtatgtgatcagaaaaagtggtccatttcgaaaaatgaagcgcgggaaggcgaaggacaaacagcaaaaacatgggaatgatttgatcaaaagtggcgccgaccagcagcgcaacaggtgatcgatcaacggccgagcaacgaaaataatttaattaattggacggcctcgtcgagcggcgaaatttcaagaggggggaggaaccgttaacaggtggaaagagtggggttaatctcgagaatttctccttctcgagaattcgacgaatatgtgcttgggggaaggggaccaaaaaattaggggataggaactaatgggaccaattagggttagagtgagcgaaatgcccgaaattgtgctctgagattgtgattgtttgtgatcggttaaaattcaaaaagatttttatttcgtttcgttaatgaataccataatgatcatatgacaaacatatgcgcgagtaattattttgatattaaaaagaatttttaattatgatctgtgaaattgaaatatttatgagaacaatgcgtaattatgggttagaaaataaatattaaaaaaaaagaaaaaaaagttgcgatacgatgcgctctgtgtttgccttttcagtttcataaaattttattttttaatcggagaaaaaaaatattcaatacttattgaatcttaatcttgctgaattatttgcccgtttataaaatcatatttggtttgatcagaaagtgtgatcatctgccctgaaagagtgaaaagtatgctgatctgattctgtaaaacatcagatcaatgattagtatatctaatctgcagcttaagaatgatttgattgatcataaaattaaataataattttttctttcgattaaaaatcaataaaaattgccatttttgatgtaaaatttattaaaattttcaagattttccagtaaaaaatgaatttttcaatataatcagttgataatcctacgagtttaaatgtaatattttagattacttatcagaacatcattcagtcggtggccagaagaagtcaaaaaatctgggtttttgaacacttttctcaataattttttaaaacaaaaactgtaatttttatgattaataaa

SEQ ID NO: 73957 - DNA, 3603 bp, Heterodera glycines
  Genomic contig location: Contig_ID=SeqID_10706; Location=5..3607; Strand=+
  SCN-specific regions: Sequence locations=1-343,367-407,484-1237,1261 -1320,1342-1860,1882-1946,1968-2440,2462-2936,2966-2996,3018 -3299,3322-3603
atgtctggagtaattaggagtaaaatccccctcctaaacagagttataaaaaaggaaatagagtcggccaaaaccaaattggaggagggcaaattcgaatatgatcagaataacacagacgagtgcctacgggtgttcaataaaacaaaagaaattatacaaaaaattgagccaaactttgaaaaattaaaaactttgcataaaaaatggcaaaatttgatgagaaaaatggacaaagaacagtggaacaccgaatggaaaatccagaaaatttttcgcgaaaaacatgattatttaaagacaattaaggaaacagacgaaatcctcgacactctgaaagacataaaattggaggtaaaaagaagacttaaagtaatcaaagcaaaaccctcttcagacactgaccaagaggatgaatcaaatgatgatgaagaagaaaacgaagacgaagaaattgaagaagaagatgaagaagaaaaagaatacgacagtgaccaggaagacgattcaccggaattgacctcaaatgatcaaacaaaccgtaaacaaacaccttttgtcaattatcgatcgagaataaaacttccaccccaaactctgacacacttctccggaaaattctcccaatggcccagcttttgggacgatttcaaatcctcagtccacaatgacccaaacttagagaacatacaaaaactgaaatacttgcgaggacttttacatgacgaaccataccgaattgtgtccccttaccccctcacaaacaaaaattatcccataatcgtcaaattactcaaatcccgatacggtaatccacaattgatcagagaaaatctgcacagcgaattaagaaatttaagaaaaccaaatgaatccacaagcgaactgagacgatttatcctattcattgaccgaattatcctacaattacaatcccaaggcgaagaaataaaccatccccaaatcaagcaatccattgagactaaactccccttcaatatccgactaaaactgagagaaaaattcaaactttactcgacaaaagaattaatgaattttctcaattcacacactcaagctcgtgaagacatagaacgaatggaagattcaaacagacaaataagaaatttcccccctcaccggccacctcaaaacagaccacaaaggcaatcatatccaaactattcccaaccccagctaaaagcaaaccaccgaaaccatcaaaatctgcctctctcgccctatcccatcacttctgcattaacaaccaaatcaaaacctgtccgtttggcagaatttaaaccaaaaccatcgcaacccaaaccacaaacaaaaataaaattttgtcgattctgtgaaagagacaatcacttgagcaaagaatgcaaaatttattcaaccacggaaaaaagaagtaatcgagcgcgcgaattaaaactttgtctaaactgtctgaaaaaaggacatcatttgagagaatgtaaatcatcattttcatgtttcaattgcaaaagcaaacacaataccctcctatgcacccgaaagcaaaaccaatataatcaaagagaaaaatttacaaaagtaaacgtcacgcaaaaccccgaggaattcgaagaaacccaaacatttatgtcaatggattccgatcaaaatcagaaaattatacaaaatgatgaagaagaattgcttatgaccacggaagcaccagtcttaaaccccgaccaaaacaaaacacaaaacgaagtaattttcttcgataatgggtcgcaaaaaagctatataacagacgaatgtgctgattctcttcaattacccacaatcgaagaaaaattattggccatatccacctttaaccaaaataaacccaaaatcatttcatcaagactagtcaaaattggcatcaaaacactaaacggtgaaatcgaatacgtaacactacagactgtggaaaaaattactgaaaaaatggtcaatagagagactgttgatatattcaaaaataaaataccgataaaccatgcctatccacaaattctaattggtatagaccattcttggcactttatgctgccgaactcacaaattcaaatactcccctccggattttactcaatcgatacaaaattaggaaaaatattatccggaaaaggtacgattgaagacacaaatgtcaatcttgtgaaagaaaaacgaaaaaaggatgagacaaacgaaatccttcaaaaattttgggaattagaaaatatcggaattaccgactctccgcatttgacggacgaagacgcagctctcatacactttgacaaaaatgtcatttttgaagaaaatcgataccatatccgatggccatataaacgagaaacaccgaatttacccacaaattttggattatgtttgggaagattaagaaatgtcgtcaaacaattgatcaaaaataaacagttggaaagttataataaaatactgcaagagcaaatggacactaacgttaatgaaattgccgacttcaaatccaaaaatttaattcactatctcccacatcaccccgttataaaagagagttcaaataccacaaaaattcgaccagtttttgatgcttcagcaaaattaagaggaagcaattcactcaacgacgaaattcaccaaggaccaaaattattacctgatttatgtggaatgattctccgattcagactcaaaaatttcgtcttattaggcgatttagaaaaagcttttctaagagttggattaaatgaaacagacagagatacaacacgctttttatgggtaaatcaatcatatttggacgaaataaaccaaaaatatcgagaaatcgaaatgagagacgtagaattaagacgtttcacccgaatacccttcggagtcaatgcttctccgtttttattaactgctgttgtgaatcttcatttatcaaaaacagatgaaatgtttgaaaagtttaaaacacagcaaatagacaaggagttatgtcttaatggaaaagaaaaacaattcaaagagctatgcacagaactgaaagaaaacgcatatgtcgacaattttgtaatgatgtgtgatgacgaaaatgaaataaaattcaaacattactggagcaaagaaatattcaaattagcatccatgaatttgagagaattcgtgtctaatcacgaacaaagcaacaaagaaattcagaaattggaaggatctgaaataccaaaagtgacaaaaatgttagggataaaatggaatgttgataccgatgaactcgaactccaaataaaaataccgttaatgagtagagagacacgacaaaaaggcaaattttgaccatgatcgcaaaaaatttcgacccaatgggttggctatccccagtaatactcaaatacaaactatttttccaaaaattatggagatcaaacaaagactgggacgacaaattaaatgatgaagaaataagagaatggaacaatatttcaaatatagacgaagtttccataccacgctcaccatttacaagtcaaaatttaaaatgtgcttctttacaccttttctctgacgcttctgaattagcttacgccaccgccgcatatttacacgcaaata

SEQ ID NO: 73958 - DNA, 1746 bp, Heterodera glycines
  Genomic contig location: Contig_ID=SeqID_10707; Location=101..1846; Strand=+
  SCN-specific regions: Sequence locations=1-159,182-869,892-1018,1054 -1348,1370-1746
atgaatttgagagaattcgtgtctaatcacgaacaaagcaacaaagaaattcagaaattggaaggatctgaaataccaaaagtgacaaaaatgttagggataaaatggaatgttgataccgatgaactcgaactccaaataaaaataccgttaatgagtagagacacgacaaaaaggcaaattttgactatgatcgcaaaaaatttcgacccaatgggttggctatccccagtaatactcaaatacaaactatttttccaaaaattatggagatcaaacaaagactgggacgacaaattaaatgatgaagaaataagagaatggaacaatatttcaaatacagacgaaatttccataccacgctcaccatttacaagtcaaaatttaaaatgtgcttcattacaccttttctctgacgcttctgaattagcttacgccaccgccgcatatttacacgcaaataataaaactgacttattattcgcaaaaacgagacttactccactcaaaggactaacaatcccaaagcttgaactattgggactattgatagccgcaagagccgttaaattcatcgtaaaagaatcaaaattaaaatttgaaacgatatgtatctggtgcgattcaaaatgtgtactaagctggttaaaatgcaaaaagaatttaccaatatttgtaaaaaacagagtggaagaaataaaacgaattgtgtcagaatttcatatcactttctattacgtaaaatcagcagacaacccagctgatttggcatcaagaggtacaacaatgaatgaaatgaaatacaacgaattatggtggaagggaccaaaatggcttaaattaggaaaagaaaactggccagcccacagtttctatactcctgagcaaaatgattcactttatgatgataacataatggaaatcgaaaacactcagacaaatttagtcaaaatggactaccaaggatttattgaatggaaaaaatgcaattcatgggataaagtgacaagaatttgtcaaatattattaaaatttgtattttttacattaaaagactctcccgaattcaaaactaaattcaaaatacagaaatttcaaaacgaattgagcttaaaattcatggcacaaaaaatgctaatacgcataattcagaaagaaatggaaccaaataatgaagaagagagacaattaggaatttatagagacaatgacaatattttgaaatgcggaggaagattgaaaaatgcacagataaaagcaacaaatccaatattcttaccaagaacacattttggtactcatttaattattatggaccatcaccaaagaaatttacacgctggaacaatgacaacattagcagaaattcgtaaaacatattggatccccaaaggaagaagaattgttgaccaaataaggaaacagtgtttctattgcaaaagatataacgcaaaaccatatcagcaaccaaaaatgcctcagttgccaaaatcaagagttcaaataacagagccttttcaaaacgttggcctggattacatgggtccacttcaagtaaaaagtttcactgaaaaatgttggataatccttttcacatgttgcaccacgcgtggaatacacctcgaattagtgacatcattatcagtacaacactttctcaatgcatttcgcagatttatttcaagaaaagggacacccaaaaatatttggagtgacaatgcatcacaactgaaacttgcctcaaaa

SEQ ID NO: 73959 - DNA, 582 bp, Heterodera glycines
  Genomic contig location: Contig_ID=SeqID_131; Location=4006..4587; Strand=-
  SCN-specific regions: Sequence locations=1-242,290-344,386-582
atggccaaaatggtctttttatcacctcggtcattgtggatcgacgcgaagtatccatttcgaaaaacgccgacacgagaagcgctcgtgccaagatcgatgccaattgcatgtgaatttcgcggcattattttatgcgaattagaaatttggtaaatcttaaatctggtttattttttaccgtttgttggtaaaaattatattggtttgattattttttggctctattgaagggagtcaacaaataaattattaaaaaattttatttgaagaaatttgaaaaatttctgattttcgacacaaaaatatgatttttttaatttcaaatttctgcttactaaatttttctgtctattttttctttaataaaggattgtccttcaaatttgtgcattaaaaatatttttgttagtctttaattaactctcgctcccgccctggactcccgtaaaatttcagcgggattttaacgggattcccgatcacgctcccggaaattttttttaacggactctatcaaaaaggaaaaaaatatttggcaactctaacaaaaaattcgaaatcgtaattctgcaaaataaa

SEQ ID NO: 73960 - DNA, 239 bp, Heterodera glycines
  Genomic contig location: Contig_ID=SeqID_131; Location=1..239; Strand=-
  SCN-specific regions: Sequence locations=1-239
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaat

SEQ ID NO: 73961 - DNA, 1653 bp, Heterodera glycines
  Genomic contig location: Contig_ID=SeqID_131; Location=5303..6955; Strand=-
  SCN-specific regions: Sequence locations=1-131,155-562,585-915,944 -1125,1152-1256,1278-1298,1323-1528,1558-1575,1597-1653
atggacaagatttcagaatttttccggacttcttatccgggggttcatttctcaaaaactactaggacaaggctcataattaatgtaattttttttgatggatttgtattctttccaaaaagtgtgtataataattttattgcatttttaaaaatatcccttagccgcggaaaattggattcgaaaaatatctgtgaattaccgttttttctctaattatcctctaatctccattaatcccacattctccaattatcccgcccccttctgaggaggttgaaaaataatgccccatggaggataattagagaaaatagtacaagtgaaaaaaaagttaaaaaatgtcgcgctaaacttcactggctacaccaaatatgagcgccacacctgaccggccctacttaatgtgttggtcaaatgtagggcaattcctacattttgtcgaaatatttattttagctgaatcaaatctgactaattaaagagcaatttcctttttttgttgtcaatttcactttgagggaaaaatgttcataattgaaacacctccacggtgaatgtctgctgttttccattgctttgcacggcaattttggggcgtccgtcctctccaggcacaacgcgaaatggccaacgattgatgttcgcctgaactgctcggtcaacgaatttccgtccgatgagatgaaaaaagtcgaaaatggtgttagacggatttatggccaactaaatgccaaaatatgtaattagcgtatgccggcaaattatcaagggaacataacgaactataaatatgaaaatgtactctctcttgtcacttaaattgattgaattggatcagagcaggggtcaatcacaattacgaacgacaaacgccaaatctgtcgtaaaatatgtcgtttgtcgttatctccaatcataattttaaaaaatctgtcgtttgtttaccgaaatttgtcgtttttcgtctgaaatttggcgtttgttgttcgtaattgtgattgaaaccaacgacaaacgacaaatttcagacgataaacgccaaatatttggggggcgttcaacttcgcccctcaaatttggcgtctgagaaatgtcccaaaaattcaccaaattattttgatctaaaattttttatttaatattaaaaacatgtttccaggtgtaaatgagttcgttggtcatgaatcagatctcagattttaatttctatacttttatcgatgatttttaaatttattcgggtttttcgaatctattagatttggaatctacaatacttaccaaaaaacctctagaaaaaccctttagccatttttcaatttttttgcattttcctgagaaatgttggttaattcataagaaaagtgacgacaaatttacggtagattttgttaattgtgattggacgacaattcacacgacagagacaaactgaaaacggcttattcaacgatataatttgttgtcgtaatcaaaattcggacgattgccaaatttgtcgttcgtaattgtgattggccccagatttccttcttttaatttattttagttttgaaaccaattttcataattcataaaaatattcctattaaatgtttctgcctgtgcttttgccgcgtgttgggtcgtttcttaattcaaccaaataaa

SEQ ID NO: 73962 - DNA, 1134 bp, Heterodera glycines
  Genomic contig location: Contig_ID=SeqID_10708; Location=937..2070; Strand=-
  SCN-specific regions: Sequence locations=1-516,663-1031,1054-1134
tttagcagcaacaacattttcaaagtgcatcgtctcatgttggtgctcgtcttcctcaaatcgctcactttgcttttccacggcgtcaacttttactttgtctctgtttatggccacgaacgtgagctttgggccatcatttactacgtcacgcatttgtgagaatggcattttctttttcgtcttatttcgtaattttaggcttaaaggtgcgcttctcttcggcacaattattctgattggctccggttacacttttttcaaagtgaatttcctttcaaattttatttgtcgtttattttgagtgtttttacagcaatttttgagtgacagagacaggcgactgttcattttcgtgttgcccctgcaaattttggccaacatcgcaatgataattctggaagaatcggagttcagcgaccaacgctatctgttctggctggagatgttcaccttcctggacattgtctgctgcatgagcattcttttgcccattttgtggtggggacaaaagaggagagagagagggagggaaaaagaaaaggaggaacagagaaaatgaagaaaaagagggacagagagataagtgagaaaagaagggtagggagagagaaaagagggacagagaggatgagagagacagaggaaagaggggggagagaaaaacgatagaaaaaagtaaggaagaaatgacgatagggaagcggcgaacatattcatttgaaaagtaataaattaaggtctattgcctttctgacggagtgtgccgcaaaaacgacggatgggaaggcggcatttagtcttgaaagacttcggctgttccgtcgcttttatttgcatgtcattgcttacatttacacaactcgtggtgccaaattcactcttgaagtactgtggaatgttttaaatgtccaaatcattttttatacacataaagtaaaaaaaaaagaaattactcacaagcattttattttttagtattttttgccggacgaaaagcgttgggtttccgaggcggctgctgaacttgcgtctttgtttttcttttgcctcgttggagctaagttcaggccccggaaaagtaacccatatttgagaataaacctggaggaggggggcgatgtggaggccggc

SEQ ID NO: 73963 - DNA, 846 bp, Heterodera glycines
  Genomic contig location: Contig_ID=SeqID_10709; Location=160..1005; Strand=-
  SCN-specific regions: Sequence locations=1-462,484-846
ccggggccgggaattggccaatggcgtgcagaccaacccgcacctgtgccaactgcaacagcaggaccagggcattgactcgctgttcttcgttttcgatttcaccgcccaacggttggtcgttgttcgttctggacacatcaaaagcatcaaattgtgcacgaatttgtcaaggcaaggacaaaaaaaggacataaaatttaatatttgtcacggatttgctcttttcagctgcccctattcggaggatggcgaaacggtctttcccccccccccccttttttctcccttaccaatttctgttcagcgcaattcgacctcttccgtcgtggcttcgtccgggggctttctttcccatttgtttgggggttcttcctccagcaacgatttgaagctgccatactttgactatttgccaatcggacttcataatggccaatattcgactcaggtgattaacggggaagggaaggaggagaggaaatggatttggttttaaaaattgaatattttcgttattttccgccattcgcttcttttttgactgtttttctctcagttcgctgtccgtttcaacgaacaacagaagggctttttcttcctgttcttccacaattgcttcaattatcgtgaacatggatacagcgaccgcgtggcggtcgatttggcggtgatttccgttgggaaaaaagaaaataattaaatgtttaaggcgataattgtcgagaaaaatgtcaactcttttctgtcggttgtggacattcccaagccgtctctttacgtttatttcgcttttcttttcgcgttggccacaattttgtgggcaaatttattgtgcaaatcgga

SEQ ID NO: 73964 - DNA, 454 bp, Heterodera glycines
  Genomic contig location: Contig_ID=SeqID_10712; Location=233..686; Strand=-
  SCN-specific regions: Sequence locations=1-399,440-454
atgcaacaaaagtcatttgacgaaatatttggagaaaaatgggaagaaaaagagatggaaaatcatcaaaagaaaagtgaaatcattcaaaaatattacaaaattaaagaaaatatcaagcaaaaaggaagaaaatatccaaaaaaagaatggaataaaattgaaagaaaaattggaagaaaattgggcacaaatcgtaacaaaatttatgaatggattaaagaattagggcttaatcaaaagccaaataaatgttataaatcaaaaactgatgaagaaacattagaaattgtacaaatgtttattgcaatgaaaaacgaattaaagcaaaaaggaaaacactcaaaaaaagaaaggcgccaaagagagggaagattgatagagaaagagaccgactgtgagagaaagaaagaaagagagatagagagaaagaaggaaaagagaggaagcgaga

SEQ ID NO: 73965 - DNA, 1871 bp, Heterodera glycines
  Genomic contig location: Contig_ID=SeqID_10715; Location=150..2020; Strand=+
  SCN-specific regions: Sequence locations=1-206,233-452,475-490,550 -575,615-696,781-892,941-1356,1395-1562,1602-1618,1640-1721,1775-1871
  Gene Ontology: Mol. function=sodium dependent multivitamin transporter activity; Cellular component=integral to membrane; Biological process=molecular hydrogen transport
gactcaccggtggattcaaataattctgacaacaacagcagtgttgtccaacggaagctgtacaaagcggacgaaaacccaccatggccgctgacattgcttttcggccttcaggtcagacattgagagggacggacggactaaatgcttaattaaactcaacccatcgattaattcaattttactgagtctcgtaatattcaatgtattttttttaatttttaaataattaccccccccccccctccaatggttttagcaagtgatggtgtccgtctccgtgcttgtctccattccgtttctgatttcggacgaagtctgccctggtcaggaccgtgatcagcttcgggtccgtctgattgccggaacttttgttgtttgtgggcttggcaccattttgcaaactgcgctcggactgaggtaacgaacgtaaataacttttgattatgcaattaattttctaattattttaatcgcaatgacattttggaaaattatatttttaattttaatttaaatataaaaaatatgaataacaaaattattaaagataaagaaaggggacgccatatccctttaatttattctatttaattttaaaattaaaattaaatgtttgttgttgttttcaggttagcgctgctccaaggggttgcattcgcctacattccatcagtgctttttttgaatgtttcgaatttaatcaaattaaaaaaattatttggtattgttaataaataaatacaaattctttttacaataaatattaaataatattttcattttcaggtgagggcgtatatgaatttggaagggaacagatgcaacgcgacaattcacgattttgtgccggccgaagtgtacgaaaataaattggcaattgttcgttttgaaaaataacttttttaataacatttatttaatttttatttaaatttttgaagattcaaggcactttggtggtggtttctgttctcaaagtgctcgttggggccaccggatttatcgggaaaatgaccaaagtaatgtgttcacagagaatgtaaaattggtgcaaggaaaaaccattagcatattacagtacattggcccgatgaccgtatcttcgcttctcatccttttgatggttgagtcggtgacaattactgtgaagcgaatggaacagcattggatctcattaatgtataatatagcaattaattatttttattcaccaaatcattcccctatcattcagaatggcggtcgcacttttcgccaccgtcctttaccttccccgtgtcaatgtgccgtgcccggcctatgtcaacggcaaattcagttttgtcggcttcaatgtttttggccaatttccggtaaaattaatatttttttcaatatatttaaattttattgctaatccatagtatctgactgccattctattctcctggttcctctgctggctgatgaccgtttttgagttaatcccaaaggatagtgtggcacggacggacaaaaacggcacaatgatggccattcaaaacgcaccttgggccagggtgccccttccaggtccatcgaaaataattataatttgaaaattcaaattcatttccaggacagtttggaatgcccaaattcaatgttggtctgttcatggcattcatcgtttccggcctgaccacaatgtttgaagcggttggaaattatcacgcggttgcgcgggtatctgaggcaagtttaattaataaattttgagtttttcaattatattttattttatcttttttaaggagcgtcccccgccttcccatgcaataaatcgcggcattgttgctgaaggattgggctgtttaattgctgcgctaattgggccatgtgttggcatc

SEQ ID NO: 73966 - DNA, 315 bp, Heterodera glycines
  Genomic contig location: Contig_ID=SeqID_10716; Location=689..1003; Strand=+
  SCN-specific regions: Sequence locations=1-70,92-136,165-315
atgactttgccaatgttcgtcggttcgttcgctgcctttgtgcttgacaatacggtgggcggtgccacgcgtcagcagcggggccttcgcgagaggggcgtcgtgtgggaattgtcagccgatggacggggtcggcataaatttaaaaaataaaatttaattttgatacaattttcaacagatgtttacgccttcccgggcccacttcagcgaaccgttgaggccattccgttgctcaaatatatgccatttatgccaaagcagaaaaaggcaaatgccaatttaagaaacggatttggagagaacaaattctga

SEQ ID NO: 73967 - DNA, 753 bp, Heterodera glycines
  Genomic contig location: Contig_ID=SeqID_10719; Location=405..1157; Strand=+
  SCN-specific regions: Sequence locations=1-32,54-499,542-753
atggaagctaattcgggatctttgtcggcttcgttgcaagcagcagaagctgaaattggctccctgaaggaaatgatcaagctacagaatgagaaaatgaaggacatgcggcactgttttgtcaacttccgctcctggctagatcagctggaggcctgggctagtgacgtaagctgttaacaccattttttaaattattacagtatattttagaacaaggaaacgaaatttgtgcgtcccgacacacgcaaacgagcgttattggacgattcaccagaaatgccggcaacatcaaatgctgcttccggtaactttttttgattgatacacatttctgactttatcctcactttaggcggacgtcagcaatgctttcaagaagaattttttgaggttaaactcaaaaaattcatgaaagagaagttgtaggaggcgaaggtctgcgcggaattcgcaattgcagcggctgagcgcaaaatgcgcggtgccggcgactggctcttcaaagcttccacgccgcaaaagaaatggtggagaagaaaatgggatgttcaattttggacaacgactaaatttttttttaaaatctacctcccaaaaattgaacgtcatcctactcctcctgcatgtgatggttttgtagttcaaccaactccatacaccgtggggttggcaccacgtcttcggaagatgaatggcgtcggcagtatgggcatgtgccgggaatcaattctccttcgggagtccaactaa

SEQ ID NO: 73968 - DNA, 882 bp, Heterodera glycines
  Genomic contig location: Contig_ID=SeqID_10720; Location=1017..1898; Strand=-
  SCN-specific regions: Sequence locations=1-744,766-882
atgccaacaagcacatttggggacagaagtggcaccaatttggaattgactctgtgttcaagcgataatgatgatgatgaacatccgatttgggatgttttggcgcgcgaaatttggccaatttttgcaccaagcattcgccatttgggctttttcgatgacgaacaatttgacgctttgtgccgtcgcatttcgcccacaattctcactgatcttgatcaattggtatcaatcaatttcgatcagctgatacttgtgattgctgatgatggacagaatggaacttctcctggccaagtgttgtccgaatggttgcacactccgagaaaagacgggcaaccgaagcgattgttttgcgaagaattggacggcgaaggaaacatagcttggctcaacagtttcaaggaggtgtgtgtttgtgtgtgtggtcacattcacatagaatttttttggaaatttttttctaaaaaacgacaattttcataaaatttcgaaaaaatcgctgaaagtttttaaaaaatttgaatcttactaatataagaatttttatgaaaaaatgggcgctactgtaaaagtggtcccttttgaaaatttttttcacttttttcatatattttttttataaatgatttttctcatgcaattttagcaaatggttaaagtttcaagatattccattaatgattccaacaatctgccgctcatcgcttttccaacattggatgatataaatttgagatggcatttttccaaaaactgaagagattttacaattttaggcacacaacggacttatccaaaacaaattgttgtgccaaaattgttgggactatatggctctgataaaacgaagtcaaaggaaggatggataattgtaataaa

SEQ ID NO: 73969 - DNA, 709 bp, Heterodera glycines
  Genomic contig location: Contig_ID=SeqID_10722; Location=878..1586; Strand=-
  SCN-specific regions: Sequence locations=1-709
atggaagcacaacgagtgatcagtggaatcaaacgcagggcggaacaaaccatggaaccaccagcgacaattcgctctttggcactgcagaatgtggccacgccagtccttgcgcaactcccaaccaaacaggcgacaaaacaagtgataattttttatgtttcctcaaatatttgtattgaattttcgaaaattttagcgctatcaaaatgacccgacattcgcagaaatggcacgatgtgtcacatcgctagcgtttctcccaattggagatttgacccctggaataattgctctggacatggctcttcccgacgaacttactcccgtccttgactggtaaattgacaatctcagaaattgtttactatttattgttctttaattatttattaggttcatcatgaactacacgggtcgtcttaagcatgatggaagccgaacacgcccgcgatttgacccgaacatttggagtgtttacactcgaacactgcaaagcgatgaccggacgaataaccattcagaagccgcgaacagacgcctgcaatgcgcatttgcctgttcacatccatcgatttggcgtttcattgaccttctgcgaaaggatcaaaagttatccgatgatgacttcgcgaagtgttcaactggacaagaaccaccgcaaaaggcaaagaaatatcgcaacgcagaccgccgaattctcacgatg

SEQ ID NO: 73970 - DNA, 967 bp, Heterodera glycines
  Genomic contig location: Contig_ID=SeqID_10723; Location=72..1038; Strand=+
  SCN-specific regions: Sequence locations=1-930,964-967
atgctctggcaacaatctttgatccgccctctgttgatgggcccgtgtgtggcacctcatttcgcgaccagcttaagaatgctgaccacccaagaagcgattgctgccgggatggcacaagcaatcggcacaacaaggcccaccgagacagaaggcactgatggggccggctgcaaaacgttgaggcccacctgtggggctggccaagtggtaagccagctaacaaatgagtggcattcaagagtcgcacaagtctttacatcagtctcggtaccgtctttaaatcaatctcggatcaagaggtctcgagataaaactcagtctcgagctgggacattttcccgcgttcattcaggttaccatacatgtgatcttggcaaacggtgacactgattttggcaactacgatttggtgccatcacgttggattgcaatgcccaagggctcgtgagcattcccttaatcttaggttttctcaattagactgcaaattttcaaaaagttacggccaaaaaatcatgaaattttgggttaggtgaactttataatgaatatccattcccaattttgacttttttaccaccgatgaatagtccacttgccgtcaatggcacttcaacaccgtggctattgctcgttgaattgcctaattaaggaaattaaaactgctcataggtaaacatttaaattctgcgtccttgaaaaaccaggttcaaatttcaactttggcattcgtaaccttttggcttgctatcaattatatttaattaatatgattctggattcttgaaaacttgtgagtgtccttgaaaaaccgtgttcaattttcaactttggcatttgtcaatgtgtacctcttcttcggtacggtacaaatggccgacgccgacgccaacgcctcgccaatagttgactcgcgatgaattatgcaagaaaaattgaggaaaatttaaatttttaatgtaaa

SEQ ID NO: 73971 - DNA, 107 bp, Heterodera glycines
  Genomic contig location: Contig_ID=SeqID_10724; Location=229..335; Strand=-
  SCN-specific regions: Sequence locations=1-107
atgtcaagttggcgaaatgtccgtacaccttcatttagtattgaattgcaaggtcgccctggaaacggagacattgaaattcaaaaaacagtgcaaatgtccccaag

SEQ ID NO: 73972 - DNA, 1625 bp, Heterodera glycines
  Genomic contig location: Contig_ID=SeqID_10726; Location=49..1673; Strand=+
  SCN-specific regions: Sequence locations=1-101,123-273,302-493,515 -1027,1053-1099,1121-1442,1475-1516,1539-1625
tggtatgaattgggaccgtttctcgtcagaattggacgattcgctgctgaacgattcgactacgctgaaggtgaagaaggcattttggagtgcgaagcagttgctcagggaaaagctaggcaaacgcgaggacgaacacattgtggcggctgacgccgagttggacacgcatttgcagacatttcgccaaattcgcgactcgacccaaaaactgcttaatctgatggagacgcaccagcgtgaggtgatcgatcattcattgtttttttgatgaaaaaaaaaaatatatttttttaatttacttattccttgcattttttttcgaccgatagttgttttttagatcatattacccaacagggtaatcatcgtaaaaatacgatgattcatacagtagtacctaaatatcctattgtattgtatattgtcgattttttttaaacagcttaacgagctggcacaattggagttggacattgcggaattgttgaccgaggaacaaaaggacgaaaaggcgcacctgcgaaaagtgcttcaagtggccggcaacgcggaaacgaactcgtcgaaacagaggccagaagacaaaacaggggaaaataagttcaaaatcatactgtattatggttacagaagaaattaatggtcttaaaggattaaaaacgaattcattgccttttcaggcatattttgcttggctatgtgacacaatttggcaatgttctttatgtaataataatggtaaaaaacattgtgaccataaccaccaccactaaatttaggatttcattgagcgcgctgtatctgactgtgaacaaacggtggacgcggtaaaaacatttctcttttcattgtcattggccatcgtttgtctaattgtcattttgtgtttgaggtgggccgggcacggcttgcttaccgtggctcactgttgtggttgaaaaagtgcagcgaaacattggaccctggcgattcgtcacacatggaagtgagaaaagcaatagcaaaatacaaaacaattttaccgaattatttaaatttaaatttaaataggattttcgtaaagtgcaacatgttgtaaagtgtcaaaagcaccgattggatcagctgaaggaggacatggccatgaaagtgggccttaaatatgatcattttcacactcaacttctgatcaaatgcaaaatattctttcatgtgtctgtgttgcaaagtgcgcgaaaccgcatcttggccgacaatttggaggagtacaaaacggcactgctcacctttcacagcgaaaatgcggctgaattttgtgcttcttcagaacaatttgacggattagaaagctatgaaattgatgtgttgaaagtgatttttaaaatgcaaaaagaaacaaaaataataatatttgaattaaacaaaaaacaaaaatttcattagctgattaaaaattttggtttaattttaattaattaaaattattattatagattcttaacgtttcgatcggatcagcaatggaggatcaacgcagatcacacacaacagacggagtgtcaaagccagacaaattgaacacttcgcgcccgtccagtgccagaagaagacaactttccgctggcagtgacaataccgagtga

SEQ ID NO: 73973 - DNA, 2723 bp, Heterodera glycines
  Genomic contig location: Contig_ID=SeqID_10726; Location=1768..4490; Strand=+
  SCN-specific regions: Sequence locations=1-572,609-617,639-899,934 -1085,1107-1180,1206-1340,1368-1375,1397-1413,1435-1625,1648 -1779,1836-1841,1863-1903,1927-2200,2233-2283,2372-2409,2431-2723
atgaaaagagtgcgcgaactgctccgtttcgaggacgatgccatgattggaatggcacaaccggcggaccaagtccgattgaaatgcccagcggctacatcttcggaaagcatcgggttgaacttgctcaagcattcctcatcttctacagcgaatctgcttgatgaccttcaacacggatgggactcaattggctgttcatctgcagcacttaacgatttagagcacaaaaagaaaaatgcagagactaaaagccaattaaattgtaaatggtcaattaattaggcattattgtttttgttcttcagcttgtgacttctttataaatgcgcaaagtgcgaaacactttaaacccgaaaaaagcggtggtgcacttttggaagaaatagaggtagcgagaaacattgctggaaaatgcatcactaatataaatattacggtagtataaagagctgccgaaatttaagcttaaatcgatattaaaagaatatactgtattcccattacggtatatttgtatttcgcgagttctaattggtttacaaatttttcaccagcttaagatacaaattaaccattttttatttcaaaatattatattctgaatatttgacaaatgaatttaggaccttttgttcgaaagctgtccttcaagtccaaatatgcacgaatttgggacgaataacaatgggaatgaacgaaaaagcttgctaaacattgtggacattggcgggggcgctgaaaatatgccgaaattggcaccagctgcaaatgacagcgcaacacacggcaaaaggagaaaaggtgatcggtgatagattattatggtttcggttattaaaatgggcgatgtgcgcgtataattacgaaaaaaacacaaaaaagcttccctcaaaaccaaaaatttaattaatttattgaaaaaaataattaggtaattaagattaatggggcaacgaacgcattgcatcaaatgaaaagaaaaagcgaattatttgatcgacagatgaaattaataaatggtccaattttatggtttattaatcaatgaataaatatatgcaaatatttatcaatcggtcctttctttcattcaaaaattcaggcgaaaatatgcaattgaacattgaagaaaagaatgtcctacaataaccgacgaaatttaattgtttattgttcaggataaacaacaaaaatttagcaaaagcctcatcatttggcgggcaaaaaaaattgtgaacaaatttgaaattactaaattctatccttagttttatttattctatatttagatatttgagagaatttaaagaaatttcttatgaaaaatcctttttatacccataaaaaattttttccaaaagagaccaaaaactaaattttaaaatatttaattcaaagcctaattaggacatttttatggcatttttattgtttttttagggtgggggtcggtttacaagggaacattccgagctgtgactaggaatttagatataaatgaaataccattggataggtgctgggtcgttacttaaaaaccatcataataagaaatcaatattcctttaattaattatatgattacaatttgaaattacatgagttaattacaatttgaaagcaaataattattatttaaattttctgggtaccttaagagctttccttgctttccttttatatgggcaaattcatattctcatagtcatttcgttttataaaaaaaggagtaaaaaatacagattagtattggagtatatttaaacaaattcattcttaatttcaattattatttaaattcaagaaagtatatattatatttttatttaatagggtttgttgaaaattttatagaataagaggaatgaaaattattaaatgaattgccaaatattaaatttacattgcttttatttttattataccatttattaattcatcttttaatgatgtatttccggcactaaatctaatgaattttttaatgacgtattttcggcaattaaatcatgtaattagttgcgcaaatattgattataatggtttttttaagtaacgcccattatgatggtttttaagtaatgaaatagcaccattgggtagaacagggtcgacttctagtgtgaatttttaattttagcggtgcattttgcctgcttcaaaagttatagggcctcaaaaatcgaaattttgtgcatgagggctcattttcaacttttttcacattatatccgtttttctccactttacaatgactgcttacatttattttaggcagagaaataattttaatgcatttttcatatttaaaaatgtattttctaaatttttaatttgctaaaaattaaattaaattaatttatttttacgttggattcgaacccggaccctcaaaattaggaatttaaccaactgagccaccaattttatgtgaaaacacagccaaaatttcaattttcgaggccctgtaacttttgaagcaggcggaatgcaccgctaaaattaaaaattcacaatacaagtcgaccccgctctatccaatggtatatagcttatatgcattttcccactcacagctcggaatgttccccttggttagcctttttcagactttgcattcgttggcctacgcgacgctgtgccgtcgactttgcaagctgttgctcagcgacctgaccagcgcggacaccatggagagagtgctgctggtcaagtgccag

SEQ ID NO: 73974 - DNA, 458 bp, Heterodera glycines
  Genomic contig location: Contig_ID=SeqID_10729; Location=1..458; Strand=+
  SCN-specific regions: Sequence locations=1-256,280-458
  Gene Ontology: Cellular component=mitochondrion; Biological process =aspartate catabolism
gggggggggggaatcccaaaattaaatacttttcgtccaagtctttcaccgccttttaaaatagaactcattcgtgatcatagactcaaaatccagatttatcactctatgcttaacaagtgtccaatcccaatatgttttgaggctgggcgatgtgaagggcatggccgaccgaatcatcacaatgcgctcccaactccgcgatttgttggccaaggctggctccaagcgcaattgggaccacattgtcaaccaaatcggcatgttctgtttcacgggaatcagtccggaacaagtccgacatttctttgtgctattcccaatttccaatgattcaggtcgaccgactcgccaaagaattcagtatttatttgacgagggacggacgaatttcagtggccgggatctcatccaaaaacattgactatttggcaaatgcgctgcacgaagtgacgaaa

SEQ ID NO: 73975 - DNA, 863 bp, Heterodera glycines
  Genomic contig location: Contig_ID=SeqID_10730; Location=3671..4533; Strand=+
  SCN-specific regions: Sequence locations=1-203,225-312,335-788,810-863
atggccgtcggcttggcccttctccttccgatcattttgctggccacaactttgaacccgctttaccagcacatccatccctacctcaaatagtcagtttcaacagtttaatattaaattcgaaagataaaccaaaatttaaaatcggaatttcggcttctttttgttgtcggcttatttcatccacgccaaacgctaattgttttcaaatggatttaaatttaaatgttcattcagtccgctgctgcacaccggcaactcgtcgcccagtcacgacgcgttcgccaccgacatttacgcgatggtcggctcgcagcagcagcaacagtaccatttgctgccaacgcagcagctcaaacacaacgggaacaagcagtacacgacacaacaacaacagcagcaacagttcacctcgccgtacgccacctccaactacggttaccacgagctgacccatccaccggcctacagtatgagcatggtcggcggcggaggcacggggcaacgacgatagacaatggagatgaaccaacaaagaatggaagccagaatgaacaaccatgatcacacagttattttcatgtagatatgaggagttggagcctatctcttgccggaaaattgcaaattcattgtctggagcaaacaattttccagagtgaggaactttgaaaaagcacgggttaggtccgggtttccgagatgaaccggaacagaattccggattgaagtactgttttaacatgatctcctctagtccaaagcgtcttttaaaacatacataactctgagccaggaccctaaaacactaaatctttcggttattttctgacagatattttccgattggagccgaaaaccca

SEQ ID NO: 73976 - DNA, 1785 bp, Heterodera glycines
  Genomic contig location: Contig_ID=SeqID_10730; Location=1218..3002; Strand=+
  SCN-specific regions: Sequence locations=1-55,77-139,163-832,855 -1371,1393-1473,1501-1785
atgcttcaccgagaacacttccgacaagctgttcacatcgggtaagctaaagaactttaaatttaaaaattaataagccttaatttcctataatttagttggatcggcgctctcgtggttggtttttagtttaatatttcttttaaaaattctaccattgttttgatttgccaggtgtccggactgttcgcctttttggcattggcactttttctcggcctttgctacggctgttgcggtcggcagcccaacgaatacgaagatgactgctgcgtccgatccaccggcgcttcctttttttcatggtccgttcactgatcagtaaattgatcaaaattctgagcgatcaattatttacatcgaaaagaacttaattagtccaacccaacaaagcgaatgatcaaaaaaaggaaggcactgatcgatgatcattgatcactctgtcaaaatgcattagaaacttgatgatcagataattatttgttctttctcagctccatttggctttcgttggctttcatcagtgtgtttggactgctcgctgcgcttgccatgcttttcggtgccaatgtctcccatttggtgtgccgtcctttggaggagccgctgcaacggccggactttctttcggtgtgcaatttgcgagttttaaattagttgtgttattaccatacaatcccagctgctcgatcggtttgtccatctgtacggtttggaccgtccttcgtccgtctctccccacaagtcctccccgtccgctgctgatcacttctcgcttgatcagcttttctcggctaaccgtcgccctgctgacctgatcagcgagtgtgcccagaagcacactttgtacacaatgctcgggttggacaagaagttcaagctgatcggacgtgaaggtcttcaggacgactaccaatacttggttaatcgggtgaacaaattgaaagcgtcgatcattcctttttcatgccattttttttgggggggggggaatgaatcgatggcatttccctaatttttgttttttccatcctctacaattgttgattctctgttcagcaacgttccatcatggacaacctttcctctcatcagctgatcgatgaggcactctctcgcggcattgtgccggacgacccgcggctgagcgctcgccaatggcactttttcagtggaccgatgcgcgacgcattgcaacgccttgggcaagtgcggatgccggaatggaacagcagcgacgtggagcaggtaactaattgatcagcagagatttgtttagtttgtatggtgatcattagcagggaattcttccattttgggaccgatcgattacttaaaggctggacgaaattaaattccgtaattatggagttttttcaattattgaaacccgtattaatttggaggatgccaaatcaccgctagtcgcaatttttgcagataaatcaaaaaatgtttcaattgttatttactttttggatttttcaaattttgctttatcgctttctgtgactgtcttttcagttttgtgcccaacccaaacgcttcgctttggagggcgtcgtcgccggccttcgccaattgtcccaacaggcgcaagccgaggccaataatagcggcgtcgacggcgaaaaacccgcgggaactgtcgcgtccaatttctccgagttggacgcggtcatccattttttggaggagttgcggcccgacacggcaagtgaacggaacagtgatttaatggcatttacccgtgacgagagtgatcagactgtgttacggtgctga

SEQ ID NO: 73977 - DNA, 3476 bp, Heterodera glycines
  Genomic contig location: Contig_ID=SeqID_1496; Location=242..3717; Strand=-
  SCN-specific regions: Sequence locations=1-146,194-395,440-849,871 -938,972-1372,1524-1554,1578-1663,1687-1763,1799-1843,1865-1946,1978 -1992,2014-2149,2171-2221,2243-2349,2385-2395,2417-2505,2528 -2743,2772-2825,2849-2990,...
  SCN-specific regions: Sequence locations=...3012-3206,3239-3279,3301 -3386,3431-3476
atggttgcagcgattgatccggtgaattttaattttgaattgacaaatagggttaaatttttaagcacgaaattcgcaaatactatcgaaattggaagaaaaatttcaaagaaataagcaacaaaaaccttcagcggaaataagactaaaaaatgaaaaaaaattaatttatgaaattaaataaacaattttagttttacgagcagtacgccaacaaaggcttgattgccagcgaaatattgataaacggaatcatttcggtgatttgtctgacgggcatttgcttaaacttttgtctcgtctacgtaacaattaaaacgaagtgaattgttttaaataatccgtaacagaggagcagaaatgcgcactcgaaaaatcatggccccgaattgcgcattaaaaaacaatttttaaaaataaaatgaattttagaaattttcttctttcaagaatatttcatttgaaactagggttaagccccgagccctcggggggcaaaatatcgggggccggggacctcgggggcgacatgtcgggggtcgggtcgggggggggggggggctcaattttcgggggtcggggaccccgatcgggtagtgatcaacaaaatttttttaacgaaaaactaaatttttatttttaaatgctcgtaaatcttcctttttttagctttaatcatctgatttcgttagcgccagcaagagtgcgttatttataagaatgttctgagtttggggtagcgacgagtcgggggtcgggtcggggaataggtcccaaaaaggtctcgggtgggggggggggctcggggttggggcttaaccctatttgaaacaatcgcgtcgataaattttcattttttaaaatctgctaaaaacccaaaggttgcgaactgcgcaaaaaaatgttgcagatcacgttcgtgctctacccctggactgaaataattcattttttatttaattattttaaaaccaatttcgcatagatcgctccattctccgtgtaaaactctgatcgctttgttcgccttttgctcttcctttctcctttttggaacttccatcaaattcttcgtttttctgtttggcatcaattacattttgcttaagcattgcttcttcattcaattactgcctctaattggctcatcaattgctgtcagtttgcaacttggcattggaattgatcgtctgtttggcgttatgttcccactatggtaataattaggggctaatatttataggtgctaaaaactagagtagagcgggaccgggaattttgggcaaaaccgggaccgggacttgccgggacctgagaagtcgggaccgggacctcgatttttgttcgggaccgggaaccgggaccaaccgggaatttttaaaaattaaaaaaaattcaaaaaatttaaaaaaaattcaaattttaatttatttcaagtgaaaatattaaataattaaatttttatttaggtttttattttataaaatccaaaagttaaagctatttaaattaataaaaattttcaaactaattttcttgtactttaaatgatcgaatattaatagaaattcagatttacatacttttcggatcacttttttcggcgcgctttttccagaaaacttttggggaagaagggggtccggcggtgccgataggcgccgctggggaaaattttgaaaatttgagtgtgatttgttaacaaatttcaacaaaaaaaggctggtttttgagattactaggctcaatttgtatggattttctttaaaaaatgataaaatacaatttaaaaaattaagaatcatattttgtcgataggaaagccatgagtataaaaaaagaaaattcaaaatactttaatttctgtagagggattgaaccaggggaaagaagcacggaaagtgaaggagactagccactaggtcatttgcacagttactttatcgaatatatttaataattatttctaaattttttccttttactccaattttctcactaatttttgcactcagacccccattcttaccagtgcttgtttttcaataggtaggttttaggtcctaaaaaaccccaaaataggtgctaaaaatgagaaaataggtgccaaaaagttccaaatttaggggtgtaaaattgaaaattttcatcaaaaagcaaaaatattttgccaagtcattaagaatatacataattttcaaaatcaaaaattatcgtcaagaaaataaaataaataaattttggaggtgaatttttgagaaattttcgggtcaattcataggggtgttgtatttttcttttttattgcatttttgttaacaaattttgggcaaaacgccaaaataggtgaaaataagtttttaaaaattttttttagttttttaggcgctaaaaataaaaacctagaaaataggcactaataactcgaaaagtagcttaacaacccctaaaaaacatgtttttcgtgcatttcagaccctagggagctcatgaaaaaaataggtaaaaacctaaaaatattatccctagtaataattggagaaatagaacggttgtgtatggatttccatttttttgtatgtttttgctaagtggcacggcatttttagtcgtatttaggcacttacaaaattcaaataaaacacactaaaatcgaaagatacatcttaaataatgatttttatgagtttttagaaggatttcaggcatttatccaaaagtaattggtttttgtcttccaaaatttactttaaaaatattttttcaattttcccacctttttaactaaaattaacgtaattagatatctattaataaatcattccatttttaattaatttattttttacttttaggtataaatcacgtggaaaatacacatccttcaaagggatcatcgcattttgttgtattaaattggcatttttctgttttgtcacttacagtggaagcgcagcccattgggaaaagtggacacaaaatgggcaattaaatttgaatttaaattttgttttcggatcatttagaccggtgatgtgccatctcggtgacccagcccatcagcccgaaactgcttattacactgacatcaatgccttaatttcatattgtgccgaatttgtgtgctatgcgctgatttggctgatcatttggagaagaacagcacaaagtcattccgtttaattaggattagagaaacgattatattaaatttggaattttttaaatttgatttccatttatagaaccctattttgaattagcgaattaattaatctatgaaaaataattaatgcatttttagttacggaacatgtaaaaaagttgacaatttctgtgagtgttctcatgtcaattgggctcttatgctacattttggtcaacacataatattttaaattaaaattaattaaaataatattaattaaaactcctagccctggctggacctaatttttttcctaaaatccaataaa

SEQ ID NO: 73978 - DNA, 546 bp, Heterodera glycines
  misc_feature (399)..(399): n is a, c, g, or t
  misc_feature (441)..(441): n is a, c, g, or t
  Genomic contig location: Contig_ID=SeqID_1496; Location=4733..5278; Strand=-
  SCN-specific regions: Sequence locations=1-23,46-88,110-143,166 -208,230-263,288-546
atggcacacccaaagatgacacttccaaaaatggcaaatccaaaagtggcacctctaagaatgacacacccaaagatgacacttccaaaaagggcaaacccaaaagcggcacctccaagaatggcacacccaaagatgacacttccaaaaatggcaaatccaaaagcggcacctccaagaatggcacacccaaagatgacacttccaaaaagggcaaacccaaaagcggcacctccaagaatggcacacccaaagatgacacttccaaaaatggcaaatccaaaattatcagtgattcttcgtcagcagatttatcagatcaaccaaccgctggtcatattcacaaaagtccctcaaaatccatttcaattggagcatcgaaaagcttcaaccgctcanaaagtcccacggcggcaaacaaggccaaagtcaatggagcanatcgaaacaaacccggcaaaattaacagcagccaatccatttacaaaaacactcgctttttgcatttttgagcacttttattgttcaaaaaagcaattagtgaaa

SEQ ID NO: 73979 - DNA, 2397 bp, Heterodera glycines
  Genomic contig location: Contig_ID=SeqID_1498; Location=251..2647; Strand=+
  SCN-specific regions: Sequence locations=1-296,318-473,496-948,970 -2397
atgaccacgcatgccgtcaattctatttcgctgctaaaaacagcggttctgttcaacaagaagccagttgaattccatctcgacacggggtcggacattgtcgtcattgatcaattgacgcacgaatatgttggacgaccaccgatcgaaaaatgtaacgaaatcggaaaggctttcgacggcacaaaaatttcctttattggaaaaggattcggtacattcaaatttggcaaaattgaagtcgagcaaacattttatgttgcaaaagcaggctcactaaatttgctgagctgcaaaatgatggatttatttgggctgttagatgaattaaagctgaaaatcagcaatcctgcagtaaatgcatgccacgcgaatggcaaaaaggctgaaaatttaatcccgaatgaagcaacgcagattgctgggacagaagtcaaaattcaaggcctggaaaaggcatttcacgaaattttcagtgaggaattgggccattgcctaaaggagaaggctcatcttgccctaaaagatgacgcaaggccagtctatcgcaaagcccgaccagtaccctacaattcgttagaggtggttgagagcgaactgagccggttggaaaagatgaacgtcatcaaaaaagtcgaacatttggagtgggccgcacctattttgattgttaaaaaggctgacggatccgcccgactttgcattgattactctacgggcctaaacgatgctcttctcgactgtcaatacccacttccaataccggaagacatttttgcgacgctaaatggaggcaaaattttctcacaaattgatttgcgagacgcctatttccaagtcgaattggacgaaaattctaaaaatttgtgtgggctggcaacccacaagggcaattaccggatggaaagattaccgttcggtgtaaaatcagcccccgccatatttcaatcaattatggataaaatgttggcaggattggaatttgccatcgcctatttggacgacattataatcgtcagcaaaagcattccggaacacaccaatcacttaaaagaagtttttggtagaattcaggcatacggattccgcgtcaaattggcaaaatgcaaatttttccgggatcaaatcaaatatctcggacagattatcgataaaaacggacgccgaccggatccagcaaaaatttatgcaattagtcaaatgcctgcaccaaacgacattccatctctgcgatcatttcttggtatggtaaaccattaccaacaatacgtcaaaaacatgcggttcattcgaaaaccgctcgacgatttgcttaaaaaggaaattgattggagttggagtgaaggatgcgaaaatgcattccgaaaaattaaggaaattttggcatccgatttgctgctaacgcattatgatccaaaaatggacatcattgttgcagcggacgcttccgaattgggcatcggagcagtcatttatcacaaatttccggacggaaacatcaaagcaattgcccatgcttcaaaatcactcgcccctgcggaaaaaaattattcgcagattgaaaaagagggcttggcgttggtttttgccgtacaaaaattccataaaatgatttatggacggcatttcacattgcagactgaccataagccccttgtcagcatttttggcagcaaaaagggaattaggcagtgcagtgccaatcgtcttcttcgctggtcattaatccttttggcctacgattttaccatcgaatacataaacaccaaggattttggccaggcagatgcgctctcgcgcctcatcgccaaaggaaatgagcccgaagacgagaaaatcatcgccatgatcaatgcggaaacagattttgagacgaatttcgacaacacaatttcaaaattgccattaaaattttcggacctaatcgctgcttctgagcgcgatgaaaacatttttcaagtccaaaaatttgtcaaaaatggctggccaaatgaaaaggccatggacaaagaaaatcaaattgtccgcgatttatgtcgaagaaaggaagaactttcaaccgaaaagggatgccttatgtatggagaaagagtggtaatcccgaaagtcttccactccaaaattctgaaattgctgcacaaaggacatcccggcatgaaaaggatgaagcagctggcacgtcaatatgtgttctggccaaaaatcgatcaggacattgaagattttgtccgtgaatgtgtgccatgtcaggctgctgcaaaagcgccaattaagacaaatttacagtcatggccaaaaacaacaggcccttggcaacgcgtacatatggattttgccggaccgtttttcggaaaatattttctgattgtggtcgactctttttcgaaataccccgag

SEQ ID NO: 73980 - DNA, 946 bp, Heterodera glycines
  Genomic contig location: Contig_ID=SeqID_10731; Location=255..1200; Strand=-
  SCN-specific regions: Sequence locations=1-214,236-249,300-355,377 -424,446-539,619-911
atgtccaaactttgcatgacaattcttttgcttaccatcggatacaattcattttcgctgtctgctgagcatttttcatacttttctgaatgcggcatttccgattttgaacccgaatttcccagtgctccaaaaatggaaatcgacacaatcctgtgaaaaatgtaaataaattaaataattaacaaaaagaattacggatgacaaatcattgcagtggatggcacaacttttattcagtggaggaggtttatttattttttactttaaataaacaatttttaaaaatatcttaaaaagtaggaggatcaaataatatcatgtaaaagagagcaaattaaggaaaaaaagaccattcaatcaataaccataatttttctcagaattcaagaaaaaaaattcctgaaaatatagaaattccaagaaaatttttatttaatattttgttggttcttgcactgcgacaatcattgggccccggcatgtgttgacagcgttgcattgtgttgatgaagaaaattttggtatgtatgggtgagaattaattataaatatataaaaattaacaaatataaaaaatttcatttttcttaataaaattttattaaaaatttaattcatagatcacaattgattattgttaaaatttgtgcaaatttttaatattagaaataacaaaaaagataaattttttgcccaaaaatttgtgctaaaatttgatgccgctctgttttaaaagttaataatttacagaaaaactctttgtgtcatatgggagcgctaatgcttcaaatcagcaacataaatccggcgttgaagcaattaaatatcatccaaaatcacaacattttcgaatttagatgcatttcaaaaggttgaagaagcacatctgcttttgaatgacattgtcgtaattaaagtaatttattattgataaaaaaataaa

SEQ ID NO: 73981 - DNA, 871 bp, Heterodera glycines
  Genomic contig location: Contig_ID=SeqID_10731; Location=1792..2662; Strand=+
  SCN-specific regions: Sequence locations=1-503,542-871
atgggtaaggattcgagactcaattcgagcacaactttaatggtcatcaaaactcaacaaatttatggtcaaattgaactagtaaatcaatataattttcttaaatattttaagtgaaattttgcaaaaattttcatttttgttttccaatgttttctttatcttgggatttttataatttaaattgccgaaaagaaaaactcgccatttttttcgcttgttgggcatatactcagcaattgtgcctgaaaaatccatctccaaaaccgcgtgattggtcaatggtcaaccctcattattctgcccaaaaaatttaaatttactcaaaaatttatgagtcctttttgaattcctgtgctcaaattaacttattttgtttagaattaattatatggttttattttttctgctttctttttttagattcaacaaattcaatcggccaaactgagcctccgaatcaaattttatgcccaataaaaaaaagaataattgaacagggcaaaaaaggatatttttgttggttgaccatagaatttccaatcaatttttttcgaatttgaatcgctaatgagtttttgctgatttgtttaattgctggcgaagttccatctaaaattggtcccaacataccaaatgattttttttttcattaaaaataacgtatactcattttcttttttgaacccttattggtgaacacttctcatcttttttaaaattatttcagacgtttcacgctcatatgccgcaaaaatttcatttaaaggtttcatttgattatttggtctttttaatttgttgtgtttgttatatcttttttgtttatgctttcatttccttaaattgtgtaaatcaattaatcttttaa

SEQ ID NO: 73982 - DNA, 1262 bp, Heterodera glycines
  Genomic contig location: Contig_ID=SeqID_10732; Location=188..1449; Strand=-
  SCN-specific regions: Sequence locations=1-112,160-207,237-270,293 -332,365-480,502-682,730-743,796-1117,1156-1262
atgattgcatttttcttcctcaacttttctcaatttgcgaataatggtccaacagctgctgatgatgaggtgcacttcaacaattttttgtatgcctcgcgataattttggctaaaaaatcaaatttaattaaaaaaagaataaaactataaaataaatgtgagcataataaatcgtcaataaattgatcaatatattcaaaaatggaaatatattattttaatatttatttaaatcaattcatacattaaaaatttgcaaatttttttctttctttcttctgtttgctcttcacttgggcttattttacgattagaacacgtagaaattggaaaatattaaaaataaattatttttattttaagcaaaaactttttcggttcttttctttcagttacagaaatggcctgctccgttttgcgttacagtatattaattgtgcttttatgctttgtatacggtaataatgaagaaaacagtcaaaaaacaatacaaaaagaagctggcacagaacataaaaatgataagcacataattgatgatgattatcttgatgacgaattttgggacaaactttcgccgatcattaatttgcccaaaattgatggagtcgaatttgttggaaaccattttaaacataccgaacaaaagaaacacgattatactcatgaaggcaagattcaaatatatttatttataacataattaagaatttacaatttttaatttgtcgaaaaccgatgaattattaaaaattacttttaaaaataacatattttatttaaaagattaattgatttacacaatttaaggaaatgaaagcataaacaaaaaagatgataacaaacacaacaaattaaaaagaccaaataatcaaatgaaacctttaaatgaaattttagcggcatatgagcgtgaaacgtctgaaataattttaaaaaagatgagaagtgttcgttcaccaataagggttcaaaaaagaaaatgagtatacgttatttttaatgaaaaaaattaatcatttggtatgttgggaccaattttagatggaacttcgccagcaattaaacaaatcagcaaaaactcattagcgattcaaattcgaaaaaaattgattggaaattctatggtcaaccaacaaaaatatccttttttgccctgttcaattattcttttttttattgggcataaaatttgactcggaggctcagtttggccgattgaatttgttgaatctaaaaaaagaaagcagaaaaaataaa

SEQ ID NO: 73983 - DNA, 1041 bp, Heterodera glycines
  Genomic contig location: Contig_ID=SeqID_10735; Location=1566..2606; Strand=-
  SCN-specific regions: Sequence locations=1-5,32-89,112-115,137 -284,308-481,503-546,568-922,955-1041
atgtactacaacaacaacagcaacaacagtcagcatcacgacgacgatgcttttggaggtgatgcacaacagttcatggacggtcaacaaatgtcttcccagcagcagcaggtagttttttgtgctggttgcatttgatcctcggtttaaaaaaaatgttcaatttgaggtcgccaccgagccgcaccaattccgtcagcaacacaacaaccgtagcagtggtggcgagcagttcaattcgccggtgagcagccaggagcgtcttcatcaaatggtgttgttctcctccgccgcaaccgctgctgccggtggtgcagcagcatcatcatccgcaaccaacggcggcagcaacagcggcactatgaacggtggtggccgcggttgtgttgcttcgtctcaaaatggcagcagcactaccaacaacaacaacaacagcaccaccagccgcggtgccagacgaatgccgtcgtcggcattggtgtgtttgtttgttttgagtctgaagaatttgttgtgccccgtattttgaaggcgggctggccaaatttaacttttctttttaattttgcctatttcatcacttttcgaatctttaaccaatgaaaatacatgatttaatttcaaatttcacacaggcaactgcttccacttcgtcgctgcgcggaatctccgacgcggagttggtcgggcgactgcaaaccgcgcgtgaacgcctgcaggacgcgctggacatgatcgactcgttgcagcgtgaactgtccgttcggcaacagttacagttgcgcggtggtggaagaaatgtgtgttatgatgatgaatgattactgtataatgaaaattgatcaccattttcctcatgatattttattatcattatgcttatttggactgattcactttgcttttgtcgctgctttctctatttaaaatccaaatacccatttaattctttttccgctcattatttctttgtgtttgtcctctgcccctttacaatcaccattttttaccacctattttaatggtcttcgataaaataaa

SEQ ID NO: 73984 - DNA, 911 bp, Heterodera glycines
  Genomic contig location: Contig_ID=SeqID_10736; Location=4..914; Strand=-
  SCN-specific regions: Sequence locations=1-137,175-318,341-350,385 -399,428-911
atgcgcaatttttgccaaaatttgaccggttataacttatatttttgaaaaaaatttttgaactttttgttcgaattcgggtccggggtcggatttgggcacatccgagttcagattcataatcatcaccctcgaaaacacccagaaactgcatttgcgtccaaaataaaaaagttaaattagggacctcaattcttaaccattgcccaaaaattcattcacaaaattcaaattatagttggtatcattcggtacgactcaattaaatggtcacaaaaagggaatcaacaaaaaaaatttaagtgcgactattccgctgatgaggaggaggagggcattgatgttaatgacgacgaacaccaccaccaccagcagcagcaacaagtgatgttcaacgacggtgatgaggagggggaggagcaagggcgaccggttgatcaccacccacaaaatgtgcatgatgaacatggcagacagcacgtggtggttagcagcggaggctgtgccaagaggagcggcggtgacgcgtccgcgctggcattggcaccaccgccaccactaccaatgtaccgcgaggagtgggaggagacggattccgcggaagcgactgcgctgcgccttcacaagcgtggccgagtgcgcaacatgacatccgcggatgaggcaagcaagacgcaaccaattgcgcacaatggggggagaaatgggtgtccccaccctattttttaagaaatgaatttttttaattctaaatttcttattgttagaagtttttttcttaagaaatataaaatatttttttctagattttctaaagagttataccaatattattgaaaaatttggttgccaaagagcttttaaaaattcggtatttgaaaaatttttaaaaatttttggacaaaaataaa

SEQ ID NO: 73985 - DNA, 777 bp, Heterodera glycines
  Genomic contig location: Contig_ID=SeqID_10740; Location=133..909; Strand=+
  SCN-specific regions: Sequence locations=1-37,65-169,191-744,766-777
atgcataaaaaacataatatcatccggtagttttaagtttaaaaaaatatttttatttatttttgcctttttcgcctcctccctcaaacggacggattctttcaaatcggcggccaaaaattgacttttgatcacttcaacagggacagagacgacatcgaaattgtcgttgtgtgatttttgttgttgtggagtgagtgtgattattgccattttgaagagccaacgacggcacaacagaaatggttggaatatttaaaaatttgaggattacttgatctgtcggttcttgacgggttttgtatttaatatgcaattataaatattaatagttgggcagctgagaatttactcgagagtagagaccgaggaattgatcacgagactcgaggtcgagaatttgttccaatgctcaaaacactgagaattggtctcgagacggaggaatgatccgatgaaaccgatattgattacaatgctcgaaactgagaatcggtcccgaggctcgagaccgagggatttgatctcgagattcgagatagacattggatcccaaagctcgaaacagatatttgatctcgagatttggtcccaatgctcaaaagactgatacccaaaagcctagcaattttcagactcgagagcctctcgagagtctaacgagatcacctattgtcctgaaatttctgttttaatgcgaaaaattttgcttttctgaaagtgtcagattcgtaatccgtgaccaaaaaaccccccggcaacaaattttcattatta

SEQ ID NO: 73986 - DNA, 236 bp, Heterodera glycines
  Genomic contig location: Contig_ID=SeqID_10741; Location=431..666; Strand=-
  SCN-specific regions: Sequence locations=1-236
  Gene Ontology: Mol. function=malic enzyme activity; Cellular component=cytosol
aagaagggatggagcgaaaggaccttctcgcggccaatgtccgaattttcaaatcgcagggcgaagctttggccaaattttccaagccaacagtcagagtgtgtatttggtggctaccgatgatttttcatcctaaaaataaacgtttaggtgctcgtggtgggaaatccggccaacacaaacgcattaatttgcgccaaatacgcggccagcaaaattccggctaagaattttag

SEQ ID NO: 73987 - DNA, 377 bp, Heterodera glycines
  Genomic contig location: Contig_ID=SeqID_10743; Location=261..637; Strand=+
  SCN-specific regions: Sequence locations=1-377
  Gene Ontology: Mol. function=NADH dehydrogenase (ubiquinone) activity; Cellular component=mitochondrion; Biological process =mitochondrial electron transport, NADH to ubiquinone
gatagcatggaatcgttgatccaccacttcaaattcttcacggagggcttccaagtgcccccgggggcggtgtatgtgccaaccgaggcaccaaagggcgaattcggcgtttatttggtggccgatgggaccagcaaaccgtaccgatgttacatccgagcaccaggcgaggcatcacatgagtgtcaattaaattcaaaattgttcaggatttgcacacctttccaaaatccacgacatcagctacatgcatttgatcccgggtaatcgcaacttcccccccccccccattaattttacatgtttaatctttattttctgcagatattgtggccattatcggcactttggatttggtgttcggagaagtggaccga

SEQ ID NO: 73988 - DNA, 450 bp, Heterodera glycines
  Genomic contig location: Contig_ID=SeqID_10743; Location=1072..1521; Strand=-
  SCN-specific regions: Sequence locations=1-126,148-363,385-397,419-450
  Gene Ontology: Mol. function=GDP-mannose 46-dehydratase activity; Biological process=carbohydrate metabolism
atgtggatgattttgcaacaggattcgcctgacgattttgtgattgccaccggaaggaattacacagtccgacattttgtcgaattggcctttaaagagatcggcgaaacgattatgtacagcattaaataattcactaaaacatcggacatttccccgagattgcctttttcagttgggagggcgaaggcgtcgacgaagtcggccgcgagaaagagaagggcactttgcgcgtccgcgtcaacccgaagttttaccgcccgacggaagtcgaacttttaattggggacccgagcaaagcgaagaaacaattgggctgggaaccgaaagtcgagattgaggtggaaaatacaacgactttacttttaaaaaatatttaaataacaggaattggtaaaggaaatggtggccagcgacatcgaactgatgaagaagaatccgatggcatag

SEQ ID NO: 73989 - DNA, 342 bp, Heterodera glycines
  Genomic contig location: Contig_ID=SeqID_10744; Location=609..950; Strand=+
  SCN-specific regions: Sequence locations=1-33,55-71,102-308,330-342
atgggcttggccatgggaacggtcgcagaacaaataccttttgttcagattttaacgcaagttttattcggttaatattttttaatttattttaaatttttcgaaagtaaaaaatcgataattttttttgcttatttataacctaaatttgccaaattttagcaaaatttttttaattgatattcttgaaatgccaccatagtcattagagatgaatttgtaaattcgttttttcacaaaaatatcacaaatttcagtaattttaccgttcaatgaaccaaaatttgacaaattcaatgcttaaagaatatgaataatatttaaatttgcttatttattgaa

SEQ ID NO: 73990 - DNA, 889 bp, Heterodera glycines
  Genomic contig location: Contig_ID=SeqID_10745; Location=531..1419; Strand=+
  SCN-specific regions: Sequence locations=1-5,29-70,99-119,179-802,826- 889
atgtgcccctggggctgggcctcttcaccgccgacaaacagatgcacatttccatgggtgacctgtgggaaaatgggaaaaattcaattcaatttattgtattctttttactttcaaagatttattaaaaaattaatttaaaattacaataaataaattgaaaattaaaatattttttgaggagaaaattaagcaagtgtttgttacctttatatgaatgtttttgtttcactttcttttattgaaaattttcattatcctcaatgttcaataggtttattttattattttagcaaaataattatttcattacattttgagctaaaatattgttgcctttaaatgaatgttttaatttgtttagtcaaaaaatgttattctctaattgtaagaaatatccgataattaaataaaatgtagtttaacttggtgctaggtcgatccaaaaaaaactcagtgattgattggtcattttccggaagcctatcgcaccactttcggggcaccaaaagtgcctgatccggaacccggaccggcccgattaagaacaatttttgttcagtttttcaagtgttatctcccaggccgggtccggttcttgacccgttcgcttggaggccgtcaggggtcggacacctctgccggagggccctcagccttgccccgacccctgtcgatggccaacccaagctaagcgtccggtaccagcggcttttttgtgcagctcgattagctctacaaaacggtatcaatggcgtccggctgtgtctactacaaatggagaaaattggcgagaagtatgtaaaaaattgaaaaattagaaaatgacttgcgtcgcgccgttcattaaggttaagcggacggcaccgtgattttgtgaatcgaataa

SEQ ID NO: 73991 - DNA, 3039 bp, Heterodera glycines
  Genomic contig location: Contig_ID=SeqID_10745; Location=192..3230; Strand=-
  SCN-specific regions: Sequence locations=1-343,426-433,456-513,535 -552,588-637,664-680,704-944,1040-1082,1112-1116,1139-1172,1208 -1416,1438-1472,1494-1663,1704-1787,1817-1875,1899-2522,2582 -2602,2631-2672,2696-3039
  Gene Ontology: Mol. function=structural molecule activity; Cellular component=integral to membrane
tgttaaatttaattcaaattaattaagcattattaaaactttattaaaagtaattaacactaatgaactaattgatagcgggcatactcgccgctgagcttgcgccaatcgccgcaacaccgtaccaatgcatggacttgggctgtctctgcaaatacttaaatggtacagtaattaaggggccaattagttaaattaatgggattaattgataattgacaggaaatggccaggaaggctcaaacagttgccaactggcggacaaccaaccattgaagaagtcggtgcggaaagagtaccgaatgctcagcgacgaagaacgaatcaaatttgtacattttactaattaaaattttatatgaaatttaattaaaaaattaataattaaacaatttttgtaaatcaattaaaattaatcatttttagcatgccgcaatgaatgccatcaaaaagagtggtgaatatgacaaaattgcgggactccatgccgcgtttggtcaatccggcgcggcccacgcggggcccgcctttttgccgtggcatcgcgaatttatgaaaaggcaatttttaaaaataaagacgaggcctcgttttacataaatagctcaattttatggattataatcaaaatttcagaaaatttttctgaaaatttccttttaaagtgcctgccctaatttggacacatttttattaatttttgcaaaaatttatggtcatttttgtttacattaatgtattccattcgacttattcttagacataaattgaagaagaagaaaaaaaactaaaaatttcgtttgttgcaaaaaaaattactgaaaattttaggatggaaattgctctccgtcaagtggacccatcggtgtcgctgccctattgggactcgagtttggaggcacagttgccaacaccgggcgattcgtacatgttcacgaaagatgtaaaataataattatatttaacaaaagcatattttaattttatttgattatttcaatgattttaaactaaataattatataaatatttttaaattgcttaaactttccaaaatgttatggacaaacgtaaattagtcctaaattttttgaattttttttaatttatagagaaattttccattggtatgataagaatcgttaaattttttacgaaactaatctaaaatcttttttattttattatatttttaacataaaattaagttcatgggcgacacggacgaagagggcaatttggtgactggcccatttgcggggtggcgaaccctcactgtaaaaatacaaataattgaatatttaattataaaccaattaaggggacaccaaatgtgatcagacacgtgggtcaaggaggcaaaggcttcaccgaaaacgagtcagtgctaatgaaattaaatgcgattaattatcgctaatttcagtgaaaattaattaaaggcaaattaattttcgctaatgagtcagtgcaatatgtaaattaatttttgctaacgagtcaggccaattaattaaatgcaaatcctaatgaataagtgccaatcaataaatgtaaattaattatcgctaattaaattgaatttggcttttaaggatccaatggtttctgaatcagcaacaaattgacaaagtgctcggatacagctcacctcaacctggggtttttatttatataatttttttaaacttttaatatttttagttgtgccaaatggaacttgactaccaattaatggaggcaagttaaatcgtgctgagtcgatccaaaaaaaaactcagtgagtgataaaattaaataaataaatttaattattcgattcacaaaatcacggtgccgtccgcttaaccttaatgaacggcgcgacgcaagtcattttctaatttttcaattttttacatacttctcgccaattttctccatttgtagtagacacagccggacgccattgataccgttttgtagagctaatcgagctgcacaaaaaagccgctggtaccggacgcttagcttgggttggccatcgacaggggtcggggcaaggctgagggccctccggcagaggtgtccgacccctgacggcctccaagcgaacgggtcaagaaccggacccggcctgggagataacacttgaaaaactgaacaaaaattgttcttaatcgggccggtccgggttccggatcaggcacttttggtgccccgaaagtggtgcgataggcttccggaaaatgaccaatcaatcactgagttttttttggatcgacctagcaccaagttaaactacattttatttaattatcggatatttcttacaattagagaataacattttttgactaaacaaattaaaacattcatttaaaggcaacaatattttagctcaaaatgtaatgaaataattattttgctaaaataataaaataaacctattgaacattgaggataatgaaaattttcaataaaagaaagtgaaacaaaaacattcatataaaggtaacaaacacttgcttaattttctcctcaaaaaatattttaattttcaatttatttattgtaattttaaattaattttttaataaatctttgaaagtaaaaagaatacaataaattgaattgaatttttcccattttcccacaggtcacccatggaaatgtgcatctgtttgtcggcggtgaagaggcccagccccaggggcacatgtcggacacttcgacctcggcaaatgacccgctgttcttcctgcaccacagcttcgtggactgcgtaaaaaacaattgaaaaaaataaaaacccctgaaattctcgtttttaaattaaaaattgctgaaattcatcggttttaaattaaaaatcgctgagattttccgttccccccccccccctcccctttaaaccgtaagaaattttcgtattttaggcatatttcattagattataattagtgagtggaagaattcattgaattttagatttgggaacagtggcgagtggccagacagaatcgaaatgaccgcgaaatgacttatccaatggataat

SEQ ID NO: 73992 - DNA, 90 bp, Heterodera glycines
  Genomic contig location: Contig_ID=SeqID_10746; Location=168..257; Strand=-
  SCN-specific regions: Sequence locations=1-90
atgtcagacgtggacccttgtgctaaagcaccgacaaaagcactgagaattgtctgtacacaattgcatcgatgggacaaaaatgcgcga

SEQ ID NO: 73993 - DNA, 669 bp, Heterodera glycines
  Genomic contig location: Contig_ID=SeqID_10746; Location=520..1188; Strand=-
  SCN-specific regions: Sequence locations=1-93,136-257,305-375,423-669
atgaattgtaaactagcatttttattcgtttttttatgtttcacatatttaaatgtggcgaaatgtgaagaaaagcatgaaaaatcggcaattaacaacaaaaacaatggcatttcaaacagcaacaacaacaatggcaccacttcttccactaatgaccatgctgagaaaacagagaaaaaagtggcaaaaaatgaagagaaagttccaaccgaagatgaaagtgccgaagatggtaagtgcagaaaaaagtaaactaaaaatttctaataaatattaaattaatatgtcaaataaaaaaaaactttatgctaaaattttagacaaggccattaagacggataaatcttctgggccaacgccaccgcccaaaagtaataattacttatttataaataatatattttcatttaattaatattgaacgaatattaaatggagcaacttgacatttttgaaaaaaaagcctggaactgtattttgtagacatggacctgggtttcctggacaaaaatctagttccaggaaaacctaggaaaaatctggtccaggaaaaagccaggcaaatttaggcccaaaaaaaccccaggaaaatctaggtccaggaaaaattgatccagtgaaaatccagaaaaattcaggtccaggaaaatgcaggcccagaataaa

SEQ ID NO: 73994 - DNA, 1381 bp, Heterodera glycines
  Genomic contig location: Contig_ID=SeqID_10747; Location=2647..4027; Strand=-
  SCN-specific regions: Sequence locations=1-237,260-269,300-325,347 -691,713-816,838-905,932-1125,1147-1381
atggcaaaactgcttcattttgtgccaccatcatcagatcacaaaatgcccgtgtttttccaaattgaagaccccgaattttcgaaactgatcacgtcaaatcattggcttagtccaagcgaaaatgatccgagaatgtggagtatgtgaaaatgagttaccgtatttgtaaatattaagactagttcatttttgcaaaaattgggatgaataagggagacggaaatcgctaatgctaaacaggcaccgccaaggaaaactgatctaagaaatttatgtaaaaaaatattttttataaagtttagacatttttctttaaaaaaatgggtgggggtgggtggtagtgctgttctcgagagtctcgactcgggaactctcgggttttttggtctcggggtttcggtcttggtcagggggtcaagactcaatctcgagtctcaagtctctggaaattttcggtctcgaacagcactaatggttggggaaatacacccacaaattaggccccgttcccccctcccccttggctatgccctggcttctaaatcgtttgtttttaagggaagagtgaaaggtgtgatatgtatggcaaagattgctacagggtaaaaggacttttgaaaaaattggatgcactgatcggttgcaaacggatgaaaagggcctcctccaatgagacggtagggttttgaattttttttaaatttttaatggtcaaatttattacttaccgccagggttgtgccaagcctatggctaaatcataaggcagggactctttttttgttttattcaagatacctaaaaattttgactaccctaagttcataaaattcaaaaaattcgcatttttatttacaaaaaacattaaacctgcaaatttcgaaaatttttttacaaaaaagaaaattttaagcaatttttattactaattcgtgaatgatggggcctgtccattccaacaccgtaacctacagtaactattgcatttaaaggtgccgtctttggctaatgagggccttggttgttacgatttaaagccaagcgaaactttgctgtgtgattgtgatattgtgtgcgacaaacatgaacttcagcaacgattagatgcgagaaaagaaagttagtttcgaaaagaaaacaaaacttttactattaaaacaaagaccaaatttttcaaaattcgagatcagagcagaatttgggaatcggtccctgggataggtaggattaacagtgccgagattttgaaccgaagtcgtgaccagtattttggaaccgggccagggaaatattaccggcgccgggattttgaacactaaatcaggatttgagaataatgcagggacatgttgttttccgggattcaagtcccaataaa

SEQ ID NO: 73995 - DNA, 1045 bp, Heterodera glycines
  Genomic contig location: Contig_ID=SeqID_10747; Location=1660..2704; Strand=+
  SCN-specific regions: Sequence locations=1-173,195-229,252-378,408 -408,430-463,492-541,582-638,660-908,931-1045
acccaacatggagtttcactggttcaaccgaaattcgatccatttattcgggggaggcgaaagtctatgatttgaaaaaatttgtgttcaatgccgggacaaccgaattgaattatgccatccatcttaatgaggtttgtgagcagggctgggcgaagctcggcttagcactcgaagccgaagccgaaggcgaagcccaatttttattcgaagccgaagtccgaagctcgaagcccaaaaaacccgaagttttcgaagccgaagccgaagttttttcaaaaaatttttttaattccaaaatttttttcatcacaaaatttcggttaaatatcaaatttatcaattgacagaactgctagagaccaaccaacccctttcgataaataaatataatgaactttttgagcaatatattttgtaatttttataattcttagaatattcacggtttttgagtcaatttaaaaaataaagggaaattttttaaatttgagtgtaatttgttaacagaaaacaactgaacaacatgcatgagaaatattaatgaaaagagggatcaattttaaagaataaatcccgcaatgaaatttacgggattatcccgggcgggattgcgggattttgaaatttcaaaaaaattaggaataaattttaaaaaactccatgaaactaaataaaacttgttttctgctcggcgactatccgcggcgccgtctcacttcttagaattattaaagacttattttcttagtgttaaaaaaaatgaaaagcaagccatgacaaaaaacgtataaaagttaaaaagaaagaaataagtgaaaaaatttagaaacattttccaattcatgacaatggaatgacaacaatttcgtcagctccaatgccacatcctaaacaaattgaaaatgaataaataaataatttataattcgagaccggacaggatcaggtgcttatgtcgcgattttccagggatactgacccagatttattgggacttgaatcccggaaaacaacatgtccctgcattattctcaaatcctga

SEQ ID NO: 73996 - DNA, 1046 bp, Heterodera glycines
  Genomic contig location: Contig_ID=SeqID_10748; Location=351..1396; Strand=+
  SCN-specific regions: Sequence locations=1-143,165-1046
atggcacacacttatgtgactgaattggccggcggcattccgtccgctcgcggcacaaaatattcctacacttatgagtcccgagttgaggaggaggggaacaacgaattgttggaacagagccaacgaaggcgggaggagacggacgaggaggagatgaaacagcaacagccgatcaccgagttgaggagggaagaggaggagcacgagttgggcagggaattgaggagaggggaggacggcacggaaagacactgtacatctacgcaaaaggtaggcagagaagcagagcgatcgacaatcgatttgatcggacaatgccaaatcaaataagccaaccgatccttttttgcttactgaagatcacccgagtgaccaaaatcaccacgacaaggcaagtgaaacaaatcccggtgaatccggccgacgttttcttcgacgcggacggaaatccaattctgaacggatttgatggtgatcagcaacagataaatgctttattgatcagtgttgtggttcagcacagaacatttcggccagcccggacgacgacttcggcgcggcgatggacggctccgtcggcatcgacctgtcccggacgtacatctcggagagcgagcagtacttcagctccccacagaccagcagctccaccgccccgcatggttcccaaagcgtttcaccgcccagcggtgccaatgacaaacatttcttcacgggtttgccttttgattcactgtgccgctcaatcgcatcactttgtgttctttctcagcaacgcctggggcgcccggtttgcccgaagtgaccgaattgaccgactcgacaatcgcattggcatggcttaggcccgattttgacggcacttcaggaccactgatcggataccgagtggaatcaggcggtctgagttagatgaatgggacccggcacacgacgatctgttgggggagacggagtgcaaaagtgaggggggggggcacaggcagcaggagaaaataatcggccattagtaatctcggtaatactgccgaaggatgattgaa

SEQ ID NO: 73997 - DNA, 583 bp, Heterodera glycines
  Genomic contig location: Contig_ID=SeqID_1500; Location=1492..2074; Strand=-
  SCN-specific regions: Sequence locations=1-257,293-522
atgggctgcgcttccactgtaagtgacaaaacagaaaaatgccaatttaatacaacaaaatgcgatgatccctttgaaggatgtgtattttccacgtgattttataaagtatctaacatatgctattagtaaaaaaattacggctaaatttataaaaaaattttggggtttgttaaacatatgaccatgactgtatattctttgaaaaaaagctagtataaaatattcctaaaaatgatccaaaaaaagttaagaagtttttatatttttcaaaaataaacataaattttttgggttttcaacccatttgtaagtttgaatttaaataatattcattaatatgtacaagctcgagtggttccaataacaaaaataattctggaacccggaaacgaaattataaaattctctattaaatgctttaatttaagaaaattcaggtttttccaagatgttaaatgggtgctaggtctaaccgaaaatggtctcagtaggggcgaaccgaaaaataatctcagtgtcaataaaaatatttaaatttaattattttaaagcaatgtttttttaattgaatattaataaa

SEQ ID NO: 73998 - DNA, 1192 bp, Heterodera glycines
  Genomic contig location: Contig_ID=SeqID_1501; Location=1902..3093; Strand=+
  SCN-specific regions: Sequence locations=1-653,676-1038,1060-1192
atggaacctgttacggtatccaaatccaatgctgaacctgtcactgtatcgaaatccaaagctgaacctgttacggtaccgaaatccaaagctgaacctgttacggtatcgaaatccaaagctgaacaagaaacggtatcgaaatccaaagctgaacctgttacggtatcgaaatccaaagctgaacctgttacggtatcgaaatccaaagctgagcaagaaactgtatcgaaatccaaagcgaaacgatccgttgggcctccaaattctgtagcgagaccaaatgtgctaacaagaaagatcaaaagtgcagcagcagtaccgcaattcaacgtggaatcagacagcgcatggattacgatatccccgaaaaaatcggggagaaaaagtacggtagtggaggcggtcgaacaattgaatccaccttctccaatgaaaaatgaggagccaaagcagaaagtcatagaaaagcagcagaagaagagcagaaaaagcgcaaaaattcgcactgatagtatctatgttggcactgttatagaaaataccatgggcactgataaacaaaacgaaaagaaagccatcgatgtgcaaaatgacaaagctagtactgataaacagattcacaaagttggcacatatagacaaaatgacaaaatttctgatggaaaagatgccaaggttgacactgatacacaaagtgccaaatcgggaattaatggactaaatgccaaggtgggaactgatggacgaagtgacaaagctgtcattgttgcaaaaaatgccaaatttggcactaatggagaaagtgacaaattgggaattggtggactaaatgccaaagtgggagctgatggacaaaactacaaaattggcactgatgcaaaaagtgccaaagttggcactaatggagaaagggacaaattgggaattggtgcactaaatgccaaagtgggagctgatagacaaagtgacaaagttggcactgataaacaaaatgcaaaaaatgccttcgatgaaacttgggaagagagtattgcaatgaaggacaaaggaaaagcagaaaaagtacaagaaattgactttgactactttatttggatgtagcaagaagtttgtaaggtcgatgagcatcagatttatattctatgaaaccttttctacaaatttctattccaaagtttaaccaaaacta

SEQ ID NO: 73999 - DNA, 749 bp, Heterodera glycines
  Genomic contig location: Contig_ID=SeqID_1502; Location=443..1191; Strand=+
  SCN-specific regions: Sequence locations=1-149,228-270,292-439,463 -591,635-665,688-749
atgtccaaaatttgcatgacaggcacaaatttcattcgcaataatttggtgcttcatcgtcgcgtaaattcatgccaaagttcaactgctggtgatgaacagaagaagacaattgagcagaagaacaacggaacaagtgatggagaaggtaaaattaaattttaaaaatataaaaattagttttttaatatatttatttagggaataaaaaattttatagaatttatgtgggtcccaattctgaccaaaacccaccaaaaattggctgaatttttatttttcgttttatcacattagaaaaaggccaaaatagggcaaattgaaataggaaaattattcataaattcgcccaaaattaaccaaattttaaaatgttgatatcattcgattgacctaagtgtttttattatccttcaaaatttcaaaagtttcgttacatgaaaaattaactttttaaattttagggccatcccaaagagaaagcacaagacgtcccagtttgggagatctgttgaatgctcgtcgtaaatctgaagcggaccgagaatctatggacacactttgggagccaatgaatgaaggaattttccgattttaaaaattaaaaaaaatcaattaagaaatttttaaattagcaattaacttctaatacttggcagtcattaattaatgctcattaaataattagttttagaaattgatgagagcataaatatgtgttaaattgcacaaaaagaccaaaactatga

SEQ ID NO: 74000 - DNA, 976 bp, Heterodera glycines
  Genomic contig location: Contig_ID=SeqID_10750; Location=3586..4561; Strand=+
  SCN-specific regions: Sequence locations=1-247,387-433,455-625,799 -807,830-952,974-976
atgataattttatgtaagttcagttaataaaagatttttttatggaaaaatttaggtttaggggacaaacacaaaacttacaaaaatacattttgtgaaatcgacgaacatttgagaagatttagatgggagcggggtttagtaaaaccaatttttaaatcaaaagccttaactttgaatggtacatcgttcactcaagccaaaacactggggctgcaaatttagttaaataattgtaagcttttacataaaatttcttaaataattgataacattgtattaaattattttttgagttttttatttattattattttcaaatttttattaaaaatgaaaaaatataattattagttattacaatttttgaaagtttatttttttatcaaaagatggtttccaaattaaaatatttaaggaaatataatgcaaaggtttgttattttttaaaattttctcttcttttcattctttatttaatattgctcatatatatcattaatattttttctattttcaatatttaattgggtgtttaagcatgtgccgtttcattgagtgaatcgaaatttctgttaatatttaaaaactgctttgttacctgtttgatattttgttctagaaataatttaatttaattttgtattacttttattgtatttatatgaacttttataacaaaatattacattggttttttttattcatgaacctatcaaattttatttaaaaaaattattaaaatttcattcaattttaacatttttattcaatttaattttaaatttatttgaatttctaccttactttaaaaatataaatgctttttgttagcttgctatttgttgtttatatatatataatgcgaaagaatttgtggaataggggcaatttttttgattttatattttggctgattgaaacatattaaaatttatcgtcaaaccatgacatttaaaaatttaattttttacta

SEQ ID NO: 74001 - DNA, 2119 bp, Heterodera glycines
  Genomic contig location: Contig_ID=SeqID_10752; Location=151..2269; Strand=-
  SCN-specific regions: Sequence locations=1-185,208-533,558-574,596 -811,840-986,1009-1411,1435-1444,1469-1540,1579-1690,1712-1906,1928 -1967,2100-2119
atgtgtgaaggacggacagaacacggtcagttggacggacggaggacaaaggcgaaaaaggcaccgcactttttggtcacatttctgtgggtccaacgctccaaattcataaacggatttggaccagtacaaactcaaaaagaaagctatcagcaaattcaagtccaaggaccaaattttgcactttcactttccccattttttctcattttggcatttgccaatctctcctccttttaggtgtgctgctgttccacttctgatctatgcaattacggcttttcttctgcttctgtccctgtttctgctgcgtcttcgtcccgccatttgccttcatccgaattcggcgccccttttgcctcaggcggaagcgaattcagccgaattttcctcccattgcccgccaaatctgtggacggcatggaattgtgcacaatttgacgagcacaattggccgacgggtcggccgaattttcacggcaaaaactgaagaaaaagcacgggtttattcttccattggcacgtcggccgacttttctttttcttctttggttgtgttcgatatttgtccattgttttttgttctttttgcaataaatatttttaccgtatccctttgtgtttctctccaacagaaaacattttgagattactgtaattttggttgcttttcatattttgagaatttttggagtcttttttatgtatttattatatgatatgccttagtgtttgcttctttttttgcattttcccccttttggcttcatttcaccttttaccgattgtcccaattccgtcagtcattgtgtttttttttaattttaagttttttttttctgattacagtaataacagcactttcatacggcggaaggataatccgtcggtgattgtctgcttattatcacccattctcattcatccattctctcattcggtggttcgttttgtcctatgatccgtccgtccttaaatccttttaattccccctttttaatcgccattattcgccccggcgcatttcgtccgccgtttcttttgtcgttgcgtcggtcgttcgttgcttctttcttttcccgcttttttctgattcgtccatttgtttctctgtccgccgttggccgactcttcgaataaatttatgaattcgctgaatattttcttgcattgtgccaactttgtgatcttcagtgccgttattgctctgattgtccaccaccaaactgtccttttaaatgccggtcggtgcgcctaacaaaggcaattaaagtgccgttttcagagtccaattcgacttcgaaagggcaaaatgaagcgaatgagacggcactttttaagaagataaacgcaactgataagaaggacgagggacagaaagtgttgttattgttgaagcaaaagcaacgacaacattttggagaagaaaaaagtgaatgggaacaaatataatttatatttataatttgcacaattaaaattggaattggaattcctttaattaatttgtgcattttttatcatttaaacagccgttaattggtcatcaaatatcaccagcatcaacagcagcagtgcgtcgtccattccttttagcgaaacaaaaaaagtgaataggaacagagcttgtggccattcattagcttgctaattggccaattagtagtttaattaattcgaaggcaaatcgcgggaacaattgcacaacgacaacggcacattttggagagaaaaattcgacaaaaaaagacaaacagaaaagagaaaaacgaaggaagagagaaggtgaagggggaaaaaggggaaagaaatggcaataatattcgagaataaatttctcgaaattcgacaacaaataaaaaaagaaatttagccgattcgacggtatccgtcgaacatttttcaactgaaaatggggaagaaaaggacgaaagcggacggctctcttcagagacatcgtccggcgcagaagaaaaagaagaagcgaaaaagaactcatcggaagcgaacggcgaagggaagggaaaagaaagggaagaaacggagggaggaggacaaagagaaggaggggacgaggaggaggaagaaaaaggggaaaacagcaccaactgcggaaacg

SEQ ID NO: 74002 - DNA, 61 bp, Heterodera glycines
  Genomic contig location: Contig_ID=SeqID_10752; Location=3059..3119; Strand=+
  SCN-specific regions: Sequence locations=1-61
atgaacgaccaatcaaaacccatcaaaaagggaaagtgcgaatggtcggaggaaagaaaag

SEQ ID NO: 74003 - DNA, 184 bp, Heterodera glycines
  Genomic contig location: Contig_ID=SeqID_10752; Location=2403..2586; Strand=-
  SCN-specific regions: Sequence locations=1-5,132-184
agctctctctctctatttctccttttctcccactctttcccattctccgcttttccaatgctattttcgtcctctgcttcttcttcttcaactgccgcttctcttatcgtcccctttcttccgcttctcttctgctgttgtctctgtgttcccccctccggcgccattctgtgccgcaccggcg

SEQ ID NO: 74004 - DNA, 911 bp, Heterodera glycines
  Genomic contig location: Contig_ID=SeqID_10754; Location=282..1192; Strand=-
  SCN-specific regions: Sequence locations=1-204,226-416,438-911
atgacggcaattattctttgtattttaattgcgccaatctgtcatacaatagcattggaaacaattaataatcctcttcctgctgctgaacaaatgataggaaacgattaccgtactcaaacaacaatttcaattggagcggcttactacggtatgttttttgctttttgggaatcaatgaattttgaatggcaaaatttaatttttgccacaactaagtgatgggccaacagcgttgccaaaattgaacgcgccatcaccaccgttgttaggccaaacaattggtacaaaaataatgccaaactttgtgccacaatgccaacggcaccgaccttttcaccaaaatggaaggcatttgcgccacaaatgctggcggcaccacaaccaatgcctcataatatggcagggcgcgtatcgaaaatttttcaagataagaacatcaaggccaaaaaataagattttagggtcaaaaataagaacatttcgcaaaattgcttcaaatcagttttttttacaatttattcgatcgaaatgcattaaatattatatttttcacctcccatgatcatttttaacaattttggtgaggaaatgagcaaatcatacatttcgggacaagtgagatcgtaattcaatttgatttgtgccagacttttcacggtttcaattgaatattggcagaataacactgagaaatgtgaccacagttttggctgaatcagaagcaaaaaagttgcgcaaaagtagaggcccatcgcttgtgaaatagtcggcaaaaatgtcccaacgcgaattcatctcctgttttgctttttgtgataccctgaaattcagtggcatattcacttttaaaaacatttttgcgcttaggcggtgccatttgttagtattagtgcagctgctaaattaaa

SEQ ID NO: 74005 - DNA, 1005 bp, Heterodera glycines
  Genomic contig location: Contig_ID=SeqID_10754; Location=2387..3391; Strand=+
  SCN-specific regions: Sequence locations=1-86,138-426,575-1005
atgaaatcaattttcttaattttatttgcatttttccacgttttaccgaatttggtcgatgctggcaactgtctttctggcaccggtttaaaatatttaaaaacatcttaacatttattttttatttcaaatattaagcgatgtcatgggatgcatattgccaaagtcttggtgaaaatgagtgccatgccaaagtcatcaccccgtgtaaattaagcgataatggccaatgtgtgataaaacgatcgattgggactgtgacaattaatgacaatagtgtaagtgattagggagaggtgaccattgctacacaattaaaagccaatttaacgggatttttggaggaaaaagctgggaccgcgacttgctgggacttaaaaagccggggatttggattttccaccgggaacgggaagcagatcaacctaaatcaaaatatcaagttaaaaaaaatagaaataaaattaaaaacatttgtctctaataaaataaataaaaaatttaaattaatcaaaaattttcaaacaaattaaaaaataaaattaaaatatttttacagaatttaataaaataattgtttttttgtcataaatttaatagcaaaggtatacaaaaaagtgccattttattaggcaaatgttttttaaattttttcagaaaatttggaaagattcttgtcaccgtcgacaaaatgagaggtgcaccaatagtcgctttgaaccatgtgtttggcaagtgaatgattgcgtattttttggtacaatgtttacctttaccactcaacgatgatcataaattaatttttatatccaaaatcggaagagcaaagaaagtgagtggaaaaaaatgatgatttttttgttgattaattattaggcgggaaaattggaccattttttgttgcaacatattcattgttttgttgataaaaaatttatttttcattttgaatacaatttaacaaccaattttttttatgattgtgtgatttatgcagaactatta

SEQ ID NO: 74006 - DNA, 332 bp, Heterodera glycines
  Genomic contig location: Contig_ID=SeqID_10755; Location=338..669; Strand=+
  SCN-specific regions: Sequence locations=1-332
cacagaaatttacggaaacgcttggaaaaataaaaattggtagtttgagttggtccgtgtacgggcgaccgcctcacacactgagtgatattgcccctcattagatttcgacaacttaagcctcacacccgagcttaatcggtctttggttggtgttatttcatgccaccaccaaactttctcaatcttctcaatccccctccagtgcggcaaccactcggcctatctgtccgcgtgtgggaatcaacgtaagcctcccaatccctcctcagcccctgcccggtgttggcaggtaaagccatgcacccggcctatcaatccacagtggtggc

SEQ ID NO: 74007 - DNA, 501 bp, Heterodera glycines
  Genomic contig location: Contig_ID=SeqID_10756; Location=146..646; Strand=+
  SCN-specific regions: Sequence locations=1-53,114-501
atgaaaaagacgggacagcggaagagaaaagtctcgggaatggctacggccgcgggagaaaaggagcaaaaggaggaaaagaaagaggacgaaaagaagggagcggaggaagaattgcagcaacagctcccggtaaatgccgggactgagggcacaaatgaaggaaaagcagaggtcggggaagaaactgatggggcggaaacaacagaggaagcgaaaaaagagatgggcgctgccccgggggagatggtggaggacgagactgaaggtcgggaggatgtgtgcaaaaaagggaattcggaatcggcagatgcgggactggaggttgaacagttgaagaaaatgttacgcgacagtggccaaatgccgacggacaatgccccacttcccctacctcgctgggtgaagggttgtggggcattcaaaaggaaatataagaaaatttatgataacatgattaaaataaacaattagtgagctgtattgtattattgttgcgta

SEQ ID NO: 74008 - DNA, 932 bp, Heterodera glycines
  Genomic contig location: Contig_ID=SeqID_10758; Location=325..1256; Strand=+
  SCN-specific regions: Sequence locations=1-232,261-320,367-430,452 -457,479-873,895-932
  Gene Ontology: Biological process=embryogenesis and morphogenesis
aaagcgttcaacgaccgggtgcagtgccatgttgaccgccaatttcacgaggcatttgccgccaccgaattcggcccgttgccggtccgtgtgccgacgccggacggcgcccaactggccacggttgcccaactgcttgccaaggccgaacgaccgttgctgctcatgggcagccaggccatgttgccaccggttgagccgaacacactcgtggacacagtgaatgtgtgttgttttattggaacattttaacgaaaatttcatgaaaattatttaatgctttattttaattaaatttcgtaaagttacattttttctagattttttaatttatttttgtttttgaatttctaaaattttaaaaatcccaatttttataattgttttctgggttggggaagcgaattgcaaaaatgtaaagcatttattcgtatattttgccccttttgacaatgccatatttaaaaaaaataaatttcccagttttgcaacaattttcgaccaaataaataatgaattttggctcaatcggacactcccccgacattgaaatttgtgccattctccgtttttgaaatttgtgccattctccgtttttgaaatttgtgccattctccgtttttgaaatttgtgccattctccgttttccctccaattttcagagtcttggcatccccgtctatttgggtgggatgagccgcggtttgctgggcgccgactcgccaattcaaatgcggcagaatcgcaagttggcactgaaggaggcggacttggtcatattggcgggtttaatttttaaaaaaatgcctaatttcgctttaaaatgccgcttttcaggctccgtttgcgattttcgtctctcttatggcaaaaatttttcgcccaacacaaaaattgtcacaataaatcgcagcgaagaacaaatgcttaag

SEQ ID NO: 74009 - DNA, 1811 bp, Heterodera glycines
  Genomic contig location: Contig_ID=SeqID_10759; Location=343..2153; Strand=+
  SCN-specific regions: Sequence locations=1-225,247-442,477-848,871 -1269,1302-1329,1351-1586,1622-1811
  Gene Ontology: Biological process=embryogenesis and morphogenesis
aaattctgatgcttttgctttcccacagaaccatgacgtgttttggcaaagtgccgtcgctgtgcaggcggacgtggcgctcactttggtcggccttcgcactgaaatggtcgcgcgcggatggaaatcgccgtgcgggtgggccgaattgttgcgggagcgtgaggccgagactgaggccaaaaatgcgaaacgaatggcccaacggccggcggatggccacatgaacccgctggtgttgttggacgccatgaacaaagtgtgatggtgttccaacaaattcaatctcttttttgatttcactcattcggtgccattctcgaatttgaaaataccctcgtttccgctctactctcggcggcattattgtttttccgccaggcacggtccgggggagggcgcagatcgtttccccacccacgtccattttttttaattgcaaccttttcaaaaacaatttttttataagaaaatctcaagaaaaaaaattcaaaaaatttaacgacgggtgaaatgaagtgcattcattgtcaggggaaaaaatttttaaggatgatgaaaattcccgtttttcttattggtgcccccccccttccaaggcgtaaccctggtaccacccctgttttcctgtctcacaaattctttttctcttgaacagtcggtctaactatgcccctaatggtattgttgtacgccaaatgcctgctttcggggagagggggcgatttgtttccatgtcgttttttggcattagtcaggcgatgccgacaggcgccgtcgggacaaaatgtttttttaatgaatttgttttttaaaaatggtatattttttggcactttgcttccaggtacttccaaaggatgccattttggtggcggatggtggcgattttgtgggcagtgcggcttacattgtgcgccccggtggccccctccaatggcttgacccgggcgcgtttgggacgcttggcgtcggtgccggtttcgcgctcggtgccaaagcggtgtacccgcagcggccggtggtgatcatctacggggacggctccagcgcgtggggccttattcaattacacataataataatatttcgtaaaattaggtctcaatataaacgatgtacaaatcattaaatcgtctcataataattatttgcacttcaaaaatataattagctcaatttttctattctcacatttttcttgacctaattggtgtcattctaaagcctaatgggtcaacaatattttgatcattcatttttatgaacatttattttaaattttttttattaattttaaactaagggtgttgactcgaaaaagcccgtaaaacacaataaaaatttaaagcaacagatatttcaattaattcaactggcttttctgcgccgaatgataaatgccgtgttcagttattcgctgatggactttgacacttttgtgcgccataaactgccggtgattggcataatcggcaacgacgcgtgttggacacaaattgcgcgcgagcaagtgcccgttttcaagacagcagtcgcctgtgacttggacgtaaaataatcgtttttttattcccaaaattgccatataatatatatataatttaaaaattaaaattttggtctgcttacaattagcgcctaatggtccattttggatcaaaatgataatgcaaatttggtccgatgtttttgaaatgaaatcctctaagaaatttccttctattttccgtctcgggatattccaacccattttttatggtaggaataataatttaaattttacaggacacccattatgagcaatgaac

SEQ ID NO: 74010 - DNA, 3481 bp, Heterodera glycines
  Genomic contig location: Contig_ID=SeqID_10761; Location=468..3948; Strand=+
  SCN-specific regions: Sequence locations=1-238,262-645,667-1788,1813 -1820,1843-2638,2660-2969,2991-3421,3443-3481
atggcactcaaatcaatcaacagtgcttctcttataaagataaaagtcctgctgaacggaaggatcgtgaagtttattctcgactccggggcagagatcaatgtcatcgatgaggaaacttatcgactgatcggacagccaaaaatttgggaatgtgccgaaagaggcagaatgttcgacgggacagaaaaatcttttatcggaaagggagaaggacacttcgaattccaaggcgtaaaatttaaagaaaatttttatgtcgccgagaagggattgatgaatctgttgagtgtccaaacaatggatgcatttggactgttggatggcattaaagccaaaatcaactctccgataaatctttgcagcgcaggggaagaattgagaggcaaaacacatgccccaatcaaatccaacaaagttgccggcaaacgaaacaaggacgccgagaaagaaatcaatcagctaaagcaggagtacaccaatgtttttaaaactgaattgggactctgcaaaaaggtcaaagcgcacttagaattgaacgccaacgcacggccaatatacagaaaggcccgtccggtcccgtacaacgccaaagaagcagttgacggagaattggatcgttgggagaaaatgggagtcatcggcaaagttgagcacacagaatgggcagcaccgattttggtcgtcaaaaaggccgatggtagcgctcgactgtgcatcgactattcaaccggactcaacaatgcgctaaaagaccaccagcacccgttaccattaccggaagacatttttgccaccttaaatggaggccagtacttttcgcaaattgatctccgggatgcgtatcttcaagtggagctggacgaagcatcgaaaaagctgtgtgccattgccacccatagaggaaattatgaagtcaaaagacttccctttggcatcaaaacagctcctggcattttccagtcgataatggacaaaatgttggcagattttgacttcgcgacagcctacctagacgacatcatcatcgtcagcaaggaccaaaaaaaacattctgaacatttgaaaaagatgttctcgcgatttcaagaatggggatttcgcgtcaaacgagaaaaatgttcgtttttccaagatgaaattaaatatctcggacaaataatcgacaaaaacggacgcagacctgaccccagcaaaatcaccgcgatcaatgagatgccagaaccgatggatgtctcttcacttcggtcatatttgggaatggtaaaccattaccaacaattcatcaaaaacatgcgcttcgtcagaaagccgcttgatgatttgctgaaaaaggacgccgaatggaattggagcgataaatgcaaaaatgcatttgacaaaatcaaaaaaattttgtcatcaaaattactgctcacgcactatgaccctcaaaaagagatcgtagtagcagcagacgcatctgatcagggaattggagcagtgatctcgcacaaattcccggacggaacgatgaaagccattgcgcatgcatcatccgccttaactcctgccgagaagaactactcgcaaattgaaaaggaagcactagcaataatttttgcagtgcagaaatttcacaaaatgatctatggacgtaaatttacgctcctaactgatcacaagcctcttctcgccatctttggcaacaaaaaaggagtgcggcaatgcagtgcaaatagactgctccggtggtcactcattcttttggcatacgacttcaacatcgaatatgtcaataccaacgacttcggccaagctgatgctctttcacggctcattgccaaaggaaaagatgctgaggaccgcgtcattgcaaacacttgcgtcgattcggaagtcgagtcaatactcattggaaccatcgagaagcttccaatcaaatttcaaaacatcgtcgagtcgtccaaaagtgatccgaacatcaaaaaggtcatgaaattcatcagaaatggctggccgcaaaatgttggaaacgaaaatgtggaaatcagaattttccaccaaaggaaggaacaactcagcatcaccaaagattgtctgatgtatgctgaaagagttgtgattccaacgcaacaccgagccaaaatactgcaactgctccacaaaggacatcctgggatgaaaaggatgaagcagttggctcgcgaatatgcgtactggccgaaaatggaccaggaaatcgaacaattcgtcgagaattgtcagccatgccaaaatgagtcaaaggcgccaaccaaaacgcacctgcaatcttggccaaagacaacaggaccgtggcagcgagtgcacattgactacgccggaccgtttttcggaaaagagtacctgattattgtcgacgcgtattcaaaataccctgaggttttcgaaatgccaacaaaatcgacaatttccacaatcgaaaaacttcgatacctcttcagtcggcacggactccccgaaactctggtctcggacaacggaacgcagttcactagccatgaatttgcaaaattcacaaacatcaatggcatcaaacacctgttctcggcaccatacaacccgatgtccaatggccaagcagaacgatttgtggacaccttcaaaagaacattccgaaaattaaaaggggaaggggctccgagtaaaagcatcgtcgaaacttttctcgtcagctaccggactacccccaatgattcgctcgaagaaagcaaatccccagcggaaatgtttctcggaaggaaaccacggacaacgttggatttattgaaaccgactcccactcagccaatagagcgaaatgaggagatggagcaaaggttcaaccgacgttatggcactaaaattcgagagtttgccgtcggcgacaaagtcttcgccaaacaccgaatttcacaaaattggaaattcggtgaagtgtccaaaaagagaggagtcatttatgacgtggacttccgtgacgagccgtcaggaagattccatgccaaccaactccgtcctcgacacactcacgacgaaaccgaccatttgcaaatttttctcgacgcatttgacatcggaaaacaaaccgatcgccaaattgccaatgagttggaagctcaggatgagcccaaccaatccgcccaagagcagggactcgagaatgatctgagtcagtcagacaacgacgaatcagtggccgaagaagcagatcagcaagttcagccacgccgatatccgcaacggaatagacgtgccccacaaaggtactcgccgtgagccgctcaaaaggggaggtgttcggatgagcctatttgaattatattggcgatctgtctattcaaatccccgccattttgttgttgtcactcgcccataaatagacggtcattccctccctcctggtcttttcccctcattcattttattttgttattttcctccgaccaaattatcttcgctttttatttattgttcgtca

SEQ ID NO: 74011 - DNA, 61 bp, Heterodera glycines
  Genomic contig location: Contig_ID=SeqID_10761; Location=3935..3995; Strand=-
  SCN-specific regions: Sequence locations=1-28,51-61
gttcggtccgagggtttaaggaagacaatcaataaataaatgtttattgacgaacaataaa

SEQ ID NO: 74012 - DNA, 2740 bp, Heterodera glycines
  Genomic contig location: Contig_ID=SeqID_10762; Location=412..3151; Strand=-
  SCN-specific regions: Sequence locations=1-972,994-1267,1289 -1610,1632-1849,1871-2040,2062-2286,2308-2441,2464-2563,2586-2740
  Gene Ontology: Mol. function=protein binding
atcggacgtcaaattcctcggacaaaccagcactcttctggtcactgctggtctcggcatgaatgaccaaagtgacacttaggatagagactaattctattgcacaatcatcagacatcactctttgggacattttgatgcctcagtccaaatgtgcggtgcattcatttgtgggccatccggacggagcgttttgtgtggcttatcagcccaacactcaggtgggcccaacacgctgttgatttattttgtgagaccaattgatctgttgtattgtcttttgtttcagtcgcttatttctggcggaaaacacggcgaaatttgcatttgggacgtgcgacagcgtcagttgcgtgcgacactgcgtgcgtttgacaatgcgagtgcttccgttcgatgcatttgtttggatccaaacggcgacatttttgccgcagggtccagcgagggcgacataaaagtgagcgcgggcggaagaaacaaaaggcggacttttattttctttttttgtccttgtcgcttaggtttggtcgtccgcttccgtcgtccctcagttgctgtattcccttccgacagaacatgccgctcgaagcgggtttagcctaaggcaggtggcctcggtcagcattcagggcgtccagcagatcagcatcgactcgcgcatgaacatgtgctcatgcggagccgacaacagtttaaaagtaaataacaaattgtggaatttactttgcattcactgttcatccttttcagctaagaataatccccagcttctcagcatcgtgtttgtgaatgacaatgtaaataataaaatgtgttgtgattttccattctattcaaatatttccaacctttgcctccactcattataaaagaatgctttgctttcattttgaaatcgtctcacaaatttaaaactttagatttttgctttccttgctcaattctagccattttggcgcggttggatttgaaacagaggaatttatctaaacgaaagggacccccccccccctcccccacttttgctccgtcttcacaaatcctttgaatgtctgcgcccactaattttttgttggttttgacaaatgcgctttttgctaaaaagcttaataacaagagaaggaagagtaagcaaacagaaaggacgaggggcaaaagcagttctgcgcttccgttctgccgtccctccgccgctcgcccacccacacaaacagtgcccccccccctccgcttttcgcgataaagcatttttgccgcctgtgcctttattacaaatgtcccaaaaatcggccgctccctcttctccgcggccgttcacttcgtcggtgccagtgccgttgcaccgttccgcgagttattcgtgtgttttatggaattttcaaattttaagtaattttgaaagtgttgcaacttaagcccttcggtgctcgccaatgcgaacaaatttttaagtgataggccccaactgatcgattgccctcgctgtaaggtgaagaattacgatgggacatttttggggtgccaagcattggatgtggcgctatttttgcttgttagtgatattgatttggcaatttatctataactcaacaaattcccaaggaaaaaatgctcaaaactttctttttgaatttatgccttgtaaaaaaattaagaaaattcattataatgaactgagatacatacaaacagaatgccgatttccgactcggccttcaaacacttgggcatttgtgagttacagataaaatgccgactcagttccaagaaacggcaaaattccgccacatcgctggtgccaagtacttattgaccaaagttgcctcgtttagcactgattgatatttccccaccccactcattctttcgcacacttaaaactcattgttttcttaaccgttttagcagcatggcttcacagaattaaaacatgtcattggcctctttacttgggtacgttcaccaaatccgataatatgtattgccgatgggtcggggtcacttcggcgcggaccatttcggcgccgtaaattttgaaatgctataacttttttatttgtcagttagctttagccaatctggcatcatttgaaagctctatgtgtgctctatatttacatgtaaaaatagaaatgaatgattcaaaaataaaaaagttatgccacgcggcaccgaaaaagccaagaaaaagttaattgaggttttttggccataacttttttgtaaactgacgaaattttttgaaattttacaggctaatagagaatctgaagagctatcgaatgataacaaaaattttaatttggttgatcaggaaaaaagttgttagcaacggcgccgaaaaggccggcgccgaagtgggcggttcccttgccgatggtgaaaatttgttggtaaaatgctgaaagcaaattcgaactccttttcgattttctaaattaaatttatagacacaaatttcgaagtattccattgccccgttttgtgttttttgatcacttgccacaaagctgcgagtaaaacattcccaccatcggcagttttatttcccctcccattgtccactttcccttcttttcaggtctctttcctcgtccttctcatcacgggactctttgtcctcccacttttctttctatgggtcccatttttcatcgacactttcaaagacgtggaacaccgatgccccaattgcaagacacacattggcacatttcgaagattgggaaaatgatcg

SEQ ID NO: 74013 - DNA, 1711 bp, Heterodera glycines
  Genomic contig location: Contig_ID=SeqID_10763; Location=390..2100; Strand=+
  SCN-specific regions: Sequence locations=1-275,297-525,547-643,680 -688,710-840,863-1295,1319-1371,1393-1522,1544-1597,1620-1629,1654 -1676,1699-1711
atgttgcacagcgaatggaccctctctatggtagtgaataggcccgaaattttgaaatggccgggactggatccggcacttggaaaatggacggagggaactccgtttttccggcactaccggttccggtggtttgtccaaaaaaaggggaccggggccgggaatcccggcgggcccccggttccgtccgggcgggctctaatagtgaaattatttggcgaattctttttgaatttgaattcattaactaaacagagagaggaaaccattttgaattttatttgactttatggcaatttttcattttaaatacatcttactaataaattattaaaattcacacagcacttgacaaccatacgcttgtgaaattggaccaaaaatggcacgacacggccaaagtgtgtgcctttgacaaacagtcgaaattgagatgttttgccgacaaaaagtaattgcataagccaaatgattaatcgctaaattaattttaaactgctaatttaagctgtgccgtcaaagcaagtgaaaaggaagtggaaaaagcagtcgatgagtgctatatggagcacaatgtggtcaatgttcaacacaaacgttgtgaatgcatgggaaacaatgtgccatggtgaagatgacactgaaattatttaatataataataattaaatattaattactctgtattttcaattaagctatggttatggtattgagaattactgtgagaaactgaaatgccaaatgttgcccgaccaatgttctgtttgtgaaaatttacgaagtaaattcggtggaaattattagtcagatcagtcagagccaattgaccttcttatcaaaattgttttgcataaatctgaatgaatttaaaaaaatttggttcacgaaaatgcgtcagtggaaaatgggtttagtaaaacaatacctcgaaagtaaatatcggcagcattttgaatgttaaaaatttttcgatttttgcctcggaaatttaggcgatgtttcgagaatttcagaagtcaacggcagagttttttagtttcaaatcacatttatccgctcccggaaaggcgtcagtgacaattttaatgtcataaaaacaagttccctgggttttcgagatcactgatcaacgaatccgatatcaatttcggccaattccaaaccccggacgcgaataattagaacatttagattttcgactttttgtttgaattcgggtccaaggttcagaattcagaacgaacttcctatataaatttacttttatactccgatatgtagttttgatacagaattaattttaaaatatttatatcactgacgcatttaaaaaaaatttaacttttcaatatggtattttcacttgaaaaaataattaattcattttttgaatttttcttgcaaaaaattccggtttgatcgaaaatccacgtcccgggcttatttaaacttttgaattttaaattattagggcccggatttatatggacaaaaaaatccaaaatatggacgaaatggtgcagtgacaaaggacccacagacgaaggacccacagacaaaggacccacagacaagggacccacaaatacagaggacccacggacaaaggacccacaaagacagaggacccacggacaaaggacccacagacaagggacccacaaagacagaggacccacggacaaaggacccacaaaataataattaa

SEQ ID NO: 74014 - DNA, 354 bp, Heterodera glycines
  Genomic contig location: Contig_ID=SeqID_10763; Location=3087..3440; Strand=-
  SCN-specific regions: Sequence locations=1-164,186-354
atgaactgcaccgcgacagcaaaaactatcgggatgagagctggagttgaagtccaactaggaaagccgcacaatcatgacccttctccaacacgatgtgaagccgctaagatcaacagaagcgtccgcaacacagcattgtcatcacgtggaaatatgccacgcacagttgtgaatgaatgcctcgctggtgcgtcaaatgaagttattgcaagccttcccctaattccgtcaatggaaaaagctgttagtagagtccgtcatgcagccggggtcaatttcaaataccaaaacactcgcagatatcgagataccagcggtacaatctatttccgaccaaacttatttttataa

SEQ ID NO: 74015 - DNA, 544 bp, Heterodera glycines
  Genomic contig location: Contig_ID=SeqID_10763; Location=4014..4557; Strand=+
  SCN-specific regions: Sequence locations=1-149,171-544
atggctaaaagaactttattacggaagcgacagaccaaaaatgcacgccatacgcatgagaacaagcgggaggagagacgaaccaaaatggcaaaggcgacgaaagcccgcctggccaaaaaaagtgagtttttcaccaattttaactcaaaaaattattttttttttttgaatttcagccgcttcacaatcgaatcccaatgccgaaatgccacagcaggacgaagcagggccgtcaacatctgctgcatccgccgaagaagcgatggaaccgccgccaccaactccaggaccagtgccgacgcccgaaatggacgaggaaattttggaattcgacgacccgccgccgtcgacacctgccacaccaattggcgatttggtgccgtttccgtcaacaccaactgcgccaatggaacggggaacagcatccggaaaatcctcgtccacgccgatcaaatggaggcccttttcgagacggaatggggcaaaaaaatttgccaaacgatggcacatttggggaaaatccaaattttcaccaaagtga

SEQ ID NO: 74016 - DNA, 645 bp, Heterodera glycines
  Genomic contig location: Contig_ID=SeqID_10764; Location=286..930; Strand=-
  SCN-specific regions: Sequence locations=1-319,343-388,414-428,465 -583,606-645
atggcatgccatcccgatttccaagacaaattgcgtgccgaaattgctgaccattttggagtagcaactcagggggaaactgagctggaattgaccgcctctgatgtgaacaaattgccatacttggaccggtgccttcgcgagactatgcgcatgtttccggtgattaatttatgccaataattagtgccatggttttcgtgtaaaattttgtttccaatttctctcccgactggcacataaattataatgaatctgatgttgctgatgactttttaaggtgttccccgtgttggagcgtgagcttcaggccgacttgcgcatcggtgacaaaactttgccccgcggggcgaccgtcgccattccgccactgatcattcaccacaacgaaaaacaattttaaaaattattttggcgaaatgctatcgaaaaaatttgaattttttaattattaattttttttaggtgtggccaaggcattgggaatttgacccggacaattttctgcccgaacggatggccaaacgtagcccatatgactatttgccgttctctgctggcccccgcaattgcttaggtgtggagcagggaaggaagaggaaaattctagcacatgtaaaagttcttaatttactgttacagtaa

SEQ ID NO: 74017 - DNA, 2163 bp, Heterodera glycines
  Genomic contig location: Contig_ID=SeqID_10764; Location=1058..3220; Strand=-
  SCN-specific regions: Sequence locations=22-248,271-305,328-526,577 -875,897-1091,1114-1163,1453-2133,2155-2163
atgaaaaagggaccagattataaattctttcaccacttgttgggcaacggcgttttggtcagcgacggggaccattggcttcgccaagtgagtcccataaatccataaatcagccgaggattactaagatttaggattttcggggcttgggtggggggggcacgcttgaaaaactgtctttcggccaatttttcgggctttttgtcttttgcacccgaaaaaattttgatttcatgaattttcacatatactttttcgaattatcagtctatctctttttaaacaagtttttttcaatatttagataaaaaattgtttattaaatgaaatttaccgtatcgtatcccttctaattaccgtatcaaaatacattcatttgaatttagcgccgaatgttgttgcccatctttcacttctccatgttggaacagtacacgcccaccttcaacaaatatggacgaatgttgacaaaaaatttggccgaattgcagggacggcgcgaacttgtggacctgtcaccattgtgtaaaataaaatttaaattgggttttttaatatttttaattatattatttagtgatcaaatgtgcattgtacaacgtgacaggtcggtgactcatttgagattacatttcgttaccaataaatagagattcattttgcagtaatcgaatgtgattagataattatcattaagagtatttaatttatctaatcagatacaataatcagtaaatttcttttttaatcagtgatcgttcattctaatcactgattaattatccctctaacctgataataatctgactgtctgtccctattttatagttatcagttcagatgattatctgattaggcaatgatcaatcacaagaattttttgtaaaaatttgtgatgccttttgaagagtcggtgatgggcgtccaaatggaccttgagcagaaagttggccgcaattacatggaagcgatcaaaaaattcggcatttaccatgccatttatgcacttggcccactgtacattttgttcccgatcacttggtatttgtttggccatggctttgcgacacgaaaagcggtcaaagcgctgaaggcattcagcacaaaggcaaatttaattaattggaaaaaaattcaaaatttaatgagatttttgaatgatgaatatttttaataatttaaattttattttactattttagaattttattttaataaaatatgtttaaatttattcttagaatgagctttaatgatttacattaacaaagctaaaaatgaaataatttaaaaaatagaaatattatttaaaaatgaatataattattcaactttttattttaaatgggaaattaataaaattaaaaatgcattaaaattgatcaactttgttatttgaaatgggaatttattacttgataattttaaatattttattaattaaaaatttttccggtgtttttaaatttaatgcaattaattcaaatatttcactccgatatttaattttgaaaatctaattttttcaattttttaggttgttgaggaccgaattcgcattaatgaggcaaatggtggcatccgaaaggacggactaatgcacagcgaaggatcactgtacaaaggcaaaattatggcatttttggactttttgctgacactgcgcgaggagcgaaagttgaacacggagcaagtgagggagcaggtggacgcgttcatgttcggaggtgagaagaattagcagcaaaaatgccgtaaaagattgggtcggaaatgccagaacttaataatgcatcatagtgaggaattggaaatttcccgaaaaagaatattgggcaaatcgccaaaaaatgtgatcatgtcaacaaaaaatcttttttattgaatttttttgttgttaaagaatttattttacatgaaaaattcaaaaaatgccaaaataaatataattcagatcacaaattatattaaatgcaaggtcattaaaaaattcaaattccgaatttgggcttcaattttaagaagaaaaacttatgaaattgccgttctcaaattcgatactttggacaatttcagggcacgacacaatcgctcatggcatgatgtggtcagtttatacatagcaattaatctaaaatatataacaatttttaatgaattaaa

SEQ ID NO: 74018 - DNA, 1176 bp, Heterodera glycines
  Genomic contig location: Contig_ID=SeqID_10766; Location=29..1204; Strand=+
  SCN-specific regions: Sequence locations=1-351,373-541,565-1023,1045 -1052,1076-1149,1172-1176
aaattccattcacaggccgttgatagaaaatcagcaattttttcttatttgcataatgtatcggccatcttcttcacatcgttcagctcaacaggtgtggcgtttcttgtcgcctttttcatttaaaaaaaaaatttttctttgttcccaggaagccatgcgccctcctccaaaattgcctgacaggtaagacctggaaattgtcaatgtattacttattaattaaagtgtaatgtacaaatatatgcttaagcatttacaagcttgggtctcaattaaaaaaaaaaacactactagactaaatgcatttttattctgacaatgagcctagtccattgtaacattttttggaaaaaataaataaaaatttttcggcgttttgttgcaaaatgtaatttgctttgtccaattccgattcccaacctaaattgaaaaaaaccgaaattcaaaaaatttcaagttagggataggaatggtcaaaattgatctcagattcgtgatcagcgaccaacaaaaaaaagaaaaatactcaaaattacacacatttaaattgaaaatttttcaggcccctggtcccgtacatgcgcttcagcaagaaaacgtggcccaaagtcagggcggacaagcctgacgtgccgttgtgggaactgggcaaaatcattggcaatttgtggaataacatttcgccggccgaaaaagcgatgtacaaccacgagtatgagcaggacaaagtctccatttttaattttattattcagtgatttgtacaaaaaacgtgaccggacggtccggtaaaaacctaccaggcttacatacattcggcataactcaaactaacgaaaaattccccgagttttcatttacaagaaaattttgtttatttttttaattcgggaccattttcacaaaaaaaaattcccgggttcgcctgttgaaatttttctaaaaattctttacaacgagcgaattagtctatgaattgagttagaaaaaccatttttcaaaaataaatacttaacttattaaatttttctttttaagattgaatatgagaaggctatgaagcagtacaatgcagcctattcacaatatatggccagcaaaagtcgagtgaaaagtgcacatcagcagcatcaacaggtcgaattttggtggaaagggaaaactgggcgatag

SEQ ID NO: 74019 - DNA, 394 bp, Heterodera glycines
  Genomic contig location: Contig_ID=SeqID_10767; Location=1801..2194; Strand=+
  SCN-specific regions: Sequence locations=1-70,92-236,266-394
atgtttaaaaaacttattgttagtaattaaccataaaattttgagaaaatttcaacgattttttggaaaatttttgaaacaacaaggcaagttcatcataaaattgaaaaaatcgctgaaaatttaaaaaaaaaatttcttgaagttttcttatgaaaatctcctaagaattttttctttgaaaaatttttaagtttgaaatttcttttttacaaatcttcgcggggggggggcggaaatgaatacccattttttaaaaatctgtttacaaaatttatgggcaacacaattgagcgtttgatttatgtttcattttttttttactatttatcattttgtttcaggaaatgctgaaaaaagtgtgcgcagaacggccccgggtggaccagcagcg

SEQ ID NO: 74020 - DNA, 609 bp, Heterodera glycines
  Genomic contig location: Contig_ID=SeqID_1503; Location=1783..2391; Strand=-
  SCN-specific regions: Sequence locations=1-111,134-237,259-512,537 -572,607-609
atgtggtaccacaagcgcattggggcctccaaccccaatgcggaaccagcagtccagctgcctgtagcgggtccgcgcaacacagttgaagaaccaatatgtggtgccgacggacagggaagccagcacacccgcatgttgctgccacccggaggcttcaacgcggtgcccttcgccggtgcgcaggacacagttggagaccgcgagcggacccgctggcgtttgctgagctgctcggtgatcaaccgaaacgacgatcaggcacagcgggctaaaaactcaacacattacgaaatggcatttgtaaattaaacatacggcaatggctgcccaaacgcagaaacgcaaccattcaaaaattgaaggttgtgcgtgccgtccacacagaaaggctcctgaaatggaagttcgacaacaatttaatatgtaaaatagaagaaagcaccgccaattgctgatgtgccgcgttgacgagtatcggttgtactaactgggcaaccttaaaagaattgaaattattatttttatttatttttcaattttgacttggccaaagggtggcatttcccccaagacattttgttgttgttgttgagccataggaataaa

SEQ ID NO: 74021 - DNA, 4269 bp, Heterodera glycines
  Genomic contig location: Contig_ID=SeqID_1503; Location=3627..7895; Strand=+
  SCN-specific regions: Sequence locations=1-17,40-265,288-531,557 -893,935-1694,1716-2781,2803-3498,3520-3874,3896-4269
atgcgtgactgtgagacgcgagtggccggcggcggcggcaaagcggcatttaacctgttcgccagtcgtcaagaccaacacgggccggcagcagctcagttgttgactcgtgccggcattgatgtcaatagggatctgtacacgctcgacgatgttcaacatctacagcaatggatcaacatcgaacacggtgtgggccaaattcggctggtcgttttcgaaaaagagcaggaataccgcatagtgttcaaaggggaggggtgagtttttccttttgttttcattttcgggctaattgatttgattgaagattggcggcgaaatttaacctttgccttgtgttggagcgcagccacttcaactacattggccgtgttgagcagcttttcgatgtgcccaactactgcattgactgtgagcgcagggcggacgcgcgctaccacgcctccggatgcaaagttgtgtgccgcctttgtctgcggtacgggcctggttatccatgccaaactgaacaggtagattaggattagaaaatattcaaacaaaaaataataattaagctaccgaatggtggaagtactgctcgaaagtgcggtgattgtctgttcatcttcccaaacgatggatgctacaactaccatttggccaattatgctccagctccaatggacggccgtgggcagcgacaacgtcaacccatctgtcaatggcgccgagtgtgccgtgcgtgttggtgcatcgcctacgagggcaaacaccaatgcccgcgagaccaagcagccgacgacgatggaaactgccgacgctgcaatgggccacactccgtcgatgagccttgctacatacagccggttgatgcggattcagttcggcagcgtgcatcgattgctgttgacaacgacgactctaacgacgacgatgacgacgaagatgagctgccgcttcgtttgtgcttcttcgacgcagaaacatcacaggacaggccattgcagctgaacaaccgcactgccaagaagcacgtgccgctgctcatcgtcgctgaagtcatctgtgagcgttgtcttcaggctggtatcggcgtcaacgatggtcttggaagaagggctcctggctgcgtttgcatgacaggattggtgagaggtcagcttttgcgccaatggtcgtcgccgccatttgtcaacgcagcgggagacaacagtcctgcgccatttggagcaccagcattcaaccagcgccgcttcttcttccactcctttgacaacgaaggcgccgacccagtggatcaatttttggattttttgctccatcatgggccaaagaaagcacacacggtgtgcatcgcgcacaacggtggcaagtacgatttccatctcgtacttgaagcgctacaccgccgtaatcatccgcccaaacacctgtgcaccaccgggttgaagatctactcaatgcgtctgtgtggtcgtcaccaacggcgagtcacatttaaggactcaatcaactactttttttgtgccttggacgcgttggtgaagagcttcgaagtgccggaccatttggcgacggtgaagccattcttcccgtatctctacatacgacgacaacatctgctgcagcgtctaattggtctaccggctcaagagttctactcccccggcacgatgaagtccgacaaacgagcgcagtttctccaatggcatgccaacaacaacaacaaccccggcagcagatttcagctacgcgagcagctggtcatgtactgtgtcaacgacgtggccatcttgagggagtccgtcatccgattccgccaactcatcgccgacaacacgcaaggcctcgacccattcctccacgcgtcgacagctgctggccttgcgcttgccacttttcgccgctgtttcctgcccgccaatcgtctggtccactcacccgagggcggctacttgcgcgggcgccgtgcttcggcagaatcgcagcgctacatccgattcttcgaactggagcacccggaggcccaagtgcagtgcgctagctggtccgtcggagaggcgcacatagaagacagtggctaccgcgtggacggactttggcgacgagaagcgcctctgcgtcccctggccattgaatggcttggatgctacttccatggtaactttgctgtttgtttgttttttctttttaaatcaacaaaattaggctgtcctgtgtgctttcccgaccgacagcaacagctggcggccgggcgaacagcagaggacctctacgaacggacggagcggcgcctctttgagctagagcacgaccatggctgtgaaatccacaaggtgtgggcctgtcagtggatggagcggctccgtcacgacccggacctgaaacgccgttacgatgccgtgttcgtcccgttcccacttgacccgcgcaacgacgcactgcggggagggcgcactgaaccgttcaagctccaccacgtgtgcagtgacgacgaggagattgtgtgcatcgacattgtcagcctgtacccatacgtcatggtgggttttctgcgaaggtgttcatttcttacggataaaaaaaaaaaatcagaaggccaaccgcttccccgtgggcaacccacgggtcctgacgcgcgaggtgctgctccatccgccaacggcacccctcccgtggactgcacctgaaaccaacatcttccgcggtttgctgctcgtgcgggtgcttgccccacgcaacatccgggtgccgctgctcggctaccgcacaaaggatgggcgcttcaccttccctttgtgtgcgtggtgcgccgaccgtcggcagcagcggccgtgccgtcacggtgacgacaagcgctcgtgggtgaccgcctacacccacgtggagctcaacaaggcactgcagctcggctacgtggtcaccgatctttttgaggttggccactgcttaaaaactttgtcatagaaaatacaaattaggtctgggactacgacgagtgggacggcacgctgttcagcagctacgtcaacacgttcgtcgggctcaaggtgcaggcgactggatggccggaggcgtgcgagacagatgagcagcgtcaggcatttatggacgagttcgaacggacggaaggcatccgcctggactcgaccaaaatggagttcaaccccggcctgcgcctcatcgccaaaacattggccaactcgttgtggtaaatattttagggggtgaaaattaaaaaaaaaaatgacatccacagggggaagcttgcgcagcgcgtgggccagacggagattcgctacacacggactccggctgaattctttgcgctcctcgatgacccaacggtggacaagttggactttgtccacgtgtccgagcacatggaccgatgcgttgtgcggaagcgacccgagttcgccagggcgccaccgaccaactgccttccggtagcagccttcgtcacctcgtacggccgcctccatctttacgactacatggagcaggtgttggccattgatggcgcggagctgctctactgcggtacgtttgtttgtcacatttttcgtggacaagcccatcttttagacaccgactccatctactacgtcaacaagatgggtggtccgtgcgttgctgagggcgaggcgctggggcagatgaagcgcgagcacatcgatcgccgaattgtcgagttcgttgcgggtggccccaagaactacggcatccggcacaccgctcgggacgggacggacgagcgtgccaacctgaagatccgcagcttccgcctgtcctacgcggcccagcagctcctcaactttgacgcgatgaaggagctcacgctctccacatacaacattgacggccaaatgtgagttttcataaatgattaagttatttaataatatgaaattcatttttttttttagcgacgatgcgttggacaacgaagacctctacgtgtatggcggcggcgaacatcgtgcaattagggtgaacttcccgcaaattgaccgcaacgtgtacgccgacctctacacgcacgaagcgcacaaagactacaggcccttctacgccaagggacgcgttcgcccggggatgcagacacgcccctttggctatgtggaggatgaaggaccgccgaacgatggacaacggacgcagcgacgaaagaggaattttgttgaccaggatcccacccagccggggcactctgggtggttttgattgtgattttttaaaattgttttgtttatttaaatttgtacaaatcatgttatcaaa

SEQ ID NO: 74022 - DNA, 1230 bp, Heterodera glycines
  Genomic contig location: Contig_ID=SeqID_1503; Location=7901..9130; Strand=-
  SCN-specific regions: Sequence locations=1-94,116-196,234-510,534 -706,728-1230
  Gene Ontology: Mol. function=general RNA polymerase II transcription factor activity; Cellular component=transcription factor TFIID complex; Biological process=transcription from Pol I promoter
atggatttaattcttgccactgattggataaataacgcttatcccgaaatggatttagaggacgccaacaaagtgaacaaagagccaacgaaaaagcaagaggaggaggcggaggatcccagctggatcagcctcattgacgaggagatgaagcgtgagccgttagctccaattggtgcggagttgacccgatcaagttgcttttggtttttatttggcatttaaattttaaattaggcactccgaaaaagtgtggttgcgccgaacgccgtcgccctgttccgctcgtggactacctctgcaagcggttcaaatgcagtgcccatgagctgcttgtgcttttcaaaagcctagagaaacgccgggacattgtggagcatttgcgctccgttcagttacgcactgcacatctccgcccgtccgtgcgcaattttccggtccgttgcaacgacctatccatcctggacacccactctgccccagcttaccgaggctacctcggcattacggttttttattattattatttttttgttaccacgcaaattaaaggtccggatgcactattacataaagcatggcatccgcttgcgccaccctaatttgccgtgtgtcgttgaatttggaggcggggaccacaaaacttttttcccgcttgaaattttgtccattgttttgtagatgtactcaatttccaattgtactgttgtttttaaaataaatgttcaacccttaactcgagagcaatttttgacaattgcgcaacgtggcgcaaacaccgagtacaaccccaggcgcttccacgctatcataatgcgcattcgtacaatagcgggtaaaactgtggctgcgctggtcttccaatcggcgcgtgtggtcctcaccggagtgccccacccaagcagtgcgagtaaaatggcggcacgcgttttgcggcgcatccaacacacacagagcatcacactggacatccaccagctgcgtgtggtcaacattgttggtgttcaaacctacccccagcgaatcagtgtagagcgactccaaaacacgctgggtggcatctattaccctaccattttcccagcccttcgttgtaaattgttgaatggagtcacgtgcctagtctatatttcggggaaggtcattgtcactggggcaaagtctcttgatattgtacaccagtcatttaccaatttatctaatattgtacccgaatatttccgtaaatga

SEQ ID NO: 74023 - DNA, 308 bp, Heterodera glycines
  Genomic contig location: Contig_ID=SeqID_1504; Location=310..617; Strand=-
  SCN-specific regions: Sequence locations=1-161,196-308
atggatttagaggacgccaacaaagagaaaaaggagctaacgaaaaagcaagaggaggaggcggatgatcccagttggatcagcctgattgacgaggagatgaagcgcgagccgctcgctccaattggtgaggaggcgccagcaacaagttttgcttttggttttcatttggcattttaaattttaaattaggcactccaaaaagtgtggttgcgctgaacgccgtcgccccgtcccgctcgtggaccatctctgcaagcggttcaaatgcagtgcccatgaactgcatgtgcttttcaaaagcctag

SEQ ID NO: 74024 - DNA, 1091 bp, Heterodera glycines
  Genomic contig location: Contig_ID=SeqID_1504; Location=1392..2482; Strand=+
  SCN-specific regions: Sequence locations=1-11,42-433,455-730,752-1091
atgaaagggtcacaaataataacaataaataaatgctttttggagacactgtgtaatgccaaaaaggcgaaagcccttattcgaggcgcatccgatgagcaacttttgtgccttgtcgaaatctgcctaaacattctaaagggacgggtccctttgcgtcctcggcatttgaataagctgaaagctcatgcacaggtgcttcgccgtctcgcccgcacacgctgctctcgctcagccaaaaaggttttgctacagcacggagatggcctcccagctattgtggggctcattgcgtcaattgctctcccgcttattgctgatgtcattgaaaaatataaatagttttccaaaaaattaaaaaacaagaaaaaatgcagcatacaaagcgctatttgctagtccccgaagagatttatcatagtttggcatcaccgccaccgtctgacggaacaccaattgggctggtccgtacccgaattaaacaaataaaaaatgatgacgccataaatgaggcggaaagggcagtcaaatatgagcaggaagttaagcgtctcaacaagctcacaaaggacgaagatgaacgtcccgtgggtgttaaattagaaaatttgagtgacgtggttgacgccatgccaaaaccagtcaacgttacaaggccaattgttgtttctacgcgtcgccatcttaaagtggggcgtgcgcgaaaagaaaatgttgaacaattagaagatactgatgatgatgattatcaaaacccacggtcgtcaagttcaaataaacgacaacccacacaaacggaaatcttaaaattaatttataaaaacgcccaatctctaggggtgtcggaggaagggcaagttttgagagctggtgggcgtccatttataaccagcagtgttgatgacattgttagtcacctgttgaacaaggacaagcgtggccaaaataaagagccaacggcattcaaagaatttgttgaaagggcaaggcagaatccgctcttgagtaggcatttatttcccgaaggtcaatccggcaaaggaatttataaaaacaccccacttaagtttaagccatcattatggatttga

SEQ ID NO: 74025 - DNA, 838 bp, Heterodera glycines
  Genomic contig location: Contig_ID=SeqID_10768; Location=130..967; Strand=-
  SCN-specific regions: Sequence locations=1-463,485-838
atggctgccaaaaaagccaaaggggaaacagttgcggtgacagcaaatgccattgttaacagcggcggcacaaccactactgctttaacttctgctgaaactgctgttgaggaacaatccatcactgccagcacatcttcggcgggacgacagcaacaaaggtaccctcggttttcacattacacaaatctcgagaaaaattttgtaagactctattggacacttattgtagggaaacatttttattttccataagagtaaaagctttttaatgccggtttttatataatttctgtgccaattttgcaaagattccgcgacgatttggtggcgtatctccgcgccgcttaccctccgagtgcgggcgaagtccatcggacggtccaattttgggtggaacgcattgaacgggccgacttcagccatattaaggaccgaattgtcgcttcggtgccgggacggtggggttttcatttgggaagaatggagaagaaaatacaattcaaaatttgtttttgcatgtcgaaatttgattcttcactttcatttttttactattaaattagctgctaatcgtttcaattagcaatcgtttaactaattgcctttttcccagcttccaaaggagtggcaccgatggtgatgcctcgtgccgttttggccatttgcgcctgcgtcggctgctcagcgaagcattcagtgtggaggaaagacagcggcacaaagccttcgtgggccaattcagctccatcggttcgctcggcgcacggcccgaggcgtggctttgcgacgagtttttgacgagtctgtccggcggacggtccatgatcagcggtcg

SEQ ID NO: 74026 - DNA, 855 bp, Heterodera glycines
  Genomic contig location: Contig_ID=SeqID_10770; Location=74..928; Strand=+
  SCN-specific regions: Sequence locations=1-330,352-611,641-738,760-855
atgaatgtcgatcatttgcagcgcacatcacgtcgcaaattggctgatgaaatcgcggctgtaataaaacgggacagatcacgctcagccagccgggcgtccctcgaacggatcagtcgggaagttcggcacaaatttgctcattacacgccacagaagaaacaacaactgccaagacaaaacaagtcagttgatccagaggatgctcttctgatcctcgggcttgtcggtacacagaaggcttacagacgactaaaaaacactattcgcctgatcaatgccaaatttgatgtgttcccgccactcgaaaaagtaaaaaaaagttttagcatttatatttatttaaaaattcaattgaatattgttaggtgcttgacatcaaacgccgcatctgtgggcctttctatcccattaatctaaattttaaggtgatgaggcgctccattccgtttggcgccgacttgagcaactgtggaagtgtatgccggacgcagaccaaattttgcagcaactggagcaccattttgtcaacaactggctcctcgactctggcaaaattgatgaactgaagcaggtatgtatgtttggagggggtaattgcgttaaacttgttttatttaaaaattgatatataataattcagagacaaagtgatcagcgggaagagcatgatgagttcgatcaaccggaagaagaaactgacgaactttcgcttatcaatgtcattgattgatggtgatttagcaagaagaaattggtggtcgacgggagacggacgaagaaaacaatgtagaagaacaattcgattttgaatagacacagttcgataaaaggtttttcttcgtttttacagga

SEQ ID NO: 74027 - DNA, 440 bp, Heterodera glycines
  Genomic contig location: Contig_ID=SeqID_10770; Location=985..1424; Strand=-
  SCN-specific regions: Sequence locations=1-46,91-178,273-301,323-440
atgggggtcttggtgagaaaagagaagtgaatcggtgagggatcagaaatttttgataaaaataaattaaattatttattttcatttatagcatgtgttcatatgcataagtggtcaagtggctaaacctttttactttcattatttgtctcgttggttcaattccctgatggaacagaaaattttttatattttctttaccattattttaattgaatttaattaataaaaaatattttaatttaaaattattatttttttcatttttaatagcctaaaaacccataaacacagcggcccaattttgggctccaagtacaagtatgctggatttttcgtcttagtggtctgtgagttagtcaccaaaaggggggggggggtctcaggttcgagtcccatgcatgctgtaactgtattttgaggtttttaaagcaaataaa

SEQ ID NO: 74028 - DNA, 135 bp, Heterodera glycines
  Genomic contig location: Contig_ID=SeqID_10771; Location=1130..1264; Strand=+
  SCN-specific regions: Sequence locations=1-79,102-135
tatgacacggaaagacttccgatttccgacatttttggggtcggaattccgacttccgaaatttttgatgaaaagtcggaaattttttaaattttttttttcaaaaaactagtatgtaagttttgtacaatttct

SEQ ID NO: 74029 - DNA, 597 bp, Heterodera glycines
  Genomic contig location: Contig_ID=SeqID_10773; Location=529..1125; Strand=-
  SCN-specific regions: Sequence locations=1-181,211-293,317-597
atgcatcaaattctaccgactgaacccatttttttgcctacggatggtttcgctggtcaaccaccaacagtccgtctggaatgccttctttccttcactctgatggcacctgtgcgcagtttggctgttgtgcaattaaaatgtgtgtgctctaaaagtttcaaaaaatcaatactttacgtttattaatttcattaaaataattaaatagtgatcccttccgaaatgtgcttatacttttcaaaacaagtggtgtctgcgggcactgtcaatgggaaaactgaaattttcaagaaatttatacaaagtgaaaaataatgccgatgaattttggcacacgcccttcactttttccgtttttttttcatttaaaaaattagcaaccactacttcagctgaaatagcgctaaaaatgaaaatggttattgatgatgagacgtttaaaagtcaatgtcatattcgtgatcagcgcactggcgctaattcttttttccattttctaaatgtgtcataagaaatgcccaattccttcacaaatacttattcatttatttgtgatacatatttaattttaactaaaaattgtaaaagaataaa

SEQ ID NO: 74030 - DNA, 417 bp, Heterodera glycines
  Genomic contig location: Contig_ID=SeqID_10774; Location=675..1091; Strand=+
  SCN-specific regions: Sequence locations=1-120,142-269,292-310,354-417
atgaagcaatatttcaaaaccaaaggaaaaaatcctgaaattagcgacaaaagaatcgccattgaattgaaaattggagcttatacattgattggttagatggaaaaaagaatttgcttcaatttcaaaaatgtgatggaaattatggtggccgagtcgtttcgcgaaaaccgcaaatatttaacaaaagagagcgggccacatcagtacggtgtctgtatttgttaatttaagaaaaaaaacaactttaatgtctgtttcaagccactcaagcaaacaaagcaaagcaaatgaatatttttttacgtagaataaatagaaaaaaaattattttctaattcatttatttaatagtgtttttgggatgaggttctttaatttgttaactgataaatatatatttttatagacaattag

SEQ ID NO: 74031 - DNA, 824 bp, Heterodera glycines
  Genomic contig location: Contig_ID=SeqID_10775; Location=45..868; Strand=-
  SCN-specific regions: Sequence locations=1-72,106-142,166-282,304-824
  Gene Ontology: Mol. function=low voltage-gated calcium channel activity; Cellular component=voltage-gated calcium channel complex; Biological process=transport
atggcaaagggtattcgttctctgttggacactgtcggtgaagcattgccccaagtgggcaatctcggctcgctcttcttccttctgtttttcatcttcgccgccctcggcgtcgaattgttcggtcgtctcggtaccgatgcttttcccccttttcccccttcgttttgaattcctttggcgcttttccctccccgtccattttttggcatttcatttttcaatttttaagaatgcagcgaagagcacccgtgcgatgggttgggggagcacgcccattttaagaattttggaatggcttttctaacactctttcgcatcgcaacgggggataattggaacggcattatgaaggtgagaagaacgggcggcactgaaaccgaccaaaacatcggcttgttttgaggatgcccttcgggatgactgtgacccttccgataattgtgaggtcagtgaatggatgcgatccatccgaccgatcatcgcttttcgttcggcggtcctttcaattttttccgccgttcctttttcagcgcaattgttgcgtggaccccattttggccccgtgcttcttcgtcgtgttcgtgctcatctcccaatttgttttggtcaatgttgtcgttgcggtactcatgaaacacttggaggagagcaacaaaagggacgaagcgaccgacgccaaagcggcagaggaggaaaaagccgcgcgagtggcacgagaaacagacgcggagacggaggagttgctggaagaagaagcggagatcgaagcggaagaagctttggaagaagcggacgagcaacagttgggagaggaactgctg

SEQ ID NO: 74032 - DNA, 1788 bp, Heterodera glycines
  Genomic contig location: Contig_ID=SeqID_10776; Location=347..2134; Strand=-
  SCN-specific regions: Sequence locations=1-282,530-545,568-570,714 -1453,1475-1584,1606-1696,1719-1788
  Gene Ontology: Mol. function=translation factor activity, nucleic acid binding; Cellular component=eukaryotic translation initiation factor 3 complex; Biological process=N-linked glycosylation
atgaccttcggcaattacgtgctgttcaatttgctggtggccattctcgttgagggctttcaggagagcaaagaggaggaaaagcgccaattggaggaagaagcgcaacggagggcggaggaggaagaaagggagcgcaagacggagttggaagtgctaatcgcagagacaacttcgccagagtttcttgacaagcgcaaggagtgcagctgcggacagaacaatttgcacgcggtcagagaacagctaatggtgaggggagagcagacaaaacgaacggcggaggaagaagaagaaaaaggaagaaggaagaaaccatcggaagagagaagagacagggaaaggacggaggatgaagatgaaaggaggatgaaaccatcggaagagagaaggtacagaggaaaggtgacggaagaggaagatgaaggggaagagagaaggaactggggaaaggggacggaagaggaagatgaaggggaagagagaaggaactggggaaaggggacggaagaggaagatgaaaggaggatggaaccaccagaagagaggagggaccggggaaagtggacggaagaggaagaagagaagcggaagacgacgaagggggagaaaaggaagaggatggaagaagaagaagaagggggaaggaggatgaaaccaacggaagagagatggaagagggagaggacggaggaggaagaggagaggaaggacatgggaataaaatacacgaagaattcggagcgaatcagaaccattttgaagaaacgtgaagaaagttcaaaggagccatgttcttccatatcgtttcatccacattcagcggatgagaagaacaaaaacaatcgacgaagtgctcctccgcagtgttcagcagccgaagcatttctgtcctcccaagtaagtcacttcttcaagtcatgtccttatcctcttcatcttcccccactcctttcatcgcttcatcttccgcccgccctcctttcctttcttcatcttccgtccttcttcccccttttcataggttcgtcccttccatctcagccgttgcacctctctccatgccaatcgtcgggtgccgtactgctcatcctcttctgccgccgtccgtccctttcctcgcggtcatttccgtccctccactcttccatcaatgtccgtcttccaatcgcccctctcacttctccccactgcttccatggagtgttccctggtccgtcctcgtctgatgagttggtctcactttggctgcgtccactcgtccctctttgacccgcagtgccccgtccatggccaccacgcactgctcgaagcgtacgcgcgagaaaagttgatgaaggccaacgaggaattgcagcagacactcgaggaagagaagagaagggcggaaaagcgaaagaacatttggtgggtgacgacagatcggaaaatgcatttcggaagataaacatgaacggatacggatgagtgagcgaattcagcattagagttggctaagccattgaatgggattacaatcggttaaaattagccgggtaatgattggaccatcgaatgggcctcgccctcctcccccggcatccttctcctctccgttgtgcctttttcgtacatttcggcaatgtttttcaggtggcgtcggttagtccgcaaatcattcctttattcccgcgcggagttttcgctgtttcttttgcccccgggcaattccctcagggagcggtgcctccgactgactgggcgcaagtggttcgactacgccattctcttctgcatgtttgccactaa

SEQ ID NO: 74033 - DNA, 891 bp, Heterodera glycines
  Genomic contig location: Contig_ID=SeqID_10777; Location=1..891; Strand=-
  SCN-specific regions: Sequence locations=1-296,405-430,452-453,629-891
tcccactcactggctgaccaatcactcactccctcttttcaaaatgccaatccattcttttccttacaaaatgccaatctcttccttacccccccccccccctcctccgactaatcaaaaccaaaaacccactctcactgttcagtattctcggcatgaatttgttcggctgtaaattctgcaaaattgaggagaattggcggggagagtctgtgaaacgatgcgagcgcaaaaacttcgactcgcttttgtgggcactgaccaccgtttttcaggtgcccttcccccccccccccttctttttttgtattttttctttcttttgctgtgaatgtttttatcgtgtctttgtcgtgtgttgtttttttcaatgttttgtgtttttcgtattttttcttttctttgtctcacccacccccccccccccctcctgttaactcttcattttcctttttctctcctttctctctctcttaccttttctcccttttcgctcccctttctctcctctcctctttctctctcttgtctcttttctcccctttctctcctttctctcctccctctctctttttatctttttccctctttctttccttttttccttttctcttcgcttttcttttctctttacccccccccccctttttctcatgcttttgggcatgattcttttcgtctgcactttttgtacaaaaataatttccggcgaacggtgcactcaaaatgaagtgaatgcggaattacttctccaagcaaaaaatgtgccatcgtatggtcattgcgaaagggccaactttgactcatttctcaccgcatttctcaccgtctttcaggtgattaatcaattaaatgatagttgacatgcatttaatacctttgctttcattt

SEQ ID NO: 74034 - DNA, 668 bp, Heterodera glycines
  Genomic contig location: Contig_ID=SeqID_10778; Location=103..770; Strand=-
  SCN-specific regions: Sequence locations=1-18,42-137,159-668
atggaaaactccaatcaggaaataaagacaaagcgaaacaagcagaagctggaacatgagggtgcactttatgttcttcaccaactcagtgacggaccgcaaaggtgaaaaaatccattaaatttcactaatttccatattaagaattttgatatttgctcgttcttcgatttcggaatggactggtgttatgaaaaatgtgtacgcagatggcactttgtttggcgccgcctttttcagtcaaatttatattcttctagcaaagtaaaaccctatttttttcacgttttttccatagaaagcttctacaggcttttgcttgttcatattcaactgtcttccgcttcattaacacaattcgatgtgagcaaaagtcaattgatgcggacatctcacgatgcatcgcttgaactccctcctgcaaatgcgccaaaatatcgtgccgctgatgcgagaattcttcgacttttgcagggctacaatgccatcaacaataaccctgctcaccaaaatgaccataattatcatgccaatgtcaatgttaatcccgataacatcaaccatttgctcgttggtgtttctcgaaattatgaaatgcgcccgtaatttttcaatgttttgttatttttttgttgttaacacattgataaatattttttgataataaa

SEQ ID NO: 74035 - DNA, 285 bp, Heterodera glycines
  Genomic contig location: Contig_ID=SeqID_10780; Location=1088..1372; Strand=+
  SCN-specific regions: Sequence locations=1-256,278-285
atgactttgtcggaaaaacgaccacagcaagcgccgcgacaattcccgcctcagatggcattgtttcggtcggactcactccgcaattataccgtcctctgccagttatgccatggtaaaactaagccaagacaagaagagtcaaaagaaagaacatcggataggtactaccaaccaatgcaaacggcactgagcgcagaagcaggaattgcgaatggatttgaacggttttttaacggacaaccgccactaaggaagaaaaggggggaggacgaagacaaataa

SEQ ID NO: 74036 - DNA, 929 bp, Heterodera glycines
  Genomic contig location: Contig_ID=SeqID_10780; Location=1710..2638; Strand=-
  SCN-specific regions: Sequence locations=1-439,461-621,645-734,756-929
atggatgagactcattgtcagcagcagctcactgatcagaccagcaggtcgcggtgtgcatcgtcggaagagggcgccgaccttctcattttggagacaatggtaaccatttgattcatgaaaccaattccactttgctaaaattataaatttctgctcgtttaggccgaggaaatgtgccgaaaaggcgatgagattgaggtggaattggcaccgagcaaatcgctcctttcctccggctccgtccccgctcacatgcattgttcccacttcgtccgcgcaccatccgaaattacaatggaacaccttggcgaatttctactccaacgctcgcatcaaagttcgactgattcgaacaaagggagggcaaggaatgaccaacaactccagtcacaaccgccacagccattgaaagccgcaccaaaaaactttcacattttggtaaaacttttttcaaaaataaatatgacttgttgaaaaccagccgaatgttttcatttttaaggaccgccactaccaattgcggaagctgagccctcgggacacactttgcatggcttttctgttgtccatcaattgggaccggcacttgacaattttcttcgatttaaatggagagacgcagcaaagaggaggcacagacatggcggagaccattggagaagaattggccaaaatggttgagggacagagaaaggtggacaaagaagaagaggagagagaatcgcataaagagagggcaaagaggccggaggatacaaacggaggaaatagtgttaattgtaagatggaagtgactgacgaataagcgaaagaacggggggcgaagcgccgattggaccaactgtaacccacaggcattttctaattcttaggtcccgaccttttttacaaattctctcccctttcttccgttattttaaaataaa

SEQ ID NO: 74037 - DNA, 1213 bp, Heterodera glycines
  Genomic contig location: Contig_ID=SeqID_10781; Location=556..1768; Strand=+
  SCN-specific regions: Sequence locations=1-111,149-303,405-465,487 -840,862-893,932-947,977-1023,1045-1139,1170-1213
atgcgcacatactgtaaaggatttgcacccgacataacatgggctgtggagaacattacggtaagtgctgtagttgatcagctgtgtgcagaaagaacgctgcacgggacgaaaatttttagaaataaaaaaaatttagtaaaaaaatgacacttttatataagccgcttaaaaagaataccgtattttctctaattaaggccctgtctccattaaaggccctgtctccaattatgtccccctttctgaggatgttgaaaaataatcgccccgtctctatttatccccccgggggataaatggaattattattattttttaaatcttatttttaataaaaattaattttaattaattctaaattgaaattcatttaaatgtttaataaacatgaaaaaataatacagaaaaatcacttactttactcaagtccgaatctaacccaccccggtgctatgtgttttcaattttttgaaatttaattattaatccctaggggtcttatgagacgggggtctggggttcgagtccgcttggctgcggtttatttttttaggtacttgtacagtttacaccagagttgccgcgggttacccgaaacccgacatttttctcgacccgaaacccgacccgatattttttctcgacccgcggcaagcctggtttacaccccataaaaattttctgaaagggcgctaaaaatatgcatacatttaaaaattcataacaagaaaactttttttgcttttattttgaagaaaggagctcaaaaaagcatttctgtattgaaattttcgattctgaagttactatgcgtcattaaaaattagactttgtcagcaaaatattaaaaaattttggcgttatgtcattattttagagtagagcgggaccgggaccgggccgggaattcccggtcatccgaggtccctgttcccggtcccggattttgaaaagctcaggtcccggtcccggttttgctcaaaattcccagtcccgctctactctacattattttattaactatttcgagatttttcatcactaaaagtcgcggccctagtcattaaaaatctgttgaaaaataatccccccgtctccattaaaggccctgtctccaattatgtccccctttctgaagaggttgaaaaataatccccccggggccttaattagagaaaatacggtatatttcgcaaaatttcaaccaaaa

SEQ ID NO: 74038 - DNA, 471 bp, Heterodera glycines
  Genomic contig location: Contig_ID=SeqID_10782; Location=290..760; Strand=-
  SCN-specific regions: Sequence locations=1-58,81-116,138-261,286-471
atgaaagtgaatcgtcttaataaagaaaaaattattaaaatttcagaaaaaacctgaagacgcacattttcttcttcttccaccttctgattttggcgtcggcaaacatgacaatgaaagtgcaaagaaaaataagatggacaaagaaaggatggataacagggccaagacatttgccaaagaacagaagccgaaaaatacaaaaaaacgtgctaatgaatggaacgcggaaaaagcaaacaaagctaccaacaagctaatgaggaaaatggcagaggaaaaaaccaaaatggcaaatgcaatgctttaccctacgaaaggcaagaaggatgccatgtacaggtgaagagcggggggggggggaagcaaattgcaacatttggccatgaatttgtccggaatttcggattgcaaataatttgattcaaaatggcttactctatggtcaaatgaaaatttttcgaaaataaa

SEQ ID NO: 74039 - DNA, 1142 bp, Heterodera glycines
  Genomic contig location: Contig_ID=SeqID_10784; Location=692..1833; Strand=-
  SCN-specific regions: Sequence locations=1-87,110-390,412-454,489 -613,635-817,854-899,921-1045,1067-1142
atgaaaaatgagatgagcaaattctttggagaaaatattgtgaattttgccaatgcaattaaaataaatttcgcggcgccatatggtaattcctatcctaaaaattttctcaaatcctcattggtgctaagtttttcttaaattccgccattattggcgtaggaaaacaaaaacaaaaaatgtaaaacatttaaattcataacttggctcagtttcaacaatagctctaggtattctctataaaaatgaattactgtatgggttatatttcaaaatctttagtcagtttattttttggcgaaacatttttgaagcagaattttttggaatcttaaagacaaaaaaataataattcttagggctatcgtatataaataattttggctcaattgcattttaataatttatatgtgagcatggcaataaacattatatgttaatgtgaattcctctgaataatattttaaaattaaaattaaaaaaaatttcactgggtttaaaaaaagttaggacaaaaaaaatgttgactcaaaattttctttagctcaattttcaagacaaatatccttggaaaattttataaaatgcatggggccggccactaaaatatttttaaattcataaacatttccattttttatttcagaaaattttgatcttttgcattcattgtccgaatattcgcccacagtttacgaagtgataaaaatggccaaaattcttggcaacattgaaaatgatggacaaattttggtcctccgttcggactcgcaaattttccattttattttgaagtatttggcaaattcaacggcagaagagagtgccaaccaaacaaaatttgccattaaatacagcttttgttttttggcacaatttgttgaagaattattgaaaaaagcaatgaaagtgaatgaactgaaagaattgctaaacattgaattaattggggaggcaattgaaagttttgtcgagaaaaaggagcaaaaatgtgccaacaaaaagtgagaggaatttgacaaattggaacattaattaaccaatgattttccattaataattttcttaagcacgcaaaatgggattaacaaatatcttaatgaaagtatgatggattttgcccatttagcgcatgcaataaa

SEQ ID NO: 74040 - DNA, 1506 bp, Heterodera glycines
  Genomic contig location: Contig_ID=SeqID_10784; Location=1889..3394; Strand=-
  SCN-specific regions: Sequence locations=1-47,69-252,275-479,503 -744,791-1046,1084-1506
atgggctcatacgaaacgtatttggagccacgggaaatgctgacgaaggctgttgctgctgcagggattgaacccgaagcatttgtgacactcaaacacggagagagttggcgaatcgaaaagcaaaacgaagggacagagaacgcccagtgattagacaaacagaagatagacaaaactaacagagaaacgaagtcatgatttgaacggttttattcagcttgagcttgtgaattagacatttttgtgtgtatacataaaattaaaatatttctaaaccagggctcggatcgtaccaagtcactttccaagtacaggcataccaatttccaagtacataacgtgggaaatttattaaatccaagtacacataaaaatttgaacaaaaaaaaaattaaaaaaggttaattaacttcaaatctatttttcacctgaatgttttatccaaatatttatatttccgctgagcaatttacgcatttttcaaaaacacctcaacaactgctggttttcaatttgcaaaatcaatagaattaagattttgctttttaaacccaaaataagaaaatttttgcgattttgggtcaatttcttaaaaaaagtgagttcttttttgggggggaggatggacggagccattggcgctgccgggagaaaaattagaccttttgacctttttacagattttcaccgaaaattttctatttctaggttaatttagtaaaaaattaatgtcgttttgacaaaatgccaaaaattttagattttttcataaaatgtacattttttagtcatactcaaaaatcccgatttccaagtacaatcttggaaaaaagtacagttaaaattttccaagcacaaaagcagaaatccaagtatgtacttggcatccaagtacgaatccgagccctgttctattgctttttttcatttttttagtgcctatttttgggttttttaggacctaaaacctacctaggtattttggctgtttttagagcctaaaaatcgtatccctatttatgagtgttttttaagtccttttgttttttatttttataaattttagttttattattaaatctcctgaatatcacacataaatgtgaattttcttttacagtgaattttatatttctggttttattgtccgaatattcgccaacatttgatgaattgattaaaatggcgaatttctttgccaatattgacgatgatggacacattttgggcatcgcttcggattttaaaacacttgaaattgttatgaaatttctgaagaagccctactattttaattctaacccaaaagtgcctgaccaacatttgccgtgcattatggcatattttgttgaagaatttttaaaaaaagcaatggctgaaaatcattatttagtgttttttggcattgaatccaatgggatggtaattgaaaattttgccgagaaaaaggagagaatgtgcggggacaaaaggtgcaatttattctcctatcattttcattaa

SEQ ID NO: 74041 - DNA, 1126 bp, Heterodera glycines
  Genomic contig location: Contig_ID=SeqID_10785; Location=1452..2577; Strand=+
  SCN-specific regions: Sequence locations=1-20,43-48,70-308,330 -491,514-895,952-1029,1053-1126
atggaaacaagtacgttgtattaattgggattatgaaattcaagcggaagcagagttagtaatgggaaacatgacaaaaaagaaaaaacttaaactatatccagggataacggaagaatggcaagaaattgcatttaccccgcaaggagtgactccaccaattgcgccattgctagatgattattttattatatcggataaagatataatctatgcgggaaaagaagtgcgaactcaattaaaatgcaatgaccaaaatagtgcgcaaaatttcgagtgtattttgggtaccgatgcatgtaaagagtgttggcttaatagaacaaaaagtgaagaagagttggtacaatgtgaatgtgaagactcaacttttggtagggtcgagccaaagttaccttttacaaccgataaaatgaatttaagaaaggatagaaatacaattttgagtgaaacaatttatactcctatccagttattagtaagagttgaaaaattaaaaattgtaacagaaattgagtgtaatttgtgtaaagccaaacaagtggcaccattgaaaggttgttatgaatgtaccacgggtggacgacttaattatacatgttcaacaaattggggtgaaaatatagctgaaataaaatgcccaggaaacttgattttcttggcaaaatgcaataaaaatggcgaaacccaaattgatgtgttaccatttacaaagtcgaaaattaatatggattgtgaagttatatgcccaggaggaaaaacgagtttaaaaattaaaggcgagttaatgtatatacctgtgaatgaacggaaatatcaggtaagaaattcagaaatattagaaaatactaatgggttcggacttaattgggaagatcttttccaatttaattggaaattatttttaaatccatttcaaaattttaaattatacatattaatcataattttggcaatttttgcaatcggagtcatttatattttttggcttatgattccaattttcaatggttatagattcataatcggcattttaattttagtcatttcaattcccgctgtcagcggagggatgcatggcatcgagagcataaatgattcagggataaagggtcaaagagtgcaa

SEQ ID NO: 74042 - DNA, 1353 bp, Heterodera glycines
  Genomic contig location: Contig_ID=SeqID_10785; Location=2992..4344; Strand=+
  SCN-specific regions: Sequence locations=1-936,958-1246,1269-1353
atgaatggtcattattacccattgggaggacttgtatttcaagggtaccaagatgagttgaattattttgaagattttttcaaattggaaatggataaatcggatatggaaataatgccacaaatgggtcttggcaatgaggaagttactgaaggtgagaaccgaattacaatacacttggacaacaattcgagtcgggaatgggtcttagaattcaaaaatatgggtgaaaatggattgaaaataattggaaagggtaaattcaaggctgttctcaactttgtgtgcttggcaatttgtaccttggcattgttaaatggggttcatggaatggacagacaaccaaacgggcaaaaggtaccaagtgaaagtgccgatgatttcgaagacttcgaaatgcaacaatggcaaagtgagctaagagatttgcaacagattgagacggccgagtccacttcgggtctaaacacggttgccacaaacaccggtacaaacaaccaagaagtgagtttagcaacggatactgtaatggttgtgccaatttctgaaccaagtcatcaagtacgggatatcattgaaaacccagttgtggatacaaatgtacaatgtgttgtagaaaaaatgggtacgacgaggcaattgtcaattccgacgaatttggatttgttgaattgggctcaaattcatcgttttttaccaccccctaatataatgttgaaggcccaacaagtgtccccaaatgtgcctcttgatcaacgaccgtccacttcggcaaacaacattggcaatccaaatgtcagtgcttcttgtgccccttcctgttcctcgatccaatgtggcaaatacgggaaagcaattcgaaattgggatggacgagttgcgcggccagtacagactgacctgtgccgtcgagaacgttcagctccttacttccgtccacggccaattctagcagcacctcaccagcaaccacgaatggtcgccaacccgccttttcctgttgagtccatccctcccattcacgtgccgtctggaattcgtcgagagttcttgcgcagaatgagccaagagacggaccactttttcggcctcgctcagttggttggagaatggaaccctacactcgcaactctgttcctggctttggaaacattctgccgtgccatccttcagctctgcgtgactgaagggggcgaccaccctgtcttctcccgccccgagtgtcgccgccgataagcgcgacgaaagatcaaaggaaagagatgatgattaatcaaaatggggacggaaaatcatatttaagaaagcaaaaagagagcacttcatcattcatttgatcattcaattgtgcaa

SEQ ID NO: 74043 - DNA, 393 bp, Heterodera glycines
  Genomic contig location: Contig_ID=SeqID_10786; Location=111..503; Strand=-
  SCN-specific regions: Sequence locations=1-244,266-393
atggtcgaccaaagcaacaaagcgaaggaaaggccatcactccttgaagaaccatttataattgacatcacggcaatcgagagcaagtgcgccaaaccgaaaatggctggaaaagggcgtaacgacttcaacatcgactaccgtattgccgatggtgcaacgtatgagcttctgaacaacgacaatctctgtctcttccggtcatttgaaatgcttcggatgaaattcatacttgcgcaacaacgtttttcggaatacaaaagggatgagagaaaacagcttgaaggcgttcatgctttgtgccgggggtgcaacattgacatcaacctacccttctattcaattgaggaatacggagaatcaattcaggcaaataatttgtttattaattga

SEQ ID NO: 74044 - DNA, 368 bp, Heterodera glycines
  Genomic contig location: Contig_ID=SeqID_10786; Location=826..1193; Strand=-
  SCN-specific regions: Sequence locations=1-175,197-368
atgagccaatattccgacaattccctcccccctaccctcgacggaccgtattcccctgttggggatgacggcaccgaattgatggacgaagcaccgccattggatgaggttatgaaacgccttccgatctcggttagtttttacgaaatgtttttctaaaattcttttctaattttgggagacattttcaggttgtgccatcggacaacaatgagcgcaaggcccagaaggagccgtcaattacccgcgaattggaggcggaattgttcaacggcgatggctttacatgtctctctgccgcacaggcggaagcgggacgttttaaaggtgtggttgtaaataatacatcatataaaattattatttaa

SEQ ID NO: 74045 - DNA, 460 bp, Heterodera glycines
  Genomic contig location: Contig_ID=SeqID_10788; Location=1101..1560; Strand=-
  SCN-specific regions: Sequence locations=1-204,255-296,318-460
atggtgattagacgaggtacaaaagtgattagaagaggtacaaatttgatgaagaggtacaaatgtgatttaaagaggtacaacagtgattagaagagttacaaaagtgataaaagaggtacaaaagtgattagaagaggtacaatggtgattagacgaggtacaaaagtgattagaagaggtgcaacagtgattagaaaattcaaaaaataaataattaaattctttactgtaaaaaattttttttaaataatctacaacaaatcttcagattagttaaaaacattgaaaataacgtaaaaagtcatagaaaaataatttacaccggccggattcgaacctaccgcccccaccccacagaagatgactcagaatccccaatcacacagggattctgaggtcttaacgatgtataaactaaaatctgatgtcagattagtgatcagcaccctcaaataaa

SEQ ID NO: 74046 - DNA, 435 bp, Heterodera glycines
  Genomic contig location: Contig_ID=SeqID_10788; Location=2606..3040; Strand=+
  SCN-specific regions: Sequence locations=1-206,245-435
atgaaactgggcttgcattggcatgcgacctcaatgccaagtgcatcgatgggtgggccgatttgcctcccgctcctaacggatggggtggggaaggaacatttgtcgccgaattcaaaattttttcatcctctttatcaccagaaaaactgtaatgaagcctattctttccatgatttcgctcaaggcttttccttaatcaccaagtttttgaatttggaaaaaattttctgaaaaaattaaataattttcagaattccattatttttgaaattgtcccggtcccgacgtatccctggtccaaaaattgatccggatcggatgagagtgccgggaaaacaacataatttgggatcatcaatgacacttttactactttactgtggcgagctctggggggggggggaatttggaattctctcccgaaatgtaaaa

SEQ ID NO: 74047 - DNA, 4853 bp, Heterodera glycines
  misc_feature (4501)..(4501): n is a, c, g, or t
  Genomic contig location: Contig_ID=SeqID_1505; Location=1..4853; Strand=+
  SCN-specific regions: Sequence locations=1-17,39-80,102-139,185 -651,675-1525,1547-1732,1754-1893,1915-2729,2751-2812,2834-3402,3424 -3606,3629-3686,3708-4095,4117-4296,4318-4479,4501-4853
aataaaccaaaaaaaagaaataaaagcaattcagacagactactgaataaaataattataaaaatgaagaaaaacacagatttttttttttttttttttttggtcgttttcgagagtgagaaatagggcgtcggaaatttttttgttttcgtttttgtgtttgttttcgtatttggttttttttctctcttcactatcggcagtaattatatggctgtaagtttttcgtaagtttggcattcgacaaaaaaaaaacgaagggtcaaaatcgattcatttctaattgattcccattcccatctcagtgccgttgaccaacaaaaatagaggaaatgaggcgaaatgtggacaatgacagtggtgcaaacaatggcgcgaacatcagcagcaacccgaaaattgcccgggatgcggaaattgctcatgttgtggacactggaaatggcgcaaatgacgcgcttggcgacggaatggacattgggcactgcccaaactgctcgtggcattgtaatgtgtgcagtaagcgaatttttctgttctgcattcgatttcgttcaaacatttctttgattcagtctgtcattaccgcctaatttgtttaatttactatcaaaaaccacaaaacggtcaaatttttatttttttttccctgttatcaatttaatcaatgtttttgggctgattttccactaactaattcaatttgctaccaaacaacaaaataatggtcaatttttttttcttctctacttttttcgtcaaaaaaaaaaacattgccgccaaaagttcaattccctattaaactaatacagtacaacaatgcgcggtgcggagaacattgcactttgaacgctaatatcatacttatcttttactgtaatcgccgatgagcctggacaattccatttttcgatttccacgatagggatgggctcttaaatgttacaacagctaatgggaaaagcgtcgctattaacaatctccacttttcactaaaaagcatttcccactcattcatcaattcattcttcatccaaagcacatagtgctctcatctcaatcgtcaaacgctccgcaattcacagccttaagcttaagcaagcaaccgcgcgaaccctaccgcctattccctcatttgtttccaaatttaattgttacatctaattattctaattttgttttcccgtttcattttgcttattatttgcgctcatatttgaattgttttaactcgcgctctcatttcaatcaatagaatagtcgtaagactaagagcagaccaaattttttttttttctcttttcaaattgtccaccccaattttcaattgaactatcctttggatagaaagaaacgaaacaatggaagaccaacaagttacaataacgagtgtagacaggacattatttcaaaatctcagtcaccctcctaattccggtgctcccttttcattggtagaaaaagtataccaaggcactgtacgtctagaggatgccgctaaccgaagtctaagagtaattaatcgcagagctgtacaaaatacagatgccattaaccaagtatctgtaacggttaatgctaacatggacactctctccacaagacttgaccaagttgtagagaaagttgaatctctggaaagccaagtggagaattgggatgaccctaatgctgataaattatcacaaaacgggaatgccactgtggtactaaggggccgcgtggggttacttgaagaagaggacgatgaagacgaatttctaaacgttttgacaactgtggacccatttgctagtcaacttccggcatgcagagatgaaaatcttacctctttcgataactgggcccaaaaatttagagaccttttggattatgcgggcacaacatggtcagaaaaagaaaaattaggccgactcaaattttctcttgaagggcaaatcagaaagctctttgataagcttccggacaataaaaaggacactgtagataaggcattaaatgccattagggacaaattagattcccctgaacgctgggaaatgtcaaaaagggcactgtgacatgcaaacagcgagaaaccgaaacagtccgggaatttttgtcaagactttcgccattggttactactgtgtgtgccggtcaaagtgaggcacaaatacagtcacgactaagggatgaatttttggaaagggtcaagcccaatttaacctttcttatccgactgactggtgtcactaagaaccaagattttgaggctgtgttttcccaggcacaagaattagaacttcttttgactaataccaatgaaaataacgttttggacccgctcaaattcactgtccaagctataacccaatctccggtaaaccaatcgggttatcgtactaaccaattttcttcctccaatgtgaattcatgggcacccgctggacaaagatatacgaataaccgtcaggttaatcagcaaacacaaaataatcaaccaaatggttcaggaagaggctattttcggggtaaccacggtgaatccaacaggcctcaatttcaaagaaatagggctaatcaataccggtcgaaccgaggccgaggggaccgcaattggactggccgtccaaaatgccatcactaaggaagtaaagagaataatagggatggcatcattttatagaagacatatacctaatttttccacaatcgttgagccgttaacccgtttaactcgtaaaaatatgaccttcctttgggaagatgagcaaaaggcagcgttttccaaaattaaggaaattctttctcaagaaccctcactttcctttccaaattattccaaaccatttcatatctttaccgatgcttctattgttggccaagctggtattttaatgcagaaaaatgaatttggcactttttctgctatttcttattgcagtaggactcttagcgcttccgaaaggaagtggccacccgttcaaattgaactgggagctataatttattcactaagagaattcaaaccatatatttttatgtcagatgtggaattacatactgatcataaaccattagcctatctcttaaaaaaggcagaagctcatccaaatttagcacggtggctaattgaactacaaagttaccaaattaaaatagtgcacataagtgggaaacaaaatagtttagcagacgctctgtcaagagcacaggaaaatattacggtcaaagaagtacaggacttagatgaacttgaggacattgctgagtttccaatttgtttaaacctatcaattgaccagcggttagtttttgatccattcgttaatacattaattcttagaggcaaagatggtaattcgtacaatattgatttaaagaaagagcaaagggccgaccctcaaatctctcaatttattaactttttacaaactggcaaattttcgaatgaaatataccaacagaccatggaatctcttactgatcaagccaaaaacctcgttattgactctggaattttgtattttaggtaccaggatcagtcaccacgaatttatataccaatctcattaagatcccttatttttgactcatttcactcttctcctcttggtggagggcacatggatttaaaaaagacattgaagaaatgtcgaaaatattattggcctttcctatattctgatattttaacatggtacaaacaatgtattacttgtcagctaagacattcaccgacgcctgcattcagggcagaaatgcaaatggtccccgccaatactttatttgccagagttggtttagatctagccggtccttttcctattactgaacgtggcaataaatacattttaaatatcatttgttggttctgtaaatatgtaatatccgttcccttacccgatgccaaatcgcatacaattgccaaagcttttcttagtaattgttatcttaagtttggtggttgcaccgaattagtgagtgacgatgcgacagcatttacttctgagttctttcgtgaattttgctcgttattatatattaataagaaatatgcagttccacattggtcgcaaggaaatgcggccacagagcgcacttttagaacatttaacaatattttgtcaaaatatgtcactaaagagcaaccagattttgatgaatttttagactatgccaatttttgttataatacatctgttcattccacgactcacgaaaccccatattttttaatgtttgggcgtgatccgattttctgtattgatcaaataatagatcctaggattagagaaccaattgcatttactgatgagacagaatttaaacagaaattagtgacctctcttcggagagcatggaagataaccgcagaattacatgctgaggcacaggagaaaatgaaaattcaatacgataagactatgagaactcctaatttaaagattggggacagggttttattaagaaattatgatggtaaacgtaacacatccaaaaaatttcattttccatnggaagggtgcctttagaattatagaaattgagggaatatatgccacaatcactagctgtaattcgcctcaagcaaatccacgccgtgtccatataaatcagcttaagaagtgttatgaaaatttaggggggcctgcctgcacttcacctaggcttagttcagaagagagaaattctctcgcagagttagaagcggatgaaattcacaatttgccgggtcactcacatcctactgatataccaaaacattctttttctcttatcgtgattctgatgatgaaatacccgctaatgagcccaatattgataataatgaggttaaaacatcactaacaccgcaaaatatggtctaa

SEQ ID NO: 74048 - DNA, 520 bp, Heterodera glycines
  Genomic contig location: Contig_ID=SeqID_1505; Location=6210..6729; Strand=-
  SCN-specific regions: Sequence locations=1-86,207-236,274-300,324 -362,384-403,432-520
atgttaattaacaagctttcacgcatcgacttggttcgtttttcattaggtcattaatatttaataaggtccgtcaaaataagtagaataaataattattatgaaaatttatttttttattttatagaaacaattaaattttttattatgtcttatgaatatcattttcaattaaaaaatatatattttaatgtattttttaaaatccttattgaatgcgcttttgtgttgttttcttttttttagattattttaattaaaaaacaaattaatgaatgtgttttatggaaaatactcaaaagttaatgttttatataaaaatatcaaaaatggctgtttttatgaaatgctaaaacaaaaatttaagtaattaagtaagtaagcgtattaaatttttggtaatgttttatggaaaaaatataaaaatatttctatgaaattgtttaaaattatcatcaaaaaaattgtgttactaattttaatagaattaagacaagttagagcggtagaaaaaaataaa

SEQ ID NO: 74049 - DNA, 435 bp, Heterodera glycines
  Genomic contig location: Contig_ID=SeqID_1505; Location=7563..7997; Strand=-
  SCN-specific regions: Sequence locations=1-5,27-108,131-131,153 -360,382-435
gaagacagggaagccaccaccaaaatcttggaccatcttgaagttaaggccgaaccaaccgccgtctttctactcggccggtacgacccgcagcgaacaacaccacgcccactcaaggtagtcatgccaacacccacacaccaacacatggcactcggaggatggaagcgcgagcgtgctcgactccgttctcaacaaaatttggcccgtctgttcgtccgaccggcgcttatcaaagaacagctcatgaagaaattcgaagaacgtctccgaaaacgtcaaaagactccagcttcattggcttttgcgacggagatctcaaaaacggcaaatgaccaggttcccgttgttgcaaaaggaccaaaccagaaggaggccagtgaagacatttccaaacccccgggagtttttgaccaaacaatccgtatgttatga

SEQ ID NO: 74050 - DNA, 442 bp, Heterodera glycines
  Genomic contig location: Contig_ID=SeqID_1506; Location=269..710; Strand=-
  SCN-specific regions: Sequence locations=1-113,139-198,250-347,370-378
atgacccacaccacaattggagggccgagagggttaaaggttattctcatcaccgaaccgatttccatggcaaagtaattgctttgaatgtaaacaaattgttagaaagactgatattttaataatatttatgtgtttaaaatactatgttaaattgacacaaaactaacaatttttagaatttttcaaatacataactttatttaaaaaaaaatagttttcactaataaataattctttattttatttcagtgacgaaaggttcagtgacgaaaagtttagtgacgaaaggttcagttaattttgaatacatagttttattgaatttttatccatctactaaactacaaaaaatgcatgtttattacaaaagtattgatatatttgtttttgttataatttttaattattaatttagataacaagaaaaatttttaataaa

SEQ ID NO: 74051 - DNA, 210 bp, Heterodera glycines
  Genomic contig location: Contig_ID=SeqID_1506; Location=806..1015; Strand=+
  SCN-specific regions: Sequence locations=1-210
atgcaagaaaataactcatcatccgacgaagagggtcaattgctttcatcttcatctgggaatgaagaagcggctaaccaagaattaattcaattcatcgaatttaagtcaaagcgtggtgcctcacttcttgcacgtaatgggtttgagtaccaatttgaacgcaattcggccttagttgataatgttgaatattggaagtgtgttaaa

SEQ ID NO: 74052 - DNA, 565 bp, Heterodera glycines
  Genomic contig location: Contig_ID=SeqID_10789; Location=464..1028; Strand=+
  SCN-specific regions: Sequence locations=1-328,359-386,444-529,552-565
  Gene Ontology: Mol. function=GTP binding; Cellular component=nuclear membrane; Biological process=tubulin folding
gccaattgtgctctgtttcattggcattgatggggccggtaaaacgaccattgtcaaggcattgcaaggaggtaggccaaaccaaataaatgccatggccgagcctttagcaaaaattgtcacgccccttcagaggattttggcaccgttcattccacggttggcttttcccgggcggaattgcgagtcaaaaagtaccgtatcactgtgtatgatttgggaggatcggctcgaattcgcgaaatttggcccatttatttcgccgaggtatttacttaaaagttatttcatcagcaggttaattcgcaaaatatttatttacattttgtaaaatgaaataaaaatccaattattttttgcctttccaattttaattcttggcactattttgctctttttttgtttttgtttttactttaggtgtttggcgttgtgttcgttttggatgcgagtgccgccagtcgaatcagtgagaacaaaaagatggtcgactctttggtcggactgcccgaccttctcggcaaacccattctgtttctgctcaacaaaaaggacctttccggaa

SEQ ID NO: 74053 - DNA, 523 bp, Heterodera glycines
  Genomic contig location: Contig_ID=SeqID_10790; Location=118..640; Strand=+
  SCN-specific regions: Sequence locations=1-19,206-495,517-523
atggaaaacggagagaaacaagagagagaagaaggagcgagagaaagcagaggaagaggaggaacaacggaagagagcggaaaagaaaacagagaaataggaacagcggaagggagtggaagaaaaagcagaggaggaggaacagcaccggaagagagcacaagaaaaacaaaaggaggagaaagaagaggaggaagagaaagaacagcggaagagagtggaagagaagcgcaagcagttcaacaaggcacagttgaaattgaaatgagaccaactccccgagcagaaagcagccgaggcggaagcactcacggacgaaatgcgatagacgtaatgacaacggtgggaagttgaaaaacatgctaatcactcaattaacacttcaagtgatcataggttgttgctaatatccttttgctgccctcaatttgtcactgattattaaattttgaccgattttttaagaaatattcgcccttttcccaagtattttctcttgttgtttatccattcaattatccta

SEQ ID NO: 74054 - DNA, 642 bp, Heterodera glycines
  Genomic contig location: Contig_ID=SeqID_10790; Location=419..1060; Strand=-
  SCN-specific regions: Sequence locations=1-11,65-427,449-642
cacaaaatttgccacaaaaatcacagttttcacaaaatttgctacaaaaattacattttcaattgccttttaattggaaagaatcggagggcactcgtcaattaacacttttaaatttccatgtactttttcccccatttacaagttcggattcgctcatttgttaatttaatcaatgttttcctctattgttcatttcaatgtcactttttgatttgccattgaccgaccggcggataataataatgcctttctttttgcagtcatttattaatgggggcaatgccattcaatgccccccccccacttaaagccgtccctttacaaatggcggctgtccttggcgattgaccgccgttttgtgcttcattcattaagggaacaaaacgtagctgctgaagagcacaaatatccgtttattaggataattgaatggataaacaacaagagaaaatacttgggaaaagggcgaatatttcttaaaaaatcggtcaaaatttaataatcagtgacaaattgagggcagcaaaaggatattagcaacaacctatgatcacttgaagtgttaattgagtgattagcatgtttttcaacttcccaccgttgtcattacgtctatcgcatttcgtccgtgagtgcttc

SEQ ID NO: 74055 - DNA, 1046 bp, Heterodera glycines
  Genomic contig location: Contig_ID=SeqID_10791; Location=5..1050; Strand=-
  SCN-specific regions: Sequence locations=1-821,843-1019,1043-1046
  Gene Ontology: Cellular component=cytoplasm; Biological process =negative regulation of cell growth
atggatgccaggaaaatgggtgccaaggaatcgggtgtcaaggaggcggagtccagggaagcggatgccaaggaagcggatgtcaaggaagcggagtccagggaagcggatgccaaggaagcggatgtcagggaagcggatgccaaggaagccaaaatggatgccagggaaatgggtgccaaggaatcgggtgtcaaggaggcggatgtcagggaagcggatgccatggaagcggattacaaggaagcgaattccatggaagcgaatatcaaggaagcggcggagtccagggaagcggatgccagggaagcggattccaaggaagcgggtgccaaggaagcggatgccaaggaagcgggtgccagggaagcgcgagtggatgtcaaggaagcgggtgccagggaagcgcgagtggatggcaaggaagcgcaagtgggtgccaaggaagtgggtgccagggaagcgcaagtgggtgccaaggaagcgcaagtgggtgccaaggaagcgcaagtgggtgccaaggaagtgggtgccagggaagcgcaagtgggtgccaaggaagtgggtgccaaggaagcgcaagtgggtgccaaggaagtgggtgccagggaagcgcaagtgggtgccaaggaagcggatgccaaggaagtgggtgccagggaagcgcaagtgggtgccaaggaagtgggtgccagggaagcgcaagtgggtgccaaggaagcgcaagtgggtgccaaggaagcgcaagtgggtgccaaggaagtgggtgccagggaagcgcaagtgggtgctctggcggcggctgtcaagggggaggcggatgggtacaaaaaggagtatgttcgaagggtgaaagccgccctcattaaattttttaattttcagggcgtttttcctccccttccatcgcctccaaatggaaacagaggcggtcaaccggtcattttccttgcaaatcgcaaaaaactcacttttattcagccgtgccaaggcgacctttgcggttccgctttgcaaacgccgccgcctccgctgcccagcgagcc

SEQ ID NO: 74056 - DNA, 450 bp, Heterodera glycines
  Genomic contig location: Contig_ID=SeqID_10792; Location=394..843; Strand=-
  SCN-specific regions: Sequence locations=1-129,153-190,213-391,414-450
atgaagaaaaaagcaggttcatatgaagtgttcacaaaagccgtaaagtaagtgttaaaaaaaattaagttgttttttggtagaaattggtttcctccccttcaattctccgtatcacttctctgataaaaattagaattttttgaatgaattcttaagaatttaaagttttgttttcgaattaatcgggctgggtggtggtgggcggggggagtcgatatgggaaatgatttacgagtggggaacggaagggaatgggccctcatattttgaccaccacaaagcctcgtaatgtctggcttaattttcatccattttccccaattccttttcagcgatccgtccgttttcgacgagtgcgaaatcgaggctaaagtgcgcgccaaattggtggaagaaattcaaaagaaacttacgcccaaagcactcaaaattcgagcggacatcgaa

SEQ ID NO: 74057 - DNA, 1492 bp, Heterodera glycines
  Genomic contig location: Contig_ID=SeqID_10795; Location=540..2031; Strand=+
  SCN-specific regions: Sequence locations=1-61,94-247,269-535,559 -754,817-922,945-997,1020-1186,1213-1492
atggccgaatttgcccaccgagccggtgctccattggagtgcctttgcatggctctgaaggtaaaaaaaattaaattaaataatgaattaaaactcaatttaaatacccaattaaaactctaattaaaatacacaacaattatatctgtaattcaaatgtttgaaaggtccaaaagcgtcaggaaggaacggacgccgaaggcaatccgcgatggaagtaatttaatattattaaaatggaaaaaaattcccccgtgtccttttaaattattttggtgggttttcgaagttgctggttacacgaatttgacatcaattttgacaaacccgaattgctaattgaactcgaaaacaaaaattaaaaataggaaataaatgaaatttttccaaccctttgaattaagttaggtattcggatttggtcgaaatgggcgtcataaaatgatcttgactccgaaaaaaacttaggtaatttccgattttatataaaaaaggttctccctttaataactctcaaagaaccgtaaaaatgattgtttttaattttattaaagaattggcataagtattggcggtggcattgaccaaaaccatcgacagtccgtctacagtgattccgtctgttatcaattttatgaaaaaaacgatgaataattttcttaattgatatgctaacaatatgatttgattgtttatatatatatataacgaacgccctttttatggtggcttttatataacgactatagcaccctaaaaaacaaattttatcaaaaataaatttaatttgtaaataatttttttgaattattattaggcaatcctaaagaatgggggtccctaatttttaacttcccattctttaggatggtcgataattacataaaatgattaaaattttcccgacttaagggaatttatgtgacaagcgtggaagcaaagtgacgtgccaattccttcttgaccatttcatatttcgattttaagttcacccgcggaagaagctggactgaaagtgcatgacaaaattctgcaagtgaacggcgtcgattacgtaaaaaacagaattaaattacaaaaaaaaccattgtttttatgcatatgtcggtaaatgaatcatctttggggtgtcttttttatttttattacattttttaaggatttttccaaaaatcccgaaagtaggcgcaaaaatggcgaaaaaggcacaaaagcgttttgttttttgcttatctgagcgtatcaaacgcacagaaattttaggctttttttaaaaatggcagccctaaaaataataatttattaagcattcatatttatcggttccacttttttttgcagacgatgatcactcacgatcgagcagtcaaatatttgaagaaggagccggtgttggatttgctggtcaccagggccacagcgaaacccagcacggaagtgcaaatgtgaactgcttgccggaggaacgaactaattgcacattaagtccgaa

SEQ ID NO: 74058 - DNA, 325 bp, Heterodera glycines
  Genomic contig location: Contig_ID=SeqID_10796; Location=216..540; Strand=-
  SCN-specific regions: Sequence locations=1-47,70-71,94-325
atgtgtaagcaaaacgaagatttgtatttttcgtgtcataagtttaacatttttcccccaaaagtttgtgagaaaatttttaaaatatatttgggcatattagcaaagattaaggatatccggaaaacaaaatcaatggcagtaatacatacataaataaaagttcattttaattcacaggaatttaattcttttttttcagaaatgggtaaaataattgggtgcacaattttccgcattacttttgctgcaaatgtaattggttttaagccgcaatttttatttacatcatttatggcattttcgatctttccttgataataaa

SEQ ID NO: 74059 - DNA, 1272 bp, Heterodera glycines
  Genomic contig location: Contig_ID=SeqID_10796; Location=738..2009; Strand=+
  SCN-specific regions: Sequence locations=1-220,242-496,518-634,656 -1066,1088-1115,1137-1272
  Gene Ontology: Cellular component=extracellular space
atggggaaaataattgtgtgcacaattttctgcggtgtcttggctgcaactgtaattggtctcaagccgcgcggaccgccctatcataagggacaagaacgttttggcccaccaccaaatggccaacatagcccaggaaagttcggacccccaccgcccaacagctccgaccttccatcgccggaaagcagctctgacgcttcggcccgtaaaaagcgcattccgttcggcttccgtccccatggcctaccaccaaatggccaacatagcccaggaaagttcggacccccaccgcccaacagctccgaccttccaccgccggaaagcagctctgacgcttcggcccgtaagaagcgcagtccgttcggcttccgtccccatggcctaccaccaaatggccaacatagcccaggaaagttcggacccccaccgcccaacagctccgaccttccatcgccggaaagcagctctgacgcttcggcccgtaaaaagcgcattccgttcggcttccgtccccatggcctaccaccaaatggccaacatagcccaggaaagttcggacccccaccgcccaacagctccgaccttccatcgccggaaagcagctctgacgcttcggcccgtaaaaagcgcattccgttcggcttccgtccccatggcctaccaccaaatggccaacatagcccaggaaagttcggacccccaccgcccaacagctccgaccttccaccgccggaaagcagctctgacgcttcggcccgtaagaagcgcagtccgttcggcttccgtccccatggcctaccaccaaatggccaacatggccttggaaagttcggtcccgcgccctgcaacagttctgaccttccgccgctctcatcgacggacagtgaatgagcaatgaatgtttggatgatcaaatgcacattatcattggaaaaaaaatgcttgaattatggcatagtttatatgagaatacattatgaagtgttgattatttgacgcattttgtggaaaagttcccgagagtcctctttttcagatttttctaatttgcgtgttggaaatgatttttaaaagaagaattaccaattttctcagcaaatctataaaactgcttattttaaataattataattcagtgaaaagctttcccgttcattatgccaatataattacccaattaattagcattacgcatggattgactttttatataattcataattgggactcggaaaattctttaaattggcataggaaattttttaccaa

SEQ ID NO: 74060 - DNA, 80 bp, Heterodera glycines; identical to SEQ ID NO: 62154
  Genomic contig location: Contig_ID=SeqID_10799; Location=824..903; Strand=+
  SCN-specific regions: Sequence locations=1-80

SEQ ID NO: 74061 - DNA, 1262 bp, Heterodera glycines
  Genomic contig location: Contig_ID=SeqID_10801; Location=76..1337; Strand=+
  SCN-specific regions: Sequence locations=1-247,269-525,547-567,598 -799,821-1214,1245-1262
atgtacgaattggcgatgcgtttgcgccgtgaaattcagtcgcgcgccatgctgcaacggcggagtgccgcgctgtcggtcgcctaccaaacaatgcaaattgacatggacgagccgaacatctgttacgagccgacggaatacgaagtaatatttttatacacggcacaatgcattgcaataatgccaaatttcaaatgtatcgccaaaatgccatgcattttatgggccctttgttataaaaacttattttaaattattttggaattttaattacaggacgaccaactgctgttggctgcggatggtattgaacgttttgctggcgatggagccggtgaagacggagcagacagaatggcagtcacagattttgagatggtcgacatgcaagcggaggaacaacaaagtattgttgttgttaaatattggccattaaaatatttacggaggataaatgcaattttctaattgatttcgtttccaaaattcctaacatttcgactcgacttggcctttacatccggaaaatatgttgttgaacagtaccattttccattgttcagttgctgctgctgctgctgctgctgctgctgcacgaccacttcgaacccgtgtcgtgatcaccaaagaggacgtggcacagcaactgctccaagcggaggcgcgcttggcactgctggacgcggacgcgcacatggtgccaccgctggtggacgaggacattttgcgcgagtcgctcaaccacaaacgcttcgacatggcctggctgttgatcaagttggacttgagaatcacgaataattttgacaattttaaatcggtcaaaaaaacgattttttcctcgtcaggcaattcgagttgaaaccgtacgagctgttggaacgcgtcacggagcaggcaatccgcacggatttcgacgctgaagacgacgatggtggcggtgagggtggcgactcctcgtcttcgtcattcgttggtgtaatggtctctgacgaggggtgcaaagatgtcgagacggccgacacgagttttggtgccagacagaagaagaagcgggtggtggacgacgagttggaggagttggactgggtgatgtacaaccggcagtatttgggcgacggagggtctgtttttggatccttattttgcaattcatataaggaacacgatccacttaagttctatgatagttgcgcccttgcgacggattgaaaaatttgtttaaaattattaaaatttaactggaattcatttgttca

SEQ ID NO: 74062 - DNA, 1425 bp, Heterodera glycines
  misc_feature (1350)..(1350): n is a, c, g, or t
  Genomic contig location: Contig_ID=SeqID_10801; Location=2502..3926; Strand=-
  SCN-specific regions: Sequence locations=1-417,440-486,508-1057,1079 -1210,1232-1425
atgaaagagaacaatgaatggcaaaacgggcacgcccactttgataagccaacggaaagtgagtgccatttcgcaccagggcaccgtgttcagcatacggcacgcgatacggtaggtgtaggcgaacggagactcgcgccgctgcttggccaattcagtgtcgacaaagcgctgaaatggaagcaaaattgccagcaaaattcagagggacgagcactaatgatcgctaatgactagtaaaatttatattgatcaattcgatctaaaaattcatccaaaagatagtgatctgaaattatagatataatttggcatccaaaacgcataagcacacctttaaacgcctggagcgttttggattttgccacgcccactcgaagcgaagtgccgaaattgcgttcggaaagccatgcacgatgcagaccatatccctggacagagaagagcagcatgacatcatttttgttacaaagcctgttgatcagtgtttgccctggtggttttctgatcagtcccaatcaacagcctttgcctatcgcttcaactcccctgatcagcagatgttcttgggcttaactcaaggaatgtacgttatgatcaccaatcatcattatttgtttatccaccgttggatatcgaaatgtcaagcccattagaacaaattcacgagggtcggtcccgaacattacacacactactttggcattttattatcccattcccggcacggcaccatggtccccggttgtccgtcttcttcgcgccgcccgcttgtctgcccgcgttgtgctgccgaatgcgtctgttcgggtccaccgtgaagccgatgtaacagcggttctgttttttaattaaataaaataggcaaataatttgtctggattttgaatttgccttatagcacttctccacacttttgctgacaaggcaataaacgccgaagaattcgtcgggcaccaacttttgtttgggcggcaacagctgagaaaagcggacgaatgaatcacaaagaatggagtgccgaaatcagaattggcattttgaactcggtttatctatcctgactaatcaggcaaaacaaaaaatgcgtccagaatttctgcggaacagaaaccgggcccgtgcccaactctcaagtttttaggaaacgattttgttatcgaaatgccggattaagtctcgaaccaatgtgccgaaaaccgaccgctaattgaaatttgagaaaaaggaagcagcagattcattaattgttgaaaaagctacccaccggatcacacaaatcctccaagttgatccgtttgccggctgtgatcattattcgctcactcaactgacaacaaaacattttanggggggcgggatcactttttccaaaaacattttgattgactaattaaacaaattgcactaatttatgcgaataaa

SEQ ID NO: 74063 - DNA, 1276 bp, Heterodera glycines
  Genomic contig location: Contig_ID=SeqID_10801; Location=2612..3887; Strand=+
  SCN-specific regions: Sequence locations=1-84,106-237,259-808,830 -876,899-1276
atgatcacagccggcaaacggatcaacttggaggatttgtgtgatccggtgggtagctttttcaacaattaatgaatctgctgcttcctttttctcaaatttcaattagcggtcggttttcggcacattggttcgagacttaatccggcatttcgataacaaaatcgtttcctaaaaacttgagagttgggcacgggcccggtttctgttccgcagaaattctggacgcattttttgttttgcctgattagtcaggatagataaaccgagttcaaaatgccaattctgatttcggcactccattctttgtgattcattcgtccgcttttctcagctgttgccgcccaaacaaaagttggtgcccgacgaattcttcggcgtttattgccttgtcagcaaaagtgtggagaagtgctataaggcaaattcaaaatccagacaaattatttgcctattttatttaattaaaaaacagaaccgctgttacatcggcttcacggtggacccgaacagacgcattcggcagcacaacgcgggcagacaagcgggcggcgcgaagaagacggacaaccggggaccatggtgccgtgccgggaatgggataataaaatgccaaagtagtgtgtgtaatgttcgggaccgaccctcgtgaatttgttctaatgggcttgacatttcgatatccaacggtggataaacaaataatgatgattggtgatcataacgtacattccttgagttaagcccaagaacatctgctgatcaggggagttgaagcgataggcaaaggctgttgattgggactgatcagaaaaccaccagggcaaacactgatcaacaggctttgtaacaaaaatgatgtcatgctgctcttctctgtccagggatatggtctgcatcgtgcatggctttccgaacgcaatttcggcacttcgcttcgagtgggcgtggcaaaatccaaaacgctccaggcgtttaaaggtgtgcttatgcgttttggatgccaaattatatctataatttcagatcactatcttttggatgaatttttagatcgaattgatcaatataaattttactagtcattagcgatcattagtgctcgtccctctgaattttgctggcaattttgcttccatttcagcgctttgtcgacactgaattggccaagcagcggcgcgagtctccgttcgcctacacctaccgtatcgcgtgccgtatgctgaacacggtgccctggtgcgaaatggcactcactttccgttggcttatcaaa

SEQ ID NO: 74064 - DNA, 412 bp, Heterodera glycines
  Genomic contig location: Contig_ID=SeqID_10802; Location=315..726; Strand=-
  SCN-specific regions: Sequence locations=1-47,70-117,173-340
atgtccaaaaatggcgagcggaagttaattttgttggtgagttgagtaaaatttctaatttttaaatgattttgctgggcaatttattagttattttacaattttagggaattcatgaaaaaaaattatataagttttatatacatttttgaattaattaattcaataatttgaggagggcatggaagattacgaagaaaaaaagaaaattgaagaaaaaatgaaatttattttcatttgaatttatttatgatcgtaaaaattattattcttcgttatttttgtttattcattaacattgaaacctgataaatggaaaagatgtttctgtttaaaggtcattaattttttaaattagaatttatatttttgtttgactttttatttcgttaaaattaaaaaaaaaaataaa

SEQ ID NO: 74065 - DNA, 1379 bp, Heterodera glycines
  Genomic contig location: Contig_ID=SeqID_10802; Location=3013..4391; Strand=+
  SCN-specific regions: Sequence locations=1-131,172-429,451-518,567 -674,698-699,721-893,927-991,1017-1069,1091-1142,1184-1320,1354-1379
  Gene Ontology: Mol. function=ATP binding; Cellular component=membrane fraction; Biological process=oviposition
atggccactttactccatggaatgcaaaggctgaacatcccatttcacaatccacgaattgaagtaagatataaatgatcatcaataattgtgatccggcattgcagcgtggccactgctaatcttttaatccattttttccataaaatttttgttttaatcagaatgaagcaatgatcataatggaggtggtaaatcatgggaaagaatcagagccattaagcgatgaattagcacatgccattaaaacattatgggcaggtaaaggaaataaaattgtaaaaaaatggatattttgtaacgatgaaatttaaaaaatggaatatttagataggaacattagagaaaaggtttatcctcgagggcaggaatttcagtaagtgttaaactaaattgtatttgatataataaaaattattagttaaaatccttaattaaacaaacattaattataaaactttttgatttgtatgcacaatttccttcatttaggcttgtggaaaacagtattttgtaagaattttatttaaaatataataatagttaaacatttattatattatatagttttttggaatcggttgatcggatcgcaaaaccggattatcgtccaactgagcaggacatactgttatcaaggatcaaaacgacgggtatcattgaggtgatggtacatatttattatttttaaataaatctaaattgccattttattaattatcggatgttacgattcagtttagcttacatttatttaccacatactagtataccgtattttctctaattatatgcccgtctcattaatatgcccgtcaccaattatctccccctttctgatgaggttgaaaaataatctctccgtcttaatcccccgtctccgattatctcactttataattaataaaaaattaattcaattttaaggttaaattcaaaatgaaaacggttgatttccgcgtatttgacgtcggtggacaacgttctgaacggaagaaatggattcattgttttgaagttggtgttttcttttagtttcataagatcaattttccaacctaaactggtgccagttttattaccaaaacaacaccaattcgaaaatttaatctcgaactaattctgaagaaattaaaaatctgttaataatttatttatatttaagtaaaaaaatctttaaatagtattaggaattctttaaaaaaaaagtttgttaaagctaatctttcttgattaaggatgtcaacgcaatcattttcatcacagccatcagcgaatttgatcaagtgctttttgaggatgaaacaacggtaattgatgaattttataaaattaaatattattttatatattcagaacagaatggtcgagagtatgag

SEQ ID NO: 74066 - DNA, 472 bp, Heterodera glycines
  Genomic contig location: Contig_ID=SeqID_10804; Location=1765..2236; Strand=-
  SCN-specific regions: Sequence locations=1-184,209-236,275-472
atgactgattccaagaatgacgagttcaacgcaaaagggcaaatggtctgtcccccaatgctcaatttctgcttaaagatgagctgcgcttcagcagttggtaaccaaagaatgttgggctcttatttgttagtgacaaatgtgtatttaagtttagccttttttgttccaaatctttgcattgaaaaatgaaattaaaattagcagtaaagccttcaaaatgacgcttcgcctaatgaaaagttttttaaaaatttatctttatttcaagatagcggccatgtcaagggctgtgctaatatggatatgtgcgcaggaagaggtgatcctcattttgaagtggccagacgtgaccccagatgcaaattcgattgttgcaccgggaatttgtgcaacggtgcgctcggcacgcacccatcgcttggcagtggaggcgccgttttggtcccattggtgattgccattttggccg

SEQ ID NO: 74067 - DNA, 375 bp, Heterodera glycines
  Genomic contig location: Contig_ID=SeqID_10804; Location=3051..3425; Strand=+
  SCN-specific regions: Sequence locations=1-375
cggaacgggccaactccgtctgagccaactttgagtcaatataactcttgaagttattgaccaaatcaaacaatcttgatatcattcgaaagctcttcacaggctctattagcctactaaaaattacagaaaatttcgaactataaaaaaaggtagaaataaaaaactttgaaaattctgccttttttgcggttttcaactgacaacttttttgagagctgattaatcactgagaaataccttataaatatcttctaaacatctagggctttcgaatgataccatgattgtgaagtttggccaacaaagaaaaaagttatagctttttgaacattgctgagacggagttggccagacggagttgacccctaccgt

SEQ ID NO: 74068 - DNA, 98 bp, Heterodera glycines
  misc_feature (5)..(5): n is a, c, g, or t
  misc_feature (29)..(29): n is a, c, g, or t
  misc_feature (36)..(36): n is a, c, g, or t
  misc_feature (38)..(38): n is a, c, g, or t
  Genomic contig location: Contig_ID=SeqID_10804; Location=4262..4359; Strand=+
  SCN-specific regions: Sequence locations=1-98
atgancgcactgaataagatggccgcggngtataananaagtgtactgccccccccccccctcaacaccatgtgcatgaatatgcgtgtgtgtgacag

SEQ ID NO: 74069 - DNA, 476 bp, Heterodera glycines
  Genomic contig location: Contig_ID=SeqID_10805; Location=11..486; Strand=-
  SCN-specific regions: Sequence locations=1-28,50-258,285-317,339-476
atggtctttttaattgaaaaaattttcgtaaagatttgcttcattttccaaggtaagaacggtatcctctacagtacccacaagacctgcatgtccgataaagactgtagacaagggagtaatgaaacagacagttgcactaattactgttgccagggggatttgtgcaacggcgtgatgcgaaccgtgcacacttttggcactggaaacagcatgattttggccgcactgattggcattttgactggtaacggatggaatttaaaaataaataaataataatagctttaatattcttattttgtacaggaattgccattttgcattgaactaaaatgggagaagaaacattgccaggcgaaaaaaggcatacaaattgtgattttacttttatgcgaatgtattggaaagtaaatttttgtactttaatattttaaatgtgtgattaaaacatacccagggcatttgttaataaa

SEQ ID NO: 74070 - DNA, 573 bp, Heterodera glycines
  Genomic contig location: Contig_ID=SeqID_10805; Location=793..1365; Strand=-
  SCN-specific regions: Sequence locations=1-24,46-66,107-348,380-573
atggcgccttcatccctttttccgatggtttctttggcatttattgtgtcaatggcaaatggtaagttaaaaaatattacataaaaataaattcattaattattttcgccggcgcctaaaattgacaaaatctttttttttattccgatacaaagaatcgacaaaaaagtcaaaaaatagaaataaataaatgcaaattaagcgaaaatgtgtcatacaaagattttaacctatataaatatctaagaatgcaaattgttggtactaataattggaacaaaatcttgctccatgaaatctattaaaattcaaagctacaaattttaaatcgggtcgtaaatttccggtttcataacatttgctcattttcagcacttgaatgttggcacggtgttcacaatgttaccgcaaaaacgagcaacattccgataaagagtgaagcagagcagggaaaatgccccgatcagttgaacaattgcgcaaaaattgactgcaaatacaaaggtcagagatcgtttttatatgagaaggatcattaaacactgtgctaatttgtgagtttaaatgaataaa

SEQ ID NO: 74071 - DNA, 506 bp, Heterodera glycines
  Genomic contig location: Contig_ID=SeqID_10806; Location=32..537; Strand=-
  SCN-specific regions: Sequence locations=1-75,97-191,251-350,407 -430,456-475,497-506
atgttgccaattcatggccttgtctcctcactgtacagcgtgtttggcgttgtgttctgctcaaatgcgtctcttaattattttattggttcatgtggggccggtgagaaaaaaagcaataatttttttataaaagtaaatagaaaagtcagtaaatttttatgaccaaataaatggagagcttagcttcgtttaatattttttgataatctaaaaaatagtttttttatgaaatttaaatgttattttagcgctttttgcggccgagtcgagtgctaatttattcttggcattggaccgattggttgaaacattttcgcccaaatacaatcaaattttattttcaggtgaattaaaattatatgtaaaaattaaatattatttaattgttcaatttataaaaataggaatttattaattcagtgcttaatttttacggaaagaaaaacatgaattctgattatttaaagacagaccgggatgcttggtgcttgctcgatcgttaa

SEQ ID NO: 74072 - DNA, 1264 bp, Heterodera glycines
  misc_feature (105)..(105): n is a, c, g, or t
  Genomic contig location: Contig_ID=SeqID_10807; Location=559..1822; Strand=-
  SCN-specific regions: Sequence locations=1-241,263-324,346-694,716 -786,831-1264
  Gene Ontology: Mol. function=single-stranded RNA binding; Cellular component=transcription factor TFIID complex
gactacggcggggaatgtgacggaggacgcggacaattcggctacgcgggaggatgtgacggaggacgcggacaattcgactacggcggaggatgtgacacagancgcgtacaattcgactacggcgggggatgtgacagaggacacggacaattcgactacggcgggggatgtgacggaggacgcagacaattcgactacggcggaggatgtgacagagaacgcagacaattcgactatgatggagcatgtgacagagggcacggacaattcgactacggcggaggatgtgacagaggacgcggacaattcggctacggcggaggatgtgacggaggacacggacaattcgactacggcgggggatgtgacggagaacgcggacaatttgactacggtggagaccgaaaacaactctcctacggtagatgccgagaagattgaatcggacaaattggctacagtttaaactgaagagttaagatgaagagtgcatattgtcttaaagtttcttaatttgtctatttaattttcatttttgtaatatttttgggtttctcaattttcacctttttctttaattaatttgcattattttttgaatgaaccgtgagaattatttatgacagctgaattcaatttacagcattaaatgtaatttgtgctgacttgacaaaactgaggaatgttttactttttcataaattttatcattatattttgaatacctttttttcaataagaaattttaatatttgaaattctgattctttagatttttataggttttaaatttttttatgattaaaatttataattaaaaaaaaattcaacgaagaaaaattattaatcttacaaaacccataaaattgttatttttatatgttcataagtaggacttatatttttaggctctaaaaatccataaaataggcagtaaaaaacctaaaatttagggggtattaaatgacaaaatgtattcaaaaagtaataaaattaagtcatatgggtgtatttttgaaactttaaggtgcttcttagtgatgtatatttcgttttattgcatctttgttataagggcaaaatgccaaaataggcaaaaatatgggtttttcaaatttttttatgcatttgactctaaaaataaagatttaagaaataagtgctaatgactcgaaaagtagcttacaattaacaactaccaaaaaaataacaacatatttttcgtgcattttcagaacatagggagctcaggaaaaaatag

SEQ ID NO: 74073 - DNA, 483 bp, Heterodera glycines
  Genomic contig location: Contig_ID=SeqID_10810; Location=62..544; Strand=-
  SCN-specific regions: Sequence locations=1-85,133-225,286-428,457-483
atgccaaaattggcaattttttgttattcaaaaagcgattgtgcagtattagcggaactattcaacagccacatgaaagtgaatgtaattttttaaataaaatattaatattatatctcaatttattttttagaccattggcccattatttagcaattcattgagaggaaaaaaagaacatttaatgacaaatttggataaaaaaatgatggaagttgataacggtaattataattattttatagaaaataatttgtttacttttgtgtatttaataaataaaatgaccactttttagcaagttggacggtgttcaccgtacaaattggtcaactaaataaaatgaaattgacacccgaacaattaatgcgcaaatattccattgacaaagctcttataatatggcatcaaaacaagaaaatgcaacgaaaatttcaaaataaaaaataaaaaaatgctttttcagcttaccaagaaatgtga

SEQ ID NO: 74074 - DNA, 794 bp, Heterodera glycines
  Genomic contig location: Contig_ID=SeqID_10811; Location=532..1325; Strand=+
  SCN-specific regions: Sequence locations=1-113,158-208,230-239,262 -427,462-794
  Gene Ontology: Mol. function=electron transporter activity; Cellular component=extracellular space; Biological process=lipid metabolism
atgaaaaatttccttacatttttggcttttttcttaatagtgccatgtttcaaggctgacaatgagaaaaacaaagcggcaccacgagtgtttgctgaacatccgggtagaagaaattatcaaatattaaaattaaaaaattgatttttaaattttagggccaaaattggtggacgaaaccacgcgatggagcaaatgccaagcggaccaaaacctgaccatttatgacttcgaagtggaaacacttgacggcaaattcaccaacttggagaagtacaaaggacaaattgtactgctaattaatgtggcaacattttgcggtaaaaaactcaaaaattcaaaaaaaacataaatattttttcagcgtttacccaacaatatttggacttcaatccaatgctggagcgtaaccgtgccaacggcgtcccattgacaattttggcatttccatgcaaccaattccatttgcaagagccggccgagaaccatgaaattctcaacggggttatgcatgttcggcccggagacgggtggaaaccgcactccaacctgcacatccatggcaaattggaggtgaacggcgccaacgcacatccgttgttcgactttttgcgcgactcggtactgtttttcgacgctgctaacaaaggaaggtccccaggtgtccgtgggatttccaaatgaaatttggtgggtggatagagcacccatgggttcttaagaaaagtgtttttattttctgcgaaatgagtacgagtgccgagatatgacgtgccaaacttttttctatccca

SEQ ID NO: 74075 - DNA, 143 bp, Heterodera glycines
  Genomic contig location: Contig_ID=SeqID_10811; Location=1175..1317; Strand=-
  SCN-specific regions: Sequence locations=1-143
aaaaaagtttggcacgtcatatctcggcactcgtactcatttcgcagaaaataaaaacacttttcttaagaacccatgggtgctctatccacccaccaaatttcatttggaaatcccacggacacctggggaccttcctttgt

SEQ ID NO: 74076 - DNA, 855 bp, Heterodera glycines
  Genomic contig location: Contig_ID=SeqID_10812; Location=600..1454; Strand=+
  SCN-specific regions: Sequence locations=1-27,49-283,305-372,394 -413,437-579,609-697,719-734,756-855
atgtgggattcgaacctgcgagggcaaaaagggaaggcaggagcacaacctccgcaccaccgaacaacacaaacggtgcaaatgtttattcgatttattgggatagaaaaaagtttggcacgtcatatctcggcactcgtactcatttcgcagaaaataaaaacacttttcttaagaacccatgggtgctctatccacccaccaaatttcatttggaaatcccacggacacctggggaccttccttttttatacgtacttattttaagaaaaaagtctttaaatttaaaggattctaagaaaatgttccttgtgtttgtgtctaaaagcaattattaacaatttttggcaaaatttgatttttgatgctaaatcataaatttgttgtttcattaattcaaaaaattgtcatcctaattaaaataaaaataaaaaaactaacgaatatatactcaaatttttccattcagtgccctcaaacggtccctgtgcttgggatcaaggaatcaatgttctataatccgatcacggtgactattattgctttttattcattttttcaacagaaaaaatctgaaagtatattaaaataaatttgtaataatttttgtaggtcagtgacatcacttggaattttgaaaagtttttgatcgacgctaacggagttcctcgtttccgttttcacccaacaaattgggtaaaatatattttaataatttcacttttgagttaacattttttattttagtcccatggtaaagaggtccagaaattcattgaccagctgtcagccgaacagaagaaagagcccgtgaaaaaggcatgaaaaggaagtgatttagaaatttggaaaaaa

SEQ ID NO: 74077 - DNA, 386 bp, Heterodera glycines
  Genomic contig location: Contig_ID=SeqID_10813; Location=2103..2488; Strand=-
  SCN-specific regions: Sequence locations=1-165,187-386
atgaaaatgcaagtgaatgcttcagctgatgaactcagaattgcacagttagttaacccgtccttaacaattttcagactcacttaacccatttcgattaaaagcgctctttttggtcaaaatatgtaaatttttgcctccaaaaaggtagggttttttcggaaattaatgaaaatgaaaacataaaattttgtcccttctatctctgatttctaaagcttatggacgggtaaactgcaattttccgcttaataagaaggcattttctatcatcagacactctccgccacgtcaaatcatccgaattctgtggcatcatttgccagggggcaattgttgcggttgcccttgtgcgttggcttaagttcaaaattcaccaaaataaa

SEQ ID NO: 74078 - DNA, 957 bp, Heterodera glycines
  Genomic contig location: Contig_ID=SeqID_10813; Location=2659..3615; Strand=+
  SCN-specific regions: Sequence locations=1-89,111-189,211-454,476 -566,588-620,642-957
atggaaacggaagaaaagaagcaaatgacatggaccgacaacgtaccaggtgttttcgacagtgattggttttgacagtactttttaattaatttctacataaattattgtatacatgaattagtattaatatataatttgcatatacaaaatttataattgaagtaagcaataaaaaaaagatttgtataggattttttgtcaaaatttatcgttttcactttttctatataaatatctcctgattgactgtagtcaaaaatacaaaaatttacttacaaatcatgtgcgaacatctgctaactaatgtcaggtttgagtgccaaaatctaataatacttataccattagaacattaaaaaaaataaactttactgtcgaaaccaacactgtcgaaaactaacagcaccactgacaaagtttgtgtgttcggtagggctgtgcgagagtctcgattcccgactcgggaaatttctcaggtttttcgcttctcggtctcgggtttttagtctcggaaacccagaaatttttacactgttaaggatggtcattgcggggaaggggtcgccagcgaagggagaaaagaggaaaaattattgaaattttggacaagttttcttaataaagttcattaaaatcgcaaaaaaatttcccgttggcgcctatcggcgccgccaggccacaaaattcccctaagttcaaaatgtaaagttatattgactcaattttgttcagacggtgttggtccgttccggtttatcggtaccgctgactcaaaaaacttatactttttcataaaattggcctttttggtgcaaaattattactaaatcgcacaaaaaacccaattttttaccggcgccgccggtgaattttcttaaaaactggactggcttaaaaacaaaaatttggtcattttagacaaaatctgttaattttagcttttaggtgctaaaa

SEQ ID NO: 74079 - DNA, 304 bp, Heterodera glycines
  Genomic contig location: Contig_ID=SeqID_10813; Location=5347..5650; Strand=+
  SCN-specific regions: Sequence locations=1-75,97-304
atgtccttctgctgctgtggcaatcatcagtcacacaagcaatcagtttcaattttgaaccatttaaaacatttgagaaaaatctttgattgtaagaaaaatttatgcttttatgaccaatatgagcagatttaaatttattaaaatgtcgaaatatttaatttttaggcactgtattttttgaatttgaaaatttttttggaattttacaaataaatattacaaatattattttgcaatgaatttatgcatattgacgtttaaattcattcaaatgatggtttactttttcgtgtatttgcca

SEQ ID NO: 74080 - DNA, 3086 bp, Heterodera glycines
  Genomic contig location: Contig_ID=SeqID_1508; Location=143..3228; Strand=+
  SCN-specific regions: Sequence locations=1-578,611-636,658-803,825 -1057,1080-1126,1153-1506,1529-1617,1643-1744,1766-1901,1923 -2002,2024-2769,2791-3086
gcaaaatttccaccgctttgaagtgctcgtgttccaatcgccgattgtacgaattatgctcgaaattttgaacatcaccgtgtttatggtgaacatcaactatttcacaattacattttttaaatgtttcctaatttggcattctgtcactcaggagctgagcagtcgcaaacacatgtacttccaaatatccaattttgctgggatgatttccatgttcattggctcctacagctcttatgtaattgtgccgcttggtgcttcgatgttgcacgaatatcggcacgtcacatttttcaacaattttatttcaaaaaacgaaatttttcagttttttgctgctcttccgtatcgtcgacttctgccaactcttttggtccgtgcaaaagttcgtcgccgacatcttcggcattctcgacatggtgccgagcatatcgcacaattccgccccattgccaccttcggcggtggcacaatgtgagcagaacaccagcgaaaaagtggcacaattatcttttggcactttgtgaaaaagtggcacaattatcttctggcacttttactagaattttcgagagaattttttaattaaaaaataattcaaataattcccattcattgtcctttcagtttacatttgctttgtgctctgtgtcgagatgcttttcgtctctttgttggcaaccttttgcttccaaccctcgcgctgtgccttttttgacaattattggaaacggaatgccaaggacaatgccaacggggaatgtgccgaggacggatatgaacccttgaatgacgacggcattgatcaaaagcagcagcagcaaacattgacgagcaccatttgagaagtgaagaatagagtgataagcaaaatgtgatcgggaaaaagtgatcgaaatttcgttttgtttattttttcgccaaattcactcataattacataacaaggccatcattaggtaaactaaagttggtcactgattgagtaatactgcagaattgcggtcaacaggcaaattttttgaaaaattagaacattttcttaccatacatcattaaaatttaaattattttttcttttttgaaaatgtgactccaaaatcggtctacgaaagttgggcccccacgtttgggccccagcaaatttttccactataactttctataacttttttcttggtcatccaaagccaaaaacttggtatcattcgaaagcttaacatgtttagaagctttttctaagctatttcttcgcgattagacaattaccaaaaaagtcatacatgaaaattacaaaaaaagtcaaaatttttgaaattttttcttaataaattttttccaggcttgaaaatcatttcggtttttgtaaggctaatagagcatgtgaagggctttcgaatgataccaagattattagatttggatgccaaagaaaaaagctatagtggaaaaacatgctggggccgaaccgtggggccgaactggcgggttccgacatttagggaaagggaaaattttataaaaatagaaacatttcgccaatgctacacaaattttttgtataaaaatgcttattttttcttcccctctcctcattccattctctcattattcttcctatatcccccggtcactttgttgctgcaaatgtcttcagaaattctgtacgtttattatatttcttttaatgacatttcgcatttaattttgtcaaattttggccaaaaattgtgagatgaaaaatttcaaaaccaattttgaaagattagctttttggaggctaaaacttcacattttacttcctattcattgcttttcctttccctttgattcattaatttcgccaattcatttttcagttggtctactgtttttcttctattggtcgattgtgccaccattcttttttggttcttttttggccatgtcaaaaaacgacaacgcccacataaaaacgaaatgtaaaataaattaaacgagatatcgaaaaattcgtcaattttcagctttatctgcggcgactgttggcttttggtgttcgattttcttgcgccttctcaactcggcctcgaaattgcactgatcaaccgccgctttaactgcatcgtcgacgaacacttcaagacacgcaaatggaaattgggctgcatgcgaatttgccacaaaattggagaaaatggcactaagcaattgcaaattgtcaattccaatgcaaagccattgccaattccgcaaaatccgttgcccaacaaagtcatcggattcagacacattcagatccagtatgattgattaaatttgatttgctttgtgaccattatacatatttttcggcttttcagttacatcgatcaaaatgtcatcgcatttctccgccgttttcaccgtcgtattttcgatgtttgttcaatggttttgtacattcacacagacaatgaccgcattttggactactttttgctcaacatttggccaatgtttcgtcattcaatgcgtctgatgaatttgaattccatctctttacgccgtctgcgccaattggccggcccgtcactgctcagcgattgtccatcacttcgctttgtctcttttaatgaagccattctgcccgcttttccgcctgatgaaagtgtcaatgcttcggatggccaagcgctggccaaatggctgttcacgccccgtccggatggtcagttcaagtggttcagaggctttgtcaattcaccggatcaatggtctccaacgatggaacagctgaaaacggtggagcattccccatatttaattggttttttttgtcacatttttaggcattttccaatgcttcttctccaattacttaccgcatttccttggcgttttcgtccacttcaattgattccgttgtgccatttgatgatctgatcaacgaagtgactggggagaaattgacactggaacaaaatgacacaaatgattgttggctcagccgttgtccaattgcatgggattaccgaaagtggaaaaatctgtcagatggaatttttgatcaaatgaacccaattgacattctgatcagtgatggcggattcgacgacgggtga

SEQ ID NO: 74081 - DNA, 494 bp, Heterodera glycines
  Genomic contig location: Contig_ID=SeqID_1509; Location=513..1006; Strand=+
  SCN-specific regions: Sequence locations=1-158,193-222,244-294,316-494
atggtgccgagcatatcgcatgatcccgccaaattgccctcttcggcggtggcacaatgtgagtagaacaccagcgaaaaagtggcacaattatcttttggcactttgggaaaaagtggcacaattatcttttggcacttttacagaattttcgagagaatttttttaattaaaaaaataattcaaataattcccattcatttgtggtcctttcagtttacatttgctttgtgctctgtgtcgagatgcttttcgtctctttgttggccaccttttgcttccaaccctcgcgctgtgccttttttgacaagcagcggaaacggaatgccaaggacaatgccaacggggaatgtgccgaggacggatatgaacccttgaatgacgaccatacatgatcaaggggtggtaccggccgagggccatacgatgtatgattgtaccagggggggtggtacgaggccaaatttttttacgatggggtccaaaaattcaaa

SEQ ID NO: 74082 - DNA, 2370 bp, Heterodera glycines
  misc_feature (2176)..(2176): n is a, c, g, or t
  Genomic contig location: Contig_ID=SeqID_1510; Location=602..2971; Strand=+
  SCN-specific regions: Sequence locations=1-22,45-66,96-140,162 -407,429-437,466-836,858-1241,1264-1357,1379-2099,2121-2180,2202-2370
  Gene Ontology: Mol. function=metallopeptidase activity; Cellular component=integral to plasma membrane; Biological process=cell-cell signaling
acaataagattcctggatactgtaaaatttaaaatttattatttggcattatttgaaaaaattaatggaattttaaaggccggaaattgcccacccaattctttaacaaacaaattgttgaaggaatgacagcgacagaaaagagcagcttttgcatatgcacacattgttcactcacatcaatgactccaaaattgatcggaactggggaaatgaaaaattaacccataaaaaatcggggaacagcctgacacagaaaacactggaacaaaaattgtgttcattcacttcaaatatttcgcaagatttccgaccaaagttggatttggcatttacaaatcctttaatccctctgaaatacaaaatatgaaaaattggaaaccttacacatttccaaagacttcgtttatcattttttcctaattacatttttgtgtgacatttttaatccatttaaggcatttttactggatgtgactatgcaaaatgtgattttcttccagggatcgggtgggagaatgcgttgtggagcacgattttcgtcaattcttttatcattgagtctcctgctcgtctgcttcgatttgggtataaatagatcaatcaggtttattgttagccatttaactcgaacagacaattcatgattcgaattagtcaaaatgggatttttaagccataaaagatgattttaggggtttgcctgagcaaatatgtggaccactacgagacgctcagctatcaaccggtggttgaccgtcaaaaacggtcattggagacggaccacgaggacacccatgggactgacgtcgatttgcacttccgatcgcacaataggtttcatttgtcaatttaaattggtggcaattacgtgccaaaaattctactcttcgcccgcatttgtgttgttgttaatgtgtttgaagctaacgctaagctggccttagtgtccccgtaactttattccaaaaaccgtttaaatgtcaaaatttttttgtgttagaatttatttgaatttcggcattggagaagcttaaacaagctagtccctttttgaacgcaaaaattgattaagtacggcactattgcggtttagcgggcccaatgaaagaccataagggggaccctgaattaagacagtaatgaaaataaatcaaaggggaccctgatatggtctttcataaggcccactaaattgcaaaaatgctgatttgtgcaaaccgatatttataaatttgcacagaaaatccctttgaatataaaaatccaaaataagagcaaaaacacaacattttagtattagacgcttataccaagttatgtttaacaaaaatgtaatatttgtgtaaaacaaagtgataattcatttatatacatcaatatttctaggactttccatctcaaacttcgaccgttggactttacaaattcgctgtttaccgacgaccacattatcgacgtggacggcgttcatcacacgcatttgatcagaccaaatcgctttttgtacgagggacaaattgtcggtatgccattgcatttaattacaaaacacccatctaaattagtaagttacggtttcttttttctggtccactcggttttaaagggttattaccagtaaaatggttacacagataactcgagaaatccaaatccactggtttaaaatccacagttttcgtggtacaagaagaccatttcttatgagtagtttcgaaaagtacgtcgaaaattgctgtgttgtcaaagaaagggttcactttcccactgtttttcatttattttccaaaaaaaacaactttggtctttaggtgactcaacttcgtttgtccatggcactttgttggacggcatttttgacggatttattttcacgggcgacggccgcacattcaccgtggagaaggcggctcgctatttcgacattggccaacgtccggcccatttccattcattcatttacgcggacgaagagatcaatcacaagcgattccgacggacgaaaagggaagcggacgaggacggacgagacaatgatcagcagcaccacgaacgtattcaattttttggcgagaattttggaaatttgaatttaaaattgggaatttatgtcacatgacggtttttcattccatcatgcatcacaaattgaaagtaatcctggtaacggttntgattttaagaccatgtactcatttagtaattcagcaaaattgctagtaatatgacgaagtatgcatttgtttagtagtagatcataactagggctggcaaaatatgcacatgcatatttttttctggactatgggaggccttaacgcacaaaaacatgttttttagcttggttttaagcttctaggatgactt

SEQ ID NO: 74083 - DNA, 103 bp, Heterodera glycines
  Genomic contig location: Contig_ID=SeqID_10814; Location=4987..5089; Strand=+
  SCN-specific regions: Sequence locations=1-103
atgaaactcctttttaccccaatgtttttttctgtcattcttcaaacaattcttctcctgctgctggtccaacatgtaaatggaggaagagatcgagtgcaag

SEQ ID NO: 74084 - DNA, 453 bp, Heterodera glycines
  Genomic contig location: Contig_ID=SeqID_10814; Location=127..579; Strand=+
  SCN-specific regions: Sequence locations=1-154,177-200,222-304,387-453
ggattatttttcaaaacacctcgtagactggaggataattggagactgcgggattaatagagactgggctataattagagcatatacggtaatttcggtttccgaaatttcttgatcctaagaatttacgagcattttggacctcgtaattccgatttttattattttataagcctagtattccgttttctgaaagttttggaattacgatttcaaaaatttgagcctcggaattttttaggcctcggtagtcgatttccgaaaatttatttgaatgttggattgcattgcctactttactgccttaaaaataaatctttaataaaataattattgttaattttgtacatttagaaaaataattttaaaacgtttttttttaaattggtttggagaataaacgacgaaaaatgatcgttttcccaatgatgattatcatattatagtggcaga

SEQ ID NO: 74085 - DNA, 474 bp, Heterodera glycines
  Genomic contig location: Contig_ID=SeqID_10815; Location=1594..2067; Strand=-
  SCN-specific regions: Sequence locations=1-316,349-411,433-433,455-474
atgtgggacacctcgatcatggcttgggcgacgcacaacgcccttcgtctcacatggttttgccaagaatgcaatctgcgtaatcctgagacgtttgagttttcgtcggccggccaatcgagaaggtgtgtttagcttaaacaattaaatatattagttaaaagcgagtgataatagactgattttttggtataataaatactttcagtatatcaaaatgtgaatgatgacgaaatttatgagcaaattgcggtcgaatattatgtgtgcgttttggagatttggtgccggaattgccaacgaaatcaaatgatgagctttgtatatatggcacaaactctgctgtgtcaacacccacccggacgacgtgacgcgcgagtttctgcggataagtggcgaagccgcagaatactgcctctttacctacaactgtaaaaactgggtaaaattttttgcaaaattagtgataataaa

SEQ ID NO: 74086 - DNA, 2465 bp, Heterodera glycines
  Genomic contig location: Contig_ID=SeqID_10817; Location=952..3416; Strand=-
  SCN-specific regions: Sequence locations=1-124,146-381,403-451,474 -730,756-1733,1757-1942,1964-2465
atggagccgagttcgaaggccgcgttcgacgcgatggtccaatgtgtgattcgacagtacggccgattttgtcctttgcctgcgcaggatggaactgcaaattgtgtcgatggcattctcagccaaagggaaaatgtggcagacaatggaggtgcttaatggcaccgaattaaaagtgagagtttggcatccaagggattcgtgccgcttatcgagcctatcaaaatgcgatggaactgcggggggccgagttgacactgcccggcccactgctcagccagtacgaccacgaccagctgttctttttggcattcgcccaaatttggtgccaatcggccgaggaccccgccaaaacgtcccggcgccttcttctcgacccgcaccccccgcccaaattccgcgtcctcggctctctccaaaatttccccgctttccaaaacgcatttaactgccccaaggacagtttatacgcacctaaagaacactgtgacgtgtggatcagcgaagtgaagcagggcaagtgaatgggaaaagccaatggaatttgagggaaggaaattaattgaagtgattcattcgcatggctttttgttaataggggactaatttcaattaatgcgcaacggacggacactttcggacagtttctgaaataaaaaaatttcttgaaattaatcatctccaattaatttttagaatataaaatgagcttttgttagtattcagaaagcctaaaaaataaaattatttcaatttatgttaatgttttacgacttatttgttcagtgaacggcgataactttcttccgccgccgccttcgcttaacattccccaaaaagaaagtgaattgacaccgaaattccgcgaagcttccgaatattttgaaaaatccgtggacatagcgcaggacccgtgcaacaatttctacgaatacgcgtgcaatgctttcgatgagatcactcatttcgacagaatcagcattcagaatctgatcactttggcaactgaattgagagcgaacaatgtacaccaacaggtaaaacgggggacagacacgagaaagtcgaacggggacagacacgagaaagtcgaacggggacagacacgagaaagtcgaacggggaacagacacgagaaagcaaatccctttggactttgtgccaatgattacgatgttgtaaaagttggagtgaaaagattttaatttggatatgatgccacaaaatggaaaacaaagcttccccaactttcagattgagcccatccaaaaggccaaattggcctttgaaaagtgcacttttctgatgcatcatcaaaaccaagtgatcgtccaagccgacttgcccagggagaagttcttcttgttccagaaaaagagcagattggtccgttttactctcacaaccaatgctaaaagtgttgacaatgttttaggatttccccgtttttgctggccaaacgatggattggccaagccgagaggaattgtccaaggctttgggcgcattaagcggctccgttatggtcgacactttgatcagctttttcgtcgacaccaattgggccgacccaaactctgaagagatggtcaaatggcaccccccccccccaaatcaatttgtggcatttcaaattcagccttatgcgttgttcgtcgaccagccaactttggcatttgacccttattattattccccggaagtgtttccgatcgttagtcaccagatggagtggggatttggagaaattgaaaatgaaaaaagagcaaacattttagacgaattgtggacgaagttctgaccgaaatggccaattatttgggcgtggaatacgcaagaaaagatttaaacgccgccgttcaggtgaatgctggcaaaagtggaaaggagacaatgcgtaacaaagaaaaacgaacaccacgccaaaacaaatgccaaagcatttacaaattatttcaaattcattataatgagaggatttggtaaatcccccccctttttgtcagaagtgatcaatcgcttttggcaccctttccctctcccaactgatcactcttctatttccctttgatcaggaagtgatcgcttttgagcgacttttggccaataatttcctcgtcagcgatgccatccgtgaaaatgacttgggctcgcgtttcaatttgttcaccgtttccgatgctcagcttcgcttcccctttctcaactggtcgcttttcctccgcgaattggcccaaaatgccccgcaaattgtccaagagaaattgcggcagccgaatttccgttttgcaattgccgagccgacacttttggccaaattgggagacgacttgggcccagggaataagcacaatttgacggccaatcagctgcttaattatttgtacttccggatgatactgttttattcaccatatatcccacaggcattcacaggaaaaaatggtaaaagaaactcaaattaa

SEQ ID NO: 74087 - DNA, 790 bp, Heterodera glycines
  Genomic contig location: Contig_ID=SeqID_10818; Location=123..912; Strand=+
  SCN-specific regions: Sequence locations=1-302,325-500,530-722,745 -751,774-790
atgggctcgtcccaacgggggccttccaattggcggacgaatgaatcgttcggaggaaacacttcggaacaattgggagccgagaggggagtcactctcgaagaacggggacagagtgaggagcagacgaaagttcagataattgaacaaatgggcggggacgaagccgaagggatttccaggctaaacaaaaagcattcggaagggcatttaatttgagcttaattttctaaatgccctcatttttggccaattccgcttctccccaatccctcatcattaattactctgaatgcgttgcttctcttctccattatctccggctccatcaccacaatcgtattccgttgttgcaacattcggtcaaaaacttcccaactggcagaagtgaaaagcatctccaaaatgtaactttgcaggtcaacccaagccaaagattcgtcatccattttcataaactgaaagggcaaaagcatagcaaaacattcattatgaactaattgctccctttttctttttctttgatactttctccaccagcagatccaagtggattcccttttcaatttaaaatcaaagtaaatatttgcttatcaatgctttctgtttcaattcctttgagctcaaatcaattctttgacatggttttgaccgttggctaatgtcactttttaaaaatttaagtgagattggcctagcaaaatcacgaaatcttaacttaaaattaattttaatgtttaaaaagttatttcgaaacataaaacatttaagcatccgccgaaagtgttca

SEQ ID NO: 74088 - DNA, 1125 bp, Heterodera glycines
  Genomic contig location: Contig_ID=SeqID_10820; Location=1..1125; Strand=-
  SCN-specific regions: Sequence locations=1-365,401-524,563-906,929 -1125
  Gene Ontology: Mol. function=adenosine kinase activity; Biological process=nucleotide metabolism
agcaaaatccaattaaactctttttttccataaaagggcatttaagggagggggaaattctcaatttggacttcggccattttttaccccggcggttcagcacttaacacaaattagcggtgttccaatgggttttgaacggaatcaatgggcaaaaaaaagtttaatgatgcgattaatcacttaattagctcatagtttcataaggctgatcgtgcaatatttttcggttcggttggcgatgattccgaagcggaaatgctactcgagaagaccgttgagacgggtgtcgaagcgaaattccaacggattgagggggttcggaccgggaaatgcgtctcactgattaatgccacaaatcggtcaattaattaattttattaattttaattgtatttttcccaattttagttcgctttgcgcttgccttggcgctgcttcttttttctctttggattttttgcatttgcccgaaaatgcgaaattaatcgatacagcaaaatttttttattcatctgtgattcaaaaaataaaataaaactaatataattaaaattattaaggcccatttttttacggtttgccccgaggcaattaaacatttggccacaaaagcaaatgaattggagaggccttttttattcaatttgagtgccgattatattcctggaaaattcaaaaaggaattgaacgaaattatgccatttgtggacattctttttggcaagttttcatttatcaaaaactcaaaattaactgataaacttttttgttttatgtttaaatttaatagtttcccccaatttagctaatgaaatggaagcatttgcttatgcaaaggcaaatgaactcaacccaactgatcatttgcatcaaattgcattgtttttgacagaaattaaaaggaataaataattaataattatttggataagcaattgtttttcttttttgttttaggccaacggaggaaaacggggggccgaattgtgctgattacacgaggggaaaagccgctaattgtggcacaaaatgggacaataaaggaattccccgtcatctctgtggataaattgtggacacaatggggcgggcgacgcattttgcggaggttctttttgcgct

SEQ ID NO: 74089 - DNA, 637 bp, Heterodera glycines
  Genomic contig location: Contig_ID=SeqID_10821; Location=2688..3324; Strand=-
  SCN-specific regions: Sequence locations=1-408,430-594,629-637
gcgcgcaaatgcaatgggcgaaaagtgtgcacgcttatctgttcgaccagacgattgtgctgtgccgaagggacgtgctgaggaggcaccaattggtgtttaaggagagaatggcactgaacggagtcactgtgcaggagctgcacgacggaaaaggtcggcagaagcagagactgctaatgaccctcaaatttgaattctgttcggctaattcccccccccccccccctttagagccgatcaccggcgcttcccttaggaacgcgttcaaagtgtccagccaggcccgcgactacgtgttcagctgtcccgacgcggccacaaaaggcctttggttggaggcgcttcgcgaaaggccgcggccacaaccgccgacgccggcagaacgacgtttggcaatgctaatgtgaagaagcaaaggaagaaaagcagcaaataaatgaagaccgaaccgaacgaaccaaaaacaacgaaaaccgacggagggatttgaattaatcggagagattaatcgaattcattcgcatttcattttttattttatgcgctttcattcgcctcgcctttcattctttttgagtccattcctgtgaacaaaaacagacatttttatttttgccaataaaatttctttttc

SEQ ID NO: 74090 - DNA, 2035 bp, Heterodera glycines
  Genomic contig location: Contig_ID=SeqID_10821; Location=1..2035; Strand=-
  SCN-specific regions: Sequence locations=1-651,674-718,741-1297,1320 -1392,1415-1495,1517-1627,1649-1749,1771-2035
  Gene Ontology: Mol. function=uracil permease activity; Cellular component=plasma membrane; Biological process=nucleotide transport
aaaacgaattctccgccggagggtgcaaattgcgtcccttcgttagatccgtccctttgtaatgatgatttgaaaccattgcaaagtcaacattggaatacttataacattttcgctgtttggatgaccggtaattaacaaaaattaaaatgaaaaaagagaatgaacattaattttgtcagatgttcacagtgtggccggttatctgacagccggaagtcttttcgccctccgtttgtccggatggcaagtaaatgattattatttaagctcacaatcagaattcagaatagtgagtgctgtagtcattttcaaattatttatttttcattttccttttaattacttttttcctttttatgtgctaattgccctcatcctcggaatactaattgtccatttttgctgcaattgggtggccaagcccagccaagttgcctttctccgtctttttcacttccacttttcttcaacaggtcactggcgtgccttacccggtcatcaatcgtgccattttcggcattcgcggtgccaacgtgcccgctttgctccgtggttccattgccatcgcttggtacggtgtacaaactttcttggcttcccgtgcccttatcgttgttttgctcaagttcttcccatcactggtcttcttgcacaatgtcttctttttgctcctccccgtccatttctccccgtcattttcagtcccatggctttgtcggtctctctccgctcggctggtgctgcttcggcttcatgtcacttgcccaagccgttcttttttggatgggaatggaggccatcagaaagttcatcgactgggccggcccggcggtgtacgtggcgatgcttctgctcgccgtttatttggttgctaacgccggcgttcacaatttgagtttgaacctcagcggtcggttggtgtggcattggcacttcaaaaaccgaacataattttaaaccgaaggcgaccctttgccctttgtcgactctctcccgtcaatgttttctgccgttgcgttggttgtttcttatttttcgggcccaatgcttaattttggcgatttttcgcgttatgccaaatcttggaaagctgtaaaattgggaaattttttaggtaaaaattgggtgaaaaataaatttattgagtcaattattggtgattaacccgcttcccttaggtttgcccataaatttccttttcttctctctgctcaccgttctgatcacttctgccacttttcccgtcttcggccgattgatcactgatccgatcgaagttgttgagcaaattgggaacagatcatcctctgattgggtcggactgaccgttgtctctgtcggaggggcgacttttgtggtctgtcaatgttcaacaaaatggcaaaaatgaaaaattaattaaaaatattttctgttataaaaacacaaattcctacgcattcagatcgccacagttggcattaacattgtggccaattttatttctcctgcttttgatttttcaaatttggctcctaattatatctcatggagaggcggcggaatgatcacagcgatcgcttcagttttattaaccccgtggaattggtaattgtctaaatgatttttaaaatctttctgccccttaaggtataacaatcccgcagccattcattttgctctcgggattctcggcgctttaattgggcctttgcatggcattttggtgtctggctatttcatcgtaagagtttatttaccccgcgggcattgtaaaatgccacaaatgaaggcgagcaaacagaaggtttgggtgcccgatttgtacagcagggacgtggacgggcgctattggttcagcaacggattcaacccaaatgcgttgggggcgactgccattggcggcgcattggcaattgccacggcattccatcccaattttgacccttttgtaattgtctgcttcttcaggtcattctgccaaaaataagcaccgctttcggctctctccacctcttcagttggttcgtcggctgttttttcggctttggca

SEQ ID NO: 74091 - DNA, 126 bp, Heterodera glycines
  Genomic contig location: Contig_ID=SeqID_10822; Location=655..780; Strand=-
  SCN-specific regions: Sequence locations=1-9,32-126
gggagtgccctgcttcttctccctcctcctccgcacctccgtccgaccttctgcttctgttggacatgcctcggccgtcgcgactccctccgccgccggcccatctccgccccgggaaattcccgg

SEQ ID NO: 74092 - DNA, 962 bp, Heterodera glycines
  Genomic contig location: Contig_ID=SeqID_10823; Location=1812..2773; Strand=+
  SCN-specific regions: Sequence locations=1-263,287-962
atggaattgtcctatttggaggcaattcaaaacggagtctgtcgtgccgatttaatcgccgaagcgcagaacatttggtcgcaaatgctttctgctgatgaacttttggtcgtttgtcacttttccggtgcgattaactgacggaaaacttttcagaaggtcgacccgggtgccttccttcgactttcttcgtcgcttttccattcggcacttggcttggattatccactgacaaattcattagaagcaaatatcgttgtttgccttaagaaatgctcaaatgaaatgggaagtcaaaatggctgcgattcgctttactgtgcatcggtcggtgttcttttgcggatgtccggacaatccgtcataaaacttaattttaggaattcgccaagaattgtaccaaatatccttggaatggcattcctagtaatttggcggattgtccgggcgccgaaaatgcgatggctcaaacattccgccttaaacctcgtcgttcagctctttgatctcctttcggcacatttggcgaccttttgccaaattcttcctggcgatgtctgtcgtgcgatgtttgaatttttaatcgcccattctgaaaggcatttttgaagagacttcatttgttagcaataattaatttttgcagagataatttggagattttgctgaagcaattgactaaaaattcagccattcgttgcggcgaatgttgcgagaaagtcttccgatcactttatgatttgccgatgccttcgccttcttttaatttggaggaaatttggagcattgaaacgaaaatcagcggaaagaaagaaactcaggcgcaaaagattggttggcatttgggttggtcattgcttttatcttttggcacagatgagtcgcagctgagttgggcttcgctgctttccctttccgacgaatgtttggccaattcgctcgtcggcgtttcgaatgccaaa

SEQ ID NO: 74093 - DNA, 939 bp, Heterodera glycines
  Genomic contig location: Contig_ID=SeqID_10824; Location=696..1634; Strand=-
  SCN-specific regions: Sequence locations=1-626,648-939
ggcgagttcagcatttacttggaactgcgcagctcggccaacaaaaagcaggtgccagaaccgtgccacaatcgcaaagacgacggatgcggcggcttcggctcgtggtcaccagccaatttcgatgattcttcaagacggaattttcagtttgtattgcgacgcatgccaaacattggaagagaacagaggactgaaggcacaactgctggtggacggaaagtcgatcagttgcgggcaggaactgagcccagggacatacgaaaacatggaattggtcttttgcctgccgaacgcggaggaaatgctcaagagccaagggctgaccaaagaaacgttcaaaagcctaattcagacagaggtaggaaaagccgaacggaaacaaaagaccgaacggaataattacttgcttaggacggcataaatctccgctccctcggcgtcttcgccaccatttacgtcttcgacaggtgaatttcccaccgctgcaacaattcaaaattaatttttagagatgtgcgaaaattggtccaaacacagcaaaaggtggagacagtgtacagaaagacgaaacgcacacttttcaaagacgaacctttgccaccggacgtgtgagtaacgaaggcgaaatgggcacaaaaaagggataaaataaagtgtgactgttcagttactggtcgttgcccttcaacagtatgatcaaagagcagaaaatgtttgttgcttgtcataaaatatttggaaatatgcaaatccgaagtaacaaataaacggtaaaataacaagcgaagaaatgagtggacaaggcgaagtggtgtcagccgatgattttgttgctcgcatagaattgcacttttagtcggctgaatttgagtttttcagcggcactcaaattgctgctgagcaatgccaagtcattctcgtcaagtgcagaaaaaa

SEQ ID NO: 74094 - DNA, 237 bp, Heterodera glycines
  Genomic contig location: Contig_ID=SeqID_10828; Location=3056..3292; Strand=+
  SCN-specific regions: Sequence locations=1-237
ttggccaacgaaattgctcgacgcgttcgcattttctgttggattttgaccggcaaacagaaccaccaaaagcgggccattcacgtgaaggcgacttgggcaaaacggtgcaataaatttgtgttcatgtcatcggaggacgatccaacattgcccgctgtgaatttgaacatttccgagggcaggtggcgtatttaaaaaaatatttcaaaaaatttgtttatgcgtaccagaatt

SEQ ID NO: 74095 - DNA, 2563 bp, Heterodera glycines
  misc_feature (4)..(4): n is a, c, g, or t
  misc_feature (12)..(13): n is a, c, g, or t
  misc_feature (28)..(28): n is a, c, g, or t
  misc_feature (72)..(72): n is a, c, g, or t
  Genomic contig location: Contig_ID=SeqID_10828; Location=1660..4222; Strand=-
  SCN-specific regions: Sequence locations=1-364,404-771,793-825,847 -1191,1215-1486,1508-1836,1874-1891,1914-2107,2131-2276,2298 -2321,2343-2417,2456-2563
acancgagtcanngagctgtcttgagancaccggaggagggatgactttcattcttctgatgtcaccgagcncaatgagcggattgacacctggagaaccgtcctcaacttgcggttcggcgacatccaatgaaccagcagatagtgaaaagaatcatatggaggaagacaacagaagtgatgttgcggaaagcgactcaaatttcttaaaatctaatttgtatttatttttgtcgataatgtttctctcgttcatctcataatcactattcttttttcatccattttctctgagtcatcaattttttgtttcgtttgtgcttatcttttccacgttatttgctcatccccttatcgattataaaatataaaaacctggcccacattcattgtttgcacttgttgatttacattcaagtcagctcggagttttcaattcaattaaatcgtgtaaatttaaggtaaattgtatttgtgttcatttgaatagagttagagaaaagttcttctctcaatctgtaaaagggacatcaggagccctttcatatagactataatttgccctccgttaggtcataactagagaccgcaaaaaaaggcgcgaaaaggcactataataagcaccaaataattgaaaaaagccatgaaaagtaacgaaaatcccgaaaaaggcatgaaaaaggcaattaaaatttttcattacaaagaccttcaattccagtttccacactttgacattgaaaggattaattgacgcctaaatgagttttttgtaatattttgtttaaaaatacgccacttgccctcggaaattgaacacaatcgtttcaaaaaatttaatataaattcttttttgtcccgaatcccgcccaaaatcatcgggttgggattcgggacgagaaaaatattgggtttcgagtgacccgaaacaattctggtacgcataaacaaattttttgaaatatttttttaaatacgccacctgccctcggaaatgttcaaattcacagcgggcaatgttggatcgtcctccgatgacatgaacacaaatttattgcaccgttttgcccaagtcgccttcacgtgaatggcccgcttttggtggttctgtttgccggtcaaaatccaacagaaaatgcgaacgcgtcgagcaatttcgttggccaaagtgacaacactcattcctggggaaagcaaaaaataataattaaaatggaaaattcaattgaaagttgtggattaaaaaaacacatgagaagaaagcccaaaataaggtaaccacaaccaaaatgtcgaaatatttttaaattttcatcatccggagcaggggtgtgcgaaattccgtgtcgttttcatgtcgtcccttttttgatcactttttgagtttcgttttcgtgtttcgttttcgtccaagaaaaaaattcgtttcgttttcgagttttttaattttcgtttcatgtttcgttttcgtgaaaaataaatattctgggctccattccaacggattacaattgctgaagcatttaaaggcttgtccatttgcccacctttctgctgcactgtgtggaaaaatatggttggcgtaacaaattctttcgccgagccctgaacattttttaaaagtgcaaatccgattcgctagaaaatgaacaaaagtcaactgggaaggaaataggggcaaaaaaaaaaaaaaacggaccagaattttcaaaaaccgcggaccccctgttcctcaaatttttttcttgaaaaatgcgtcgcataaaagtaagtgaaaagcaacaaaaaacgcccctgcctcgttccatggatggtaaaaaagaaaaaaaaattggcaaaaaatattttttatgaataattatagaaaaaaattggccttctgtcatatttactttttatctttatttctctcaattttatgtactatctcttcgtttttaataatgtaatgaacaacatttaggtacttcatcttgtttaactttttttctgcttgttaaatccacaccaaattttacatatcgatagagaaaaggaaaatgtgcaaactttcagtgttttgagtaaaaattttggcctagaaagttatttaattcgcatttatctgaaattttttaaattttttattatggctaaaaaaattattgcttaagcttcaaggcagaagaggtgctgaacaactgaaaaaaaggcgagaggaaagaaaagctcagacggagaaggcgagacaagcctatctggctaagaaaagtatgtttttcaacggatttttaggtcctaaaatatttcaaactaatttcagcagtccaataccaacaaattgacgacgaggaaggagaagccgagatggagcagcaagaaatgggccaagcggagcaggtggaagagacttacgaccatgcaagtgagtttcaatcattttatttataaaaaaatatcaaatattcaatttttagtggacttcgactttcagttggacaattatgtccaaatgtcgcagaatttgaccattgatgaccaacttccgccggcatgggacgcaacagcagaagtgggagtttaa

SEQ ID NO: 74096 - DNA, 99 bp, Heterodera glycines
  Genomic contig location: Contig_ID=SeqID_10829; Location=108..206; Strand=-
  SCN-specific regions: Sequence locations=1-99
atggacatttatggtgctggccaaccggcaactcatgattttggggaaattgtaaattacgacgattggcaacaatgggacaacggctggggaggacag

SEQ ID NO: 74097 - DNA, 575 bp, Heterodera glycines
  Genomic contig location: Contig_ID=SeqID_10830; Location=25..599; Strand=-
  SCN-specific regions: Sequence locations=1-336,359-575
atgtacagcaacataagcagcagtggatgggttagcagtgaccacccgcaacagcaaattggcaacttttattcgtatgatgcggacccgactttaagccccaacggtggtggatacaatgcttattttgactatccaaatcagcaacccgccgcttcttcatccaattctaattttgtcccacttggctctggtcgccctttcccgcacacaatcagtcagcacgcacaactcagtttctctgacaattcgaatgcaaattttgttccgcttggctcgggtcattttctaccagaacgaggtaattccaaattaattttgaaagataatcattcatttttatatataacttttttgtcagatcttttcagttaaacgaggggggaacactagtgcagatggtacgccacaataatttttttttaaagtcgtataaaacatgtttctagggttttccaggttgcatgattatgaatccgtgcctccatttcgaccaattctgagccccgtactcaaattctaaaattttgtcgaaaagtctaaaattcccaaaaaaatgttttttatcaaataaa

SEQ ID NO: 74098 - DNA, 1202 bp, Heterodera glycines
  Genomic contig location: Contig_ID=SeqID_10830; Location=3310..4511; Strand=+
  SCN-specific regions: Sequence locations=1-132,166-287,309-370,392 -928,950-1202
  Gene Ontology: Mol. function=calcium ion binding; Cellular component =endoplasmic reticulum; Biological process=protein folding
atttttgcctttattcgtttttctccaacacttcgattcatcggcgggaggagaacaacggagttggaaggacgaggacggagtggaagtggaaatcatcaaaaagatcccgggttggtgaatgaaatgggaaggggggatggagggagggaagggccgaaaatgacaacgaaacgaacagattcaaagtgcaaagtgaagagcgaggcgggcgacgagttggagcagtacttcaagctgacggacaaagagggcaaactgatcggatccaatttcggacagaaaccgtaagacaggaaaaaagggaggagggggggggggggggttacgaggacaattggtggtaattgacccatttagctataaatttgtgcttggccatgggcaggccatccgtccgatggacaacgcaatgcgcggaatgtgcgtgggcgaacagcgccgggtgaccattccggcggaagcgttggcggaaaacgaacggccccagggggtgggcgaggaacaagcgatgcattactttgtggagctgaagtccatctttcgcgcagtgcccggcgagaaatggatggaggacgacggacttagcattgaggcaggaaatattggaagaaatgggggggggggacaattcgacacaattttaagtcccaaggaccaaccaatgctttttctttgttaggtcactcacaaaatagaggaagacaaatgtcgacgagcggagcccggcgacttcataaagcagcactacaccgtccacctgcaggacggctcctacgtggactcgagccacgaccgcggggcgaccttcgatttcaccctggggatggggcaggtgataaaaggcacgaaaagcaatcaatcacattttgaaatcaccatctttttttgttccgtcccccacttcgatcgctcttttttattgcagcaaaaggaaaagaaaatgggatcgaattcgccatggacaaataagagactcatttaggcatggaccgggcaatgaccggaatgtgtgagggcgaacgccgaaaactgatcattccgcccacgctcggtatttcccattttttggcatgacacagaattggaaatcattttcagcctatggcgaaaatggacggcccccggccattccgcccaactctcaattgcacttccaaatcgaactgcaaaagctggtcaagaaggacgaagagaaggaa

SEQ ID NO: 74099 - DNA, 1216 bp, Heterodera glycines
  Genomic contig location: Contig_ID=SeqID_10830; Location=1023..2238; Strand=+
  SCN-specific regions: Sequence locations=1-156,178-935,965-1083,1106 -1172,1197-1216
atggggaggaaaaatgtgaaaaccgccaaaaaggagccgactacttcaagcgcagacgacaacgtattacttaaaacggaggagacagaattggaccggaatgaccgggccgaatcttcgccctcaaccgcaacacaaccggcaatgatgccaaaagaaatgtacaacttttgtaaggtctggcagaaacaaattcaaaataaacaaaagcagatcatgaaatatgttttgtttctgtttcagtcgattttggaaatcgaagagaaaggcaatgtcaacttaactcgtctaaagggcaacaccaaatttagccaacttttgcgggacaatccgatgtttgacgacagcgttgacattaggtaatttgaactaaattcgacaaacaaatgcctgaaatggaatttattatttacaatcggatccaagcaattttaagcatttgggttcacaatcatcagtagatgtttttttcttgtttgttaacagattaaccttcattttagtgcgtttcaaaattcatttacgcacttttatcgctgggctaccattttgtcagacgtttcgttgtcgaaagcactgcacacggtgatggaatatgcccaaagtgaacacatggtgttcaggtggttctcgctggataaaaattcattgaaaaacttctatcaggcacccaaactacccaaagcgaccgcaaaatgcattcactcgttttgcgcaactgaccggctccaaccccttcaagtcgaacgggcaaacgagtgctgattataagaacgaccaagtgattggggtggaatggagcagagggaacttcaattgaatgataatgaagttaccaaaacaagcaattttaaggatccgcgggtggtgaaagcgaagcaggaatatgcaaaggatcgcgaacgctatctgtttgattttcttccatttgcaagaattgttttttattattatttcatattttagagccaaacttcgagaatttctcaatagccacacggatgagcttttcgaggggcaaattcaatatttgcacaaggaaatcaaaaacacgcaaaagtccatagaacagaaggtgaaatcgcattaaaaaatatttttgttaattgttaaggcatctttttttaggcagaaaaaatcgcaaaataggattatataggcacaaaaataggtaaaaaaaaaatttaatttattaacactagtagcagaactcgta

SEQ ID NO: 74100 - DNA, 1512 bp, Heterodera glycines
  Genomic contig location: Contig_ID=SeqID_10831; Location=762..2273; Strand=-
  SCN-specific regions: Sequence locations=1-86,108-128,150-236,258 -283,306-346,368-389,418-852,874-1091,1114-1434,1456-1512
  Gene Ontology: Mol. function=galactosylgalactosylxylosylprotein 3 -beta-glucuronosyltransferase activity; Cellular component=integral to membrane; Biological process=carbohydrate biosynthesis
gaaattcatttcgaccttttagaaatgacaatcgaaaagtgttccatggttatcacactttgcattctgacactgttccaattctgtttttataccaccaaaataatggaattgtctgccacaagtcgccaattggaggcggaaatattttccatgaggcggaaaagggaagcgctgcagggcgaaattgacaatttggtcagcagcaaaagtgcggagagagggcaaagcggcagaagaaggtggaggaggggagggggcagctaatgaccataattagcaaaattaagtaggtaaatgggtaattaggggtgggagatggagtgcaacatgtattggcccaatccataattaattattttaattgaccattctgctgatgctaatcgctttgtccccctcccctccactcatttaaaattaaatgccttttcagaatgcattttacgctgtcctcccctcccattccgtcgcctttgtccctccctcccattttcttcatcactccgacctctcgccgagtcgcgcaaaaggcggatttgacccgtcttggccaaactttggtgcccgttgcgaatctgttttggatcattgtcgaggtcattcaaatttggcgatttgatttttcttggcaacgcgtcattaggattctgagcatccgtcgccattcattggccaaatgatgggccgacttggcattgtcggcattcatttggcggcgacaacgcccagcgaatggaaaaacaaatttccgaagggagtcgcacaacgaaacgcggcactcaattggctaaggtgaaaaggaagagcaaaagccgagaaaaagcgaaaagaattgacaaattaagggagaataaagcagcagagaaaaggggcgtcgtttacttcggagacgacgacaagtgaagctcattttaaaaccaattcttattaaatcttatttgtttcagtgcgtacgattggcgccttttcgctgagatgcgatcgatcagccaaattggcatttggccggtgggaattgtggaccaaatgatcaccgaataccctctaattggcagtaattgtactgtaattggcattcctcagaggccaattaaattaataatattttttgtagcaaaagttttcggcttcaattcaaaatggaaacgccaacggccatttccaattgacatggccagcttcgccgtgaacatttcacgaattctgactaacgcaggcggtggcttcagttaccaaaccccgaggggttatttggtgggttttttgattttatttttttaaactcagaataattcgttgtcattcgcttttcaggagtcacattttctgatttcgctgaatgtaacgatagacgaatttgaagcgaaagccaacaattgcacaaaagtttttgtctggcacacgaggacagaaccaacgccactccttgcggaggaaacggcaaaattcgcctccggcggggaggggcgactcgacgagacagaaaaggacgccgtcggttgacaaatg

SEQ ID NO: 74101 - DNA, 1219 bp, Heterodera glycines
  misc_feature (18)..(18): n is a, c, g, or t
  Genomic contig location: Contig_ID=SeqID_10832; Location=203..1421; Strand=-
  SCN-specific regions: Sequence locations=1-49,71-460,487-487,509 -535,557-750,774-789,813-1219
  Gene Ontology: Mol. function=protein binding
atggacacacaaggcatnttcgacagtgtcagcacttttaaaaattgcgccaccgttttcgcgttgtccacgatggtttcctctgttcaggttttaaactgaaagaatttttgaataaaatttaaggaattgcatccatttttccattcatttgcttcccagattttcaacatcaacaagaccatccaggaggaccatctgcagcacttgcaactgttcacagagtacgcccgactggcgctggacgagtacaacaacagcaaaccgttccaggtaattcttttttttattggttgaccatttctctcatcaatttcagtcgcttttgttccttgtccgtgactggagtttcccttatgacgcggagtacggcccaatcggtggtcaacgcattcttgacaaacgattgaaggtactcaatcagatgaatgtatcatgaatctcatgcataaattgaagattttcttatattcttccattccatctcaaaatttaaaatattttccattagctaggattcttcgtaaaatcaattcctgtgcccccatttattctcggcttatccattgatttgttaaatgtatttgtttttgccaggttacgccccgtcaacacccggaacttcagcagttgcgccgtcacattcgctcgtccttcgacaacattcgctgctttttgctacctcaccccggcctcgaagtgtccacaaatcagcatttccgaggcgaacttgacagtgtgttttttttattgtttgtttgctctttttgtttgttcattgtattcaattttcattctgctttagaaattgactccaagttcaaggcacagctccgttcgctggtgccgcatctgttcgaccccaacaatttggtcgtcaaacaaattggcggtcagcccatcacttgccgagagcttgccatctacataaatgtaccctttttcgcgtcgaattgaaatatttaagttcaaatttttaggcttatttcgaggtgttcagcaaggctgaactgcccgagccaaaaaccattctcaatgtaagtggaaaagaacattcatttctgtattgttattgacccgagtgattagtgaaaaggctaattaatgctttccctccttatgactgccaattgcttttgttttttaggccaccgctgaagcaaatcatcttgcggccgtggtgagcgcaaaggcggtgtatatgagggagatggaagaa

SEQ ID NO: 74102 - DNA, 663 bp, Heterodera glycines
  Genomic contig location: Contig_ID=SeqID_1512; Location=1030..1692; Strand=+
  SCN-specific regions: Sequence locations=1-56,99-117,265-312,359 -377,441-472,505-551,588-663
atgagagagaaaaaagaacataacattattcagtacaagaatcgcaaaagtattaacaataattgaatatttaaaaatatttttcttaattgttaaatccaaacgatatacagaatgtaaaaataaaattatcgtaaaaaatattaaaaaatgtttattcaataatttataactttaataaagaacaaaaaaaatagaattgttattatgctaataaaaaaatcaatttattaattaatcaatttgaatttgtaaaaatttaaacacagcgatatattttgaaaccaatataatcggagaagggtacacttgataaataaaattgaatataattataagtatacaaaataatttttaagaggcaaataaaagggaccttttaaaataattgaaaatattagttaaaaattattaaaaattgttacattaaaatatattatgaatgcttattaaatggatatcgggttgttactattattttagtaatttttaatttaaaaatttggcaattagagatggtggcttccgctggtttaccaaaaagatataactaaatttaaaaaaatcaataaataataatatatatagtttcagaattcagtcaaatttggaaacagtaaaatttcttggacgcgaatctgtaaattaaaatgtctcaaacaa

SEQ ID NO: 74103 - DNA, 167 bp, Heterodera glycines
  Genomic contig location: Contig_ID=SeqID_1512; Location=2532..2698; Strand=-
  SCN-specific regions: Sequence locations=1-167
ccgagccctcccttcacccctttctttctttcatcatttcccgtttgccctaattttctcatcatttcatccatcaatcactcctcgttcgctacttctttcattcctccccgtcctccccatttgtccgctcgacggacattcgcggctgacgttcagtcgtgaca

SEQ ID NO: 74104 - DNA, 974 bp, Heterodera glycines
  Genomic contig location: Contig_ID=SeqID_1512; Location=4816..5789; Strand=+
  SCN-specific regions: Sequence locations=1-98,121-129,248-307,350 -354,376-582,605-974
atgtcctttacgcttcgactgcccttcctattccacccaaaagttgcgtaagaatcgattcgttcataaggaaaactccccaattcagcaacaatttgatttaaaaataaacccttaaaattggcattgattaattatatttttttgtagtttgaaatcaattttcaattacaaataatattaaattttttcattaaatattagacttttcactaatttttttcgtttatttttaatttaataatttctttgtttagcggcggttttttctattctttccaatttcgcttccggcactcttttctcgtaaattaaaaaaaatttttaaaatataaattaagaaaaatttcagaaattttccaaaaataaattttgtttttttagcatcatttgctgcttactttcgctcaagtgcgccgatcaattcccggatttccgtcgccggtaattcaaattttcaggggtatttttggcaatttttgataagatatctaattaataatgttccaaaaatttttaagcataatcttttggttttttgagcatatattttacaccccgtttcagttttggcctctcagttccaaaaagatttgcattgtttatagaatattcgatgcagaatatttttctgtgtcggtgtgcaaaatttagtgggaaaaaagttctatagagtgaagtaaattcggttttttgtcgaaaaacagagatagtacgccaaagtgagagctgttttttctctgcactctctttattggtagacatttcgttttttgaaacggttttggtaaatttttacaagaaaaacgtaaatattttataacgatcaatttttagtatttagccgttgttttcatttttcgttttttacataattcttgcaatttttaggaaaaactattattgccgctttcttgcatagtgtatatattttttggattttaccgggttttttcactttcagcacactaaaa

SEQ ID NO: 74105 - DNA, 1215 bp, Heterodera glycines
  Genomic contig location: Contig_ID=SeqID_1512; Location=6218..7432; Strand=+
  SCN-specific regions: Sequence locations=1-155,177-177,208-409,463 -470,887-891,932-1004,1097-1215
  Gene Ontology: Mol. function=cytoskeletal protein binding; Cellular component=cell-cell adherens junction; Biological process =intercellular junction assembly and/or maintenance
atgaaaggctgggtgttattggatatttgtgagctggtattaaagcctagaaagcagggatggtaccaggattttggaagggggtggggtgattagccttccgggatgaaggccttttttcataccatttttgaaggtgttctcgaaattgttgttttggtattttttaatttaccctattttattttaagttttaaaaaataaaatccaaaatccagaccgtattttttcaaaaattttcattaaattatgtcttggggctgaatatctttgttactgtgaccatccctgaacaaagtgaaaaaccagacaaatcatgttttcctcattgcacagtccaagtccgccatctatagctatgatcgagcttggtgcgaaagtctaggcaagaaaaaagaaaaagatcgacaagaagaagaagcagaagaacaaggggaagaagaagaagaagaagaagaagaacaccgaccagaagaagagcgacaagaacaagagcgacaagaacaagagcgaccagaagaagagcgacaagaacaagagcggccagaagaagagcgaccagaacaagagcgacaagaacaagagcggccagaaaaagagcgaccagaacaagagcgacaagaacaagagcggccagaagaagagcgacaagaacaagagcggccagaagaagagcgaccagaagaagagcgacaagaacaagagcggccagaagaagagcgaccagaacaagagcgaccagaagaacaagagcgaccagaagaagagcgaccagaaggagagcgaccagaagaagaagatcgaccagaaggagagctaccagaaggagagcgacccgaaggagagcgacaagaaaaacagagacaagaggatggggaagaagaagacggggacgatgatgatgatgatgatgatgatgataatgaggatggcgccgtccggtgcaaagtgattttgcgaagaggaggcgaaggagacgatgatgacagtgctggagggaattcgggagggaatggtgcaaaggatggcggagggggagatggagaaaaaaagggaaatgatgggaaaaagcaggaagaaagaggagggggaggagagaaagcaaacgagcaatacaaaaatggttcaaccgaaacagccggaaaagcgagcgaaccgtacgaggaagcgaaggtacaaaccattctgagcggcaaaaaataagtgcatgaaaaa

SEQ ID NO: 74106 - DNA, 1399 bp, Heterodera glycines
  Genomic contig location: Contig_ID=SeqID_10833; Location=1035..2433; Strand=-
  SCN-specific regions: Sequence locations=1-28,50-205,228-247,270-1399
atgccgtttttcgagacaccgctgaacacaaatggaaatcttcttcaaatggtcggccactctctcttcgcacaattcgttttggtgatgattttgttgtcaaatgaagccgttggattgtggttcacaaggcgggcgtctgtgccgaattctgtgagttttggacgtgtagcacaaaattgcaacttgctaatgtcttatgaatccaaattttttgtgttttcagttgaatctcagagaataaaaactgttttgttttgtctgttgcaattttgttaacgctttgctgggcttatgtttagcattaattattgtcaactttttttcaggtcaaagccattttccgtcgtcgtactgcatctgccatcattttcatttcggcgctcgtctcgtattcggtgtggagctgtacggctgtgcttcatgggctctgtatcaacctgcattttgaaccatcgaatgcgccgttgttcactttggtgagtttttacaactttcatcattcagcatttctgatcatttctttgccaaatttagctgctcaacatcgtcctgttttgttcttcaatcattgagctcaacattttgaacagtcgttttcgcagagggcgtctgtgcaacttcgaagcgtcgccatacactttgaacaatctgtggctgtggattgaacgtgagcgcgctcatctccgttttgtgatccgcgcattcttcggcctgaacgatgatcagcagcaacgccagaacgatcatcagatgtttggccagaacgatgatcagtgatcagatgatattttattatgggtgaattgtgtttgctggataatcattccccctgtaaatatgccgtacccttccccttctcccatcgttttccataggaaaattagtcccattgtcatacatacataatcatgttgtttgttttcgttgtatgttcaatgaaattttactgtcgaatttttgatatttttctattatctgaccgtagattttcaaaaaaactaaaaccaaattttgtttgagataaacttgtttttagggtcgtaaaactgattctgacattatccatttcgacaaactccgaattctgtctgagcaattttgatccattggttatttcaaaaattgatagcaaaataatgacgaaatgtttcattcgttttgaaaatgcagattcatttcagttttcccaaattttcaaaataatttcaactcggattcccgtttctatcagcagtgtaaatttttacggtttactaacggtaccgcccggtactagaaaaaccggtaattctaattttgaaaaaacgggtaccaaaaaaccgctaattaccgaatggtaccgttctagcccatatttcatggctcaacctctgaaaatgcagaaaaacaaaataaa

SEQ ID NO: 74107 - DNA, 361 bp, Heterodera glycines
  Genomic contig location: Contig_ID=SeqID_10834; Location=833..1193; Strand=-
  SCN-specific regions: Sequence locations=1-187,209-361
cgtccgatttttcttttgcccattatttgcgcctcgggcgtcgtctgcgtctttcacactctctccgtggccaattggctctccgactggtggatcagtgctgatcagtcactcgacttggattggctgatcattttcacctcggcgattaccttccaagcaatttccatgctggtcttttctttaaaagcatttaatgattttcaaattgttaaggccttttaccttcaaattcgctgctatcgccttttttgacagtcaaattcaaaatattccattaattgttgcgttaataatcgcttcgactgctgctgaaagtgagctatttctaaaaggtggcagtaaatcatttttatttcca

SEQ ID NO: 74108 - DNA, 2716 bp, Heterodera glycines
  Genomic contig location: Contig_ID=SeqID_10837; Location=1445..4160; Strand=+
  SCN-specific regions: Sequence locations=1-72,138-588,617-620,642 -674,696-1016,1039-1061,1090-1269,1291-1808,1830-2241,2263-2351,2417 -2569,2593-2676,2698-2716
atgcccgccgctcgggtcgccgaccgttcgccaatggcacatttgccgttgcgagaaagtgcccgaggggcccaacaacaacagcagcaaggaaaggaacaacaacaacagcagcagcagcagaaccaacaacagcagaaccaccacaaggagtgcgatggcgaggaggccgagcaggagcagaaccaacttcggaagaacaacaacaacggcaaattgatcgtcgtcggtgagttggccaaaattggcaaaaaaaagggggaaatgagtgcaaattgaagcggacaaatcggcagagcagtgccaaagggagagggaaatgtgcgcaaaattaatgcaaaggagggaccagctggaagagcagctgatcgcacgagtggacgagctgaaggacatttgtatcgcggaaggggtacgattgggcagaaggggggggggggggattgggcgatgcctgatcagtggtgatcagagtaggaatgatagtattggtctgactagggcctcctcattaggtgagatcaggctgggcctgatagtgctgatctgactgggcctcattagaggagatcagattgggcctgatcaaccaagaagagagaggaaagagaaagagtcttactgatcagcaccagctgatacttttgatcaggttgaaaaacttaccaggtctgatcaaaataaaaacagtttgaagaatttttcgaatcaattccgtaatgggagcttagaaaccatagaatgaatgagtgcattatgatcagcagaagttttaaattgaattaagaaattgttaaaattcgaggcaccattaaggattgattagacaaaatatgttccgatcaaaaaatgtgattgaaactgatcatttcaggacttggtcggacaattgcccaccgaaatttataagtgccttttgccgggggagattgagccgacggtgaagcgccgggttggcaccacgttcaaattccctcaagaagtgctgagaattcgacgacggaacagcaaagacagcgccagcggcggcggtgaaccaaatgtaattaattaattaggggttaattaaatataattagaataataattgaaatacaggaggaacgccaaatgacccaattggaggccgaaatcgagctgaaccggcgcattgtggcagcagcggaacggttggccaaggacaaaagcgtgaacaaaagtgtgcggaagaagcgccgcaaggatttgcatttggccgcgcaacggttacgaggcctcgagaagggtgaggggatttgaaaaatgaattccttggcattttggcctcgagaagggtgaggaaaagcggattttttttgatattttagcatcaagaaaagggtagaaaattggaaaagcggatttttaaaagattttggcctcgaaaaggttgaggaaaagcagattttggtgaaatttttacttcgagagggtagggcgatttgaaaaacggatttaatgaatcttttcaacaaacatttttaatttacgccccttttaggcctccatcggctacgcttgtccagctcgaagccggacgtcagcacaatggcggacggatgcggcggcgctgtgcccgccgcttccattggccatcagtcgggcagcggcttctccctgaacagtctcagtcagttgggcggcacacgctatttgagtaccactaatctgggccgaacgaaaatcatgaattgattagtaattatcaaaatgataaataccaaactgaacagcgactgatcggtccttcatgagatttaagcgacacttttgccaattttgcacttttaaatggcatctctgcattttcccattctccaaacaaaatccccacccctgtttagaagcttggcccaacttctaccacacttttcgcatgtcctccaacaccaagtcgtgccctgccaccccccgtggctctgtgcctgatttgacaatgccattggctgattctgccgcgacggctgttcccggggcgaacaatgccaacggcgcggaggcgggcaaaaatcggaggacgacgccgagcacggcaaaaaagttgcacaaaatgttgagtcggtaaggcagcaaattaattagcattaaaataatactttctgatcaatgtgatcagattaattccttcccccccccaatcactgatcactttctttggctctatccgatcactttcacatttcgcccaatcactgataaccttttttggctttatccgatcaccttcccctttcccccaatcagtgatcaccttttgtcgtcctcaaactcggcccatccgtcttccgtccctcccgcgtcttcccccgtcggccacccttcggaattgcctccctccccctcttcctcctcgtctctcagtggccatctccccgcttcttcctcctccccctcctccagtggcatttcttctgcgacgccttccctttcatcttcgtccaatttgatcagcttggcatctgcggcaccgccaggtcttttttttaattttccaaatttttctgaaattttctacccgaaaaaaaaattctaataaaacttcagtgccaagtcgtcgcgcgtcgtcggggggcggtgcatccgccggcggtagcgtccaatcaacgaattcagccacaacagcagctgatgatggagcggcaacaacagcggacagtaggacagcagaaatgccaagacaagactcaagcagccactt

SEQ ID NO: 74109 - DNA, 1810 bp, Heterodera glycines
  Genomic contig location: Contig_ID=SeqID_10839; Location=1423..3232; Strand=-
  SCN-specific regions: Sequence locations=1-48,70-374,407-1237,1284 -1337,1359-1780,1803-1810
atgggggtctgggtgagaaattgagaggattgagttgagatttgaggaaaataaaattttaataacataaacattttgccaatttggtccatttgaataattatttttttgtatgcatacaaatgacatccttttaaaattatacgagcggttggggtccacttcgtttcggcgccgctcgtttcggcgccagcccagtttttggactataacttttttctttttccaccaaatctaatattgttgatatcattcgagaacccttctgatgctctattattttgcataattccaaaaaatttgatcaattttgaacaaagttatggccaaaagtacacatgtggcctggttttttgaattcttctagtcataatgtttttgagcattaacgaaattttttgaaacttagcaggctaatagagaacacttagggctttcgaatgataccaataatgttagatttggttgacaaagaaaaaagttatagtccaaaaactgggctggcgccgaaacgagcggcgccgaaacgagggtgtcgaaaattgatgtcttgaatgaaattgactatctattagcggggtatattggagaagaattgtttcttgaaaataaggaacgagtaacaaccggttgcagcaatgacctccagagggcgaataaagtaaaacaaatggaaaaataggaaactctctaaatcaatttaagttggcagaaaattatgtcactaagtggggattctcgcgattgggaccaatttgggtaatttatgtaactcttttcaacaaataaatcctttcattatttaacaggtcggaacgggatcatttgttagcccggcaagaatggaggaaattagcaatgaaattacagaactgatggatcagcgaactgtgaaagttaaaaaatttctgaaagaacatgaggtaaaagaaattatgcgaattaatccaacttgtcggcaatttcgttgccgacgagagggccagaggaggacgaagcggaatattggtgttcaacgccgacggcacggcgagggaactgtcagaggaggaggaaaatgagtgggccggggggatcttcagccacccccccgcccaaccgcgggacccaaacaaaggagggaagaagcgccgaggaggacgacgctgaccaggaaatccggaggggacattcccggataagggccattgccatgttaagcgatccatttttttaaattcgacgacattttcacccctctttatttctctctttatttaaacttttcatttcccttcatttttgctcatttacataatgtttttcgtcaacttcaccatttgccttttcttcaccaatttttctgccattcacatctgcctccgatctttgtccctttgttcacactttctccgatcgccatttccattgggccgttttgcattcatctcattttttccctttgtttggcattttttctccccgccgatttttgtacccttcggcgtcgctcttttgcatcttaatctttgcccccccccccagggggaaattgtttttggtacttaagtattgtttatcgtctatttggggtcattccatttcattcctttccatttttttacacacacacacattcacctcttgctcttcactcgttttcactcctcaccatctttttctttttgctgaatctttcccaatttttgaccccctcaataatccttatcgcccttcccttcctccaattttcaccatataatccatcaacatctcgcatataatcatccacctatttttgaccatttttatcatcatcatcaccaataaa

SEQ ID NO: 74110 - DNA, 1592 bp, Heterodera glycines
  Genomic contig location: Contig_ID=SeqID_10839; Location=3738..5329; Strand=-
  SCN-specific regions: Sequence locations=1-370,392-1280,1302 -1546,1586-1592
atgcgcagaaaaaatatgttaatccatataatttacaaccctaatgatgaccttttgtatcggcatttgttcgaattggtcgacatagacaaagcgttgtgcgcactgatcagttctgatcggatgatcaacaatttgaaggagtacgtcatgtggacccaaaaagagttgctaaaggacaaaatgtttgacgatgtgaccacatccggcttgatgagaagcatgaaggtgggtaacggtgctaaaaatgctaaaaaaaccatcaataatttacaaaaaaaaaaatcataaaaatggagagaaaatgcaataaaaagacaccgcaaaaatttcagaaaatacacccactaagaattgaaaaaaatttcccaaacatttaaccctaaaatatgtatatactttttttttcttggttatttgcctatttttgtgactatttaattgcctatttcggcggtctacgtcagttggcggagcagaacaaaacgtcgtcggccgaaacgtcgttggatggatttttggaccataacttttttctttctcaaccaaattaaacattcttggtattattcgaaagtatttgaaaaacgctattaaagtgcaaattttcaaaaatttttattcatgcacaaaaaaataagggcaaaaaaaagttcgaaatactaggttttcgagttccttctggccataactttttttttttttgaaacttaacgaaaatttttgaaattttgcaaattaataataaacacccagagctaccgaacaacaccaaccaatgcttaatttgattgacaatgaacaaagttatggttcaaaaagtttttcgtcgaacgtttcggcgccgacgccgttttgggggtgcactggtcagttgtgccctacacgtttgggcccctgcatgtttttgactataactttgttttctttgtcatcaaaaggcaacaatcttggtatcactcgaaagctccttcacgtgatcgcgattagccttacaaaaaacaaaaagattttatggcttttgcaaaagttattaagaaaaatttcaaaatttcgacctttccgcaattttcatgctataactttcttatcaattgtctaatcacgaagcgatagcttagaaatagcttctaaacatgttaagctttcgagtaatacacaagattgttggatttggatgataaagaaaaaagttatagctaaaaacagggcccaatcgtgagggcccaactgacgggttccgaatttcagtatctcatcgcaagatcattcgaatcgcgaaaacaatgttatgaaaatgagaataaaattttgttgaatttgcgcgtgtatttccgtctgtttggcgccattgagcgccaaatttcgtcacgaaaaactgaggatacggtaaaagagattggcaacaacactacggtagaaatggaatgggccatcctatacaattttgtgcatgatttttttgaaaaaatgaagcaatttgtgaaaattgtagcagaggttggcattgagcaagcaaagcagagacagtgcaaaaatttatgagaaatttaataattttaaatttttctattattattttattgaataaa

SEQ ID NO: 74111 - DNA, 801 bp, Heterodera glycines
  Genomic contig location: Contig_ID=SeqID_10841; Location=331..1131; Strand=-
  SCN-specific regions: Sequence locations=1-43,72-549,572-714,762 -770,793-801
atgtgttgcaaaaaattgaaaaaacccaattctgacaggttagttttaattttaattataatttttatatagttatgtgtatttaagtttaatagctagtgcaatattacgcgatggcttattagacagaacttatcaaataattcatgataaacaatgtaaaggagtaccgcttgagcaactagctgctgaacaaatagataggagccaaagacgagatcttgtgcaatgttctataaaccctaaatctttgtggcgagaagtatttctctttattaaaaccagaattttttttgttaaggggtcttatcgggctagagaacacgatgttgctgaggatattgaaattgaagatatttctggaatttcatttaactaccctaattggcaatctgtaagaagctcttactaccgtagaagaagaaatcacctaggggattgttctgatccctttaatgtcccagaaaggcttcaactaaataaacggggttcaataaaattgcttcttaaaaagaaaatttccgaagaagacatgtaagcattagttgggtaaatttattaaataaaaactttaaggtggttgcgatttagagataaagaattaggtgtaatgctttttatttcacattctcaaataaaagctgccagtcactgtaaagttttaggtaatagtacctaatgatcataaagaaagattacaaaagtttgccagtgttttatatttttttaatatttattatgtttaggatttgttatgcttgtcagttcatatttttggagaaagttttaaagagcaataaa

SEQ ID NO: 74112 - DNA, 544 bp, Heterodera glycines
  Genomic contig location: Contig_ID=SeqID_10842; Location=1256..1799; Strand=-
  SCN-specific regions: Sequence locations=1-165,188-194,222-271,293-544
atgaaaaaaaccgaaaattttcaattaccgtacgacttcgcttcaatcatgcattatacaacacaaatggacgggttggtagttttttatttttacactaagatcttatttttggccttaatgtttcttttcttgtaaaattttcgacccgaacccttgtttaaatggaaataagtttaaccaaaaatctgtcctgtttaatagaattaaaaactaaaattgctctttttcgtttcagcgagaacaggatcatcccatttaatcggttttatgaaagaacagcggggcaaccgagactgtctttcaaggacactttactcctcaataaaatatactgccccggttagctgaatatacagaataattagaaaattagcacattgtttacttttgtacatcacagacacctgcaaacaactaccgaacaagtgccaaaataatggatatcaaaatcccaaaaattgttggcgatgcctttgtccggaaccttacaggggaagtcactgtcaattcttcataagaggttcggtaattttttaataaa

SEQ ID NO: 74113 - DNA, 697 bp, Heterodera glycines
  Genomic contig location: Contig_ID=SeqID_10843; Location=728..1424; Strand=-
  SCN-specific regions: Sequence locations=1-281,303-340,362-461,483-697
atgggaaccaaatccactttcttggtatcattcgatagccctatatgttatctattaacctgcaaaattgcgaaaaatttggttgaggttcaaagaagttatgggattttttgaaccttaaacaaatttttcgcaatttttcaggttaaaagaagaacatatagggctaccaaatgataccaagttttggtttacaatgaaaaaagttaagttcaaaatttttttgctaaaatatatgcttttatgtttttataagtcgctctaagtcaaaagttcggataaaaaatatttttgggtttcttttgcaataactaatccgcgaaaaaattataaagacataaatccaatttaaaattcatttatattatattcgtcttatatgtatatcaactttttataggagcatgtgcagatcccctctggtgatccattaaaggcaggcgacactttgttctcaaaaatggatgcccaagaaatgtatgaccaacgcaaagaaggtaatgcgtggatagttgtgaattaaactaaattctgaggaaatattttaagcatgtgaaaagtgctttgggacgattcggcaaaaacggcaggccagcccaagtattcaaggagcacggaaatggacaaaatttcccatttcgatcaaattcagtaaaaaatgttggcgtttttcatgatgtatgttcttataattaaa

SEQ ID NO: 74114 - DNA, 1290 bp, Heterodera glycines
  Genomic contig location: Contig_ID=SeqID_10843; Location=2222..3511; Strand=-
  SCN-specific regions: Sequence locations=1-221,256-392,418-452,479 -541,570-681,703-840,862-1034,1065-1290
atgccaccaccagcgaacacttcggcatcaattggatggagattaacattccgacttgcacttccaaattttcgctcaatgtctccgcatcactttaccaaatcggttgtggcgaaatggaaacgcaaattgactttttcaatttgccaacaaattattcgcaaaagagaaatgagttcgatgcatgccaaaaggtgccaacatcggagacatgtcggaagtaaaaaattttaattaaaacattaaaaatattttggctttaaaattattttgcgattttattagtttttgcttggggatacaatttaggttttacctatttttctgagctcttctcagctgcctaatgcctgttttatgagtttatattagggtagcattttttttccaataaattgtctcaaatttatttattttcgttgaagaacttttgatactggtttggcctaatgttgttacaattttttaaaaaatttgtcattttacgccccgagcctacctatttcatgtattataaaaaaaattccaattttggttgaacatattttaaattttcataaaaaatttttcccattaatgttaatgtgttttaattgcattttttcacatcagttcgtatgaattggttgcctgtttcaaaagcaaacgacccccattggtactcaacaaagcgatttcacaaatctgcaaaagacacttcagcaatgagccaaattcggctggatttcgaattcgccattgcgtgcgtcgggatgccagggcccaattgatcatcatacaatccattttggatttttcatttacctttctcaagtcgttttgagaatgaatatataattgaataatgggtttccataaattccaggtacaaagtttgccgaaagttttcattcaaaatggaagaccttttgcaagcgcatctttttgtcccaatttttttcatcgatttttcatctgatcgcgcgagcacaattcgaggagcgggaaaagagctcacgatcaatttggccaaaaaagtaaaaacaacaaaaaagataataataataaatatatttagaaaaattcactttcttccgttttgaattcaattatggaagaatcatggaatggcacattggcaaaatcgcttcattttatcccacctgaaaatggatacatcgaaatttttttccaagtttccgagctacattattcaaaattaattacgcgcgaagaggatctggagccatacagaaacaatccaaacattgtaaaaactttactgaaaacttaataggacagacaattaaa

SEQ ID NO: 74115 - DNA, 1006 bp, Heterodera glycines
  Genomic contig location: Contig_ID=SeqID_10844; Location=13..1018; Strand=-
  SCN-specific regions: Sequence locations=1-33,57-331,353-662,686 -738,770-781,880-892,914-1006
atgccaatgccatcctttgcccgtctccgtttgtttcccctcttttttcttcttttgctgagcacaaacagcgaatgtgattggtgggacaattttgtgaacggtgcgcatgaaaagattgttggtgtaagtaaagatcaaacaaatggttaattatccaatttaaaactagagttgcacggtaccggtactggccggtaattaccggtttttttgccaccggtaccggttttttcaaaaatcaaagtaccggtaccggtttgtctagtaccggtaccgccggtaaaaatttgcactggtaagaatgggggtctggtcgagaaaagaataggaaattggtgaagaaaaacgtgccgagaaaaaagcggtgtgagagcaaaaaaggtcattgatttacattactttacatggccggagaccccttcgcaaaattggaaaattggccgctgatcccttgttttgcaataatctgaattttgaggtctacatctggattttagtgttctttatcctgaatttgaaaaaaaaacttggtcaccctcaatatacatatacttctgaacaattctaatgctaaaaaagcactcgcgcgaaaactgaataaaaattttgtatttgaaaaattttgtccaaaaatttttacgttggaaaattaccggtttttaccggtaccggtttttgcattaccggtcagtaccggtaccggtttttttacaattaccgattaccgtgcaactctatttaaaacataaaatttataaatatatatcacaatgcagtgaaaatattaattgataaaataattataaaaaaaaatatttattaataaaaattaatttaccaataataaaatattcataaagttgatatatatttattctaatttcaggctgccgattggctgcgcgacaaagcgggaccaacggttcgcgaaaagttcaacggcgccaagcaaacactgcaggacccggagacgcatgagaaagtgcaggaatgggttgaggag

SEQ ID NO: 74116 - DNA, 1416 bp, Heterodera glycines
  Genomic contig location: Contig_ID=SeqID_10845; Location=1882..3297; Strand=-
  SCN-specific regions: Sequence locations=1-367,403-403,434-440,490 -1416
gttgctcaacaattacattggacaaccccggccaaatggaacttggtctcaaccactcttcccaccagagcagtggaacgtctacactcgcacactgaatggggaagaaaggacgaacaaccacgcagaggcagaacatcaccgtcttcaaggcgccttcaactgccgtcatccatcgatctggcacttcattgacgttctccgccgtgagcagaagggcaccgatgggaagtatgcgtcatttcttgctggacttgagccaccgcggaaagctaagaaataccaagcggctgatgagcgcctcattattttagaatttctccgtggaatttcgcgcaattatcatatgaacccataaattgtttccattttttttttttttgttaagtttattatatttaacgaaaaatttcattttttgtttccatttcttcattttgttaaatttattatatttaacgaaaaatttcattttttttataatttttacaatttcttcctgccttttttttcatttttggcttggcgccaaaacgtcggcgccaaaacgtcggcgccaaatcgtcggcgccaaaacgtcggcgccaaaacgacctggtcccttttgtctaacactgggcttgacccatagtgtcaagaaaaacttgaagacataacgccaaaattttcaattttttgttaaccctacagtatgtatgtaccagggatggcacggaattccggtttccgaaaaaattatggatgtcggaattccgaattttttgatagaaagtcggaaattttttagtaaatttttttccaaaaaattgataattttctacaattctgttaaaaaattgcactggaattttcaaaactttcccgccggcggcgcctatcggcacctcaggacacccccccccccagtaccaaattttctttgaaaaaagcgcaccgcaaaaaagatatggagtccctttcccaaaaatgttctaaaacaatagaaaatgacatatgtaaaagattttgatgaaaatcattgagtaattttttcaagcaaatatagaaaaataccaaaaacttttttgaaatcaccttttacttggttaagaatttaaaatttagcctattaaaatattttgaaaattaggtaaattaatctttatttttcaaaaatttcccatttcctacttccggggcgttagatgaccatgaacccgtggttgctcatttgctacgggtaaaccatgatggcagtggttattttacataaccaccttctttgactacggcccccgattgtcgacgtttttggggtcggaattccgatttccgaaaatttttgagacctcggaatgccatccctagttggtatagtgcaatgacaaaggcccatcggacaacccggcggaagatgccagcaggtttccaaataaa

SEQ ID NO: 74117 - DNA, 106 bp, Heterodera glycines
  Genomic contig location: Contig_ID=SeqID_10846; Location=129..234; Strand=-
  SCN-specific regions: Sequence locations=1-39,105-106
atgcctcggcgggtaaccaccgacgcgcacgaatggagcaacgatattcccactgtccctatctactatctagcgaaaccacagccaagggaacgggcttggaaaa

SEQ ID NO: 74118 - DNA, 1986 bp, Heterodera glycines
  Genomic contig location: Contig_ID=SeqID_10846; Location=3150..5135; Strand=-
  SCN-specific regions: Sequence locations=1-277,299-1080,1114 -1628,1651-1939,1961-1986
tgcgatggatggacgtgcttataccgacgaggaatcttggtcaaatgtattggtggaatgtggcgtgaacaacgatcaattgcgtgaaagataccaccaagtgagacattttcgctcattatttacaaataatatccatttctaacaataagatttatcatctcgtcaccgctgcggatggtgcacaatcattttatcaacttgcgaataaccaagcccgaaccgaagcaatggaggaagcaattgagcttgacaaaaacaccagagaagtatttttattattttattagcatccaatgccgaaattaaggcatggattgggcatcaatgtctatcaataatcgataattcaaactgttgttcgtttgaagaaaagatctccaaacttattgctgatgtttgtgagcgtcttgacattccgattttggatcgtttggcttcaaatagcaagtgaattttataataaatttggtttccataaatctaaaattccaaggaaccgcaaatggttggtcagcaaaatcgttgacatgccttcttgcaaatgaagaaggaggaatttttaatcgaggatgattatctcagtacggagggttcaagtcaggtaaattttacttattacagcgtgaaatttatgtcaccattttctttgacaattttcatttctggaatcgttttgcgtttctcattatcgtttaaatttttcgcgcatttttaccagaaaacatggaaactgtaggtccccatccctttgtgctacacctgggctacaagtttatctttgcaggttcgacttcgctcgcgtagccaaaatggaaagtacacgtacacacttacgacccgaacctttgaagacgctgatggcaagaagtaatcttcgcctttaaaaaaaattctcttttgcaaatatagacttccccaaccggttgaaacacggaagcagttggacaggcgcgagtatcagagctacttgaaacttcttgacagaagccgtcaatcaattcacaagaaacgtgtgtgttttgtcttcggaaatgtggtaaatcggataccttcaaaagtcactagattgctaaaagaatatgcttttcctttcccagtattttaacctggacatttacattgcacctcttcctccagcgttgatgtacaatgaaaaccagctgatgatcctcgaggcaattaaatatttgccatattttatagacaaaaaacattgttaaaaatgtttttatagctcgattaactttccagacatataccacgcgccctattggtgatcctgagccgcgtttgcccgattttctcgaaattgagcgtgagataactatggagtcagcctactcaatgtaacagcagcaattctttccttcaataccattgttgtgcatgtcactgtttaaggtttaacttggctcgcaacaacccggggaacgtgactggcataaatggagcagtgcactgaaccaacctatcatagtgagatcagtgactatgcaaatttttgatctacaatgagctttttctatccggtcttattttgttccaataattttcatcatttggtctaattttcaattgtaaccgtttaatcgattttgtatcatattgaaaataaaacattaaatcaatttgctttatttttgcacaagtctttaatttaatctattgtgttatttttgaaaatcaaacaaaatttggatagatttttggcttacaattaggcgaaagtgtctgtacagttgcctagcttcataagttttgctttattgtattccaacaatgtgaggaaacaaaaaaaaattacaacaaagctgaaatgatgcattgaatgctttccttgaattttggaccagagcccgcaatcaattgagagcaaatttggcaaattttttcgttccatgtatgagttgttttccaatcgtcatcagaatattcatctaaaagcaataaattttaattgggactgttaaagtgagagaccaa

SEQ ID NO: 74119 - DNA, 782 bp, Heterodera glycines
  Genomic contig location: Contig_ID=SeqID_10846; Location=2551..3332; Strand=+
  SCN-specific regions: Sequence locations=1-491,516-625,647-782
atggagttccattgttctacagttttgttgccagacactgccgatgagttagctaatgacgtacttaatgccctctgttttggtagaggtgcctatttttcttattactaatagcacaaggacatcattttaacacatttccagttgcttccttgtcacatatggcttcaatgttggatgatcgcttcaaacctatccaaatcgttcgtccctttcgcgacatttcctctcgcgagttagaagcaatgcataacattgagcgggatgaatgcagtgaacccgtcttggcgtcttgcagaaaagagagtggtgatgtgtagttaaatgcatccggtaacaattaatatatgacaatgtttagttgatgagtctaattgtaagaataaatgtgacggcagtcttcaagcgcttactgaggattttatatcggaacttcgcaccggtggattcccagcgacggtattagtataactatatcagtaagacacttccattttctttttaaatattgcaggtatcgactattttaagcgtctcgataaaaattgacaatagaacagtgggtcggaattgtggactttgttacgaacaattcgaaattggtctctcactttaacagtcccaattaaaatttattgcttttagatgaatattctgatgacgattggaaaacaactcatacatggaacgaaaaaatttgccaaatttgctctcaattgattgcgggctctggtccaaaattcaaggaaagcattcaatgcatcatttcagctttgttgtaa

SEQ ID NO: 74120 - DNA, 663 bp, Heterodera glycines
  Genomic contig location: Contig_ID=SeqID_10847; Location=40..702; Strand=-
  SCN-specific regions: Sequence locations=1-663
atgacaattgatggggacaaagggtcgacaagcgaatggccgactgatttttggagcaaaattttagcagatgatcaacggcacatgaatttagcatttgaaaggacccaatccatgggctcggcatccgctggcctaatcggaatggatcagcaacacgtggatttgggatttggaaggtcaaaccaatttggaacggatcaacggcacatgaatttagcatttgaaaggaccaaatccatgggctcggcatccgctggcctaatcggaatggatcagcaacacgtggatttgggatttggaaggtcaaaccaattcggaacggatcaacggcacatgaatttagcatttgaaaggatcaaatccatgggctcggcatccgctggcctaatcggaatggatcagcaacacgtggatttgggatttggaaggtcaaaccaattcgacacggataaacaactcatggatttgggatttggaaggacccaaaccatgggctcagcatccgccggacaaattggcatggataaacaacacgtgaatttgggatttggaaggacccaatccatgggctcggcatccgctggcctaatcggaatggatcagcaacacgtggatttgggatttgggatgtcaaaccaattggacacggataaacaacac

SEQ ID NO: 74121 - DNA, 81 bp, Heterodera glycines
  Genomic contig location: Contig_ID=SeqID_10848; Location=768..848; Strand=+
  SCN-specific regions: Sequence locations=1-81
aatgtttttgcggtcggtggttgttctggcccgggacaacatttggccaacgccgaatctgtccaatttgacggtcattaa

SEQ ID NO: 74122 - DNA, 3009 bp, Heterodera glycines
  Genomic contig location: Contig_ID=SeqID_1513; Location=859..3867; Strand=-
  SCN-specific regions: Sequence locations=1-582,604-889,911-3009
atggtcgcccaaatcaaaaattcacgggcaaatcaaaggccaaagccccgccaagcaactgatcagacaattcagccgttttatgttgccaaatcgggatcattgaatcttttgggcacaccggcaatggaagcgtttggatttctggaagaaatacggcgaatgatcaatcccgcccaaatcaatcaaatttcgtcaaatgatgcggacaaaatccaacaattcgtcgaaatattgccgcaaaaatatgagcaaatattctcagatggccttggctactgctccaaaatgaaagccaatctggtgctcaaggaaggcgcaaatccaacgttcaagcgcgcccgtccagtgccatattccacgctgccaataatcaatgcagaattggatcggttggagaaaatgaacgtcatcacaccagtcgaacacactgactggccagccccaattttggtggtcaagaaagcgaacggaactgctcgtctgtgcgctgatttctccaccgggctcaacgactctctccaattaaaccagcatcctctgccattgccagccgacattttcgccacactgaatggtggaaaattcttcacaaaattggatttgtcggatgcatatctgcaaatcgaactggacggcacttcaaagaaattgtgtacaattgctacacaccggggacactaccaatatgagcgactaccatttggagtgaaatccgcccccgggatttttcaatcggtgatggacaatatgctctccgatttcccattcgcattggcttatttggacgacgtcatcatcgtcagtgcgacatttgatcaacactgccaacatttgaaccaaattttcacccgaatttcagaatgggggttcaaagtccgaatggacaaatgttcatttttcaaaaatgaaatcaaatatttgggcgtgatcattgatcaaaatggacgtcggccggacccaagcaaaatcacagcaattgcggaaatgcgaattccttcaaacgtcagcgaattgcgttcatatttgggcatggtcaattactaccaggagtttgtccgaaatttccggtttatccgacagcccctggacgaactgctgaagaaggacgccaaatgggattggtcacccaaatgtcaaaatgcattcaccaaaattatttcaatgctacaatctgagctggcattgacgcattttgatccaaatctgccgatcatcgtcgcagccgacgcttcacaacatggcatcggcggcgtcatatcacacaaatttgccaatggctcaataaaagcagtgtcgcatttctcacgatcactcacaccggctgagcaaaattacgggcaaatagaaaaagaagccctggcattggtggaagccgtcaaacgctttcataaaatgatcttcggcaggaaattcacattgctgacggatcaccagccactcaagaaaatttttggcaataaagatggtgtcccaaagcactcccacaaccgtctcgtccgttggccactcattttgacggcttacgacttcgaaatacaatacgtcaaaacagacaaatttggacaggcagatgcattatctcgcctaatttccgtccaaaagtcaaaatccgacgacgacgaagtcattattgcctcattcgaagtggaatcggcattggacagaaatttgatcaacaatgtcaaccatttgccgatcaccttcaaaaatttggcccaagaaacggcaaatgatcaggcactccaacaaattcgtcaatttgtcaaaaatatttggccagaacctaaaaattttcagccaattgaagggctggacgaagccaaattcattcaattttatcggcgccgcgacgaaatttcaatcgtcaaggactgcctgatgttcggcgaccggacggtcatccccaaatctctgcagaagcaaattctcaaaatgcttcatcagggacatccgggagtcaaacggatgaaatcgttggcaagaatgtatgtctactggccactgatggacgccgaaatcgaggcgttcgtccaaaaatgcacttcatgcgcagctgtcgccaaaaatccaatcaagacgacactgcagtcatggccaaaatctgatggcccatggaaacgcattcacatcgattacgccggaccatttcatggaaaaatgtatttgattgtcgtcgactcattttcaaaatatccggagatatttgaaatgaattctacaaatgcatcggccacaatctccaaaatgcgctcattgatcgcgcactacggcatcccggaaacaattgtttccgacaacggcactcaattccaaagtcaccaattcgaaggtttcgtcaaatcgaatggaattgatcacatttttacggcgccgtacatgccacaatcaaacggacaagccgagcggatggttgacacctttaagagggcatttgcgaaaataaaaggggagggagtcgacggcaatgtgctcgacacttttcttctcacatatcgcacaacgccatcagacacactggatggaaaatgcccggccgaattatttcttggccgaaagcctcgaataggcctcgaactcctccggcctccgctgtcaattccaattgtcaaggacgataaaatggaggaccaattcaatcgcaaacacggcgcaaaattccgatcatttgaaattggacaattggttttcacacgtcggcacaattcagcggaatggcgacacggcaaaatcatcgacaaaaagggtgtaatttacaccgtcgaattgccaaacaattctcgcggccgatttcatgccaaccaaatccgcgcacgtcaaattccggatgaggacatcgaagacccgctcgatgtgatcaatggcacttttggcctcccaattccattaagggaccaaaatttggcagaagtcccgccatccaatcaatcaccgccagtccgccgttatccgattcgaaatcgccggcctgttgaccgccttcaaatcgaccccagccgatcgtcctat

SEQ ID NO: 74123 - DNA, 913 bp, Heterodera glycines
  Genomic contig location: Contig_ID=SeqID_1514; Location=33..945; Strand=-
  SCN-specific regions: Sequence locations=1-300,322-913
atgttcagaggaagcacgctttttcgacggaaagcggtgcaaattcatcggacgcgggaccgccaccttccaattcaacgaattcagacaattcagccgttttatgttgccaaatcgggatcattgaatcttttgggcacaccggcaatggaagcgtttggatatctggaagaaatacggcgaatgatcaatcccgccaaaatcaatcaaatttcgtcaaatgacgcggccaaaatccaacaatttgtcgaaatattgccgcaaaaatatgagcaaatattctcaggtggcctgggcttctgttccaaaatgaaagccaatctgatgctcaaagaaggcgcaaatccaacgttcaagcgcgcccgtccagtgccatattcaacgctgccaataatcaatgcagaattggatcgattggagaaattgaaggtcatcacaccagtcgaacacactgactggtctgccccaattttggtcgtcaagaaagcgaacggaactgctcgtctgtgcgctgatttctcgaccgggctcaacgactctctccaattaaatcaacatcctctgccattgccagccgacattttcgccacactgaatggtggaaaatttttcacaaaattggatttgtcggatgcatatctgcaaatcgaactggacgtcgaatcaaagaaattgtgtacaatcgctacacatcggggtcacttccaatatgagcggctgccatttggagtgaaatcagcccccggaatttttcaatcggtgatggacaatatgctctccgatttcccattcgcattggcttatttggacgacgtcatcatcgtcagcgcgacattcgatcaacactgccaacatttgaaccaaattttcacccgaatttcagaatgggggttcaaagtccgaatggacaaat

SEQ ID NO: 74124 - DNA, 466 bp, Heterodera glycines
  Genomic contig location: Contig_ID=SeqID_1514; Location=4789..5254; Strand=+
  SCN-specific regions: Sequence locations=1-147,169-220,242-427,463-466
atgaacagaaacgtcaaaaaagcacaaaaaattgcaaaaaggtagcaaaaatcaacatttttctagcaaaaaattttccaaaagaccttttttcaactttttttttctcctatgttatattaactatttcagaaccggagaaaagggaataaatttttggttttcaaatttcaaaaaccaaggtataactgtgagtccggcggtgccgatatgcgccgctgggaaaattttttggaaattgtaagaaaaatgatgagaaaaattgctaaaaattaaaaaattttccattttttttcaaaaaatactgaaaaaggcaaaaaaaaggcaccaaaaagttcaagctataagcttcaaaccaagttaaaaactcgttttacgtgcatattaggcctctaattataaccatttgtgcgctttaattccattcttattaatgtttgtaatttttaatttaatttctattgaa

SEQ ID NO: 74125 - DNA, 57 bp, Heterodera glycines
  Genomic contig location: Contig_ID=SeqID_10849; Location=755..811; Strand=+
  SCN-specific regions: Sequence locations=1-57
atggagaatggcaatggaattgaaaagcgaggattggtcgttgaggacggtgacgga

SEQ ID NO: 74126 - DNA, 1799 bp, Heterodera glycines
  Genomic contig location: Contig_ID=SeqID_10850; Location=742..2540; Strand=+
  SCN-specific regions: Sequence locations=1-657,679-777,799-904,927 -1148,1172-1757,1779-1799
cccgttttgtcctccccttcctccgccgccatttcaaaattgacttcctccgcattttcatccgtgctcgacaacggtgtcattggtgtgggaaaagaaacacgagcattatttatttctttccaaaacaaaaaattcatcgctttatttgatgacattaaataccaaaaaaagaggcaaaatgagacgattaatttgggaatttaaaggtgacccgcaggtggactgtttggaagaccgcgtccgattgaccttccgaacgcagcgaccgttcacaggacgtaaaagcgatgagaaaagggagagaattggcagaatttattaaaaatgattaaggaatatttgtgaagggaatggtggagaacgacaaatgcgtgaacaattaccaacagaagggccaaacgaaggtgaaaaggcaaaagcaatactcaattaatgggggtggtaattggctaattcactcctaattaatctaattaatgagttcctaattaattaccccccccctctttttgcttgcttccattccccgcttttccttctcctcaggtggacttcgaattgaccaatggccagtgcaatatgcgccgctccagaaaggttgtttgattacgccgtgactagagaatgtttggcacttatcttttctgaaaaagatggcttaattctattaagccattcattaattgctttttcttttttttcttttccaattttggcattttctgaaactttcggatgttttttggaaagcatttgaacttttttttactacaataatatttacaaattgtttctcctccttaaaaataatcaggtcaccgccccaaccaaaaatagagagaattttgaatcggacgggcaacccaaagaaagaaatgaccacccaaaactcaccaaacatttatttctcttctcactttcaagtgccgaattctctctcgccttttgagaagaataaagcgaacagaaaaaaagaccttatgggaaaataaaaaaaaaagtttgaaaattcgggggggggggatttgggatttggtaagtccaatttgccattaattattgctttgaaccgtcacattttctgctgcttgacaaggtcacacaacaacagctgcaaattcatggcaaactgctgattatatatgtttttgtcttttttgtaatgagttgttttgagaaaggaaaggcgccccggggggagggaatggcgccggggggcttttgccaattctaatggatcggttcatcaaacccagcagaagtgccacttcgtatttcggcccttcaatttccgattgtccttttcagctcggccctgaacagcggggcgtggaacagtccgtcaccataatcatttcctttcacgacattttcatcacaaaggtcgatcgggcgtaccgttgcacctgcttttacatggtttagccaaacgaacattcaaatggcaaaggcttttcttttctcgcaggaagccgacaaagtggtgacgaaccgtttcgatgtgaggtaaaacgagtaaaagatcaatgcacataaaaagtgaattgaatgccgtcctttacgcagtatgatgccaacaacggaattggtggacaccgcgcgaatgccaatgtgcacttacaccgtacgcattcccactctctttggagttgctgttttaaatggggacggtcttcagaaacggaatttcccatgccaatttttggatttgtcctcatgccatttatgattagcttcggctttatcctccatgcttttctgctgtcttttgttttgaactgtgcatttgaccccaa

SEQ ID NO: 74127 - DNA, 1964 bp, Heterodera glycines
  Genomic contig location: Contig_ID=SeqID_10852; Location=542..2505; Strand=+
  SCN-specific regions: Sequence locations=1-36,58-135,157-480,503 -599,630-631,653-738,770-792,815-917,946-991,1013-1129,1156-1251,1299- 1320,1342-1380,1422-1468,1491-1497,1542-1633,1655-1739,1761-1765,1804- 1964
atgttcattttctgttttactctctgctgtttggtcagtttggcatttggcacactgctaaatgtgggcattgaaaatgtgccggaccaaattgtgatcaacgccaatcaattaacgccattaacataccatttgcttaaaattttggaaaatttgatgggcattgtgccaaaacgccatagttctatcaatttccgaattattccagcagttgacataccccttgtcgaaatggtgtacagcggtcgactgaatgtgcaaaaaattttgggagaaattgcggaaaattttgaaaaaaatgctgatttggcacaaattttcgagcattttttgatgtttgctgatggatattaccaacccgtacaaacaggtgatgtgaaccatcataaacaggaggagaatgcatcgcgaccaagggagttggaattccattacattttgttagaagcctagtttcaaccctataaagtcccttcaacactttatttattactttttggctcatttaaaatatttcctggaatagagccacccctcctgaaataaagcccccgttttgatcgggagggggggggggtctattttaggaaaaatgttacattaattttttttttaataaaataataaaagtaatcaataaatgttttttgaaacggtgaaaattgtcgtttttaaatacgcggtacgcaaatgctcgattcgtggcagtggaatttctgtccacgctccacccttaacataaaataaatttaattttttaatttttttaggaaatgctgaaaaaaagaaagcagaatttttattatattgtatttattcatttgtgaataaaattacacaaaaatgtttgcaattttttgacaatgatcctttggaggcaacaaagctttgggctgacattagtaaaaggcaaaaactttaataaaaaattaattaattaattaagtttaagctttatttctcaagtaacgcccgttccccactcaaaacttcgtgcagttttttcccaattttgcattggccaatcagatggatttaagccagttttgggtgaatggacaactaattgggctacaaataatttcaatcaaaatttggatcaaaaaattcatatcaaattttcgacaggtaatttattttatttattaattattacgttggtaaatattttttaagaagtgatgactctcaattatatcaaatctgacgaaaacaaggcggtgaaaataattttgatcactcgtcatcgcgtaaaattaaattttaaaaatttccaaattaaattttcttaaaatttagagaggctttacgtttcggaagaaaaagaaatttttcaatttagtcattgatgggacgggtaaccaccacatttgatacacaaaaataaattgtgtgctgctttcttcattttcatatttttaagaaattgtcaacacagatggtgggatatttttgacaaaaattgataaactttggcctcaaagaacattcaaaaagtaaatttttaattatttttttttgaaaaaataaattttaatttagaaaacgaattttttgtggcgctttaaatgttagtgccgcgaaaattcaagaaattttggaccaacttgcagcatcaacagaatatgcatataattcaattaaatcgccggatggaaacaatgcttttactaaaatgttgatgcataagttagcgtctgttgccggtgatcatcagttgaacataagccaaattcaatggttttctgggaaaaagttggtaccgaattttgccagatgcaaaatttaaatgtatttattgtaacgattacttttatgtaccgtatttcataaaatagaacccaatccttgctaaattaaaacaaagccccccttccgcgagcggggttgaaaattgagcctcaacccttaaattagacccccctgaaattaaaccgccgctccccttccgaggggggttgaaa

SEQ ID NO: 74128 - DNA, 314 bp, Heterodera glycines
  Genomic contig location: Contig_ID=SeqID_10853; Location=42..355; Strand=-
  SCN-specific regions: Sequence locations=1-17,40-41,63-314
atgaaccgacggtaatgaattttaaaagtcacacaaattcgtcatttatttaactaaactgtttttccataatttcagttggatttgcaacgatgtttggatggacattttcccctcttttgaccgtcctcaacttggcctcaaaatggcacttctttcgccacgtttcaatgcgttggtggacaaacatttcgatggaaaaagcgaattgactatttggagaactatcgaaattagcaaggacaaaggaccagaaccgaaactatctgtacagatggatgacaaatctttgccatttccattgcccgacgacc

SEQ ID NO: 74129 - DNA, 596 bp, Heterodera glycines
  Genomic contig location: Contig_ID=SeqID_10853; Location=2087..2682; Strand=+
  SCN-specific regions: Sequence locations=1-76,102-385,408-410,432-596
atgaccaggtatgtaggtatcagcagatgtcaaaacaaacgccatattgatgatgatcagtgaccttgaaaagcccaaaaatattaatttttaaaatttttcgaggggggggggggggtagcaaaacaaggagtaccacactgggttaggttcaaggatatattttgtcatccctaaaatttcttgttaccacagtttaacacacttccagaactcaacattagccaagtgtcagaaataacccacaaataaccaccaaaacacgggggaggttaaaggttattctcatgatcgaaccaatttctaaaacaaattaatcggcctacgaatcagaaagttaaatatgtattagactagtgtttttcaaatagattatgtatctatgtatataatttttaatattttttccctttaaaattctttattttatttcagtgacgaaacgttcggccaccaactcgtaaagctcttttttcaaaaaatcaacaaatttggatgacaaatttgtgccatttccattgccggaccgtccgttgcccagcaaaatccgttttaattaccttcggattgagtacttaaaaaacagttttatggca

SEQ ID NO: 74130 - DNA, 455 bp, Heterodera glycines
  Genomic contig location: Contig_ID=SeqID_10853; Location=2808..3262; Strand=+
  SCN-specific regions: Sequence locations=1-175,197-311,333-455
atggaagagcagccaatttgggatgtttttgttcgtgaaattaaagatggccaacccaagcgattgcgttgcgataattactacgaacaaacggacttagattggatcaacaatttcaaggaggtgtggccataatctcgaaaaatcactgatttttgtttcaaattgtttagcattttcttcgtgccaatgccatttcttccatcagttacgaaattcatttttatgtgcaagtgtcgtcaatgctaatgatgccatttgaatgtgtggtgaacgaatcgacaaaggaaaagctgacattgaccaaagcaaatgaaaataaattggacaaccgatggataatgaaacgatgcaaaattgggaataagaccgcggcggttcagcagcacaaagagggcgattgtaacaatgtgtttttttggctttttgctgacattaattacatttggtgagca

SEQ ID NO: 74131 - DNA, 141 bp, Heterodera glycines
  Genomic contig location: Contig_ID=SeqID_10854; Location=484..624; Strand=-
  SCN-specific regions: Sequence locations=1-56,80-141
gtgctcggtctctacggaatgattgtctcactgctgctaagttcctcctgaacaatggaaggaagaaagaaggaaagaatggcacgtctgctgaacattgtgccgaccgtcgtgttttgatgatcaaaatgaccagccacc

SEQ ID NO: 74132 - DNA, 131 bp, Heterodera glycines
  Genomic contig location: Contig_ID=SeqID_10854; Location=213..343; Strand=-
  SCN-specific regions: Sequence locations=1-131
ttaggccgcttcgcggcctcgaacgggcgctttgcgcccgttttttaaattttgttgggcttatacgggtgcttcgcgcccgtttctaaatttgttgggctattaaggcagcttcgaggcctcagacgggc

SEQ ID NO: 74133 - DNA, 569 bp, Heterodera glycines
  Genomic contig location: Contig_ID=SeqID_10855; Location=82..650; Strand=+
  SCN-specific regions: Sequence locations=1-153,222-458,481-534
atgcctccaagcgaaaatttttcaaatatctcgctagatattaatgatttggaagctcgaccgctgcctgagccccaacaacccgaacaacaacaagctgaattattgattcagattgttgatgttgaggaggctttgcttttcaacgttcatgagggagaagaaagaagagaagaagaagaagaagatgaagaagatgaagaagaagaagaagaagaggattttgtgcaatttgaagaattgatgcgtttacatgccgagtatgtagcgcaaattttcaatgaaattgatgatgatgaaataaacaatgaatgatttttttgaataatcgaagatgaccgaaaaaatggattctgttataagctccgccccttttgctgtaaatttatttgttattccgcttcttcgttcgaatgaggtcattaacatttaaaatattttagcttatgggcggagcctaatttatttatctaagtccaccactaaattttctgtataaaagcacaccgctttgctcactttgttcattcgaacagaagaagaagccgaagaagcaacaacaacaaaaa

SEQ ID NO: 74134 - DNA, 4181 bp, Heterodera glycines
  Genomic contig location: Contig_ID=SeqID_10855; Location=782..4962; Strand=+
  SCN-specific regions: Sequence locations=1-1254,1286-1387,1418 -1439,1494-1942,1964-2094,2116-3059,3082-3193,3215-3295,3319 -3872,3894-4181
atggctaaccgaaatccattttctatcgagtctgtgcatgagatgcgcaataggccaaggaacactcggggagaagtggcccaagtgcgttttgtcccgcttgaacaagtccaacgaccggaccgcgtgttggaaatgcttgttgaacaattgtttgcgcgagtgcttggagatcggccaccgccctccttgattggcttacaattgcacccgcccacgtttgagaatccattcacaattgctcttcggcctcctgaacaaaacaatccggccgcaattgctgactatattcaacgtttgaacgatcaatcagcggcaggaatagacttaacagccgggacaacgcttaccaaagttttggctgtttggccaatgcatgatgatcgaacggaaaatggacgtgaaggtaaaagagaccacaatggatgttcattggatcatttctataggggcgtgttcatgggatcatgaacactccgttgttcacaccgtcaactcactagtccggattcggaatccgaacgacagattgtgcctagcaagagccgttttaattgggttgaaagaccatcgttcgcgccagtaccaaaacacccgagctggacaacaaatgtttaagaattatgttggccaacaacgatttcatgggcctgaagctcgccatctgttacggagagcgggaattaagacgaataaaaatatgtacacgctggatgacgtcagacagcttcagcaatgggttgatgaacgttacgaagaggcacagattcgtctaactgtttttgagaaagagcgacagtatcgaattgtttacaaaggggcgtctggccgtgctgctcgcttcaacctgtgcctattgttggagaacgcccattttcactatgttgggcgtattgaacaactgttccgttgcacgtcctattgcgttgattgtgaaaggcgggtgactcgttggtatcatccgcaagaatgcaaagttgtttgccgcctttgtctacgctacggtgcagactacccttgccaacaacaacaatttgccaacggaaggaacagcaaacatttctgtacacagtgccaattcgttttcccaaatttggactgctacaactatcatttgtccaatcgcgcaccggccaacttggatgggcgaagcgggcgcgcgttccgttcaatctgcgaatggaggcgtgtttgtcgaacatgtggggggatcgtctatatcaatttccaacatgtttgtccaccctcggtccgacaacaacaacaacagcagcagcaacagcaatttgcatcattgtgccaccagtgtgggggacctcatgcggaagatggtccatgttttattcagccaatggatggacgtcgtgtttttgggcaaacacgacgtcaacaaaaacaacaacaacaacagcaacaatcttcagttgaaaactgtttgaatggcaacgatgatgctgccgataaagaagatgataccgatgatgacaatgatgcagaaggcgagtcccagcatggggctggtggtggtggccaccgtcgccaagcttctcaaaaaacaattagatattgtttcttcgatgctgaaacatctcaggacaggccattacaacttcgaacacaaattgcacaaaaacatgttccgcttttgattattgctgaagtgatttgcgagcgctgcattgccgatggaattaccatttacggcggtattggaaagaaggcgaatggttgtgtttgtggcatgccatcagggccacggggccgtctttggtgtagcccgccctttcgtaacgcaccaaatgacgacactgagatgccaacaaacatcacatataatcctagacgtcttttcttccactgctttgaagacgcaaccaaaaacccagtggaccagtttcttgacttcctcatctcaacaggccctcgaaaatcgcacactatttgtttgtctcacaatggtggaaaatacgacatgcatctggttttggaggcactacatcatcgaaatttacccccaaaacgaatctgcacaacggggctaaaaatttactcaatgtcgcttaaaggaaatcttcagcgccaaataacctttaaagacacactcaattttttcttctgtgaacttgacgccctgccaagaacgttcaatttgccaaatgaaattgcaactgccaagccgtttttttccatatttatttattcgccaccaaaatttgaatgttcgcctccaagggctgccaaatgctgtattctatcaaccagaccacatgaaaacggccaaacgcgaacaatttttgagttggtatgcttatgaaggagcagtcgccaaatttcagctcagagaacaacttataatttattgtgcgaatgatgtagctatcctgcgtgaaagtgtgctgaaatttcgccaattgatcatggagaataccatgggcttggatctatttgttattgcatctacgggtgcagcacttgcgttggcaacctttcgacgttgttttctgtctcgcaataaactgatcaacacacctgagggcggttatttacgaggaagacgcgcatcggcagaatccgcacgatacattcgcatgtatgaactgatgaacccgggtgagcacgttcaatcggcgcaatggactgtgggggaagcgcatgttgaggattctggttatcgattggatggattacatgttcgtctacctcctctgcgaaatatagcgattgaatacatgggctgtttttatcatggtagtattaattgcgttaaatgcgtatgaaaaagaataataattctcagggtgtcccaaatgttttccaaacgatcgtcaacaaactttggctggcggtagatctgctgaagagttgtatgaacgtacacaacgccgcctttgggagctagaacacacgcacgggttcgagcttcacgttgtttggggatgtgagttgaagaaaagtttgcgggccaatccagtgcttcggcaaatgtacaatgacgccttcgttcctcgcccgttggatccacgtgaggatgccctgcgtggagggcgcacagagccatttactctccaacacatttgcactaacgatgaggaaattgttctcatcgatattgtttgtcaaacacaacagtgaagcaaacataatagcattttaattcaaggtgagtctctacccttacgtgatgaaggcatttgattttcctgttggaaatcctcgtgtgcttacacgtgaagtgcttttacaacctccggcatctccattaccatggcgaaacgcaaactgcaatacatttcgagggctgctgtttgtttctgttttgccgccagatccggttctaagccctcttcgtatcccgctgctaccatatcggacaaatgatgggcgcctgacttttcctctctgtgctcgttgtgctgataatcgccaacagcgcgcatgtgcacatacagatcatttacgttcttggaacgctgcgtatgaccccccccccccgctcatcgattggtttatacacttaggtacacacatgttgaactaaacaaagcacttgaactcggatataccgtaaccgatctgtttgaggtaactcgataaatttgaaaaaaagttgtaaaaaaaaatataggtttggcattatgatgaatgggatgctgaaatgtttcgtggttatatgaacacatttgtgggcatgaaagttcaagcaagtggatggcctactggttgtgaaagcgaagaacgtcgcgatgactatattgacgagtttgagcgtgccgaaggaatacgactcgaccgtggaaaaattgcaaataatcctggtcttcgaatggttgcggtaacatgccttgagcaatgatcctctatgctaattctactttagaaattgctggcaaattccctttggggcaagtttgcccaacgcgtgggaagaaccgaagttcgttacgcttcatcgccatctgagttccactgtttgctcgacgacccttcgatagaagtactcgactttcatcatgtttcacctcatcttgaccgtgttgttgtgaagacaaaagctgatttttcaaaagcaccagcgaccaactgtttgccgattgcaatttatgttacttcatacgcaagacttcacctttattcctacattgagaaagttgtacaacttggtcataaacttctctattgtg

SEQ ID NO: 74135 - DNA, 387 bp, Heterodera glycines
  Genomic contig location: Contig_ID=SeqID_10856; Location=359..745; Strand=+
  SCN-specific regions: Sequence locations=1-158,180-282,304-387
ctacatcgaacaagtgctgtctggcgccagtcctcgttttgatatggttgaattttctcaggacggctcttggtctttttgtcaatcacccgacacaatgttagacacggattcggaagacgaagaagctgatacaactgcgtcaccatccactgatgaaggattacaaaagcaaatgccgattgagaagataataattaaatgagggtgactatgcccgtggcaatgaagaagaatatgaggtctttatcgatatttcgaaacccctagttaattaagaagtaaaatccatgaaagaaaattgggatctcaaaaatagtcattttgtggataaaaagcttgaaaaatttcacgggcgaggcaattctgtcctcaaatattttggaa

SEQ ID NO: 74136 - DNA, 783 bp, Heterodera glycines
  Genomic contig location: Contig_ID=SeqID_10856; Location=1368..2150; Strand=-
  SCN-specific regions: Sequence locations=1-783
atgactcgtagaaaaactgttgctgtaacggaacagaattgttcctatgttgctccagcagatgtgcaaaatgtcccgccgggagacccacaatatggtgatggatttatgtactacaaaaccaacgataatgacaccctttacagctgcgaaggaaagaataaaactcgggtaaaaatgggccgggaatatttttcacaatttcggggtggaacagccttccattccatcctgtgtgatcagagctggtgaaactcaaaaacaccccccaaattggaatttaatgaagggaagaaaaacaaaatttaatattcgaaacggaaaaaaataataattatgtaaaaacgaaaaattttgatatccaaaactttgaaaaataaaaatgctaaaaaattttgaaagtaaaatgaaaaataaaattcgttatactctggattggcattgaacaaaaaaagatatttaattataaatttctattttgtttcagaaatgttggccttgttaaattggcaatacaaacggagacaaatggaacagaggatgattgggaaggattttgattctaaacaaaaattattatgtattatggaagagtattttgtgttattttttggataaaatctgctgacaaattgagtgaatatttccaaatccttctccggcgcgaccggtcagcaatcattaataagaactacgctttacaaattatgcttacttttgaatccaaaatcttaccagagatgtgcttatttatgaaactttcgataaaaactctgaaataaa

SEQ ID NO: 74137 - DNA, 965 bp, Heterodera glycines
  Genomic contig location: Contig_ID=SeqID_10859; Location=203..1167; Strand=+
  SCN-specific regions: Sequence locations=1-12,34-289,311-410,476 -545,571-629,651-733,757-813,884-942
atgacccataacttttttcaatttcatttttatccgaaatttctttcggattcatgggttacataccgagaggaatggattggtatgtattttgttgcaattccatgcgcttaaggctttggacggttcagtcccaaagccatttggccatttcagtcccgggtttgtaactcttaagggattagtttccgcaaaaaaaattctttcatcatacattacagaccgatagctatcgcttggtgtatacttcgaccattttcggctctgtgacatatgataaatatttaccaaaaattaaattaatactttacataatcttcctcactttgccatttatttaagggatcactttcgtggcgtaattcaatgtcaaattgtgtaataccgcaacatttattggaaatttgaccaattataataaaaaaaaaacatcagtttttaaaagaaaaacaatattaaaaataaaaaattaaatgttccgttttattttataaagtaagaagtcagataatatttaattcaattaataatgcttctgatctctttaaattctttgaaattaaaagccaaaaataatatggcatctagttttaatgaactctttattggtattattgaataaagcatgcgttaaacataaagttaccataacaaaaaataattttaccatagttaagtattgttggaaacataacataatttgtctttaaaatttaacttaaaaaataacctataatttaaattttgtaaaatcttgacttaattaaactcttaggggaaaaatagaaaaaataaaaggaactgcaagaaaagattaatttttatttgaattaacttatattgttataataccatcaatatttttaacaaaattttttaatttcagacgctaaaataaaaaaagaccaagaataaaactaaataggaatttatatgcaaaacaaaaataattttaaaaaattaaa

SEQ ID NO: 74138 - DNA, 2762 bp, Heterodera glycines
  Genomic contig location: Contig_ID=SeqID_10860; Location=1..2762; Strand=+
  SCN-specific regions: Sequence locations=1-1587,1609-1721,1831 -1848,1884-2059,2102-2121,2153-2192,2219-2238,2261-2267,2290 -2496,2518-2558,2592-2656,2709-2762
atgctttcacggcttatcgcgaattatccgcgaccccccttagatattttgattgcaaaaatttgcaccgaaactgaacgtttcacggcacaattttgcagtcacgaattgatcaacttcccgtcactgcaaccgaaatagcagaaatgactcaaaaagatgaaattctacaaaaagtggcaaaattctccaaggaagaatggtcacaaaagtgtaatgaccccgacctcgcaccattctttccaaaacggaacgaaattttgcaaatcgagaattgtctgctttatcaaaaccgagtcatcattccaacagtgttacgagacagaacgttgaaagcgcttcatatggcacacccaggaatagtgcgcatgaaagctctcgcacgccaacacgtatactggcctggaatggactcagctatcgagaaattggtaaaaagctgcgaagaatgccaaatcgcccacaaagcagcaccaaaaacattgctttctccttggaatgccactaaacggccattccaacgtgtgcacattgattttgccggcccatgccaagatggccatgcttatctactttactggattctttttcaaaatggcccgaagtttatcagatgaatacaatgacatcaaaagcaacgatcagtgttctccgattaatcatccatcgacttggcatcccagaagaaattgtctcggacaatggacgacaatttcgttcgtcagagttttccgaattttgtaaagaatttgggattcgacatacgttcacaccgccatttcatccacagtcaaatggccaagtcgaacggtttgtcgacacttttaaaagggcaatgcagaaatgttcgaaaaaggacaaaaattgggctgagaaaatgctcctgtcctatagaacaacaccgaattctgcaattaatggacattcaccggaccaattattctttggtagaaaactccgcactcaattgtttcttacacatccgacaggaaaagtcaatgagacgattgacaagaccatttttcatcagaaacaggaaaaataccgcacgaaaattgcacaaaattttaatgaaaagcatggagtcaagtcaaatgaatttttaccgactgatccagtgcttgttttgaattaccagcatggtaaggcatattggctccaaggtacagtcatcgaacgactcaacaattcgccaacttatcgggtaaatgtgccaagactcggacgaaacattcatcgaccggcacgccaaaatacgacaccgaaatgccaaaagcggaagcagcccgacgaaatccacccaactactgccaattcaccacccatggcattgagacgctctagtcgcaacaccaaaccgccgatccgcttctagccaggctgacgccgttcaagaattgaggagggagatgttgggtagtgaataatttgaatttatggcgatctgacttattgactttatttgttatttctatgtccatccgccccctccctcgtccataaaagtggatacctcctcccattatttgttctttcctttcatcattcatttatattttatttcccattttgccctacgaccgaatcaataaaattatttatttatttctttttctttgtgtgttctaagtggaagaacacaacactgatcaaagatagaatatggcatagtttcaaatttgagggaaaatcaacctaaattattcaatttctaaaagaagaaaaattaaatatctaaataaaattgtattcaaaataataaaataattgataaaaaacacctaattaaattagaaaatatttaaatataaatttaaaaattatatttttgtcattattttgttggccaataatttataaataaataacagaaaaaaatttttggggcaatttttgactgaaaattatttcactatatcttagttaactatttcagattttccgtcactaaatgtagcgaccctaaatattttgtacttaagacttgatcaatcttacccgaagtgttgcggtaacaaaaaatacccacaagtgaattaaaggaataaaaaattgtacgttaaaaaataaaatctaatttatttttttaatttcttatttacaacaataactaaacactggttattaatttttataattttaaaaattaaatgcaattcaaagacattcaatttaaattaaatcgtgccttgaattttttcaattttcaaaaactttaaaatcttgtgctccaaacggtaaataattttttaataaaaatcatgttgaaaatttaagaaacatttattccagaggaaatccgacagttttcggagacgagttctacaagtaaaaataggtattatagataaaatataattgaatcgttccaaaaaaagatcacttcaataacataaagctaatgaataaaaaatatttaaacttttcaaactataattttatgtgataataattttccgaaaagtttacaaaaaatcgctgaaaaatcgttgaaaagttaataaaattgtaaattaccacctgaactaaatgcgaattacaatagtacactaatatttcaaattattgggtttaaaaaattactgaaaaataggttaatttataataaatatcatttaactttaaactaagcaaattttttagggcatttaataggaaaaaatattttagatttttaatatatttagttgtaatacaaattatttatagagaattctattcttactatgtatatctatgttgtaaataatgcataaagaatt

SEQ ID NO: 74139 - DNA, 1600 bp, Heterodera glycines
  Genomic contig location: Contig_ID=SeqID_10860; Location=2283..3882; Strand=-
  SCN-specific regions: Sequence locations=1-50,72-472,495-565,587 -1071,1099-1174,1227-1291,1325-1365,1387-1600
  Gene Ontology: Mol. function=transposase activity; Biological process= DNA transposition
atggacaaaattcgcctaagacaactgttactttacgaattccgaaaaaattctacaccaacccaagctcttcgaaatatttgtaaaagtgagggcaatgatgcactctctctttctacagttaagcgatggttcacaaaatttcgtgaaggcaatgagcagctcgaagatgaaccccgctccggacgaccaccttctctcgattcggacgacttggagcagcacgttcagcagcatccgtgttctagttcgcgccaacttgcagcagagttcggggtccatcagacaacagtgctcaattacctccatcagctcggcttcatcaacaaaaagggtgccgaagttccccatacactgacccaacaacaaaagcatcagcgagtggtcacctgcactgaacttctcgcccgtttgagtgctggaatgcagctttgccagctgatcacgtgtgatgaggtgggtttatctcaacaacaaaacggcacaaaaacaatggctgaagccaaacgaattgagcgagccgacccccaggcgtcttcaacatgcaccgaaggtattgctgtgcgtctggtggtgttcatcagggttggtccgctatgaacttgttccggctgggcaaaccatcaacgccgacatctaccagcaacaactgcagcgggttcatgaccaaattcgtcgtcctccattttctgcaaaattccgcggcggcgtactcctacatgacaacgcacgcccacatgttgcgttatcaacgcaacaaaaaattgagcaacttcgatgggcggttcttcctcatccaccatacagcccagacatcagcccgtgtgactactatctgtttcgatctatggagcacttcttgagagggaaagaatttgctgatcaaaacgaggtcgaaaatgcattggatgactttttggatcgaaaaatgatcagttttataaaaaggggattgaaatgttgcccgaacgatggaggaggatcattgatcaaaatggtgagtacatcattgattgaacatttgttttttgtgaaataaaaaattgtttaatgttgaagtgcttaaagggtcagaactttttcatcaacccaatatttcagtttttcaaattttattgttaattctttatgcattatttacaacatagatatacatagtaagaatagaattctctataaataatttgtattacaactaaatatattaaaaatctaaaatattttttcctattaaatgccctaaaaaatttgcttagtttaaagttaaatgatatttattataaattaacctatttttcagtaattttttaaacccaataatttgaaatattagtgtactattgtaattcgcatttagttcaggtggtaatttacaattttattaacttttcaacgatttttcagcgattttttgtaaacttttcggaaaattattatcacataaaattatagtttgaaaagtttaaatattttttattcattagctttatgttattgaagtgatctttttttggaacgattcaattatattttatctataatacctatttttacttgtagaactcgtctccgaaaactgtcggatttcctctggaataaa

SEQ ID NO: 74140 - DNA, 325 bp, Heterodera glycines
  Genomic contig location: Contig_ID=SeqID_10861; Location=758..1082; Strand=+
  SCN-specific regions: Sequence locations=1-182,206-215,237-325
tggtgaattgattattacggtgaatattgttcatgaaaaacactatgaaaggttaaaaaaggttattgctcatggaggcgaattcattgaacgaatcgtttaccacacaaacaaggatttgacaaaaatgaacaacaacaacaacaacgtttttgagcaactttttgtagcgataatgaacgtaataatttattaataataattaggtatcggcattttgaaaaaagtaaatccaggtccaggaaaaatcaagattgccgaaaaatggcctggacctggacccaggaaaaacccaggcctggatccaggtccaggccgattttta

SEQ ID NO: 74141 - DNA, 1826 bp, Heterodera glycines
  Genomic contig location: Contig_ID=SeqID_10862; Location=524..2349; Strand=+
  SCN-specific regions: Sequence locations=1-285,312-528,551-566,599 -689,750-771,793-934,959-994,1023-1028,1051-1289,1312-1496,1518 -1524,1547-1599,1627-1826
atggcaatgggtgggaatatggccaactatggcatgatgccaacacaatatccgaacaatggcccaacattcggccacacaatggccaattatggcatggtgcttggcgccacgctagggaatatagcggaaaatgtgttcgagcgtggcaaggaattggtcgccaaaatgaacaacaatggcaaccaacacccatttagcggaatgccaggtaggaagaatcagtctaaagtcatttcataatttaccgcaactttgttggcatttcgtaaaagcgcgccaacattttaaaatttgaattttgactgctacttcttaaaaatagttcttatattaaaagagagacttgaaatttttcacaaaagtactttagcataaggactaactatctgtataaaaaatttcaaaaaaatcattttttaacttggaaagtaaaattgcattatttcctataaaacctaaaaaataagtgaggcatatgccatggaatttatttgaaatgatcaggaaagattattttcacttttgaatattataaaaattttaaattgatttgaatttgacttagttcataattttattaaaatttccaaaaattacatactctaaaatattccgaaatacttaatctcgaccggtccatgctctggatttagatgaaggcagtaggtcattcaaatgggggccggaatctttatttaaaaaatcttcaaaatgaaaatttttggtgaaaaattatttataaatttgctatcttttgatagcccttggtgttttctattagtcttttaaaaattttgttaagtttcaaaaaacggacacctaattattgaaatagagcacaaggtgctgctgccctattttcaactcattgtaggggacggggctctaattgataagtggggcatactgtaatgtctctcagtaaatatggtaattattaaaaaaataaaaaattgcaatttttcatttgctaattacacaggcataatggtggagaacaacaccaacaacaacagcaattatggcaacatgccatcattggtggtcggcgttgactccacagtagagtactctgtgaatgtgagaagtcgcatggtcgaagacattggcatcgaagtccaaggcgtggcacaatggccaaaaaaattgttggcaaaactgtttgaggaggaattgtttgagggcttactgtacaaaaagggcactggtgccaaccgtggcattgggccgagcatggccagaattccgcactgggaagccatgctgggcttgtcaccacaaacaaaagtaaatttaattgggtggttggcatttaaaaaaaaaattattacggaaattaaattagccactaaatgccaagcaaattcgtggaaaatttatgatgtacttaattcccgaaatgtggcaaaaatttttacgaatttctggggttcttatttcatcatcttaggaatgaaaagtcacaaaaatccaaaaaaggcatgaaaaaaggcatttaaattttttttattaaagcttttaaggagcaaaacacgtaaaacttaatcaaaaaacttaattttggtcatttaaatgattactaaattttgtataatgtttttcaaataagtaaattttaaacctaaaattttttatcaggaaaaaaaaatgaaattttggcgataaattattgagaaaaattttcaattattaggggtatattttctcgattttattgcattgtagaaaaaaaaaatgccaaaaagacaccaaaacggcaaaatgccaaaaaaggcattaaaagcaggaaactgccgaaaaaggcaaaaaaaaaaaaaggcata

SEQ ID NO: 74142 - DNA, 231 bp, Heterodera glycines
  Genomic contig location: Contig_ID=SeqID_10863; Location=233..463; Strand=-
  SCN-specific regions: Sequence locations=1-165,190-231
atgtgcggccgtaactcactgtatctatcagggatgggccgaggtttcgcttttcgcatttcgcctttcgcattattcgcattttttggcgtttcgcatttcgcttttcgcatttcgctttttggcgcgtaaagcgacttttacacccctaagaattggattaaattcccataaaatttttcaaaattttacctataaattggctaattttcagtgaaaaactgtttataa

SEQ ID NO: 74143 - DNA, 94 bp, Heterodera glycines
  Genomic contig location: Contig_ID=SeqID_10863; Location=351..444; Strand=+
  SCN-specific regions: Sequence locations=1-94
atgcgaaaagcgaaatgcgaaacgccaaaaaatgcgaataatgcgaaaggcgaaatgcgaaaagcgaaacctcggcccatccctgatagataca

SEQ ID NO: 74144 - DNA, 573 bp, Heterodera glycines
  Genomic contig location: Contig_ID=SeqID_10864; Location=763..1335; Strand=-
  SCN-specific regions: Sequence locations=1-27,49-334,365-462,486-573
atgccttcatcgacctcagggtcagtattgtcttcgggggcgacagcccaacctatcatttctgatgatgagtcgactcttaaaatcgtaaataagacactgtttcaaggcaaacagccaaacagtacagtccgttttgaggatgttgaaaaagttttcggtgaactcatacgactcgaagagggagtcagccgcaccatccgacaagttaaccgcaaggctaacaatgtgcaaaatcatcttggcacccttgccaatgaagtcaacgtaggctttcagaccttcaccgctgagatttcaaaagttgctggtaaggtaaagtccctcgaaaacctcaattcagcaaacaaaaacattcaacaagctacggctgtcactcaaccacttgtccctcatcatgctcatcctcctgtacagcaattgggacaccaaacaggccagagacctaatcaaaaccaacaaagctccagcagcgatgatgaggatgatcagcaacgcaatgcattatccttccaaagtgtcaacatgatcattgatgcgtatcccatggcacttgaaaggctacaaggatga

SEQ ID NO: 74145 - DNA, 187 bp, Heterodera glycines
  Genomic contig location: Contig_ID=SeqID_10866; Location=771..957; Strand=-
  SCN-specific regions: Sequence locations=1-108,130-187
atgaaaggcaaggctctggctttgaatgctctacatggcgcgcggatcaggcaaagcatgaccaaggagcaattggccgaacgccggaaattaattgagcagtgcgcaaagaaaagaaaagaggacgcggaagattggattatctacgcgaatcaggtcatcctgcgcagtgacattgacacatttc

SEQ ID NO: 74146 - DNA, 721 bp, Heterodera glycines
  Genomic contig location: Contig_ID=SeqID_1515; Location=319..1039; Strand=+
  SCN-specific regions: Sequence locations=1-332,377-562,584-593,622 -645,668-721
atgtcgttgcgcaatgtgcgcgacaatgaggagaaggagtcggcattccgtggcatttgtctgatggtcaattgcaacccgcagggcgtcgccgccgcgttcattttcctctgcgacgcgatcgcctcgtggcagacgcccagcgaagagctgcgcttcatgttcggcagggtgagccccactttctcccacccccacccaattagtgttcttaattgggtaattatagcataggttacctcaaatttttcttagttttcaaccaatttttaataatttgtctcaatgtgtagcctaactacatggagacgggcattttattgtagtttttgtaaaaaatttgaattttttttatttgaaaatttaaacaaatttagtttttggaatgaaaagattggaatgcgaaaatcaaagaattctaatgcatttcctaacaatcttttctgcaaaattattgtctcccgtccaaaatgtaaacatttttcgacggaaagggagaaaaacgtatcaattcgcattttttacgaattttgatgaaaattcactaaattaaatgatagcaacaatacatcatattaaataattatttgccacatttttattttattttcagattatttacgccttcaagtcacaagtgggagaggagaattggaacaattttgtcgctcaaattccggaaccgttgaagcaaaggctgggcacacagtaccaattgtga

SEQ ID NO: 74147 - DNA, 1409 bp, Heterodera glycines
  Genomic contig location: Contig_ID=SeqID_1516; Location=25..1433; Strand=-
  SCN-specific regions: Sequence locations=1-111,133-754,777-1127,1153 -1188,1211-1223,1259-1281,1303-1409
atggacaaaattcttctgctcttcccaattttggtcatcgtcatcggattgatcgctgctgacaaatgcaacaacttgtatgatgaatgaaatatttgtaaacaattttaatcacttgttttagtccaaggctgaatttccgatcgcttcagcaacagcggaaagttcgggaatctcgtcgatgcgcaatgccaacgagtcgcgtcatgtttggtttggaaactggcccttatgacaacgcgacgtactttgttcattttctcatcaaaaaccaagtgagtcaataaaaaaaaattcagtataaatttaaaaaaaacagaagaaaacattaaacccgtttaaaactttatcaaacaatttgcaatttttgtttttttttgacattttatgcctttttctaaaaacttaaactttcatggatttattggaaaaaactcccagaatatggattaactattaatttatgtatccattaagaatggcctaatgagcagatgcagcggagtgctgttcaacccttctcttgtcctcacgtgtgcccattgctgggatgaagcagcgaaagacggtgacggatcaatcgcttatgcaggaatcgaggacgggcaaagtgtggaggagagcgtttccaagaaggtgcagttttacaataacacatttattacccaattataattatggcaaaatccccaaaaatttgtcttatttactgctgaatgattcattgtacccctaacctttctgctaagccagctatttaatttgaaaaatcatttattcacattcaaatctatgatttttcggttttttgttttaaatttaattagccattactctgtctaaatccgataataggggcgaaaaacttaattataaaattttgaaagcgttaatcttaatctagttattttcaaaggtgctaggctttgtgctccaccccgccttccgtttactaaatggcgcagcatttgacttggcagtcgtcgcagtgctcccctttgaattggtgcccggaaaattgggaacaattggtttcccacgcttcgagccggtttacacatcgagccaatgggtcgactgccaaattgctggtaaggaagtaattaataatgaactatctttgcctatattttaaaagtcaaatagaaaagaaaggtccaaatcaatcgattttgtttaaaaaactggattttttataaattttaatattggcacctttcaacaaaaattatctttaagaattaaattaattaaaaatggaaaaggaattttgaatcggagactaaatttatttatttttctaaggaagcggtcaatcgttcacaaaaagcggggacagatgcgaaaacacgaagcgccggctttacatgacgggcattttgacgtctttgtcatgctgcaacgatgcc

SEQ ID NO: 74148 - DNA, 444 bp, Heterodera glycines
  Genomic contig location: Contig_ID=SeqID_1517; Location=301..744; Strand=+
  SCN-specific regions: Sequence locations=1-177,199-208,237-260,283-444
atgaaaagattggaatgcgaaaatcaaagaattctaatgcatttcctaacaatcttttctgcaaaattattgtctcccgtccaaaatgtaaacatttttcgacggaaagggagaaaaacgtatcaattcgcattttttacgaattttgatgaaaattcactaaattaaatgatagcaacaatacatcatattaaataattatttgccacatttttattttattttcagattatttacgccttcaagtcacaagtgggagaggagaattggaacaattttgtcgctcaaattccggaaccgttgaagcaaaggctgggcacacagtaccaattgtgatcgtcgacgagccccgctgcccacgactcacagacacagaaccattctcaaaattcattccaaatttccaggggacggacggaattcaatcccccgccataccggaaa

SEQ ID NO: 74149 - DNA, 1423 bp, Heterodera glycines
  Genomic contig location: Contig_ID=SeqID_1518; Location=449..1871; Strand=-
  SCN-specific regions: Sequence locations=1-172,194-267,290-643,666 -681,703-761,783-791,813-957,979-1103,1125-1423
atgagcagatgcagcggagtgctgttcaacccttctcttgtcctcacgtgtgctcattgctgggatgaagcagcgaaagacggtgacggatcaatcgcttatgcaggaatcgaggacgggcaaagtgtggaggagggcgtttccaagaaggtgcagttttacaataacacatttttacccaattataattatggcaaaatccccaaaaatttgtcttatttactgctgaatgattcattgtacccctaacctttctgcttagccagctatttaatttgaaaaatcatttattcacattcaaatctatgatttttcggttttttgttttaaatttaattagccattactctgtctaaatccgataataggggcgaaaaacttaattataaaattttgaaagcgttaatcttaatctagttattttcaaaggtgctaggctttgcgctccatcccgctttccgtttactaaatggcgcagcatttgacttggcagtcgtcgcagtgctcccctttgaattggtgcccggaaaattgggaacgattggtttcccacgcttcgagccggtttacacatcgagccaatgggtcgactgccaaattgctggtaaggaagtaattaataatgaactatctttgcctacattttaaaagtcaaatagaaaagaaaggtccaaatcaatcgattttgtttaaaaaattggcttttgttataagtattaatattggcacctttcaacaaaagtgtctaaaaattacactaattaaaaatgggaaggaattttgaatcggagactaaatttatttatttttctaaggaagcggtcaatcgttcacaaaaagcggggacagatgcgaaaacacgaagcgccggctttacatgacgggcattttgacgtctttgtcatgctgcaacgatgccgtaagccgattggtaatttacccataatttacacaagattttctaatgacaaaaagataaatttataggggaagcccctgggccacaaatttccgatgggcacaatttgctttcgaggacactccgatgcagcatgcgccggcgacagtggctcaggcgttgtgtgcaaatagtgggtttttttcaaaaattggttacattaaccgtaaataccataaattaattatttagtgagccaacaggggacagagtcctcgttggggttctacgcgcaggctcgcattgctgcgccaaaaacggactccgtttgaatgagccgggcgagagcaacatcgtcccgttggacgtcgctcgcagaagttggatcagccgtgtcgccctccaccacttccgatgcggttctttaacacctccttgcgcaccggcaatggctttcgcagcgagggcgtcaatacaatacgacgacccagaacatgcgtacttgtgatgtaataagacaataaa

SEQ ID NO: 74150 - DNA, 533 bp, Heterodera glycines
  Genomic contig location: Contig_ID=SeqID_1518; Location=2066..2598; Strand=-
  SCN-specific regions: Sequence locations=1-357,379-533
atgaccacggcttggctccgctgcgaaatgaccttgacccatcgatcaatgggtgatgagtgagcgttgtttgtgcggcatagcccacccctcccgccgtacacggtgctaggccattttgcgaaaagtacaaaaatggacccatgactgccatttttccattatttaatttccatttttttaaatttttaaaacttttgcaagattctgactttggcgcattttgccacatttaaaaattgcaagatggacaaaattcttctgctcttcccaattttggtcatcttcaccggattgatcgctgctgacaaatgcaacaacttgtatgattaatgaaatatttgtaaacaattttaatcacttgttttagtccaaggctgaatttccggtcgcttcagcagcagcggaaagttcgggaatctcgtcgatgcgcaatgccaacgagtcgcgtcatgttcgttcggaaactggcccttatgacaacgcgacgtactttgttcattttctcatcaaaaaccaagtgagtcaataaa

SEQ ID NO: 74151 - DNA, 627 bp, Heterodera glycines
  Genomic contig location: Contig_ID=SeqID_1518; Location=3432..4058; Strand=-
  SCN-specific regions: Sequence locations=1-21,43-100,126-193,241 -264,288-368,390-550,573-593
atggagactggtagattatttttcaaccttctcagaagggggtatataactggagaccggcagattaatggagactggcatataaaaagagtatatacggtattaatatattttttaaattttttccttttaactccaattttcttcactaatttttcactcagacctccattcttaccagtgcttgtttttcccggttcccggttgccctaccgggaccgggacctgagcttttcaaaatccgggaaccgggaccgggaccttggatgaccgggaattcccggcccggtcctggtcccgctgcactctagtttaaatgagattgttataaatttttaccaaaatcaccaattttgtgatttttacgccaattttttaagaaaaaatgggtccggcggcgctgataggcgccgtgattgtttcaaacgaaaatatgacagttaactgatttgttcgcaattttatgatgtttaaaaaaatgaggatttttcattccaaatgaggattttttgaggtattttagttgcaaatgaggattttttatggctgaaatgaagattttcaaaattttgagatcgcagctctgggctaacataatttaaaaaaaattattttatttctaataaa

SEQ ID NO: 74152 - DNA, 817 bp, Heterodera glycines
  Genomic contig location: Contig_ID=SeqID_1518; Location=4095..4911; Strand=-
  SCN-specific regions: Sequence locations=1-2,25-43,91-95,148-361,408 -415,441-450,481-500,533-583,605-817
atgacaaaaatctatcattttcttgcttccggtatgcataaaaattggaatttttaatggtgaaagatggacgaagaaacgatcacgaagaagcctttttttaatttttttatattaattttaatttaaaatttttagtttttttttggcttgtctgatgattagggtcgctacatttagtgatttactaatttttttactcaattgttttgaagaaaggagctcaaaaaacgtatttctgcgttgacatttttcaattctgatgtcactatcggtcactagaaatcactattttggcgcttcgtcactaaaatagtgaaaattcattattttggcgttttgtcagtatttcgacatttttaggaaaattccttaacaaaaatgcaataaaaccaaaaaatacacccctaagaaacgggttaaaattttttaaaaaataccagtaagaattggaaaattttcttaaaaattctttccacaattttttttctttacaaattttgattaaaaatgttcagtatttgataagggaatagttcaaaggaaaagtaccttatttgcaactccaactagtgaataaaaattattttggcttaatttttggctgaaaattacgtcactattcgtcactatttcggactttttgccactattttagttaactatttcgagattttccggcactaaaagtagcgaccctactctgatgatgaagcagggctggatggagtcggagatgacaacgaattgttcatttattagcccctcttactgttgaattgagtttaatttttttttggaaaatgtgccaaataaa

SEQ ID NO: 74153 - DNA, 510 bp, Heterodera glycines
  Genomic contig location: Contig_ID=SeqID_10874; Location=1..510; Strand=+
  SCN-specific regions: Sequence locations=1-90,112-375,400-510
  Gene Ontology: Cellular component=mitochondrion
accgactcggtcaccgcagtcccatcattctcctgatgcttgttttgtccgttccgttgttgttcatctactctggccttggttcctcgcgggttgagcacgttattggcatgtctttgctcggagtgaccatctcgggcccatacaatctcatcgttggcacaattgccattgatttgggttctcagcaagccttggccaacaatgctgaggccctgtctaccgtaactgggctcattgatggcattggctcggctggctccgcattgggccaactttttgtgccgttgattcaaaatgaacttggatggatttgggtcttccatttttttattttaatggtaacaaatcatgggaagagtcaatgcgagcttcttttgcccttcagaactttctttcatccatgtgccttatccgtcgtttcttccacgacgctcggctcatttccctttcgtttgctccgaggcaaaatggtcgtcggcaagagaacgagccgctgatttcgaataa

SEQ ID NO: 74154 - DNA, 1042 bp, Heterodera glycines
  Genomic contig location: Contig_ID=SeqID_10874; Location=398..1439; Strand=-
  SCN-specific regions: Sequence locations=1-430,454-620,642-764,786 -1042
atgggagaaaagaatgccatcatcagtcccggcttattattacgtaacttctgtcagatggcattggcttcgcttggctttccgtttcgtcttctcccaacccttcgagcaaagtccagtcgaaaaaatctgcacaaattaaggcattgtccgtggtcagctaatgaaaagaatggcaccaaaaaacgaagcgaaaggcgacagatcgaagccaccgaaagcgtcgacgaaagaaaacgacgattcaattggcgaattcatttgaggaaaagcccaatcgaaatgccaaaagtcactttggggctgaagttcgaaaatgcttcttccatcgttggcagtgaaatggacggaaggaaaaggaaaaaaaggcatttggcaatcaaaaaaagaagggacagccgaaaatgacagaggcaaaagcggagaaggaaaggccattagctgagaaatgagcaggaggagaaacactgaaagtggggcatttgccaaacgaaaatgtgagaaaaacggcggaagaaatcattcgaatcgcttagttcgagtttcactccgactcgattcggcgagatgaaattattgaaatggtcaaaaaatgcgcagtcaatcattggggcggggcagccaaataatgaggaaagtgcaagaaaaaatacggtagggaggggacgaattggagcatgctaattctccgcccctcccccgaccaacaacagtaacccgaccgtacagaaatgctattttttcatttaaaattcatgtacatcaaaaaataatattggtcaaaaagctattcaaatttttaatgtgtggcaattttatggaatgtgttgcaaaataacaagtcaacaaaaacaaaatttacatcatttggcgacttaagagtatatttggcattatatgaattaaatacaatagcaatttcagttcagttattcgaaatcagcggctcgttctcttgccgacgaccattttgcctcggagcaaacgaaagggaaatgagccgagcgtcgtggaagaaacgacggataaggcacatggatga

SEQ ID NO: 74155 - DNA, 261 bp, Heterodera glycines
  Genomic contig location: Contig_ID=SeqID_10875; Location=2038..2298; Strand=-
  SCN-specific regions: Sequence locations=1-110,159-261
atgaatgcgacagtaaaaagcaacagagaaaagggaataaagcgaactgcacgcattcacacaaaagaattggcatgtgaagcattagacaaacacattttattcgtaagattttttatttatttattttttaattttaaaaaatttatttaaaatttcaggcattttttaaatgaaacaaatctacatccaaataacaaaaataattagagaacagactttaaacgtaagaaaaaggtgaaaaaggcatatctaaataaa

SEQ ID NO: 74156 - DNA, 3021 bp, Heterodera glycines
  misc_feature (6)..(6): n is a, c, g, or t
  misc_feature (17)..(17): n is a, c, g, or t
  misc_feature (22)..(22): n is a, c, g, or t
  misc_feature (31)..(31): n is a, c, g, or t
  misc_feature (72)..(72): n is a, c, g, or t
  misc_feature (88)..(88): n is a, c, g, or t
  misc_feature (121)..(121): n is a, c, g, or t
  misc_feature (174)..(174): n is a, c, g, or t
  misc_feature (195)..(195): n is a, c, g, or t
  misc_feature (209)..(209): n is a, c, g, or t
  misc_feature (228)..(228): n is a, c, g, or t
  misc_feature (251)..(253): n is a, c, g, or t
  misc_feature (256)..(256): n is a, c, g, or t
  misc_feature (270)..(270): n is a, c, g, or t
  misc_feature (297)..(297): n is a, c, g, or t
  misc_feature (347)..(347): n is a, c, g, or t
  misc_feature (353)..(353): n is a, c, g, or t
  misc_feature (358)..(358): n is a, c, g, or t
  misc_feature (360)..(360): n is a, c, g, or t
  misc_feature (365)..(365): n is a, c, g, or t
  misc_feature (379)..(380): n is a, c, g, or t
  Genomic contig location: Contig_ID=SeqID_10875; Location=84..3104; Strand=+
  SCN-specific regions: Sequence locations=1-721,757-786,809-809,833 -1321,1343-1445,1503-1556,1578-1580,1602-1788,1810-1840,1862 -2057,2106-2231,2253-2514,2536-2602,2624-3021
  Gene Ontology: Mol. function=peptide O-xylosyltransferase activity; Biological process=glycosaminoglycan biosynthesis
agcacngcgacaggacnccgcncgaagggangggagaagacgaaacggaaagccaagcgaagccaaggccancggacagaagagacgnaagaagaagccgggacggaagacggcaaacagngcgcccagacaaggcaaacaagagggggaaccacgccggcccccggggccgcnacgaccaacaacacagcaacngcccccggggccgncgcagggcccagggcgccncaaacgaccaccgaacgcccaannncgngacgcggcggaagnccgacgccaccgccaccgcagacccgngagagcgagccggcgacgacgaccgcacgaaacgcgaacaagaggacccnacggcncccancngagancagggccaaagggnngggaccgccgagggcaacggacccgaaattatgccggagggctgcacgtcgaagtcggcacgaactcagccacaaaaggacccatcgctgcaccgttggaggtgaacgaaggagcggtgggaattctttaattgggtggacgaagtaaacatattataatgatcactgatcactgctgatcaggaatttgagtcggtggtaatttttactgcctttgtgtttttggcattgcgttcatcattaccgtccgggttcgattttggacattttcccgtctctatcttttacatattccctttaccattttcgcccgtctcaccaagaattcattttggtactttcatataactttttatttatttattattcttcctttgtccattgtttggtttacgcaacttaatcaccaaatatttttcatgaatttttaaatatttgtttttgggggattaattcggggaggagagacgaacaaatggttggtcacccattcgttcattcattttttgtttacttttgcaaaggattaaaatggtgggagatgcgattgtatggcttaaacgcttatagtactaataaatgctgataaatgaaaattgaattggtcaaatattttaaggctgtgacaaagtgtacaccaaaagttcgcatttgaaggcccaccaacgactgcacaccggtgagacttgtgcttttggcacttttgtcggtgtcaaatcggtgcttttctgtccattccttcgattggcctttaaagtcaacaattgtcggtttatgtttggcggcgctcaaaggccattcattcgcgctgactttgttctttctctgttcccctcattaagtgccttcttcaccagcgaaggacggcctattggggtcactcatcagttcaaccaataacctcaaacagttccgtcccatcggtttttttttgtttttgtttgcgcacattctttgaaggaaatcggaaatgcgatcccaccgcaaaatcaaaactattgtaattaggaccaattacaagcgaaacgaaggctaatgagagcactgaagaaagggggagagaatgggaagaggagagggagggaagagagagagaggaagagagggaaggatggagggaggagtgaggaatgaggggattagacagactggatcagtatctgagttaataatgacaaggggaggaagagtgagagagtaaaagataggggagggaaggggcgttgattagcaatgcgatcaaaggttgatcagcagtcagtcagccaattattcaggcgaaaagccatacccatgcccattcccgaaatgccattggaagttttcacgcagtgatgagctcacccggcacattcgcaagcacatgggcgccaaaccattcaaatgtgcccaatgcatgcgcagtttttcccgctctgaccatttacaggttcagaggaagagggaatcccgaaatatcgcaacagttaaagacaacaaacactttcagttgcacatgaaaaggcacggaggaaagcgctgttgaaagaaagaatactcgttgaagatcattgccgttcattttttgacgagtttttatttagatatgcctttttcacctttttcttacgtttaaagtctgttctctaattatttttgttatttggatgtagatttgtttcatttaaaaaatgcctgaaattttaaataaattttttaaaattaaaaaataaataaataaaaaatcttacgaataaaatgtgtttgtctaatgcttcacatgccaattcttttgtgtgaatgcgtgcagttcgctttattcccttttctctgttgctttttactgtcgcattcattttgctgcttttggacaggaaattaagcacagtaatgccatggaattcgattcaattcagtgtgcacttttttaggaatttagggattttcttggtgaaaattggcaatatgaagacggcacgaccgaccgattggccaaatccgcacaaaatcggattcaaagcacagcttgcaaagttcagctaaggaatttcctccatgacatagcatttaaaaggcattggccggtcaaagaaatcgcgaagaattgcgacgatttgttcggtgcgtttccttttgcttttgcgttcgcaatgcattttttccattttcacaaatattttctttgcagaagttccctctgctgccaatgctttgaaattccgtccgttttcccccggcacttcccatgtcaaaattcttttcctcctccaattgaatgggagggattctcgccaactccgccgtctcttccgttcccttttcctcccccgtcacttttattttgtccacgtcgacagtcgccgcgaatttatgctgaaaggtgaaacattcagcagaatggttctgaataaaatatttttgaagaaatgttgaaggtcgaagagtctttgagggcggagggattcgcaaattttcgcgtggcaaagcgtcggatggccaccatttggggagggtcgaatttgctcgaccttttcctttggacggtggcggaaacactcggcgaaacgaattcgaattgggcgcaatgggattatattgtgaatctgagcgagacggacatgccaattctatcagtggaagagttggaacagaacttggccga

SEQ ID NO: 74157 - DNA, 1437 bp, Heterodera glycines
  Genomic contig location: Contig_ID=SeqID_10876; Location=283..1719; Strand=+
  SCN-specific regions: Sequence locations=1-162,184-417,439-1053,1075 -1142,1164-1357,1379-1437
  Gene Ontology: Mol. function=peptide O-xylosyltransferase activity; Biological process=glycosaminoglycan biosynthesis
gcgcaatttgcccgtcaacctccgtttggacggtggctccgattgggtggtggtccaccgcgacttggctctgttcgccatttccgactctctcctgccctctcaattgcgtcttctcttttcttccgtccttttgccccttgaaactttcttccacactgtttgctctccctcttctcttccgatgcttttccgttccttcgtttagcttgccctgaacagtgccaatttctgtcgtcggattgtccgtcgcaatttgcgctttaccaattggcgtcgtcgccagggctgtcgctgtgccccgttaaagtccgtcgtcgattggtgcggctgttctccgctcgcagtgagtgccaacgaattgggcaaattgtcgttgaatcagtgagcaccaatggcataattgcctttttatggcattttccttcctccccctttagttcccagtccaaatttcacttttttggtcgcaaattcgattctgccgttgatattgctcccattgcttttgtcgaacggcaaagccttcgcttccgtgtcgatcttttgccctcccaaagtgccgtcttttccgcccattggctcaatttgttctccgccctttcgccttccgacgttccgttcggttggcattgactttttccttttttaatgcaattttaggattaaatgccgagcttttgacgctgttcacttcatccattgcccgttttatgttgccgaacaatttcatttttcaacgtttgcacgactttcacatttacagagaattttctgcgtcccctctccaaacaatcgcaacattttccgttgcttttggtcacactaattacttaattgaggtaatttgctttttgagtttcgaatcctttcactttttccttctcaggcactgattggccagaaaagggactctttcgcaacttcttctcccaccgattttgaggtcatcgacgaggacatccgttttctgttcaatgccgaggaaggcatcgaaattgggctcgacttcgaccacaaagaagagattttccgaacttttccaccgcttctctctccggtgatttctccttttcaaacccattaaatatttgtttttagagttccaagttcactttgaaatggcgttgggttcgccttggcatcgctgccgatggccgtgccaaaaggacgagtccccccgctgagctgctcttccgtgggcccaatggcaccgttttccacaggatggccctgccttcttacaattctttctccggcactcaattcgcacagttcgaatttggccgtttttctggcgtttcccccggtatttcattttccggtcgctttccctttgcgcttaattaattattcggtggtttctcaggtgtttggtccgttgctttgcatgccaacaattcccttccgattgccctcctgtctttccccgtcttt

SEQ ID NO: 74158 - DNA, 493 bp, Heterodera glycines
  Genomic contig location: Contig_ID=SeqID_10878; Location=1794..2286; Strand=+
  SCN-specific regions: Sequence locations=1-371,393-493
atgtttttgagtggaaaggatgatgagtcctcgatttcggctattgataggaaactttggcaaggaaagaccacgataaaaatctctgatttagaaaaagctcaaaatgatatggggaaattagaagatggagtgaacagagcttttcgctgcctgaatcgttccttgaaccaaaaagtcaattgggtgaaagatgtcgtggccaatacaaatgccaattttgagactctgaaagtccaattcgagaccctaaccgaaagagttgatatgttggaacaagacagtgatgggacggattcaggtgggactgttagtattactaatctgaatagagcgtcgcgtgcaccgtttgtgacgccaatgggcaatgcacagcccaaccaagttgtaccgaaccaagtgccaattcatcaattatcaagcgaagacgaagatgacgggccgactctttttgacctgaacatgctctcgagcggacccacagtggggtcag

SEQ ID NO: 74159 - DNA, 309 bp, Heterodera glycines
  Genomic contig location: Contig_ID=SeqID_10879; Location=6..314; Strand=+
  SCN-specific regions: Sequence locations=1-9,31-51,77-309
atggtacgtgggtttagacctttttctggatccatgcgacgagacaacaacaaagaggaagaggaggacgaggccgctctcgcaattggggaggaggccgccaggagcaatttagccaaagaaactggtcaagcaaccctcgatgccattattgtgaccgtgctggacattttgcgtacaattgccatcaacgccgtgccaatttcagaggaaattccaaccaatcgttccgtcaaggaagatggtcaaatcagcaacctcgccaatctcagggacaatggcaaaatcggcagaatcctgttaacatga

SEQ ID NO: 74160 - DNA, 655 bp, Heterodera glycines
  Genomic contig location: Contig_ID=SeqID_10879; Location=885..1539; Strand=-
  SCN-specific regions: Sequence locations=1-77,99-160,182-234,257-655
agcatttctcttacttgttcatccaaatagcccaatttggagttcatttccgattcggtgacccaactttcaagtgatctcgtctttctgcttctctttgaggattcgttgctatcgtcggaaggcaagtcttgtacagcaaatccttcctccgattttatcagattcagaccacatgagttgactttctttgtgttgttcaaaaatgtcaaacgaaaactgacttcatccgaaatccaaatattgtcaagttgtagtcctttccatgtgccaatttttgaaaattcacaggcacgggtagtgtgggtatcccacatgagcaatgtcttgtcttccatttcacattggcctgccttgaattggcaattgttcactgacccaaggggacttagcataattgtgctaccatgttgtgacatgattttagtcttaaaaagataacaattttcagttgagacagtcgaccaactaaatgaaccaattaaccacattcggggtgacaaatccaatttcttgtcagtatgcgagagtcccgagtcattaattagcaagcctaagctgcactttccattttcggccatttgcttacattcactcggagtcatttgcaacataagtggttcaagagtctcttggatcgtaacattagtgattg

SEQ ID NO: 74161 - DNA, 1702 bp, Heterodera glycines
  Genomic contig location: Contig_ID=SeqID_10879; Location=476..2177; Strand=+
  SCN-specific regions: Sequence locations=1-158,180-808,831-883,905 -966,988-1702
atggattgtcaggtcgaaaatgaattagcaaaagaatcctctagtgaatccccagcctgtgggccggaaacaaagacaaacattcccaaaacgtcaaattgggaacggccaagcgtacgatcgaaagtcgcttctttaatgttcattacatttatgcttgttggaatgattttaccctttactactgctaatatgccccatctgccaatgcatccccttgtctgtcaaacccaaaacggaggaaaaatttggcaattgccggcagttactggctgttcaaagctgtcaattgatcattcaaaagcacctgttgttcgaactttcgatgtcttttcgccaaatttatttgagcactcggcagatgcttgggcttgccgaaaagtgagaaaatccgtgcgtaagtacacttcaatcactaatgttacgatccaagagactcttgaaccacttatgttgcaaatgactccgagtgaatgtaagcaaatggccgaaaatggaaagtgcagcttaggcttgctaattaatgactcgggactctcgcatactgacaagaaattggatttgtcaccccgaatgtggttaattggttcatttagttggtcgactgtctcaactgaaaattgttatctttttaagactaaaatcatgtcacaacatggtagcacaattatgctaagtccccttgggtcagtgaacaattgccaattcaaggcaggccaatgtgaaatggaagacaagacattgctcatgtgggatacccacactacccgtgcctgtgaattttcaaaaattggcacatggaaaggactacaacttgacaatatttggatttcggatgaagtcagttttcgtttgacatttttgaacaacacaaagaaagtcaactcatgtggtctgaatctgataaaatcggaggaaggatttgctgtacaagacttgccttccgacgatagcaacgaatcctcaaagagaagcagaaagacgagatcacttgaaagttgggtcaccgaatcggaaatgaactccaaattgggctatttggatgaacaagtaagagaaatgctgactatttccttttctcagacaattaaatcgatttgtgattatatgttggagacgagaagatgggcagcgacggcacttctctcagatccaacaacttttgccagaaaattattccaatctggtaaactggtggcaaaagtggccgggcctgaattgattaaagtgtggccatgcatcgaattgcaaggacatgactacgaatttgccaaaattggaaactcagcggattccgaattcgaatgctttgacaaaattccaattaaattccgagtgaaggacaacaaaagaatggcatttattgacccaaggacaatgattttgagctccgatgcgagactggcaccatgctcagaataccgcaaacagctcatttttgtgcgtggttctctttatgaagttgatcaaatcgatgctcaggtcaaacaggtgaatgccaatcgcattgacggtttcagccttaatctgtcattggcaccgacttatgctcgccattcctttcttcacattgccctagtgaatgtgtctgactttattggccaattttacgacgccaatttggcaagagaaaacgaactcacattccaaatcaaaagtgaggacgctatagtcacaaagaaaagtcgaacaatgggagcag

SEQ ID NO: 74162 - DNA, 311 bp, Heterodera glycines
  Genomic contig location: Contig_ID=SeqID_10880; Location=21..331; Strand=-
  SCN-specific regions: Sequence locations=1-33,55-98,128-311
atggacacatgtgtaaaggaaaacggtaagtgttggccatcatttaaaggctttttggtggggcatttttggcacaatagctttgaaaaatgctctccaaaaatttaaatattattttttaatttttggcagattttctccgatttgatcagtcgaaacgcatggaaaaccagtcaaagtttgcatattttgagtcggcacaggccaccattttgcgcccacctaaaaactacttaaaatccgccgaaatttggctgagtgaaaagcaatgtgctggatttcgctacgaaattgcggcaatgctttgttaa

SEQ ID NO: 74163 - DNA, 996 bp, Heterodera glycines
  Genomic contig location: Contig_ID=SeqID_10881; Location=933..1928; Strand=-
  SCN-specific regions: Sequence locations=1-22,44-184,207-402,425 -588,636-800,855-996
atgcatttcggcaccgttttgtcccttccgctgccgcttttcctcgtcgtgtgcttttccactgccgcacacatcgctcatttcaatgcaaatgcggagcaacaaaatgcaatcgaatggaacgcaaaacgggacagaatttgtgaggtgagtgaacaaacggcacaatgtcggacgggggcacaataaaaattttttaattaattgttcagatgccgctcaatcttggcaattgcacggaaaaattaacgcgtttttactacaactcgtccaaacagcggtgcttcagattcttttacacgtatgtgccattttgagatgccaaaagttcacatcgggaatctcgaccattgaaaagccattaactaatcacttagagcgtaccaaaagattaatttatctttgattttttgttgtcatttcggcacaaatgccattttccgcaattccaattcattttccattttttcgctttcagcggctgcaatggcaattcaaatcgctttcgtaccagaagtcattgcaagagaaagtgccatcccgactttcgattgtctgctgttttccaatcggagcgaaagagtgggcaaaaattgaaaaattaattaaattatataaaatatattaaatttaaagaagcagaaaatgaccgacaaaggaacaattgcgtggaaaattgcagaagggcgggcggcgtttgtgtgaacggaatttgccaatgcaaaagcggatatgaaaagagagaaggcaaatgcatcggtaaaagagactaatcagcgcaattactgactatctttttcaatataatttattttattaaattaattttttttaaagtttttttcatttttattgccatagattcgaatgaatgcgattggatcagttgcgaacggaatgccaaatgcatgaatttgcccggctcatttcgctgtgaatgccgcaagggtttcgcgggcagcggattcaattgcacaaaaaatcgaagtaaataaa

SEQ ID NO: 74164 - DNA, 1073 bp, Heterodera glycines
  Genomic contig location: Contig_ID=SeqID_10883; Location=61..1133; Strand=+
  SCN-specific regions: Sequence locations=1-47,72-198,255-266,293 -362,384-389,414-493,530-602,654-694,741-768,825-860,915-1015,1056 -1073
atggaaagtcagcagcaattgatgttcaacacgtcaatgggttccagcactaataataacaacaacaacatctttgggcacagcatgcaaagactggtgattaacttatgcccaagggttttaatacgttttttcctgagttcccagatacatgaaaagcgtgaaaatttgttttagcgactgatgttaagctattactttttattattttaacattataaagaattctttaaaaataatttttaaaaatattacatataaggagaaagataaaataaaattttattctaaaccccaacccattgatcagcagacttcgccggatgagagtccgttggatcatgtaaatgtgcatcaacagtatgcagtttcaacatatgcaaataatgagcaacaacagcaacaattgcttttatctccgtcaccaccaaaacgcagcgcatccttcacagatatgtgcgcttcctatcagcagatgaacattcagggtgggataaatttaaaaatatatttttttatgtaatatatagcatttattgggttctgattccagaatttttggataattttttgatgtttttaaaaagatttttaccaaaaagataaaaaatcaatttatcataataatttatttatgttaaagtaattaaaaagaaatctcgcttttatggatattaaaaatttaaaagggttcattatttaaatataatctaattattttaattcaattaagaaaatatgcaaacaaatgtgcaagtgactgaaatgcaacagcaatatcagcagcaacaacaatttcaaattcaacagcagcagcaacaacaccttgaagggttttttgcgcctccttttgcatatggtaatttttttaaaatttattttagattttattaaatcaatttatataaataattggttaattttatgcattgaacttgatccggatggaccacagccaaaaatatctttggcaaatcagcagcagtcggcagcacattttgccgcatttaaaggcataaattaatttagaattttttaattttttaaaattttaaggaaatgaacttactcca

SEQ ID NO: 74165 - DNA, 150 bp, Heterodera glycines
  Genomic contig location: Contig_ID=SeqID_10886; Location=559..708; Strand=-
  SCN-specific regions: Sequence locations=36-150
taatttagtttataaaatttacttaaatatatattgaattaagcaccagaagtaaaacgggagtcaaaaaattttccaaactataaaaaagtaaaaaattcgcttatgtgcaaccacgcgaaaatggccacgcgaaaatgaccccgaccg

SEQ ID NO: 74166 - DNA, 951 bp, Heterodera glycines
  Genomic contig location: Contig_ID=SeqID_10887; Location=920..1870; Strand=-
  SCN-specific regions: Sequence locations=1-283,308-951
atgtttattgctgttttcctgccacagatgccccactccgcgttgcccccgttgccagacaatcggctgagccgttcgtttaacaccgcctccgtgctgttgacctgcctgaacgcgcactgtcaacgcgttgttcagccgttcaacaactttttgtgcgacgcgtgctttgaggcgcagaagcgcgagctgacgcggacactgatcggcggtggcgggcaccacaacgccgcgctggccgccgcttcatccgccgctaacatttcggccaccgcaatcagcaacggaggaggaggagaaggaggcaacaacaaaggcaccgccatcatcatcattagggctaatgatgatgatgatgatcaaaatcgaagtggtggcagaaagaacaacgccactaaacatgatagtaatatcagcaccaccaccaattcccatcgtttgcattgtgatatttccaccacttgttaattaattgcctaattagaagaagacaaatgcagcagggatgggggagagagagcaagagaatatcattttcgacattcccgtttcttgtcggcggtatgccgtttctcgaaatcctttatccgacaatctgcgggtcggcatggcgacttttgccacatatacattgattgtcctagtgccaacccgtgttaaagcaggcgtgcgatctgtcccgatttgtcctataatttggaggatccaaatccgacaaaatgaaaaactcctgctgatttgtcatccaatttatcttggttttgaaaacttcagatcgcacacctgtgttaaagcatcacaccaaatgattttgcttaattgtcccaaacatactgactgactgattaatgatggtcatcctttgacaattttgtctttatgttcagttattgacaattttattaaattttatttgtagaatttcttgtagaactttgacaaatgaataaa

SEQ ID NO: 74167 - DNA, 384 bp, Heterodera glycines
  Genomic contig location: Contig_ID=SeqID_10887; Location=2649..3032; Strand=-
  SCN-specific regions: Sequence locations=1-120,186-210,232-305,328-384
atggtggagcacgaatttgtggagccggattctgcagtggacaaccggaggaaaagggcgttggatgccgccagaaagattgtgtgtgttgagaagggcggtgtggcgtggaaaatggtagaggaaggcaaggaagagagtgaggagaaggaagaggaaaagcagcagcaggaaaaggatgagaatggatggccaactgaaaacaggacatgggagcagcagcaggccgtgttgggtaaagtgtcaatctggcgcgactacttccgcaacggcacgaacagcacgtccgccttcgtctatgctgccggacagcaaatcaaccaacaagatgggtcccttcgcagcataatggccaaatttttgatgcgagacaaccaaagttaa

SEQ ID NO: 74168 - DNA, 136 bp, Heterodera glycines
  Genomic contig location: Contig_ID=SeqID_10888; Location=1279..1414; Strand=-
  SCN-specific regions: Sequence locations=1-136
gtgtacgagtcgttggagtgtgtgcatgtgttttgcgctcgcgcacattttgtatcggcccatcattgtgtgttggtggacaccattctgcgcaatgcgaaggccgaagaattggcaacgattccgttcggcggca

SEQ ID NO: 74169 - DNA, 505 bp, Heterodera glycines
  Genomic contig location: Contig_ID=SeqID_10889; Location=558..1062; Strand=+
  SCN-specific regions: Sequence locations=1-170,205-505
atgtctcgcaattcgttgaataattttgcatccctttggcctccgactgtcgcggggtgtccaatggcaataataacaccaaaattccctgaacaaaatgcgtcttacaatgtcaacactttcacattccaaacaattgttaatgaattaaaaactggtaaaacgaaaacaaaaaaataaaataaattattttaaaataattaagcaaatcaaaaattgtcagaaaatcccaacaatcggcaaatggttttcgaagaaattgaatatttgcacaaatttgaacattacgcggtcattttgtgtttgtccacgacaattgaattttaccggacaaattgtggctatcagaagagcaaaattcgacagaaacttttcaattgggcaaaatcagaagaaaattcggaaaaattggacaattatcagctgataacgcaatcggagaggaaaacgaagtgcaaaatgacaaagtaaaataaaaacaaaagcattaaaaagaaattaaaca

SEQ ID NO: 74170 - DNA, 1275 bp, Heterodera glycines
  Genomic contig location: Contig_ID=SeqID_10890; Location=81..1355; Strand=-
  SCN-specific regions: Sequence locations=1-199,221-282,326-641,681 -1275
atgtatgaagctgatttgaacattaaacgctttaaattggacaaaattcggaccaaaaattgggaatgtaaaaaggtgaagaaaacccacgcggcgatttgcaacgaatggaaaaagcggtggacaagtcttacggtgtatttggcctattacagagaatttggacgccataaaatgggcacaaagattgaaaaggcactgagaagggaaaggggggccatggcacaattggcaaacaaaatggccaagcaaattggtgggtcccaagttgaattagcatagatatatttattagtaaaatttattaagaaaacataaattataagaaagtgagttttagtgaaaatttgccatttacttggggttatttttaaaaaaagttccaggacgttcttagaggtattttctctactttttattgtattttatgaagaaaattttcaaaaaatactgaaaaaggcaggaaaaaggtgccaatcttaaaaaagacaaaaaaggcaccaaaaagttaaagctagaagcctcaaattaagtaaaaattcagttttcgcgttattgggccgtagaaaaaggcataagcctcaaaatccggtctctaattatagtggacttttcagccaaatgtttaaatttgcatacaaaatacaaatgaaaaaccaatagagaataatagaaaaacatattgtaatattatttcattcaacgtttattgtaattaatcgttttaactgttaaacagaagaaaccggcatgcttgaccatttggcagttaagccgcacttcaaagcaagcgccgatgggtcaatgctaacattcactgagtcgattagtcaatgcttttccgcttacaatgcgctatttttagcggaaaaatttaaattttgtcaattttactcatgcctttttggcatcggtgggccaaagaaggcccaaattcagcccatttccgaatttatcaacgaaaaggagtgcgttttcgtcaacggatgggtccgcgcttatcaaagatttaaaagaattggcgacaacgaaccgaaaatgggcgcccgaaatcttctgagttcgattgtgctacagatcgaaaatgacgagccaattccggaggaaaagctcagcttaatcccttttcacttcccggcatcagcgcaatgaaaaacattgaaattttgaaaaaaaacaaaacgagaatttgtttttcttttctgataatcgcttttcaaaattttgtacaattttacaattccaaaaaccaaacaattttgtgaaatcaataaa

SEQ ID NO: 74171 - DNA, 248 bp, Heterodera glycines
  Genomic contig location: Contig_ID=SeqID_10890; Location=1422..1669; Strand=-
  SCN-specific regions: Sequence locations=1-65,123-172,194-248
atggtcataagaattgcagcaattctgccgattatttttgtttatggcatggagcgtaagagaacaaatttatattcaaaaaattgattaataggttattaaaattttcaaaaaataattaaggtaatttagggtacccggacacaacaaataaaagagacaatttagcaatgaagaaaaagcagcaggggaatttgagctatttatattcaattggagaagacgaaaaagtgttaattgattattaa

SEQ ID NO: 74172 - DNA, 286 bp, Heterodera glycines
  misc_feature (54)..(54): n is a, c, g, or t
  Genomic contig location: Contig_ID=SeqID_10890; Location=2120..2405; Strand=-
  SCN-specific regions: Sequence locations=1-62,102-286
atgccaattcgctgcctgaccagacaacggcacaaacattgcctttgcaatgtntgaggtggcattttgggggaaaacaatttttaaatcaaaaatattttcagtttatgcgcgccgaatttccacttgacatttgctcatttggcatgcgttgaacacatcgaacacattttggactgttaccgacaacttttggaggacaattcgctgaataattctgcctttttgcagcaacaaaaattgatcactttgccctcttcgccattttcatgacaaaaaaaataaa

SEQ ID NO: 74173 - DNA, 1631 bp, Heterodera glycines
  Genomic contig location: Contig_ID=SeqID_10891; Location=1186..2816; Strand=+
  SCN-specific regions: Sequence locations=1-161,191-191,214-216,246 -260,282-390,422-467,489-592,614-718,853-925,947-990,1012-1038,1060 -1323,1365-1453,1480-1588,1610-1631
atgccaactgataaatttgatgccatcaatttttcagagtggaaaattctctatgaaagcattcgtcaattttttgattattgcgattttctaaagtctaatgccgatgccgttttgttttatgaaggttaatgaattaaatcattttccaaaaaagcatgaaattaattattattaatattattattatgtatagttttttgcttaatgaaacacataaaaatattttaatatatgtaaaataagcccagaattcagaaaataattagataattatctatgcttatgtattaatgcctgctaatcctcctgtcccgacctaattgccaaacacgaaacccgaatttatggattttaaaagtctggtctctaactctattaatcatagccatattaacttataattataaaatattttattgatatgggctaatagcattagcatttattaatttttagatgattatagaagagaagaatttgaacattttgcatttaaaccgcagtttttttacccgaacggtgacacaatgccaatcagtgatgccatgcgcaaaattgttgaaggatttaatataattttaaagaaaggattggccaaaatcaattttttctccaaaaaagaattaccgcaaataaatttcatcaacagacaaatttgcacaaaggttaattatgtaattattattaatcaaattattggtgttaattattggtctaaataaaaaaaaaattatttttatttttaaaaatatttataggttaaaaaatatattttaataaaaattttcaaaatttacaataataaaaataaatttatttaaatttttattaaaaattataaatttttttgaggtccttgcttggacttactcaataaaaaaggctgaaaatatacaactcgcaaaatcaactttacacatcgttaaattgcatatattaattagcggatttcacaattttacatttgatctgccgtatccgccaatcgatgaaaatgaaatgggcgaatttggtgctgaattaaatttagagtttttaataacattttaattcaattagcttcgtaaaaatgtcagatctaaatatataatccttaaattttaatttttggtaattttcgacattattttattcaaaaaaaaaaaataagcagactattaggtgagtacttagcaaacctaatagttcaaataaattaaaaaacattatgagccttcgaaaatgaataaattttaatcacattatgaatctaatattattaaaatacttaattatatccaatcaaattaatcactttcagaaaatgatctcatttcaaatggttttattggaaatagacaaaataacactgaagacaacattgaagaaaatgatgaagatttatattggatttgggcctacaaaatgatgcttgatacaatagaggaaggaaatgataataaaggtaatgtaattaaaatattttaaataaatattgcgcttttttaaggaaatttcaaaaaaagaatgttaaattttttaaagagccaatggctttaatcgacaatggaattaggtattcgttggtgatggatgttctgaaaaaagaatggtttgatgaattaaatgattatgacaattagaaatga

SEQ ID NO: 74174 - DNA, 328 bp, Heterodera glycines
  Genomic contig location: Contig_ID=SeqID_10892; Location=633..960; Strand=+
  SCN-specific regions: Sequence locations=1-20,62-150,177-285,307-328
aaaatgatctcatttcaaatggttttattggaaatagacaaaataacactgaagacaacattgaagaaaatgatgaagatttatattggatttgggcctacaaaatgatgcttgatacaatagaggaaggaaatgataataaaggtaatgtaattaaaatattttaaataaatattgcgcttttttaaggaaatttcaaaaaaagaatgttaaattttttaaagagccaatggctttaatcgacaatgaaattaggtattcgttggtgatggatgttctgaaaaaagaatggtttgatgaattaaatgattatgacaattagaaatga

SEQ ID NO: 74175 - DNA, 2120 bp, Heterodera glycines
  Genomic contig location: Contig_ID=SeqID_1519; Location=489..2608; Strand=-
  SCN-specific regions: Sequence locations=1-572,618-763,787-831,860 -922,945-956,979-983,1020-1059,1081-1105,1128-1909,1984-2120
  Gene Ontology: Mol. function=protein binding; Biological process =intracellular signaling cascade
ttacagttaaccggcgattgggtccaagtgcaaattgtgcatttgcccaacgaagcggagggactcggctttggcatcgtcggagggcacagcaccggcgttgtggtcaaatcgatcatccgcggcagtgtggcggacaaagtcaaaaaaataaataaacgcattaacattaaaataaattcatagcggatgggggagtaaaacaatttaaaaatgcgaaaaactaatttaaaaaattcggggaaagccggggaattttctgttcgccgatcaatcaaaactttagggattttcaaaaatttaaaaaatcgaaaaatcacagagaaggaagggaagggaaacggaaaaatgccaaaaacattgctaattggcaaatgatttgaaccgccacaatttgctgattctgaaactaaaatggtgtgacaaattttgtccggcctaaaattcgagctgctgatcataagccaaactccgtttaggacatgcgccttcgtccgggcgatcgcattctgcaaattgggcacatttccacgcagggactgaacaggtgggcattttgttggaattcgccgatttaaaattaattttaaaattgcatttttaaattaataattaatgattcattattttccatcagtcaacaagttgccgctctgttgcgccagcaagaagccgttgttcagttggttgttgtacggcccattcagctgcaggacagtgaacaggacacaccgcgtatgttataattagttcaattttatggttaattgttttaaattcaatttaaaatcgtttggtatgtggaaacaataaaataacttttttggttggaatttaaattatataaaattaattaattctttaccctattttggctaattcttttgtcagccccaaaatctgattttaaggttaaatgttcttttttaaaaatttataaaattcgaatgcccgcattttctttttctttctatattattttgtttattttaatttaaatttaattaatttaatttaatcattctttattattgaaatttaataatttccaaaagaatttcaaaattattattttcctttcgaatactacacaacattatgtctatattttaaatgctttgattttgaactttccttggcattagcaaattcttggtattctttccaaaaataattttcaaacattttaaaataatttttccattttaaacaatttttgccctcgaaacattcgcccggtgttttcttttgtgacttttgattgactgctgcttctgctgcacattttgtgacagatgaggcggcagcaatttgtctgctgccagccgctgacgggtgtcagctgtgccaaaaatcatttattatttcgattattatgaattattacatatttatatattaagcccctcttttaaattttattggccgaattttttaggggggcggggcggcagcgccgaaatttgtgtgccccgggggaatttttgaaatgtgatagcgcccgaggggcgacggagcaccgccgccaccgctgatgagcaaaagcgccaaacaatttttggcttttccaataataaatagcaccaaattatgatgcaccactgggaaaccaaggaccaaatttcatcattattagtcgagaaaattcaatttttaaagactttttcggttgtaaagtctcgagaccaattcttgacttttgaaccgacaaattcttactttctaatgagtgtattagataattagcagtgattattaagcattttctcattattcaatgctattaagctatggatctgttttcgatggacgaaagtttctcgagagtcgcgaccgaacccactcccaaaaaagccagagaaatttttagacctcgagactgcgaatctcgagcagtttttattggtgccattctgttttaaaatttcacttttttaaataaaataaattttaattgttagaatttatgtattaaattttttagtatttcattttcgaatttttcaaaacgaaaatgattttgaaaaaagtgttcagtctgctggacaatggccactcgtgcggcactttcggcggacactttggacgagcaagtgcagacacggcttgaagcattttcg

SEQ ID NO: 74176 - DNA, 2682 bp, Heterodera glycines
  Genomic contig location: Contig_ID=SeqID_1519; Location=3142..5823; Strand=-
  SCN-specific regions: Sequence locations=1-383,405-992,1014-1404,1431- 1540,1568-2340,2362-2427,2449-2682
atgcgcctgatcgattggcttaacaacaaattcgtgacaaatccgtggcacaaccggaccaaacataaaaacggcaattcaattagcaacaacggttatcatcaccatcaatacaatggcacggcattgcacagcaacggcggtaacaacaagtgctttgccggggtgatgccattctcgaccatacgaccggatggcactttgtgtcaccccttcggcatttcgtcgtccataccatggatgccgcacacgcggtcacaaatgccgccactgtttggcaccgtttcgccgtccaacaacaccagccgccgtccatgggaagcggccaaacggttgctgcgtgccgtgccgcttcgcctgtcgcgcaaggcatccgaaaccgcgtcccattcgtcatcgttcagcgaggacccgttcggcggtggcggagaccgtggcggcacgccaatctggcttttgcgcgaccccgcaccggtcgcgcctcgtacgggccaacgcgttggtgtcgacttcgccgcaacgcaacgtcgccgtaccgagtcgcctcgcgcactaagacgcagcgtacgcgacttgcgactctcgcgtcgtcgtcgtcgcagcggcttcgcacagttttccgcgtttggctggcagcaacagcaggacggcggagaacggcataatgcggaaagaacaacagtcggcatggacgacgtattacggcacaaaactgaccggttgaatcagccggcaaaatggcgtgaggacaacacggcgccaagaaagttggcaataattcaaatggcaaatgagcgccaaattggcacgaatccaacagaaaggcaagacgaatgccaaaaaacggggctattacaacatgatgggacagaggaaaaggccgagaatgggaatcaaagtcgtataaaatcggcatttgatgcggtgccgccgaagaatgcagtgatgctgaactttgcgacggagttgcagcaacggatggccgagcacatgaaggcacaatatgccaaaaaaggcgctgtactgtttgcggaccatgttctgctaagcggcaccaaaagcaggcatgcacacgtgggcacccacactgagctcgagaccgagaaaaggccaaaattttttggtctcgagactgggatttactgccgagactttatttcaagatttgggtcttccgggactaggataatattaattgttgcgagactaattcttgaagcttaatctcgaacttaggaatcgactggataggcgagaattgatctcgaacttgaagttctggcattggcctagggatttatttgagcctgatcacccatcctgttccacgggattctagggcccgagaattttggtgattggtccaataggccatggcccatccccaagatattgtctcgagaccgatgacaacaacaacaacaatcacacaggcatacgccgttgtcgtccgcgcatagttcggggcgtctatcggtgcggtgggccaattccgtcgacacgccaaacaatttgaacagcagcagcaaaaacattggccaacatcaacagcagcagtcaaaattggcacttccaactgatacgcattctgtcactaccagcagaaaggggtgccaaaaatccgcgagtgtccgctccgcggtggaaccgcgagtcgacgaggagcggtgtcgacgactttgcaacaccacgccgtcctcgcggcgctcgtccgcccgcgcgctgctttgcaccggcagcgcgctgattggatggcgccgcatgaccatccccgatcggctggagttgccgcctccggcaccgaccgcctccaaatgcttacggctggaaccgccgcaaatggaacggtttggcagctgcgagcggtgggcaccgccaccgctggtggagcgcaagcgcttcaatctgctgaacaagcggcatggcaccgccggtggcggctgctgtgacagctgcggcagcagtacttggtgttgtcccagccgccgtttctgtcgcggttgcgctagtgacagccgccgctggtggccgctgatcaaccagtggcagcaacagctgcacagcgtggtggcgaggccgttcatcagcagcaacagcgcggtgcgcaagccggcacagcagcaaaagcagcaactgatcgtcggattgtcatccgaagaaaaagccgcagcggatggatatgctggcggtgtgatcgctatgccagcagagggacctaaagcagtacccgaccgggttttggtcatacaacacgatgactatgcagttgatgatggccagcaagggcatcatgatcgcgacgaagcggttcatcacgactcatatgaaagcgatgaatccgtgacgtcagccgacggcacggacgaaaaagcaacagaaactgaacaacatgatgctgatcatcattatcatcaagttcaagcagaacaaccactgctgatgccatcgagtgaattccatcaacgcaatttgctgcttttgtcggtcattcgcttgttgctaagacgaaaactgaccaagacggcggagacatcgactaatgatcggagtgaatacaatcggctggcagctgaacggctggcacgggcggttgtcaacacggcacaggacgagcggtggattgaacggagacggaaacgcaaggaacgggaacggcaacgcattgtggaggcgagaaaatag

SEQ ID NO: 74177 - DNA, 1209 bp, Heterodera glycines
  Genomic contig location: Contig_ID=SeqID_10895; Location=707..1915; Strand=-
  SCN-specific regions: Sequence locations=1-158,193-273,301-346,371 -480,505-973,995-1080,1102-1209
ctacacgccgttttgcgacagtcgcaagtccatggacggctttcggttctggcggagcggctactgggcccagcatttggcgggccgcaaataccacatcagtgctctttacgttgtggatttggtcaaatttcggtgtgttgattttcaaaaatgttttttaatcatcaaattattaaatgctttttaaatattttcagccaaattgccgccggcgatcgtctccgtggccaataccaagggctcagctccgacccgaactcgttgtcaaacctggaccaggatttgcccaacaacatggtgagttggcaagcaatttgttgacaaactttacaccaaaattcgtcaattctatgcatttttgagtttagtgtgtctgacggcgacatcagtcaccgccatcgttctcttccccgaaattaaaaaaaaattgcaaaccaaaatttttcaaatgaaattagagaattttttataagaaaattacaagtaagaacatttagaaaaaatcttaaagcgatttttcaaaattttatattgtattactaattttttcaaagattcgaaaaaaccctagaaaaatttttcaactaaatctttttcttgcaattttcttgtaaaaatattttctagaaaattttttttaatttctaagtttgaatttttttttcattttcgtgagtgggaaagttatgctctccaacttcggcctttctgatcccaagaactagattttttaagcgtttattttctgcgaaaaaaaatcaaattctcatattttttacagaaaattcattccatttttatccccattcctcaatgtttcagattcaccaagtgcgcatccactcgctgccccaggaatggctgtggtgcgagacgtggtgtgacgacgtgtccaaggacagtgcgaagaccattgatcttgtaaacactattatttcgaaaatcacacaaattctcgaatattccattatttaaaaaatgcttttttgtagtgcaacaatccgctgaccaaggagccaaagttggactcggctgttcgcattgtgtccgaatggaccgagttggacaacgagataaagcggcttttgacaagcagcagcaacaatagaagtgctgttggaaagccgcaagacgacgaaacagcatttgatgacgatgaaaagcacgaggaattatgattaaaagaattaggcgttccaaaataaa

SEQ ID NO: 74178 - DNA, 890 bp, Heterodera glycines
  Genomic contig location: Contig_ID=SeqID_10896; Location=1..890; Strand=-
  SCN-specific regions: Sequence locations=1-250,272-306,328-349,372 -507,531-890
  Gene Ontology: Mol. function=UDP-glucose:glycoprotein glucosyltransferase activity; Cellular component=endoplasmic reticulum; Biological process=protein modification
gcaccggtcaatcgtacgatcggattaacatcttctcgctggcctccggccatctctacgagcgcttcctgcgcatcatgatgctgtccgtgctgaagaacaccaaacacccggtcaaattctggctgctcaacaattacctgtcgccccaattcagggtgatccagctgaaacattaattattattttttcctaatgagtcacgctccgcaaatttgacaaactttcattccatttaagcgttaaagactttccatgacttttcttcatactaaattgtggttctaattccccagcgaaattgccggaataatttttggagaataacattttcaagaaaaacattgtttccatgaatcgatcggagcctatattgttcatttttttaaatttttgttgatattttctaccctcatttttttgattgtttaggaatcccttcccgtgatggcttctcattacggctttgactatcagctgatcgaatacaaatggccgagttggctccaccaacagacggagaagcagcgcgtcatgtgggggtcagtgttacgctcgcgacatgggaggcttttactatgcggaccgctaatttgctattttccaagaatttaggacatttatcccccaattttctaaatttggcgttctctgcattttttaacgtttttgaaaacagtcataaatgataatttctttacttcaaaatggattttttttaattcagaaatttctttctagctacaaaatcctctttctcgacgtgctgttcccgctggacgtgaagaaaatcattttcgttgacgccgaccaaattgttcgcaccgatctgatgcagttgatggagtacgacctcgagggcgccccgtactggtgagtgattgcggagc

SEQ ID NO: 74179 - DNA, 1668 bp, Heterodera glycines
  Genomic contig location: Contig_ID=SeqID_10897; Location=758..2425; Strand=+
  SCN-specific regions: Sequence locations=1-155,177-336,440-1403,1425 -1668
atggacgttgtttttggcggctcttcgacaacaaatggtagtggcgccggtggcggcgcaactaaaattgggcgcaccggcgccggcgccgccgattgctcatcgggcgacgagtcaaatgaaagcgaacggagcgacgcgccgacaaacaccggcgccggcaccggcgcaggcgcagcgctaaccgaacgacggacaaagcgaaaacagcagaaaaagggagaggaaaatgagcatgaagaggggaagaacacgctcaaagcaatgttcccgacaattttgaggaggaaaagcggtgggaaaaaaagtgagcgaaagtcaaaatatttaattggcattttaaatgaataaattacaaaaaaaaaaacatttaatagtttaaaaaacacttttaatagactttaatttaataaaatttatttttatatcttaaaaaattctaaaatgcatttaaaaagccaaaaaggcatattgattcattcgaaaatgcaaaaatctgcaaatttcaagttaaatgccatttggtagagaattttttttttgccaatccttactattctaatcactagaccgaataacacaaggattttcccgcgaagccaggtctcgtccaaataatttttaaaagtgcgcccgggtcaggatcacctcaagcagggtttttaatctaaaatctgtttcggataaagatgacgaaacttgatccggaatttctcaaaaatttcaaggctctactaataattctcattaatttgtcagtattgcattctaaaataacctattttcagatgcttgttggtgtccttccgcttcatccctctcactgcctttcatccaccagcatccgcttaatcctcatccaatcacttttgccaaccacgaaagtgaggcagccgccatggtcatcagcaaaaacaacagtagacggcacaacacaatggcatcggcgcacccgggcgttaaaacggagccaaaaacacgcgctacggcggcggcttcatcaccttgttgcataaaacgggagagctgttgcggtggcgccgatatgccggaaaagagaagcaacaattctcggatggcaaggacggaaaatgccggcgctgacggcgcaggcgcagagcgaaagtgccgagtcagcgctggcttttcagtacaggaattacaactccaacggcacgagcaatgcatgttgcaacagcagaaacgcattgatcaactgttgctggagttgggccgatcccagtcggcactgaaccagcaccaaaaaatgttggaggatgccgagcgacggatggtcgaggagggcggccaaaccggcggcggaatggaggtgggaaaagaggcggatttactaatccagctaattaaaagcaattaccgtccttaaattgtccttaatcactcagggcctttcctttatcagtcaatcgttgatctttctgagcccttatgtcacaagatcgctccttgtttaacagtttttgttgattgaattcacgcattgatttgatcaatgcttcttcccatcactttcccaattttcatgtttttcagtattggcttagccaattggaaaatggtcgtcgcgaatttgcccaacagcagcagcaattggacaagcaaatggacgtccagaaagtgctgtgcaagcgggaccagcagatgaag

SEQ ID NO: 74180 - DNA, 567 bp, Heterodera glycines
  Genomic contig location: Contig_ID=SeqID_10899; Location=21..587; Strand=-
  SCN-specific regions: Sequence locations=1-398,420-567
atggccaacccaaacaatttcattgctatgattacaacgcacaagcgaacttcgattgggtcaacagtttcaaggaggtgtggcagtaatctcaacaaatcactgattttgttacctctatttttgttttcaaattgcttagcatttttccgtgccaatgccatttcttcggtcagctaccaaattcgttttactattcgtgtgccgtcaatgcaaattgtgccatttgaattggtgaacgaatggacaaaggaaaagctgacattggccaaagcaaatgaaaatgattggcgcatcgattggataatgaaacgatgcaaaattattggagagacggcggcgtttcattggaaagacggaaattgggacaacaattgtaaccgtgtgttcttttatcttttttgtgccaataattgcattgggtaagcaattaaaaaagggatttgatttttatccgaatttgaattttgcgcttaattaaggtcattgtctccgccaccggaagaagtgaaagaaaaagcgggacaaagcatcacaaatggggcgtcttatgctgacaatgagtga

SEQ ID NO: 74181 - DNA, 613 bp, Heterodera glycines
  Genomic contig location: Contig_ID=SeqID_10899; Location=686..1298; Strand=-
  SCN-specific regions: Sequence locations=1-553,596-613
ttggatttgcaacgacgttttgatggacattctcccatcatttgaccatgcccaactcggcctcaaattggcattgctttcgccacgtttcaatgcgttggtggacaaacattttgatggcaaacgcgaattgacaatttggagaacggtcgaaattcatcacaaggacaaaggatctggaccaaaactgtctgtagtgtttgatgacagagctgtggaatttccgttgcccgaccgtccgttctcctgcaaaatccgttttaagcaccttcagattgagtaattataaataagagtatatcgcaataaaagcattcattcaatttttaggtacattgatcactacgtcatcgcttttcttcgtttgaatcaccaaatttttgacaaaagaggcatcaatttagagttgtggaatccatcatcacacaccatggatgtgcagccaatttgggatgttttggcccatgaaattttgccaattttttcggcaaacattcgccacttgggctttaacagtggtgatcatttggacaatttgcgtcgtctcatttcgccaacaattctcactgaactgaatcaattgaattcaatccattcatttgatctgttctga

SEQ ID NO: 74182 - DNA, 1706 bp, Heterodera glycines
  Genomic contig location: Contig_ID=SeqID_10901; Location=342..2047; Strand=-
  SCN-specific regions: Sequence locations=1-250,274-873,896-977,1009 -1065,1087-1706
atggacacggaggcggggaaagcgcaactttatgccaacaatacggttccatttccgctgcccgagcgtccgttgccgagaaaaattcgcttccaagccttggaaatattgtgagagtgttggttgcatcgtttcccctcaccggttccgctcggcctggggtcggagggatcccgatcagtctcgaaaattttgaaaaagccatcggtacggatctcgaggtcgggatcccgatgccgtccggtctctaatccaaaccatataattaaaaaagcttcaaagcatcgttggccccactaaaggcattttccttccttttcaggtacatcgaccactctgtcatcgaatttctgcgtgccaacaagcaaattttcgacaacaaaggcaccaacttggtgttcaaattgtcatcgtatttgtccggaaaagaagacggcagaaccatttggcaatttttgtgccgcgaaatttggcccatttttacgccgaacatccgtcagttgggcttctacaacggtgaccatctcgtcaatttgcgtcgtctcatttcgcccacaattctcaccgacctcaaccagctgaatccgcttgattccggtgaactgtttcccgctggtgttgctgacgatggaccgaacgcaactgctgggcaagcactcaccaaatggttgcacacgcctaccgtcgatggacagccgaaggaattgtattgcagtgatcatgtttggggcttcaaattcgactggatcaaaacgttcaaagaggtgggtgatgggggcggaaaattttcttgaaacaattggtcgaaccaacagcagacaaaatccaacccgtaaatcgtcataacttttatcagcttcaattaaattaagcattttttggtataattgatagaccttaactctatttacagcaaaatttcaaaaaattgatcctgtttaaaaagtttatggaagacatttttttacaatttttggtttttttttttaaattgtaaaaaaaatttttgaatttgcatgcaggtagtttatttttttcgaaaacttacaagaaccgggccaccagcaggtccttggtaaaatcctgtccggtttctaaagcaatatgtttggtgctactggttcggtatacttggtgatcaattttttccattttttaggaatttctccgttccaccactccggccagttactacatcttgctgcacttatgctcaatgccagaaaagccgtttgagctggtgaacgagcaaacccaggaaaagctgagcttggccaaaattgagggcaatgtgttgatcagttattggttgctgaagcgatggccaatcgccggcggggagacggcgcagcgcaaagacgaaaatggcaacaaattgaacaacgtccgctttctgattcgtggcattaactgcattgggtaagcacccagcaacggcattttctgttttcaaactattcaacgaatgaatttatataggccattgtccccatcgacggcggaccaaagcaacggaaatgccgtgccgagtggcgccggttccagcgaatgatcggacggaagaaacgaatatttaatttgaggaattgttttgatgagggaaattatatttgttgagatgatgatgcacacattacaaatgctattttcttcatgtgtttatccattttttggctgcttgttcattttatttgggaaataataaa

SEQ ID NO: 74183 - DNA, 1026 bp, Heterodera glycines
  Genomic contig location: Contig_ID=SeqID_10903; Location=579..1604; Strand=-
  SCN-specific regions: Sequence locations=1-349,371-378,400-790,812 -891,913-1026
atgggcaaaactgtagaaagtcaacttgaacaggtttattacaacctaaattcgccggccagctacgcaggaatgcaaaaggtgctagcagaagcgcgaaaacgtatccccaatctaaagcttcacgatgtacagaagtttcttcataaacaaaggacttacacacttttcaaacccaaaagaaacaaattcccacggttaaaaactgtcccaagtggtttgcatacggattggcagtgtgatctttgcattatggactcgctgaaggagcacaacgatggatacaggtatattcttgtctgtattgatgttcttagtagacagatttatgtcgccgaagctgagtcgaagaagagtgagcatatgattgaagcgtttgaaaaagttttcaaaaaggcacaagtgctgcctaataaaatgtacagcgacagtggcctagaattccaagccaaacgaatgaatgagtactggcgttcaaaagatatcattaaacatgtaatgtacagccctcatctgcatgcaggtgttgtggagagagcaaatcgcacaattaaggaaagactttaccgttattttagcgaaaaaaacacacacagatgggtagacattattgataaaatagttaaaaacctgaacaatttagtgaaccgtacaacaggaatgcgtcctgttgatgtgaattttcgtaatgcaacagagctgagaaatcgtctatataaagacgtggaacaacaaaagcgaattccaaaattcaaaattgatgatatcgtaagaattaccaaagagaagggagacttctccaaaggatattttccaaattttactgacgaattattcaaaattgttcgggtaaacccgaccaatcctccgtcataccgaatcagtgatttagaaggtgaaaatataaaaggtattttttacgatcaggaactggtaaagactgttgctgctgaacagacaactcatcgagcagaaattttgaaatccagggtacgaaacggtgttaagcaacattttgttcgttag

SEQ ID NO: 74184 - DNA, 551 bp, Heterodera glycines
  Genomic contig location: Contig_ID=SeqID_10905; Location=139..689; Strand=-
  SCN-specific regions: Sequence locations=1-94,325-481,513-551
atgacttggcacggcgtcatattttgtgtggttccgttgaatatcagttccatttcaattgcacctcttttgttttttactaggtaaaaatcgcataaaaatgaattttaatatttggaatttaattattcttataatgaaaaataattttatttttttttaattaaaagaaataattaattaattaaaaattgatgatagacagaaatgttattaataatttttcttttaaacaataatttaaattaaaataaccaactaaaaaattaaaaggccttattaatttatttaattactttattttattaattataatattaaaatgccaatttttagcactgaatatcacaatgcttttacaaaagaatgggcacgattacgtgctttgttcgtcgggcttcaaccgtcaaacacaatttttgcaacaactgttgagattttctaaatgtgttgatgagttattttaaaaagcgataagacgaaaattatttatcatatttatttatttataacaatttgtggtttttcaataattggtttaagccaataaa

SEQ ID NO: 74185 - DNA, 846 bp, Heterodera glycines
  Genomic contig location: Contig_ID=SeqID_10905; Location=1213..2058; Strand=-
  SCN-specific regions: Sequence locations=1-37,86-330,352-377,402 -470,494-507,529-533,581-753,775-817
atgcatttttctgaagctaatccaataatatttgcggtaatttttcaaaaaaatgaaattaatattatttaaatttcaatttttagctatttttgcaatataaggatgaacagccgtgttggccaatcataagctgcgcattgttgctgagcataattgcattttttggtttgatattcaatacggcactcatttacgtcacagtacgagcgcggtataaataaaaccgggaaaatattttataattcaataatgattatgcgtaattaggcacttaattagaaacagccaattattatttaattgctcagatcttagccctgaaaaatgttgttgaattaaaaataaattgaaatcataataattcgaaaatttccaattaaaaaataatattataaattcactgaaccatcttttagaaatattatttaaatttattcgaagttaattttcgataatttgacaattaatttatgtgaaattttgtttaatttgttaattttgtatgaaatttcttgtttttatgttcttgcatttattataaaatatttttcaaaataaaaattattttttaattttagaacattaattagcccgacaaatcgtttattggcatttaatgcggccctcgaaattgcgcatcaatcatcgtatttcacatttttgttcctcagtttgaccggccaaacattcattgactataaaatggccgtcaaaattggcacactttcaatcattggttataatgtgtgattcctgcaatgctttgtactgcaattgatcgcctcttttgcgtcatattcccttatttgtaaccaaattttttaattaattaatataaataaa

SEQ ID NO: 74186 - DNA, 547 bp, Heterodera glycines
  Genomic contig location: Contig_ID=SeqID_10905; Location=2429..2975; Strand=-
  SCN-specific regions: Sequence locations=1-283,305-310,332-336,363 -364,410-547
atgtcaaaagaatataagcaaaaaagaaaatattcgccaaaagaatggaagcaaaattatgccgaaatttgtaagaaaattggagttggcattgggacaattgaaaattggaagagaaaatttggcatttgcaataaattaacaaagaatgaaaaattggaaaaaataaaaatttatctgcaaattaaaagcgaaaatccaaaaatgagtgacaaggaaattgcaaaaacattgaaaattgatagaaagagcatttcaagatggaagaaccaatttggagaagaaatattggagaatttaaatgaatgattaaaagaaaattggataaatttgccgtgaaattttatttgaaaaactgtttatcaaaatttgtatttatattaaaaaatatatatatatatatattttacagtccggttgcaaaagtaatgcatcaaaatgtttaatcgaccaaaactcaattttaagtttagataaaattctaaaacaatttctgctaagctaacttttgattctgatcaaaaaaagtctttaattaaataataaa

SEQ ID NO: 74187 - DNA, 362 bp, Heterodera glycines
  Genomic contig location: Contig_ID=SeqID_10906; Location=91..452; Strand=-
  SCN-specific regions: Sequence locations=1-26,97-162,185-362
atgcaagaagtgatcggaacggtaggaattttttttattaaattttaattaaacattaattgaataattattgtattaaatcatattttttaaattgaagtttttttttgctatttcctcaaattcttcaggccattgcctttgccctgctctccaacggacggtgtttaaattccattcttttccttttgaactttccctcttccaagaattcccctctttgctggcgttctgatcaccatggtggatacgttcacttttctgctgatcgatcgctacggctttcgcaaattggagttcattttcgccgttctgatcagcacaatggccatcacttttggctttgaagtgaggcaattaaa

SEQ ID NO: 74188 - DNA, 947 bp, Heterodera glycines
  Genomic contig location: Contig_ID=SeqID_10908; Location=156..1102; Strand=+
  SCN-specific regions: Sequence locations=1-156,178-542,569-640,662 -717,748-947
aaattaccaactaattttgcaatgacatacagtcaattaaaagcaaatttaaaccgtttgcgatcaaaacccgatttactggaattgtatcacaaaacaattttggatcaggtcaatgatcagggatctgttgaaaaaaccgatcggttactggatccaaacaaaaggggcaaaaaatacattacttacctcatcatgcggtagtgaaagaaaccagtggacgtacaaaactaagaattgtttataatgctaatgcaaaaagtggtaataatccagcattaaatgagtgcatagaaaagggtgttaatgagtacaacgatttaacaagcattcaattatggagacgtttgaaaaatattttgattgggtctgatattgctaatgcttttcatcaaattgagttggcaccagaagacagatattgtgtacgttttttatgggttgaaaacccattcaatccttatagccctttagtgcattatcgatttaagcgagtaacttttggagttatttgtagcccagcccaattagcattaactattaaaatacatttagaaaaatatgaccatcctctcattaaacaattaatccaaaatatttacgttgataagttaatagtgagcattaccgacaaaaaggaatttaaaatagtttacaaaatgataaaacaaatattttgcgaagcaggtgtggatgtgagagaattcttgtcaaatgatttaaacaaaatacaaaaattacccaagtaagatcgtattgaaaaggaaactgtcaaattgtagggaatttggtggaatttccgagaagatgaatttattatcaaaatgccgaaatttgaaacgagtaacaaagttatcacaaattgctaagacatttgacccttgtgggattacagctccaattatattagctgcaaaacttttctgtcaagaaattgaaaatggaaa

SEQ ID NO: 74189 - DNA, 490 bp, Heterodera glycines
  Genomic contig location: Contig_ID=SeqID_10908; Location=1712..2201; Strand=+
  SCN-specific regions: Sequence locations=1-490
atggaatcgtctaagaaatacagtagcttatgtaattcgtgcatgggaaaaacaggaaaaagagcatctttagaaaagaacgaaaaagatcaaaaatttaagaaaaataattctgagggaaaaccaattaaagaattagttagtctaattcgacctttagaaatcagtgaaattgctaacgccgaaattttgattttaaaacaaactggtacaagaaaatcatccgcctacaaaatcactaataaaaagtttggatttgtttaaagatggcaatcaattatggcgtacaagaggaagaattttacaaagtggtctaaataaaatttggtcagaaattttcagagacgaaaaacgtgtcgaaatccaattgagagggttgtgtgatcaaattgggtgttctttgcgtccaattgatggagagagagtcccggtgaccaacgtcgtttggctgatagccgcgcacctgccaattctcactgatcagacccaa

SEQ ID NO: 74190 - DNA, 269 bp, Heterodera glycines
  Genomic contig location: Contig_ID=SeqID_10909; Location=317..585; Strand=+
  SCN-specific regions: Sequence locations=1-111,133-133
ctgccgacaaccgaccgccgcccgcgggatggtacaacggacgccatcacggaaaccacgagggatggcattggcacaacggcggaagacgatgagacagaggcactcacattaaaaaatggatttcattttgttaaataatatctactttataaattaataatttttacaaaaaaataagtttatcacaatttaaattctttatttttttaattatgtcatattttatatggagaaatgaattaatttttatttattattttaaaata

SEQ ID NO: 74191 - DNA, 814 bp, Heterodera glycines
  Genomic contig location: Contig_ID=SeqID_10911; Location=67..880; Strand=+
  SCN-specific regions: Sequence locations=1-21,43-183,215-391,413-770
attttgtgcacaattttcgtgaattaattttcaccaagaaattttacaatagtgaaaaacttgtgctcagaccgccccaaattgacgcattttgggtgcattttacgcgtcattataaggggagggacaaaccggtgcaattgtccactgattacctgaccattttgcatctttcaaaggatgtaattaaaataattttgaattattaaaaaaagatggaattttctttatgacagatcgaagcaaattcaacaaaaggatacaatgacaaattgctaacacaatttgatggacaattgggcaacggaagtgcttttctgaacgactcgaagataataaaggtacagaaatgataaccaaaaacccaaacggaatggaaaattatgaatacaatataaaaaatttatttaatgttagccaattaaaattacaaaataccacttagataattgaccgcatgccgaaaaggttttattattttggcgccattcggcactgttcccgcttcatcaacaattatccaaatggcatttttactattccttcgccgtgcctttcatacaaactgtgcgatttgccgaaggcaaaagtggagtgtaccgtaaccaaaagcaaatattacagaagcacgattatgccaacaaaaatttacagggtaattagtgggaaatgattagttagttattgcgcatcattaaaacattcaggttcacgttttaaagaggaccatttttgtgaagaggaaaggcggatgctttgccagaaaactgatattttaactttattaaaatgtatttttttacaaaaaaaaaaa

SEQ ID NO: 74192 - DNA, 686 bp, Heterodera glycines
  Genomic contig location: Contig_ID=SeqID_10912; Location=187..872; Strand=-
  SCN-specific regions: Sequence locations=1-48,136-434,536-686
ccaccgtatgctcttccaccgtatccctcttccccatcgctgatgtgccttcttctctccctcctcctcctcttcctttccccattcatttctcttcctctcttcgtccctttttccctcgcccttccgtccccccaaaagcgttgtccctcccctctcttccgtcagtcgcgaagttcgcctccgcccaacggcacatcgcctcactattcaactccaattcacttcttcgccatcactcaggtcattttgattggcaaattttgaaatttaactaacaaaaagggcactcaaagcaaaggcacacaattcattttgattattttgatcaaaatgcaattagaattgccaatttgaaattgcccatcatttaggattgccaattcgttctcgctcgtcccgaccaacttggccaagtcagtcagtcccactattctcttctctttctctctccaattctctctaaatttcattgtctctgattgtctgtctgtccgtctcagttgccctctctctccgtctcttcgtccgtctccgattgtgcgccctcgcgaattaatttgctgtggtctttgaactcgcccgtcccctctctgctgctgctccaacaaagggcccacaaactttgccttctcccaatcgaagtgccattttcggtgatcgctcacagcacggaactgttcagg

SEQ ID NO: 74193 - DNA, 1151 bp, Heterodera glycines
  Genomic contig location: Contig_ID=SeqID_10913; Location=1621..2771; Strand=+
  SCN-specific regions: Sequence locations=1-31,60-93,122-691,714 -925,953-1151
atgattgctcaatctgtgccgaacattggccattattatgatgaagaggaagtgatggaagacgaggaggaatattcatacgaagagattgacgaagaggaggaggaagaagaagaagaagtggagaaggaagagaagcgaacagtcgccgcaagggcactgccagcggcgcaattggcggaggacggcggacagaacggcactgcccaaggcaatgaaattggagggcaaattcagtggcgagacaagggactgtctgcactaattgcattggaactgatcatttggcactttctgatcagttgggactgaccaattggaactgtctgcactgatcactttcccatttttgtttctgttttgtcaccgattttccccaaagtgttacaccacccaatgtgaatttgcataaatttgtccgcatttcgcctattttgacgcaatgtcccgccggtgacttagttcactgtcccgaccgacggattgcaaactcttccggcaaaagtctgtcccaaaaatttaagtgtttggtttttctgtccgttgcccgtcaaaatcgatcatttgggcaggaaattaacttttctgttgataaagaagcactttggcagccaaaataatcactcaaatgagaatgaatacaaaaacggaactcaactcactccgtcgccatcggcgaattataaattaaaagaaggaaaacgaacaaaaaacaacggatcaaacgaatgattgatctctcaccacagccactttccctcgaaaaaacagaacacaaccccctcctttaaacctaagcctcattaagttcatacctcattaatgtcttttttatcattccaattcccctcccttccctgtctgatcagtctcaccctaacgatcactttgtcagtttggctccctaaatccgatcagtaggttagctttctccctcctcctctctctcccccaattgttcgtttggtcattcggccattcattttcattttttgggtaccataaattctgggctggtcaatcacagcctttattatgagaggggaggaaactgttgactttgtaccccgattagtcattcatcattttccgatcagtgcgcaattaattaatttactccccccgcacctttgacaattccacccccgcaa

SEQ ID NO: 74194 - DNA, 833 bp, Heterodera glycines
  Genomic contig location: Contig_ID=SeqID_10914; Location=2416..3248; Strand=+
  SCN-specific regions: Sequence locations=1-43,66-277,299-668
aagataaaagagatggaagccgccaaaaaacaaattgaagtagaagaaagtgctgaagaagaaggacgaattttaaaagaaaaggcacggaaaacggaagagcagaaaagagggcaaaaagctaagaaagacggggagaaatggggaagaacggaagaagaggggccaaagcgtgatggcaagcactgcctaatgagatcgtatgtggcatattataattacccgagggagggaagtgatcaatcgatggaatgccctgaggaggcgagaaaaagagaggaaaatttaaaaatgaaaacggtcgaagagcgagaccatgccttccggtcatttgtgaatgccgacacttcactcgacgggagagcgaaagtcgggcaacgcttcgctcgaaatttgttggccccggtggagagggatatcatccggaacccgggaattcccccagaaggacggggattttgccaaagtgccacaggttggcagggactccctcatcccgaaggacggaacaattggcacgccacggggtggcagggatcgagaaagagggcctggaatatgagccctattcggtcaagtccggtgggcgcaacgatggaagaaaagatcgaacgtgtgcgctcacttttatttgaatgtacgcacacattgagagacgtagtcgatgaaatgaacgcaaaaaagaagaaagaggaagagatgaacaaagagagaacgagagaaacagacgaaggaagagagcacggaaagaaagagggcagtgagaagagtgagggaacgaaagacaaatgaagagaaagaacagaggacgaaggaagggaacaacaaaaaaa

SEQ ID NO: 74195 - DNA, 80 bp, Heterodera glycines
  Genomic contig location: Contig_ID=SeqID_10914; Location=3526..3605; Strand=+
  SCN-specific regions: Sequence locations=1-80
caatactcaccaatcacggcggacggcacaacaaagcacggcacaatcaaaattccaaacaccaaaacaacggacgtcag

SEQ ID NO: 74196 - DNA, 642 bp, Heterodera glycines
  Genomic contig location: Contig_ID=SeqID_10914; Location=4380..5021; Strand=+
  SCN-specific regions: Sequence locations=1-178,203-234,256-293,315 -383,422-430,452-642
atggtttttagtgacatagaactaacgtttgtcacggcggacgctgttcgtttggtccaagacaaaaaagtttggactgtcattggtacagacgggtgggttaccaaaaaacgaaaatgaattaaacgaattttctacagaaatgattttctcaacattaaattttgggaaaaaaatctggaacgtttgattcgtgacattggcactgatttcaaagtttaattattttgggaaataaaaatcttgatcttgcttaaggaaccgagcaatgaagaaaaagccttttttacatttttgagccacaagttttccatcgccggtgatttcagcccaataccaattaaaaaaattcggaaaggagaaaattttgtgtaattaaagccatttaaaataatattaaaaaattaaataatattaatatgttagtgcattgttattaaaacattttgttattccatttagcgatgttgaagctgaattatgcaatgtcagacaattacgtgtagtccctgttcaagggaacgaatcacgggttttggatgttttggttatttaagaaaaaaccaacacaaaaataactgcatggaatattttggcggtttttttgaattttttattgagtggcaaagaagtagaaaagca

SEQ ID NO: 74197 - DNA, 1263 bp, Heterodera glycines
  Genomic contig location: Contig_ID=SeqID_14; Location=798..2060; Strand=+
  SCN-specific regions: Sequence locations=1-9,31-85,107-274,322 -359,394-601,623-647,669-783,827-853,894-969,1009-1080,1134-1220,1251- 1263
atgtttaacaaatgtgatttaataaatgaaaacatacattttctggtaggttttacgattgtacctaaagtactggaatgcacatttaccggttttgttttacaactttgattttgtgcgggaaatgcacattttccgttttgaacttaaattttagtttttttttcggttacgtttttttttgtattttcaacaataattttactccgattgcgttttttttgtaaattaaatttttttaacgttttttcgaaatttcattatgaattactacttttttaacaaaataaattatttttaaaaaattttattgaaaaatttctatgtttgaattatgctcagatgccgccgtcaagcagataaaatattttttgtaaattatttaaattttttcatacgagggttggcgaagaattccctttttttgtcagccagcgccagactaaaatttttgaaattttcctgcattttgtgcgtttcgttgtaatgtgccttcacttttgcctgccattaacaggtaccattgagctgtttgaggagttaactgtgtgcaagacgggtgatcaactgtccgcggaccaggcccgcattaattttaataagtatgccatttattttaaaactcaagaatgataattaaacattcaaaatgagaaaatacttaatctaaattgaaggtcagtaaaaaataattgaactcaaataaatcgttcattgtttttgccattggtttaagtcaattttaattcaccagacaagtgcatgaatttaaactgcttctgcataaatataaaactattagaaaagttgaaaaagaaacatgattcaatcaaaattaagaaatgaaggtcagtaaaaaatataattaaatataaaagaaaaaaataaataaagcaattcatttttcaatgaaattgattaagctcacgaaatgggttaagaaaaatattgttaaaattttacaagttcatttaaatttatatttatattatgtaataaatataaaaacgaaaaattaaacctaaagaatcggcctgaaaatttacataaaaatgcagctctatgaaatgaaaagttttctaaaatttattattttattttcttgacaagaaataattttatttttttaattacagccccctttcttcgggattcaggaggttgtactaaaccttgaaattgtgagctacgattgaatagaaaatgtaatttggatttgcaatttttattttttattaaatgttttttaagtcaattttttca

SEQ ID NO: 74198 - DNA, 5289 bp, Heterodera glycines
  Genomic contig location: Contig_ID=SeqID_15; Location=189..5477; Strand=-
  SCN-specific regions: Sequence locations=1-3,25-2805,2827-2975,3001 -3635,3657-3911,3933-4292,4315-4538,4562-5261,5283-5289
atgccttcaaataaacgaaatttgagagcgaaaaggcaagagcggtaccagcggcagatggagcaatctgtcagcccagatcgctcacccgtcccagacggaagtgcagatgagaatggggtggcatcacacccgggcaccaccacgcccaatattggtgctttgcaattaagcaccccggcctcttccattggaagtaaaagacggagtatgcctccgaaagccggagcggagccattcagggcttcgcaaaacagtgtgtcatccgttggcacacaaattgcatcggccactcaaaatgatgagtcatcgcctcgcaacaaaaaagggaagatcgacgattttgatcgacccatatctgctcttgaggcaattgctttgacaccggtttccacgcaaaggagtggagggcggccggctaagaaaagaggtggcccaggcaggggcaaagctaatgattccatgggcgaaagctcttcaatggatcagagctctgaagctggcataaatgcggcggttttgcccaatgtgcctgaaaaaataaatttcagcacagtgcaaattaatttcgcaaccacgcggaatttagcctgtaaaatttggaaatggggagcaactgctctttacgaatgcgatgcaagaaggtcaggcccaagattcattgaaacgtgctggaatgatctggcacagtttctgaatgacgcctttattgtcgaatatttggcatacttggcaagcatatcacagcgaaaagtggtcgttgttgatccagctgtgtggcaaatgggcattgaccgtgtcattgaatataaaaatatgacatttgggtatgaccccaatgtcccggcagaagtcatacttttgccattgcatttccctggacattggactctcattgtccatgatgttcagtgcggtactcattttgccgactctttgcctaccccatatggcagattggatgtgcaactgacggacaaaattataaagatcatttctgacattttgccgtcaacagtgttgaccgggatttttaatgccgtaaatctgacggtccaacacgatggaaatagctgcgggtactttgtgtgcctgtatgctgaatcctggcttatgaacaaccgcacatttgttctgccagatttatccatcaattatgaaaaaaagcgcattttgtggcacatcaatgagctgtatggctctgataatgtgccataccatccgagggagggggtaccaactccttgcccaattgtctatctacatgcggatgaggtgcagtcgacatccaaggccgctgagccaatggaattagatgagccggatgacataatgatcatcgaaccacagacaagtggaaaggcagctaatgcaattctcacccaatgccaagtggcaggtgaaaaccaagctgacacgcttggtttggtgtcggaatcttgcgttccgcaagagccaattgcgcaggctgacgatgcaatatttgtcagacctaagacgcctccaaggcgatcagtgcgcataggtagacggcaatcagcttcgattagccgttcttcttcacctgcaccgaagcgtcgcacatcggaaaatgtacctggacaagttacaccgctcactaaacggtgtcaccttgtgcacaagggttggtgctgtgctgccgcagcagcaaagcattatccagaatacacagattctggtaggcttggcgaaaaaaagtgctctcattgtggagcactactcttcccgcatgagaacagcagcctttgctgtcgacagggaagagttgttttaccaaagcttaacccacatccaaaagagcttgcaaagctccttgtggacgaaaaccaatcccgtgaagggaaggagtttgtgcgacatatgtcgcgttacaacaatttgctccaatttgcgagtgtttcggctggcaataagccatgtccggcaggcggaccaatggcagtaattctcaatggagagttccatcgccgcataagcagtatgcaggctggcacaacccagattcctggcttcggtcagttgtacattctggacccagtcgaagccatggagcaacgacggaaaaatcccacattcacgggtgaaaaaatcacaaacgaagaagagtttgtgcaaggtcatcaacttaatgataagacccttgagatcttggagcaaatgatccaagcgcatcatcctgctgcgcaagcatataagcaggcgcatgagcagctcactgagcttctccaacaacaaaatcaggaagagcttcgtttcttccgtatgactttgttgaatgagcgcagagctccagctggcctcaaagacccaaaattgcacccacaccaaataatcaccccttctacgggtgaagggatgttcgctattcatgcggaccctacgggtgcacctccgcccaaaggaatttgggtagagaacaaacaagggcaattaaatgaaattgctcctttcagtccgtggactgacagcctaacgtacccattaatcaaaccattgggagatgatggatacacaactggcattaaatatgctaagccatcatcgcgtaagcgaaaaggtgctcagaatgcatctggcctatttgactctgaagccgagtcagataatgagtcgtgcgagactcagtcaattgcatcatcagatgctgggtcagtcgcagactcagatgctgaatctgtagcttctgcttcatcagcgtatggacgcattgacaaatctaaaagatttatctcattgcgagattactgcaagtatcgtctcgccataagggacgaaaatgtggagttgaagtaccaccacattctttcatgtggtggaggacttggccaacgctggatccttgatcaggctgcaaaaattgattggcaagtcgccacatttttgcgcagaccagacatggacctgcggatcagcactccaaaaaatttgctgcagtatttggtcaaccaatacaacaggcagcaagcacggcaaaaccccaatgcccaacagaaaactgttgatgacattggcagtgttgttcggctgtccgagcacaacgtaaattctctccaatattggaagaaaatgtatgaggattgcaacaccgtttttgcacggtgccatgacgcgaaaaaggcgcgtctcttcatcacattcacgaacaacagggaatggcctgagttcaaagagaatatatataaaaatggtcaagtatttactgaccgttttgacatgtggatgcgtgtctggaccagcaacatcgccgagttccgagaagaactttatgagaaaaagttctttggaacaatccttggatatggtgaatccatggagttccaaggtcgaggaggcccacacgctcacattgttgcccaaactgacctggacgcagtaccacatgtcattcaggaatacatatgggcgcacattccatctttgcccgataaagatgacgacacgcccattgcgaaaattcatcgcgaaatccgcgaaacaatgcatatgcaactgcacagatgcagtgacagttggtgtggtcctagcgacccaatttacgggcggtgcaagaaggggttcccagccccttactcaaaatgtactgttttacgcccggataggcccgcgatgtatttccggccttcaccatctgatggtggtgcccaattagaggtaaacggcctaatatacgacaactcacatgtcgtgccgtataatccttatgttctgctgcgttaccgagtacaccataatgtactgtttgcatatggtaacaaagcgaatattaagtacgcactcaagtacccgtttaaagggccaggacattgttatgtcgagtgcaaagaagagtccggcaataaaatcggaattgacgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcatattggaaacaatggcaaaatgagtggaagaatgacccaaagtttaaggacattctttttgaaaaagtcccagagcagttccgatgggcaaaggacaaatgggtcctgtacaaaaggcagcaaataaaaaggccacctatcggccgaattgttcctgtacccccatcggacccggaaaggttcgcgctctattcacttatgcgtcactttcctggagatccagatcatcttaagatggttaatgggttgctttgtacctcattcactgaggctgcaataatgcatggtcttcttgaagacggcaaaatttgggacaaaactctggcggaggcagctctgtcgcgctggccagatcagatgagatggctttttgtgagcatcatggtctatggccagccgagtaatgccatagaattgtggaacaagtacaaagaccaaatgtacaatccgcaaggcattattactccggcacagcataaagcagcagagcttgaagccctagccgaccttgattggcggctgcacagctgctttaacttaagctgtgtgcattttggcctgccagacccgccaaactcaattgccaaaaatactgacgcggcaattgaagagtttttctttggcgatgatgatttgaatttgcctccagggcaaccaaatcttcgtccacagccaaatgcccctccgtcacttaacagcgaccaacagaaggtctttgatgctgttttgttggcaatacagtcgaaccctagggatccgactgtcccccgccgtttcttcatatacggcgatggaggtacaggaaagacattcctgtttggccaaattattaggcgcttgcgaaaggccccatacacctacaaagtgcttgccacggcatccactgggtgtgcagccattttgctgccatatgggaaaacagcccattccacgtttcgtctgggtagagaagtgtcattagacaagctcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggagggaaaacagtcattttcagcggtgacttcaaacagtcgctgccggtcgtgcctcatgaaggcttaaccgctcag

SEQ ID NO: 74199 - DNA, 734 bp, Heterodera glycines
  Genomic contig location: Contig_ID=SeqID_132; Location=409..1142; Strand=+
  SCN-specific regions: Sequence locations=1-734
  Gene Ontology: Mol. function=transporter activity; Cellular component= integral to membrane; Biological process=immune response
atgactctccagtggaccgtggttgcgttcattctttacgcagaaatagccacaattattgtgcttcttttgccatgggttcggccgacaatgtatttattgaaaatgttcaaaatacaaattcagtttaattttaggtggaaaaaagtgtttaacagtcgcgttgtgcacaaactcaaacagttttccaatgtttacgcctacgctttcatttttgtgctcattcttttgttcgttggtaagtttactccttttggctcaagtacagtttatgtgtccaatcttttttacatatttcagatgccacccgtgaggtgcgtaagtacagccacgtggacacgactagagagatggtgggacgagtggccgaggcggacgccgtcgttcacatgcgtctcttcaggtgactgattcattctcactttggcacggcagcaaatgttttccttttagagctcagcgaaacctttatttgagtggtttttctctgcttatggcactgtttgtgacggctttattaatttgaccactaataaactttcattatcaggattatcagtcgcatcgtcactttgctcgcccgttgtgcccacctcgaattggctgctgaggcggcgatgaaacaggcggaaggggcgggcaaagcggcgcaaactctgctcggaaaagtaaaattgaaacaaaaatggacggataatgacgaaaatttcgactggtttaggagggcgatgtga

SEQ ID NO: 74200 - DNA, 494 bp, Heterodera glycines
  Genomic contig location: Contig_ID=SeqID_141; Location=249..742; Strand=+
  SCN-specific regions: Sequence locations=1-8,31-178,202-235,259-494
atggtgcgcaaaaaacaaaagctaataactgacgattgtgctccaagcacttcaaatgatcagcgcacgaatgacgggttcaaagctcccggtcaaaaaagcggtcaattgattgaaacggttcaaagctccgtacaaaagcggtctgaaacaatacataattcgattgaattacaaagcaaagaaaaaagtacagaaagacgttgtttgaaaaggaaacgattgcaaatggaagaagttatagatttggatgatttgcctgatgaatttttctctcctagcatatcaaatgaaaaaattaaggaatacgatagaaatcgcaaaatatcccgctttcaaatgaatgaagaacagagaaaattagagagagagttgaatttaacagttgtgcaatctagacgatttttttatatctcagtgcttaactattgcctttttgtatgataactggtagatattgggagtgaaaaaaagtttgtttgtgactatttaca

SEQ ID NO: 74201 - DNA, 707 bp, Heterodera glycines
  Genomic contig location: Contig_ID=SeqID_133; Location=409..1115; Strand=-
  SCN-specific regions: Sequence locations=1-59,81-707
  Gene Ontology: Mol. function=CDP-diacylglycerol-inositol 3 -phosphatidyltransferase activity; Cellular component=endoplasmic reticulum; Biological process=signal transduction
ttccggttctcgctttggtgctatgttggaccaactcactgatcgcctcacttttcttggtgttctgatgaccctttgccattactacccaacaaaaatgctcttctttcaatttgttgcttttttgttcgtttttacaattttaatattttcaatacaatcagggtcatttcttttagcattacccttttttaaaaagccgtttacacctttggatatgttttaggatctccaacaaaataaaaaatttgaggtgctaattatatgaccatggctgttattagcctattcgataattattaatttattcaattcagagacatcgccgcacattggatgcatctccacgccactgatctaaccggaaaagagacgcacaaagggtcgaagaatcccattttgaacgtttattatacatcgaagtcagttgaccggtagattacgttcgtttgttatccatttccttcaggacatgtttgttttggatgtgctttggcaacgagttattctacggattgctatttgtcaaccatttttgggctggccctgggcttttaggaattcattttgtgcctctgttggcctgcgttgtctgcccggtcgcccttgctaagtcagcgatcaatgtgcttcatttagtgacggctagtcaaactgtggctgaacacgatcgagaaaaacgcggctatttggtgcaacagtcggta

SEQ ID NO: 74202 - DNA, 3118 bp, Heterodera glycines
  Genomic contig location: Contig_ID=SeqID_134; Location=1178..4295; Strand=-
  SCN-specific regions: Sequence locations=1-946,969-1681,1737 -2111,2133-2149,2172-2339,2377-2602,2626-2752,2774-2923,2946 -2975,3001-3118
atgagcgctaattctgttcctcactctcgcgggtggtcgctcaatagccgaacattggccattgccactgccttgggtttaggcagtgcgcttatttattgggtgtgttttctttttccttctgttttcttattttataatttttagttttaccgttgtcggaaccgaaacgattgtgagcagaaatcggtgtccattctccaaaaggctgaaaagaagaaagcccagggtgttgaagcatatcggcgcaaagactttaaggaggcaattcgtttgtttggcgatgccattgacgaactgcgaaaagtcggcaaggaatttagcgaccaagtggatgaagcgaaaatcggagaacttatgtctttgtgcgagaacaacaatggtgggttaaaaggcttaatgtatcaaattttttatttttttggggcgctgcaattagcccaatcgataatactggagaatctgtgctccacaaaaaatattctgttatatgttatgtcagatttgcaagagtagcaatctttattagccaaacaatgatacgacataaacattgagatgatcatagaacaatcgtacaaaacataaataatctgatttactagccaaacaatgatttttatggagctcagattctccagtattaccgcctaattaaatcaaatttttttattgaatcgtttgagcttcttaacctatgccgtttagctgcctgcttcgacgagttggttggttgacttgcacttttaaatggatcaaaacgcgacgatcattaattctccgcatagggaaacactgaaaaatgtttggaccattgcaatttggcacttcaaattaaaccgaactacgaaaaagcgatgagacgtcgcgcgagaacgcacttcaaattgggacaaaatgataaggcaattaatggtcagtgtgaattgggcgacttttgtttgcatttccaataaaacttcctcatttaattggaatttcagactatcttgacttgaccttcatggaaaatgtaagcaaagaaagccggaacacttaccatgttgagcttgaccgtgtcgctgaggccaccatcagcccattgctcaatgaaatcattcaggtgacggacagagtttccactaatattcttctgcttattttaaggataagattgggaaacccatgaaaattccacaaatgatggtctgtgaatggatgattagtactgtgaccaacgacccgttgttggcgagaatgaacaaattgacgaacgatttaaatgaggataaaactcgatggattagtgctttggacgatgctttgttgacgctcaaacgaggagaatacgagtgagttattattgtaagcatttgtattcaaaaaacacctcctttcacttttcacagtgaaattgcttctttggcttttgcaattgtgaatgacgaaactcatgaaattgtggaccgtatattggcagtgcttttggcggcgcgtttcttgttctatcaaacgctgaaacaacaagcaatggaaacgatgcaaaaatttgagcatttttgggacaaacttggtgaactcgactttaaattttttttgtatttcgtcgtcttgcagacgaagcgcagaaattggcgcacaaggatatccatgttgcacacataactttacaggtccgtaaaggattttcccttctgaaatgaaataattatttttgagaaaaattataaataaaaaaaatatatctattaataaatggagcctcgcctatttgtccattttgattttttgttgtttatcgatgtttatacattcagttttttaggtgactttgactgatttggtcgagagcgaatcgttgagcaatgaggagaattacaaaattgatgagacagctaaacaacgctgccaccaattggttgaggagggacttcgaataaaccctaaaaatgtcgacccactggtaaattttgaaaaacctaatctctctaaatcactttccgcatattttcggtcacttttggtgttcaacttattcattatgatcaacatgagaattccttagtcatttttcaacgtgctaaaaaacttgatcagaagaatccattcattcggtgcgttttgcttttcacttacaattggtgtcctacaaaaataggggattcgttcgcaaaggaatgaaattcttttgattcaaatgcatttcttcttttatagttattacgaaatcaatgccagcctttcaattgccattcgtcagcaaacttttcttgacattcaaaatcagatgtttatgctacaacaaattttgacggattcggaaaatgttccgatttttgcgtttatatttctctctaaggtattttttaatatattaacaaattaaagaatatttaagttcgcaatgcttttgcacaacaatcaaatcgtgctcgaagcgtgcaaaaaaacgcttgagaagatgcccaattgcgcctacgctatttatctcttggggtaatttcctaagaatcggcattttatttaaaatttattcatgtacagccagttaacataaagggtagggaaatgaaaaattgtttcctttttttgcgcgagtcggctttaccctcccccagccgaattcctgggaccgtccctgccccctcccctcggtttctcaagaaaatcccatgaaattcgtttacaattagtgaattttttccctttttatttatgttttcctgaaaatttattacgaaatatgtctttgaccccctccccactcggatttttctctatttcatgaatgtttaatttctttagcctcgtggatatgtcagaccgcttggatttatcacaagtcgtgcagagtatggaaaatgcaatgcgaaaagcaattgaggcggacccgaattattgggagccgtacagaataatgggcaaaatatgcggagaaaagtaaattacaaaaacattttattttagtaaataatacataacggttctaacctaaaattgttatttttgtgggtttttgttaaatatcaaaccgatcaaaacttggcaaaattctagcaaaaaataatcaacattttgatctaaaacattaggagtcgagtcagacgaccgacccaagttgattcaaataaccaataaa

SEQ ID NO: 74203 - DNA, 362 bp, Heterodera glycines
  Genomic contig location: Contig_ID=SeqID_134; Location=51..412; Strand=-
  SCN-specific regions: Sequence locations=1-362
atggctgaaaggtgcgttctttcttggggtattggaattgttttgcgtttgttttagcgtcggaatcaaacgctgtgcgcctttgggtttgcgtgagggttctgtcgacaatgagactgtacgtcttccgccctatgactttgtgcccgtcagcgttggttgtcctccgcccgtccgtccgagtgatgagaatgtttttttgttctacccaaacctgctcggttatgtgcgtattttgctcgcttttggcgctctttttgcgatgtcttacgaggaaaagccatggagcgccgcactgctatacttcgctagtgcacttttagatgcttttgacggatatttggcccggaaatttaaccaaa

SEQ ID NO: 74204 - DNA, 229 bp, Heterodera glycines
  Genomic contig location: Contig_ID=SeqID_134; Location=4400..4628; Strand=-
  SCN-specific regions: Sequence locations=1-229
agcaccatcgcccgacgccgcccaagtgcaaagcgatgagcgattttctgcctttttcgtggacagtgcttttgccattgatcggacttcttcgcattacaaaggcggaaatttggcggacagacaagcgaaagaaaggcaaaagcgacgtcagcttaaaaacaatacagacgcagattagactctgttaacagatttgtcatcaattttcactgatttaaataaatac

SEQ ID NO: 74205 - DNA, 649 bp, Heterodera glycines
  Genomic contig location: Contig_ID=SeqID_136; Location=1278..1926; Strand=-
  SCN-specific regions: Sequence locations=1-75,97-214,266-417,443-649
ggaaccaacttttctactagtcagtatgaaacggcggatgttggtgttggaaatcagaaaagcatttgtttttttgttaatgctgatactcccactattcgttcgtatatgtcttcgtttcggagacatcaaaaagaggagactttgcgcaaggaatgggggaaaaagcgagagtcaattgttaaggtccaatacatatacatattttagcgctaataatatatattttgttttcaaagactttaaaatgtttctaaaagatcatttaaactattttcatatcaaaaatacaaaatccttgtagacattcctgaattttggactttttgttctaatttatgtctggatttagtaattggtcgaaatgtacgtgaaattcctgatcggctaccccggtctctggaaattgttttaaggatttaaaattttattttaaatattaggacaattttttgcgaaacaaaagatgtcctcttttatttatttttctaatttaccttttcgtttttaagttttataaaaaagaaaggaagtctgcactccgatatttaaagaaacgggcacaagaaaagcgataattttatcagaccgatttttgtccgtgtacatgttccatgcgaggtttaagaagccacgactaaattttata

SEQ ID NO: 74206 - DNA, 445 bp, Heterodera glycines
  Genomic contig location: Contig_ID=SeqID_137; Location=2330..2774; Strand=+
  SCN-specific regions: Sequence locations=1-370,392-445
atggtaaacagcggaatgttttacgacgaattgggcctgcgcgaatttactgtaaaaatcttacttctctatgtcttaaaacaattcctttttgaggttgccccaccaggaccggcactgaaaaacaaattggacaaatttgtggaccggaaattgaatgaatgtgtggcacgagtggagaaattagtgaataacaaaaaggttaaattgagtctaataaaacattaaattgtggatggtgcaaatgatttcaggacgaagtgaaagacctggccgagcatttggaggcaagcgacggttggcacttgaacgaggaacagatccatcaattcttcaaacgcagaaacgcaaatgcgtccccatgaagaagcaaaagaaatttatttcacataaacattacaaaaacaaaaaatttgtactttcttaacccttcccctgctgaaaa

SEQ ID NO: 74207 - DNA, 236 bp, Heterodera glycines
  Genomic contig location: Contig_ID=SeqID_137; Location=125..360; Strand=-
  SCN-specific regions: Sequence locations=1-2,24-155,182-236
atgaaggaacgaacagcaaaaaagaagcaaattgacgttgaagatgatagtcgttttatggatttggcgaaaaatccaatgttcagagagatgcgcaagaaggagcacaaggttcaaatcgatgacaaacacaaagttatcttttgattaagcccgtttatacaattcaaaatttattttaggaaccgtttagttttcttgcttcaattggtcgggtttatacaagtgatcacgag

SEQ ID NO: 74208 - DNA, 1415 bp, Heterodera glycines
  Genomic contig location: Contig_ID=SeqID_137; Location=3632..5046; Strand=-
  SCN-specific regions: Sequence locations=1-640,662-664,686-716,738 -1037,1066-1415
  Gene Ontology: Cellular component=nucleus; Biological process =reproduction
atggaggtgatgcgcggcatctcctgggacgaggtgtgcgaactgcgtaaaaagcaccgcaaacggggcgacgacttctacacgtccaatgtcgggttgaacggatgcgtaaagcacagcattgcgttcatcttcgggctgggcattgacaacgccaacgggtgaggaggcggggaatttttgacgaaatgaattatgcaacaatctgctactttgccgagatcgggacaggaattcatggttttttttaattccgggttttggaaatgaattgccggtcaatgcattccagtcccgccggtttagttctccttttcaattgcagtgatcaccacctcccggccggcttgggcatgtcgcgcatgtactgcatcaacaagccgaacaccggccgaagtccgcgctacgaaacgatggacgagttggcacagcggttcaccgcagtgcaaaacttggcacatgcagaaaagttgtggaaggagcagtttaacggtgagaacagggcaaggaaaaaggcgaatgatggggagaagcactatttttgatgggtcttaaaatttggggtcgaacattttcagttttcatgagtcttaaaatgacactcgctttccatattagaatttccgacccacaatgacatttaaaaatggatgttggcacttttcagcatgggagcaaatgtgccaccaccgtttcttttacggcaaatgttcaacggaggtgaaaggcactttctgtgagattggacgtcgcatgcgcacttattttgtgctgtccggctcactgatttgcatgtggcccgagctggagcaaattttgtccaccgacgggaagggcggcaagcgatcactccgtcgacggatgcaaattgtacgcgtgcggacggacagcaaacaacgcattgttggtgcgtatgagtggccatttttcgtataaaccagaattgggcttacaaatagacagtttgatcgctttacaaatacttttcaataattagataaacgtaagggtgtgcactacgttccccccccccccccaaaaaaaatttttttaaagaaattttttgagaatttttatggtcaattactaagatttttcaaaaaattattacttacactttaacctgcaataggaggggttcgcaaaaaataaatcatagccatcacaagattcaaatttcattgacgaaattgtttttaaatatatgggtagggagggcgcacggtgatggttttgtacgttctggggatggcgggtgcctgcttacaaaaaatttgttgcgccatggaattctactttttcaagtttggctcgacgccattcttggttgtaccatccgtgcaccaaatctcggccctcacgaactgttcttcatccaatgcaaacggagggccgaagcgacggcgggcaaatga

SEQ ID NO: 74209 - DNA, 87 bp, Heterodera glycines
  Genomic contig location: Contig_ID=SeqID_137; Location=3169..3255; Strand=-
  SCN-specific regions: Sequence locations=1-87
acaaatgacttaatcggtggagcaacaacagctgttccgaatgaacatgttcgccttccaacttgacgaggcggccgatgtgttcag

SEQ ID NO: 74210 - DNA, 85 bp, Heterodera glycines
  Genomic contig location: Contig_ID=SeqID_138; Location=2565..2649; Strand=+
  SCN-specific regions: Sequence locations=1-54,76-85
aacattatggaatttttgattggtgtttctcgaaattaccagatggatgcttagaattttatgaataaatttttgggatgttaaa

SEQ ID NO: 74211 - DNA, 2716 bp, Heterodera glycines
  Genomic contig location: Contig_ID=SeqID_138; Location=1..2716; Strand=-
  SCN-specific regions: Sequence locations=1-77,99-184,207-247,269 -474,497-504,526-765,787-919,941-996,1034-1076,1098-1421,1443 -2290,2312-2601,2623-2716
  Gene Ontology: Mol. function=GTP binding; Biological process=signal transduction
cgattgggcccctccgattgggccacaagggtctgtcacattttccattccatactgtcaaaaataatttaacatcccaaaaatttattcataaaattctaagcatccatctggtaatttcgagaaacaccaatcaaaaattccataatgttcgccttcggcacttcaattattttccatcgtgatattaatatattaaataataagctgaattaatgttattttagttaggcaatcaagaaatgggaaaatataaaaaattataaaacaaatatgaagccaaatatatttacaaatatgcaatgaaacacgcaaacaataacatttgacaatataactttttttattctgactccccctcccctcccttgtccatgtagtgactgctctatggggcccaatcgacggggcccaaccgacccggtccgaatacccatgggttgtctttttcaaaaaaaaaattctctgtaaaattttgtaaatttattgtcaatttttagaaaatttgtaaattttctcctttacattccccattatttttttaattctttacatttgtgcaatttttttcttttacactttttctttaaatttcctggtggcgtttaagaaaaagaaaatccaaggaattttgatttattttttgccacccccccccgcccttccaattttatgtcattttattgtcatttttcagaaaacgctgttggaaaaggaactcgaagcggtcggaattcggctcaacaaacggccgccaaacatttatttcaaaaagaaaaatgggggcggactgaaattcactcatacagtgccgttgacacattgccacgagaaactgatccaaacggtgctgcacgaatacaaaatttttcatacaaaatatttaaaaccaaaatgccaagcttttatttgtcctattaaatgaattgttttgaggccattaaggatttattcaaaggtatttagtgatgtttatgttaccatcattctattagtttttattctttgtttgtttttgtaaattttaaaaacaccttttacttccataaaatttaaatggcggtttggtgttgacatcccaaaaagagaaattctccatgtttcagcattgacgaactgatcgacgtgatccagggcaaccgggtgtacatcccctgcctacacatatacaacaaaattgaccaaataagcctcgaggaggtggaacgactcgcccggctgccgcacagcattgtgatcagttgcgagctgagcctgaacctggacgacatgttggagaaggtgtgtgcaaactgcacaaatgtcaccggactgcaattttctcccagtttttttgagaccgaaaatgataaacatgggctttttgttcggcattaaaggacaactgatcctcacattttttccatttgttaaatttccattattttctcctttaatcctttggttggtgtccagacatttgcgtcccggacatttgcggtcccagccaaatcggacatttgcggcccggacatttgccattccatccatttgaattgattttggaagataaatatgtttaagagatggcaggacgttgagcgacgcaacaattacattttcgacatctatcgaaagcaacaaaatgtgatgaaggaacccgagagcggagtgagttttatcctttcaataaattgcattttgttgaaccgaaattgaatcagatccaaaaattctgaagagaaaatgctcgaaaacatcaccgaagaggacatgcgcacctacctggaaggcgtcggcatgttgcagcagcagccgggcgggcgcggtttcgccttcgagcgcgacacagtgacaattcccaaattcctgaaccgcttgctcggcctgccggtctacgcgcagaacaaactgttccagtacttcagcgacatttgcgcggagctgatcaaagtggccaaagtggacggcactttcgacatgggcattttgggtgagtttttgaagtttttttccaaaaaaatgccaacattattttgtgccatagatatcggaatggacaatgatcgggtgcacaagaaagagtaccgtcagtttcgcggtgttggcaaaagtggtgactttgtggtggaaatgcacaaaatggtggtgatgcgcggcatctcctgggacgaggtgtgcgaactacgcaaaaagcacctcaaacggggcgacggcttctacacgtccaatatcgggctgaacgaatgcgtaaagcacagcattgcgttcatcttcgggctgggcattgacaacgccaacgggtgagggggcggggaatttttgacgaaacgaattatgcaactatctgctactttgccaagatcgggacaggaattcatgggtttttttttaattccgggtttcagggacggtcccaggattttggcttgggggggggcacctccccccgggcgacgacctttttttttttttgcttttcacacccgttttttatgtggcgcggtttttgcaaaaaaatttttggggtacagggggtccggcggtgccgataggcgccgccggaaaaatttttgcggttttaaatgcggtttgttaatagattttgtccaaaaaatgaccaaattttgtgattttgagccatttttagcagattttcattaaaaatttgtggattttttgaaagatttaacaacatttcttggaaaatttgagtgaggccagtatctgcggggtg

SEQ ID NO: 74212 - DNA, 1276 bp, Heterodera glycines
  Genomic contig location: Contig_ID=SeqID_139; Location=1..1276; Strand=-
  SCN-specific regions: Sequence locations=1-326,349-364,394-544,575 -728,750-1128,1150-1160,1182-1276
  Gene Ontology: Mol. function=GTP binding; Biological process=signal transduction
tttccagttgggaggagggggatgactcttccaaataaattagcccgaacgattgggtttttagccattctcccgtaaatttgacactgttcaattgcgttttgtcaggtccgccgtcctcggtcaggttttacgcctccatctgtcttctgctcgttggccatgcgttgcatgggcaccgactggcccttctccgccgtttgggccccgcttggctaggccgagtccgcgaacagttggccgactgccgagccatggacgaggcggacaaagcggcacaacagcagcagaatttcccatcctttggaaagtcaacgttcctttgaaccgtcacaacaacagaggcaatgttttttgtgaacgcttttgcagaaaatatattttttggttttacaaatcatgcttttaacaaattttaattttcgcttccaaattgttgtgtaaaattccggtattatagtttttgacttctttttgttttcagagtgttgctgcctcgtacgaattcaccactttgacatgtaatttcattttgggctaattcaatgtgaaatgtttcatttttcctgttattttaggcattcctggtgtgattgaggtaggcgtttattttgctgcaatttgtccacaaacgctttcgccagtacgaaggagcgaacatccaactgctcgatttgccgggtatcattgagggggcagcgcagggcaaaggtcagcagttgagaaccatttttaaaaaacaattttggcatttcttttcaggccgaggaggacaagtgatctccgtggcgaagactgccgacctcattctgatgatgttggacgctaccaagggggagatccaagtaaacacttggcttttttgtaccaatttgcatatgtcattcaacaagcccgtagccaggaaaaattttcggggggggggaaagagaggggtccggtccgaagacctttttttttcaaatttatccgtaattttttttcgctgaataaaattgataaaagttgtttacgatctgcaaataactgcaattttccacttgtagacttttctattgtttggtcgtcggcggcggctgcttaaaaaaaactttttcccgctactgggtaaaaactccactttttcactaaaaaaggacccaattttggccgttttacggaaaatttgagtgctatttgttacgaaaattgtctataaaatttttaaattttcgtttggggggggggaattcgaaaaaattttcttatttggctgaaaaattttttaaaaattttc

SEQ ID NO: 74213 - DNA, 686 bp, Heterodera glycines
  Genomic contig location: Contig_ID=SeqID_140; Location=325..1010; Strand=-
  SCN-specific regions: Sequence locations=1-686
atgagcgagaactttgatgtaggacgggggaacgtcccagaggttttttgattttttttcattttctacttaattggtatttccatgcattacaatttttgggaggacagggtgagctgtacccactcactttagccctctgcccacgtccccatggttacgccatagtttcttctactgggacccaattcagcaatggtttcaggcacgctaaatcgaatctgacagcttcgatcaatttcggaccccggacccgaatttgaaccaaaagtcgaagatctttttttcgtccaaatacggcttaaatacaggaaaacaaacttagggccatcatttcctgcgataaaaactatttttaagtcgtttttagatgaaaaatgcgaaattctagaatttaaattttcgactttttgttcaaattctgatccggggtatgagattgatcaaaaagtgtgtcaattcgtgtctaacttgcccgaaaaccaccatagaaagtgcttttagaatttttaaattttttttgaagtgttattgatcggctcccatccctgaactgtactttctcttaaaaaaaagtttttaatgtatgtgtaaatctgcaggctcgaactgaacaacccgttcccggtggaagtgccgctctcgaaggtgccagcgtagccggtaatcattttttcgttacctag

SEQ ID NO: 74214 - DNA, 573 bp, Heterodera glycines
  Genomic contig location: Contig_ID=SeqID_1522; Location=1246..1818; Strand=-
  SCN-specific regions: Sequence locations=1-263,290-433,532-573
atgcgcttttctggaagtttatattttcaacgaattgtaaaaattatttggttaaaaaaatttgtggcaagtttttctcgaacggtctgtaaattggcaattttacgaaatgcccatgttgacaattcttacgaaacgacctaacaaacacccttttgaatttgcctaaatttttgaaatttctattaccatatttggaatttttcagagaattcgtgaaaaaaattctaaaattttcccacggcagcgcctaaggtgtgaagaatttcaatttaaaaataaatttttcgtccacctttgtgagcatgaccattgtgttggagcccaactcccacacggttcgccacatttcgttggatgcctgcttggaccgtaccgattgggtaacgacataggctttctcgcgtatccaactctttaattgatcatttacataattaatttgtattttaaatttaaaatatttaaaaaaaaatttttttttttgaatatttaaaatttttaataataatttgattttaaacaaattaactgttttttggactgatttttaatggtgaagttttcattaaa

SEQ ID NO: 74215 - DNA, 2672 bp, Heterodera glycines; identical to SEQ ID NO: 1522
  misc_feature (2598)..(2598): n is a, c, g, or t
  misc_feature (2636)..(2636): n is a, c, g, or t
  Genomic contig location: Contig_ID=SeqID_1522; Location=1..2672; Strand=+
  SCN-specific regions: Sequence locations=1-120,149-626,648-892,915 -1008,1030-1065,1088-1124,1146-1287,1386-1529,1556-1862,1884 -2197,2234-2556,2578-2672
  Gene Ontology: Mol. function=protein tyrosine phosphatase activity; Cellular component=adherens junction; Biological process=neurogenesis

SEQ ID NO: 74216 - DNA, 885 bp, Heterodera glycines
  Genomic contig location: Contig_ID=SeqID_1523; Location=4173..5057; Strand=+
  SCN-specific regions: Sequence locations=1-314,336-356,539-885
atggtggaggtcgcagcggtgcctttctggcgctggatgccaatttggaactattgcagcgaacaggacagttggacgtgtacgagtacggcaggacgttggccaactcacggcaacatttgatcgacacggtggaccagtacatattcatctacgacggtgggcactgaatatgggctcagatcagttcaactgatccggaaagacgaattggttcctaaactcaattagtttgatcggattagtttctaaattcaatcagtccattatcatatttaatcacaaattttggtcgtcaaaaataagaccaaagaaaatcagcgatgagcttgatggaaattctatcgctaaaatcgaaatttaagaaataatattttttttccttttattatatttttattttaggtttaaaagaattttttaggtttctttctttttatttatttatttttttaagaatttaataaataaaagaaaatttaagtaaaatttatttactaagtttttttatttaaataaaacaaaaatttaaataaatcggtcagtccattatcatttaatcagaagagatcttggtcgccaaaaaaagaccaaagataatcagcgatgaatttgatggaaatttctatcgctaaatcgatcatgatgaagcctgttcaagaaatagtaaatcagaatggataccatctgctgagcttaatccaacagaaaagaccaattaaactgtttttttcagttttatgcgaggccgtcctctgcaacattcagcccattggcatgcatcagctgaagaaccgcagcggaatgtacaaagcgcgcaaagaccgcgagctgatggaggtgcaggacagccacgagaacaaggcgaacaccatgaaatattaa

SEQ ID NO: 74217 - DNA, 7010 bp, Heterodera glycines; identical to SEQ ID NO: 1524
  Genomic contig location: Contig_ID=SeqID_1524; Location=1..7010; Strand=+
  SCN-specific regions: Sequence locations=1-108,130-628,650-723,746 -765,787-854,889-896,919-1072,1097-1298,1327-1383,1405-1507,1580 -1694,1844-1865,1957-2472,2502-2953,3039-3139,3177-3197,3232 -3381,3403-3576,3598-3653,...
  SCN-specific regions: Sequence locations=...3675-3778,3801-4046,4088 -4467,4494-4706,4729-4986,5008-5022,5044-5503,5525-5586,5609 -5748,5789-5813,5839-5880,5902-6049,6071-6210,6250-6269,6295 -6300,6322-6632,6654-6707,...
  SCN-specific regions: Sequence locations=...6730-6734,6756-6761,6783 -6794,6824-7010
  Gene Ontology: Mol. function=transmembrane receptor protein tyrosine phosphatase activity; Cellular component=integral to membrane; Biological process=protein amino acid dephosphorylation

SEQ ID NO: 74218 - DNA, 87 bp, Heterodera glycines
  Genomic contig location: Contig_ID=SeqID_10915; Location=419..505; Strand=+
  SCN-specific regions: Sequence locations=1-87
atgttgaccgactaccgtatatgctctaattatagcccagtctctattaataccgcagtctccaattatcccctgtattctgaggag

SEQ ID NO: 74219 - DNA, 371 bp, Heterodera glycines
  Genomic contig location: Contig_ID=SeqID_10916; Location=1674..2044; Strand=-
  SCN-specific regions: Sequence locations=1-371
atggcagatcaatttgtacaacccgaaactgcggaggagcaacaagtgaaagctaagaagccacgcgttgatgagcgatttctttggaaaatcacgcggggccaatttgtactagcgattcggctgtgttcaggttaatcaaatttttcgaccaaattaattgacaactttcagaggactggaacaatttatttcacaacaaagacaagacacgtcggctggaagatgggcgagtggcgattggattcgagatgtgtgaagaatgtgccagaatcaattgctgtgtcagtgatatgattgccgatcaaaagaagaagccaaaaaccaccgaataattcatcaaatttttcgcattagttgtagccaataaa

SEQ ID NO: 74220 - DNA, 857 bp, Heterodera glycines
  Genomic contig location: Contig_ID=SeqID_10916; Location=2141..2997; Strand=+
  SCN-specific regions: Sequence locations=1-523,547-857
gtataaaagccccggcaatttgtcagctatgtctcatttgttctgctacaatggtccttgccatcgaattttgtgcccaaattctcggctgttcccctaaatcactccgcgacaagctcaatcatcccgaggaccgagtgaaggcactgaaggagctggtcggaaaaaaggttcggacgacatacaaggaccggaatggaatgcagaaaacattttttgtcgacggaatatcggacaagggagcggctttgaccccggcgtatggcagactcagacaaccgtacaacatcaacattgctgcccatttctacgctcgccaccgtatcaagctgcatctcccgtacgtgccatgtgttgtggagaaatactccgggagtggcgaagacagatactacccaatggagctactcgaaattgtggacgaggactacaccatcaaagagcgatggcttggcaaactgtttaccgaaattgaggaaattcctgtcaaacgccttggtcgagttgaggaagtcgaagaaattgacgacaacgatgatgatgatggtggtcgctacgaatgcagtcaaccgtcttacgtttattggtaaacacattaattttccttaattatgcacttttctacctaaaaacgacaaattcttttttaactttatttataaaaattgtatcttccactccttaataatttacaaattgtgtcttcttgctcttaattctgcacttttctacctaaaaatgacgttcccaattgcttaataatttacaaattgtatcttccattgcttaattctgcatgtattttaactccttaattatgtacttttctacctaaaaacgacaagttcgtgcacata

SEQ ID NO: 74221 - DNA, 381 bp, Heterodera glycines
  Genomic contig location: Contig_ID=SeqID_10918; Location=1063..1443; Strand=+
  SCN-specific regions: Sequence locations=1-34,56-381
atgtcagaagatggccaaattacattgggactcgacgtgttcgagtgctgtccaccaactgcccctccgttcccatggccatgggttcccgtgactattcgggccgagtctaaggactccaatgaaagagttgactgcgtgtccccctccacgttgtacatcctcaactcgtcgtatggccccgtgttcgggtcggtctccaagtcgttcacttgtgcattcagtccatcatctgttgaagaatgttgtgcagaattggtcgtcccgtcccttcttcgttccctaccaatttgcctccctcccctgggggtacactttggtggtgcccccgccgagtccgtttgtgtccaatggcatcaccggcttcctcaggttggatag

SEQ ID NO: 74222 - DNA, 469 bp, Heterodera glycines
  Genomic contig location: Contig_ID=SeqID_10918; Location=460..928; Strand=-
  SCN-specific regions: Sequence locations=1-6,164-239,340-381,403-469
ccattgtcctccatttttgatttctctctttctctcttcttgccatggctctctctttttcacccttttccctctttttactttctctgttttctcaattctcttttcgcgtctgtcttcttctctaactttctctcatattgctcactcttttcccttttttatcgccggaatttcttcaaaatctttcattaacattcattgaaacgccttcttcataacgtaaaatccttttgcttttcatttattatttatacatatatttttttatttaattttgaattttttcacttttttattttattaattttacattttttcattttatgatttatttgtccgatttgttgtcctttcccttttctgccaatcttcacacatttccattcattttgtctttttcattgcattttgtgcatttggttgtgtttgataagctaaagcttaaaaatgaataaagaaatatgct

SEQ ID NO: 74223 - DNA, 810 bp, Heterodera glycines
  Genomic contig location: Contig_ID=SeqID_10921; Location=163..972; Strand=+
  SCN-specific regions: Sequence locations=1-391,413-431,502-525,547 -550,572-597,620-770,792-810
atggcactccaccgcaaattcactttggccaatgccaatgccattgagacggacgcggaaaagagccgaccgaaagtgtgccaattgcgccaattggaaagcatagaaccgacgcattggaataaatgaaaaaaggataattaaaaatcgaatgcctaaaaattaaaacaaagaaaaaaggttggccttcgcttcggaatccatcccaacacgaccatttttcctttttttctctccccatttgggttttgaaaaagaaaggagccgtagggtcaagaactttgattggaattgaatgaccaaatttgcattttgagtcatttttacggctgtgccgccgttaaacgaattgttcagaaaaatgacaatttttctaaaattattcgataagaaaaataagcaaaacttagaaataagttcagttgtagccctaattatttttattttaagcttaaaagatttttcatttattggaatttttattttattaatagaatttttgtttttggtttagaagttatcattaagaaatttgagatcatttgaactataaatttcatttatttttaaaaatctctgatttattttagataaccgaaaatttggaaaaaattcaaaagattacttttgaagcaaaaaagttgcgaagaaagagggcatttttcaacagaaccagtcttatttatggtgctgcttttggggatttgtgtgaaaagacggagacaaacaaagatttatggcctttgtcataaatattttataaactgaaaatggccaaatatatttttattcgaaggtttttcttttaaa

SEQ ID NO: 74224 - DNA, 220 bp, Heterodera glycines
  Genomic contig location: Contig_ID=SeqID_10922; Location=85..304; Strand=+
  SCN-specific regions: Sequence locations=1-7,30-180,202-220
ataaccgaaaatttggaaaaaattcaaaagattacttttgaagcaaaaaagttgcgaagaaagagggcatttttcaacagaaccagtcttatttatggtgctgcttttggagatttgtgtgaaaagacggagacaaacaaagatttatggcctttgtcataaatattttataaactgaaaatggccaaatatatttttattcgaagttttttcttttaaa

SEQ ID NO: 74225 - DNA, 679 bp, Heterodera glycines
  Genomic contig location: Contig_ID=SeqID_10922; Location=759..1437; Strand=+
  SCN-specific regions: Sequence locations=1-156,179-206,228-465,511-679
atgtacctcaagttccacaatgtgtacccgtgttggaatttcatcattgccgcattggccataaatgcggtggcaatgttcggaatggtcagcaacttttccgtcatttgggtgacctataggacaaagtgggtattcgctttaaaatacataattcataaaaataaaatgactattcatttgctaattaatgaacaattactcaattgatcattctaaaatgccttttttaggactctccgcggcactgccaattttctgatcgctctttgctccttcttcgatatgcttcacgagcatggccatttgctgttcctttacactgcgctatctggccaaaatttccttcccatctcttctgcggttcgcttttgctccgtttccctttttggcgttggcggaattgccgtgtccattgccttcactgggctcgatcgtcttttgtgcgtcctctttccggcattgtaaattttaaactaatttaaattcattaatttatcaaatatttttcagtccaagacgagtgaaaccgttgccctatctcagtgcgatcactttgctctgtttggcttcttccgtctgcactttgattggttactacaaaaaaaacaatgaaacgccagagtttatggtcactggcacattctccgatttagtctcggttggcatttttttgtaa

SEQ ID NO: 74226 - DNA, 1791 bp, Heterodera glycines
  Genomic contig location: Contig_ID=SeqID_10924; Location=60..1850; Strand=-
  SCN-specific regions: Sequence locations=1-367,391-567,589-1791
atggaaccacgaaaacgctcctctaacttttccattgatcatattctctccgcgcccaaaaagccacgtcaaggcttcctgatcaatgaactcttgggtgtcgtacacttccttggatcggtgcagcaaggcgaaggaacatcaaaacaggcaaaggactacgttaaaaaattggagaacagcatcgagcacatggccaaattccattacgtcaaagtcaagtcaaagttcaccattacggatttgccgagcacgcctgaggcattgttggctgggattttccaacactgcatcgacgaagcaattgttgaaagccgtgagcgaaacatcgaacctacacacctcggctgtatgatcagcagtcctctgctggaaggcggagatatcccaatcccgatacgacaaatgacaaacaacactctcgacaccattctcaaccagttcaaaaaagtggcgcagtccaaacaacagaaaaatgtatcgttatggggtgagccgtttaccgtcaccatcacgactctcgaccgtaatggactgccatccaaacgtcgtgtcaatgggggagctcgtcgccctgtcaaaacggccgttcaccaccgaattaatgaccagtgcctgattaaaattcgcaataacgacaaccacttctgccttttctacgcgctgcaggcaacaatggtcgacaaaacatgcaattggcctcgctggaagtttttcgactatgtgaacgacagaaaaggacagcagggacaacttcatcatgatgcggttgagctcatgcagcaggttaatgcaccaatggacttggatgggtacgacgcggacacttttgtgcctcacgtcgttgaccattggaacaatacgcagcgacaacaccgctttgctgtgttcatctttggatcgttgggacagtataagccgctgtacaagtacattgacaacatctacgacactccgctgctgttgtacttcaatgaggaccatttcgatggtgtccagaagcagggtggtctgttcggcaaaccgtactgtttggagtgtgaacggccatacgacaaaatgtcaacacacaacaaaacatgtaaagcgcgctgtgtgctgtgctcacgtgttggaccagcttttccatgtccatcatccaccggcttcatcaaaaagtgtaaagagtgcaacaaaaaattcaccaacaacggctgctaccagcatcatctgcagtcaggctactgcaagcggtcgaaaaaatgcaaagattgtggtgctgtttgggatgtgcacgacaacactcagaagggcagaaaaggacatgtgtgtggtgaacgcttctgtaagatgtgcaacaactaccacaacaccgagcggggatgctacatccaacccattgagcccaaggaacgcgacccctaccgcatcgtggcatttgacttggaaaccatgcagcacacgccatctgtaaagcctgagaagcgtgagcatttgccgaatttcatcgcagcacgagtcgcttgccccgactgcattgaaaatgagagctggcgagaggcatcgggaggctgtgaagtgtgcggtccaagtcgtacagtcgccttttgtcaacgccgcttcactgaaacaacagtcaacaagcaagtggtggcggaaaacccattggaagcgtttgtcagctggctgataaacgacttgcctttggcctacgacacctatgccttctctcactttggcggccgcttcgatatggtgctggtgttccgcgaattgttcaaacgcggatataacccggacatgttgcgcaaa

SEQ ID NO: 74227 - DNA, 1349 bp, Heterodera glycines
  Genomic contig location: Contig_ID=SeqID_10925; Location=375..1723; Strand=+
  SCN-specific regions: Sequence locations=1-188,210-221,252-301,325 -453,478-763,804-1349
atgaaacgcaccaatttcaacaatgctcttccaatgagtgagaaaaagcccaaacttcgtcgacgcctgccggctgaattgaacagcgagctgatcagtttcgtgcctttgatctgcctatttgccaatgtgaagcggactccaattggtcctgtgtgctaccaattcgagtgttttcgtagtcgacgccaaaagaattttgaatatttggtaatttcccctttttttattttattacataaattattatagaagggtgttattgcattattcgatgtgatgtttgaggagaaaaggacaccgaagaagaagaaagtggggagactgcatctacaggaagaactgccgcatgacctcagccgaaatgagctcctgcactacctgtgctacggacgactgggaacgaatttgttcgagacttattttgtgatgagccaagcaacaaatgtaagcgaaaagttttaaatttttaataacaacacaaaatttttagtcaattgccattgggaatttgtttgggcttctgctcgattttgcaatgagctcaccaactccttggcacatgaagcgaccaatttgctgtggaattttcttccgtcaacatttgccgtggattctgcaacaaccgatgaacgtaatgctttctcatggcttttttccggaggtccgaagtgatggttttgaatttttttggctgttcaacccacacttgaaaaagtatgctgggtatgtccgaattctccctgagcttagtcaacctgacaatttgcattttttccttagcattttctaagcatttatttgatcattttattcatcattatcattacatacagatcggaatttgtcgatttttccattttctcaataaattgttgaaatgaatgaccttgtgacatatgatacacaaaaacaatacagtgtggggcacacgttgacactaattgggattgatagggacgtatattttttcttagacccatcggaaacttattcaggaatgatgacacaatgacagatggtattttttgggctaagctgtcataataaatcactggttcttccattcccttcgcataaattgcacaccaatgagaccctcccttgttatgtgggtcccggttcacaattagcgctgcgggatactgtagagtgaccggaggcggtaattgatcactggcgaagcagccccgaaagactcgcgcggtcccccggttttcgttcaagattgatgtgatttgcacgctgtccattcttcatccaaaaaatagagcaaagttgatggagaaccaggctgacaataagcatcaagtacaatgcaaacaccgcccagcaaacggcttgttgga

SEQ ID NO: 74228 - DNA, 303 bp, Heterodera glycines
  misc_feature (197)..(197): n is a, c, g, or t
  Genomic contig location: Contig_ID=SeqID_10925; Location=1..303; Strand=-
  SCN-specific regions: Sequence locations=1-159,181-303
attatggggagcaaaaatccaacgcagaattaaagtacaggctatagggaagctattcccgattttttcggtctccccataaatctgggcgcatcggttcggggggactgccccgaaaacaaaaaaatcgattttttcaagtgtccgtttggggtactcaaacatttatggggagcaaaaatccaacgcagaattanagtacaggctatagggaagctattcccgaaggattcggtctccccatacatctgggcgcaatcgggtcggggggactgccccgaaaacaaaaaaatcgattttttc

SEQ ID NO: 74229 - DNA, 383 bp, Heterodera glycines
  Genomic contig location: Contig_ID=SeqID_10927; Location=137..519; Strand=+
  SCN-specific regions: Sequence locations=1-37,60-383
atgaaccgacggtaaagaattttaaaagtcaaaattcatcatttatttaactaaactgttttccataatttcagttggatttgcaacgacgtttggatggacattttcccatcctttgaccgtcctcaacttggcctcaaaatggcattgctttcgccacgtttcaatgcgttggtggacaaacatttcaatggcaaaagcgaattgacaatttggagatcaattgaaattcacaagggcaaaggacctgaaccgaaactatctgtgtggatggatgacgaatctaacaatgttgtggaatttccattgcccgaccgtccgttgcccagcaaaattcgctttgattccattctgattaggtaagtaaaatcagagctatgaca

SEQ ID NO: 74230 - DNA, 787 bp, Heterodera glycines
  Genomic contig location: Contig_ID=SeqID_10927; Location=1163..1949; Strand=+
  SCN-specific regions: Sequence locations=1-787
atgccaatggtgccatttgaattgcttaacgaatggacaaaggaaaagctgacattgaccaaagcaaatgaattggacaacagttggataatgaagcgatgtaaaattattggggagtccgcggcggttcagcagcagaagaaagatgataattgggacaacaattgtaacaatgtgttcatttggcttgttgctggcactaattgcattgggtgagcaattaaaaaaagcatttgatttttatccgaatttgaattttgcgcttaatttaggccattgtctccgccaccggaagaagtggaagaacaaacgggacaaagcatcacaaaagggacgtcttctgctgacaatgagtgacggacaaacgaacaaaatcaatgagcagacgcagaagaaatgaatattaattgaaaatgaccggacgatcataattcatcagtgatcaagtgcattttatgaagaaaaacctctgaatttcggtaaataaatcggacgcataaaaatggcaaaaaatgtacgaaaacataacaacttagagctttaccaaattcatttttctgttcatgtgccgtcaatgccaatggtgccattcgaattggtgaacgaatggacaaaggaaaagctgacatttgccaaagcaaaggaattggacaacatttggataatgaaacgatgcaaaattattggggagaccgcggcggttcattgggaagacggaaattggggcaacaattggaacactgtgatcatttggcttgatagtgacactaattgcattgggtgagca

SEQ ID NO: 74231 - DNA, 450 bp, Heterodera glycines
  Genomic contig location: Contig_ID=SeqID_10928; Location=104..553; Strand=+
  SCN-specific regions: Sequence locations=1-450
atgccaatggtgccatttgaattggtaaacgaatggacaaaggaaaagctgacattggccaaagcaaatgaattggacaacatttggataatgaaacgatgcaaaattattggggagacagcggcggttgattggaaagacggaaatttggacaacaattgtaaccgtgtgttcatttggctttcttatggcattaaatccattgggtgagcaattaaaaaatggcatttaattttgtttaaatagttcaaattgtgcttaattaaggccattgtctccgccaccggaagaagtggaagaagaagcgggacaaagcatcacaaaagggccttctgctgacaaatgagtgacggacaaaagaacaaaaacagtggtgattagtggaagaagaaatgaacataattcatcagtgatcaaatgcattttatgaagaaaaacctcaattggtaa

SEQ ID NO: 74232 - DNA, 309 bp, Heterodera glycines
  Genomic contig location: Contig_ID=SeqID_10928; Location=900..1208; Strand=-
  SCN-specific regions: Sequence locations=1-140,257-309
atgctaattttcgaactcaattacgaatatcatcaaaaacaacagcaacaaaaacaagaagttcaagcagtacaacaacagcagcaaattttgatgggaatagagatgaagatagacaacagcaaaaatggagaaacaaggaaagaggtggaaaagatggagggaaatagcattggggaaggaggaggagagacggaagagaaagagaggaaaaggaaaattcggcgcaaaaatgaggaggagaaaagagagagaaacagcagcaaatcgaaactgtttaattttgctggtgctaatattgctaattga

SEQ ID NO: 74233 - DNA, 805 bp, Heterodera glycines
  Genomic contig location: Contig_ID=SeqID_10929; Location=48..852; Strand=+
  SCN-specific regions: Sequence locations=1-127,149-190,217-399,421-805
atgcaaatgaccaaacgaagaactgcactttcaactccaaaacaaggtaagaacccataaaaaagataacgcgaagaacggcgaatgcaaatatagtaattattctcgagtttcgctattatcacaaatgtttggctattgcatatcaccaattttttgttaaggaaatgattggactttccgctcaaactgcttaaaaatttatacaaatttgaatttttaaccatctttgacaaattttttatgaaataaagtaaattttgctgttaccgtaaatccgctatttgaaggcccggccttctaatggacccatcaattgaatatggcaattcaactaatttagtaaagcctcgtttcttattcatttgttcgaataaaattatggcatgaaaaaaagtaatgatttgcggaaaagttttcacgcatattctaattttagttacactagtgtctttgcgtgcgatgagacagctgtttgagtgttttaaggcggacggagccataccaaattttcatgaaaattgataaaattggcaattatttacaagatgagagagaaaaagagaagagagcgaaagaagtcaaaaataacaaaaaaaaagaggtctggtagcaatttatacaaatttgaatttttaaccatctttgacaaatttttttatgaaataaagtaaattttgctgttaccgtaaatccgctatttgaaggcccgggccttctattgttcaacccctccaaaaaggggcttttaattggagggggccttctaccagagaggggccttcaaatagcggatttacggtaa

SEQ ID NO: 74234 - DNA, 1138 bp, Heterodera glycines
  Genomic contig location: Contig_ID=SeqID_10930; Location=1403..2540; Strand=+
  SCN-specific regions: Sequence locations=1-646,668-1138
  Gene Ontology: Mol. function=tRNA (guanine-N2-)-methyltransferase activity; Cellular component=mitochondrion; Biological process=tRNA methylation
atggatggtgctgaatcagtcattttgcagtgcgcaactgagaaaggaaatggcgttggtccatcagtcgcggccgattgtgaggcgaacaaattggccgaagtcaccgagggattggcgagaatcaccgcgacggcggagggcggcgagactttctacaaccgagtgcaggagttcaaccgagacttgacgtaaggcttcaaaagccgagcgaagggcgcgtctctttccatcttaaggagtttagggtcgtcgttttgagggcattcgctgccgaaatacccaacgaaaaagagccgaaaacggaagaggagggcccaaaagccaaacagaggaaaatggacgagggaaaagcacccgaagcaaatgcagcgcaatccgtaagcattttttagtcattgaaagtgcccattttcgcctcccagcagccccgtgccttttctgtgctcgatgccttgtccgcttctggtctgcgcgccattcgcttcgcgttggaagtgccaaatgtgacgcgagtggtggccaatgacttctccgagaaggcattcgaagcaatccgtcggaatgtgcagctgaacggcgtccaggacaaagtcgaggcggtcttttccgacgcaatgtttgagagacgacttttcggcttaaatttcgcttggatttgtgtccctttcagcgatttgatgatggcacatcgcaaattcggcaaaaggttccacgccgtcgacttggacccctacgggtcggcgtccgcctttttggacgcggcggtgcaggcggtgatggacggaggtgagcaaaatggaccacaatacacttggaatgagctttttaaaggcttactgatggtcacttgcacggacacggccattctctgcggcaacactcccgaggcgtgcttcaacaagtacggctcggtcccgctgcggcacaaatcgtgccatgaattggttcccccggccctcgctgcccttcccatgccctcccttaaggcccttcgcattttgctccgtgccatcgacgcccatgcgaaccgtcacaagcgttacattgtgccgctcctttcggtcagcgtcgacttttacgtccgatgtttcgtccgaattcggtcgggcgctgcgatggccaaagacagcgtgac

SEQ ID NO: 74235 - DNA, 939 bp, Heterodera glycines
  Genomic contig location: Contig_ID=SeqID_10931; Location=497..1435; Strand=-
  SCN-specific regions: Sequence locations=1-107,133-226,248-251,314 -362,406-441,480-587,613-805,828-939
atgttttctcaaaaagcagaaaatcgacgaaatgttgagcaagctcacttgtgtgttttaacaggaaatctatttttcttgaataagtccatagaattatttattcgaaatatattaaaataataaaattatgctttcagctctgcaaattattttcaattgagtaatttaaacatttgtcatcttttcaatgaaattaagtttttttttaaattttcttgcattgaaaaataaattttttctttgtgttcataataattattaaaattaattctcttcttttatcaatttaaataaattaaatttttattttgttaatctcttgatttttgtgtgctgatttttgaaatttggcttccttgataatttaattatttctgattattaatatattttcaaaaataaggctttgtaatatattgaagcttgtgattagttgcgatttttacaatatattttttatttgataaatattatttgttattagggtgcgaaactttactcctattcatccaaaatttgaaaatatttatcgtgtagagccacatatcttgatagtcctaataatttattcgatattttcaaagaaaattatataataataattttaatgaatggcttttttaattaaattatgcaaatattctatttttagtcgcaacttatattgtaaaacacaaaaatcagtaagtatccatgttctaaaatttggtatttcaacgcatggaaagggatttgttaattagacgtaagaagaatgcgaataaggcaataaaaaaagaaaattttatatttatgtaaagccttttaaattgaaaattaattaataccgtattaacattttaactatttatccttaaatctaaattgcaggcaaaaagtcgcacaactctgatgagtcttcgcatgtttaaatagatcataattattgaaaataaa

SEQ ID NO: 74236 - DNA, 631 bp, Heterodera glycines
  Genomic contig location: Contig_ID=SeqID_10931; Location=2524..3154; Strand=+
  SCN-specific regions: Sequence locations=1-24,91-127,178-261,314 -334,356-580,602-604
atgagggagaaagttggtaagtggttatttttttaaatatataaccaataaataataaaaaaatttcgtattgtataaaatattattaatcaaaaagtgaatattttacgtcttcacattatgtcattaaaataatataaaaattaataatatggaaaataaaaaataataaaataatttccatattaggtttgaggcttttaagtccaaattcttcatcttacttgattccttgtcagaaatggcctcaacaagcaaatcttttggtaatttttaaaagatttcttttattattcaaacaaaatttaaagtgcaaatcgattcgacatttgacgaagaattcaaaaaatattgttcggttgatttgattggacacgaattggaccctttggattggtggaaaattaacgaatgactatttcccattctcgctgcgctttcaaaacgatatctttcagcccaggcaacaacgattggaagcgagcaacttttcagtgttgcgctgatgtgtttgactatcgtcgatcaaaatttaaggctgaacatgccgaaatgctcatttttttgaataaatcaattccaaaaattcaatattattgataaaaaattttgttttgttattttttcttta

SEQ ID NO: 74237 - DNA, 684 bp, Heterodera glycines
  Genomic contig location: Contig_ID=SeqID_10931; Location=4249..4932; Strand=-
  SCN-specific regions: Sequence locations=1-613,635-684
aaaacaattgcgaacgccatcgaattgcggcttaaacaagccgaagaacaaaaaaacttagttcttgccactattttggaccctcgattcaagaccatttaccttgacagcagtcgactgaatcagtacaaagactggctgataagtgaagtggagagttaccacgcaaagacagatgtcatattattttttctatttttgtaacttatttttttaggaaattgatttacaaattgacctaagagactgcagtggttcaagttcgggggatattttttctcgttttgaaaaggacgcggaatttgatcaattaatgaatactgtaaataaactttatattcccctcaaattaattaatttaaggcaacatcccccagtccatctgcattggagacacgacaaaaagccgaagttgaagtgaatgaatatttacgggaccaaaaaatcaaatccagggccgatccagcattatactgggaagttaattcacaaaaatggccattgattggtgccgttgtacggaaatttctttctccgcctgcaacaagttcagaaagtgagaggcttttctcaacggccggcctgatttcagatgacttgagaaaaagtttacaggcggcaaatctggcaaagcttttgtttcttcaccataacttgcttctaaccggattttcaattgaatga

SEQ ID NO: 74238 - DNA, 327 bp, Heterodera glycines
  Genomic contig location: Contig_ID=SeqID_10931; Location=3790..4116; Strand=+
  SCN-specific regions: Sequence locations=1-106,129-130,153-327
atgtgtctcacacggtcccattggttcgtaactccttcgattgttagacttaacttttgatctgaaatgctaaaatttcaaaaatggtaaaatttcagctaccttataaatccttcatttggcccactccaaatgtctgatgtacaagaaaatgcttcacattttcgtaattcctctttgatctttcccttaactagttcacttgcaaccagggctggacgcaagtggatttacaattacggaaatccgcaatccacaattgcggcgattttctcagttgcggaaatccgcaattacgggtgtccaaaaaccccgcaatttccgtaa

SEQ ID NO: 74239 - DNA, 1210 bp, Heterodera glycines
  Genomic contig location: Contig_ID=SeqID_10932; Location=78..1287; Strand=+
  SCN-specific regions: Sequence locations=1-160,186-212,248-685,707 -760,783-884,906-1152,1174-1210
atggccaaggaatcgctgcgggcaatgcaggagcaggtgcaggaaacggcgatgaagctgcacgacgcggaaatgaggtgggccgcgggcgcgctttttactatacaaaacacaacggcacattatttggaattggcacttttacatgggtgcagctcgacccccccccccccccccctctccccaaaaaaatttccaaaggattttttacgaattttttttaaaaaaatctatttcttttttttttggaaatttctgtttaggggaaacgataccgagggggggggcatccattattttgtatgggggttttctcggcagttgccactcgccgtttcaaattttactcaatttcccatcaccaaattgaaaaaaaaaatttttttttgtcatgtgattgtgtgtcgtaaattgaaaattttgttcaaaaaataacataaaaggttaattgggaaagcaaattctgaaaattattttcggatgtcgctaaatcaacatcaaacaccgtccgccaaccattttcgtgcttaattcccatattccttcttttttgttacagtttgatcaacgtggaggaagagtgctcttttttgcgacaacgttgcgccgattttgagactcaaatgggccgtcagcgtgacgactacgacgcactgctcgtcaagtacaattcttccaaaactgcaccaccaccgccaccatcaccgtcgccgccgtttgcattggatgcacagaaagaagagtcttcggaggaaagcaagcggaagcggtggtggtgggcgaaccggaacaacatcacagcagccagtgctggagacgatgccgacgacgacggcatcgaaacaggaggtggcaacgcaaatgccgggcgaagacgatgacgaaccgccaccgccgccgccgatgccgaagaaaacagcatccaaggaggcagagacgcaagtgccggatggcggtggtgatgggccatcaccgctgctgccgcaagtgccgccgaacaccacagtgaagatggaagcggcaacccaaatgccgccggacggaccgccggcagcggaagaaatgacggcggtggtggtggcgattgtggcgatgattttgatgtttttgttcgaattcgtgtctgcagttcattagaatttacgtttctacattttttaacaaacattattttgtaaacactccgacacaaaaaacgagacatgcgtca

SEQ ID NO: 74240 - DNA, 1658 bp, Heterodera glycines
  Genomic contig location: Contig_ID=SeqID_10933; Location=515..2172; Strand=+
  SCN-specific regions: Sequence locations=1-207,229-313,335-354,379 -1658
atcaaaattgtgcgcaacccggaggacgacgaacggctcgcctatgtgaactttgagcggcccgagtgcgcgaagagtgtgcgccgctcgctgctcccacgcttacagaaaatgttgggccgaaacattggcgttgacccggccggtgtcatccgggaccaagaaggtggtgatggtgtacaaggcaggcccgtagccagaaaaaaagaaatttttgggtcgaattttcgaaaataaattgtaaatgaaggtccgacggtgctgtcagatgcaggaaaaaaacaattttttttttgaaattttaatacatttcgtaagaaatttatgaaagtttcaaaaaatttgccatttttcttcaaattttttcatttcatgggtgggtggggaattacccctcctccccctggctacgggcctgatggtgtaatccgctaattttcggtgggcctttattttaggttttccagcccctccccggagatatttttgccattttttgggtatgtttcctttatttttgggggttaccagcccccccccccagacatccaccatggtaccaacaaatgtttgcccattttcagggtttcttgatacccgtatttatcggcccttgcccttggaaattatgttatttttcgcctagctcaatcaggagaaccctattaatttttttaggcaaattcatcccggaccgttacaatcgtgccgtcatggctgctgccgaccgttcaccaccgcccggtgggcccagtgccgcgggtccggtgccgttgcgacgtgccgcgacccctccaatgcagcagccacgtcgtccgccaccgcgccgcatggaaatgcccgttttccgtaagccaactgttttttgtcaccaattaattcaaaataatttttagggggcgggggttggaaaatttgttcgacgagaccttaggaaaataaaatttctttgtcagacttgaaccaagacgacgcacaagcgggacgtacaatttttgtgggcaatttgccgggcgatgttcgcgacacggaattgcgtcggttgttcgaagcatttggcactgttgacgatgtgggaccaaaaaatttgaaatttgttgttgtttttttcccattacaattttaccccctttaaataggtggacatcaaattgttggccgattcaaacgcagcctatgcctttgtgctttttgaggtttctgtcaaattttaattagggcattgcaataatgaaaaaaaaatcaaattcgttattttgaatttttgagttcggtttttgttgaattttgctttcaaaaaaaattttcattttcaaaaaaatcctggaaacgacctgctgccaaacataagcacattgtaatattattacttttttagacggttgaacaggcactttccgcccgcgaaggccaacacaacaaaccgatgcgtcccggtgaataccgttgtcaattgggttggtttttccccacggtatatctaccgtatactccctccacaccgtgttttaaggttatggtaaaacgcagccgtgcaccagcctaatcatcggtggattgggcccttgggcttcggaagatttgctggagaaggcattctgcgactatggcgaaattgcgtccatccaatacgacggtggcactcatgggttcatttg

SEQ ID NO: 74241 - DNA, 689 bp, Heterodera glycines
  Genomic contig location: Contig_ID=SeqID_10934; Location=632..1320; Strand=-
  SCN-specific regions: Sequence locations=1-319,350-689
atggaccaaagcaatggtttttacgacagggaagaagacaaagtgaaattgattattgatctcacaactgttgatgaaccaaaagtggacaaattcaatttggatcaaagcaattcgaaaggcgcactctttatggaaattgaaaaagtgtcggaatttgcgcgagaaatcttttggagtgaacgtaaaagtgaaactgttcacatcggaggatttccatggaaaattttggcacaaattggaaagaaaaaggaagcactgacaaaaatgagaaatggttgggcttttatcttttgtgtgatgctccaaaagaaggtgcaaaattactaataattaatatatatattaacgacaattaattaattgatattgagcagaaacttggagttgcaaatgttcggcaactcttcgaattgtctctctaaagagcggagtgtcggatttcagaagaaaactcgatgaccatgtttttgacaataaaaacagaggctggggattcaatttcatttcatttgctgtgagtgacaattaaacattcccttaattgttccaattatttatgatcaattaaggaactgatgaacccaagcaaaggcttttacgaccaaagcgaggacaaagtgacattggccattgatgtcacagtgaaagaagcaaaacggaggacgaaacataaatgcccaatatga

SEQ ID NO: 74242 - DNA, 2688 bp, Heterodera glycines
  Genomic contig location: Contig_ID=SeqID_10934; Location=1394..4081; Strand=-
  SCN-specific regions: Sequence locations=1-24,50-110,141-204,237 -393,415-552,581-702,736-777,804-893,924-933,955-967,1006-1614,1675 -1968,1991-2336,2365-2591,2619-2636,2659-2688
  Gene Ontology: Mol. function=protein binding
atgtccaattcgatccaatcgattagtgttcggatgaagcatttgttgagcacgggagagtacgcggatgtgaaatttttggttggggacggagacgcaaaagaggcgagttttaatttttaattaattatttaaaatttgtatggtacagtacggtgcataatttaagaccactttatttaaatgcataaattagatttcaagtaaatttaaaaattcttattaatataatttttgttgcattttttgttgattagtttattagacaattatttagagtaattagtccaaaaatacaccatcaaattgcgactagacaatgagttctaggatttttttattagaaaatgtattgttttctttttttttaccttttatgaaatttactccctgaggagggtgtttttgctctaaattttacaaatttctccaacaatttcctgacaaaatttgtcactggactttcctctcccgattcccgaatttgctctccccgagtgtcagggatgaacagtatatacccgctataaattcctctgaatttttgtactgatttttttaaatctttaattattttaatccttttagattattttggcccatcaaatcgttttgaaatctgcttccaaagtatttgaggcaatgttccgctttgattcaaagaatgcaaaagcggataatggtaaaggttaactattatggaaaattaatatattaattagaaattaatataaaccggcattttataggatttgcttttttttccaatttatttcgatttaaaattaaataataatatttttggcttaattttaagcttctaggttgtcttttatttacatattttcacattttgcctatgtttcgatttaaatccatattttgacattttcatttttacaaaaaaataaaaaataaaaatacactccaaagatgaaattttttcaagaaatagatattcctattgaaattttaatatatttttagtaaattaaataattttttgcattcatctaaaaaatttaatggtttaacgatttttcaaaaatttgagctcgatttaatttgtttcaattagcctttgcaaattgccctgttgttgtggaaatccctgacgttgaagcagcagcgttcaaagtgatattgagcttcatttacgcggacgatttaagcgaattgaatggagacaatgcaatgggagtgctttgcgccggtgaatttttttttctaaaataaatgctttaattattggatttactaattagccgataaatacaatatccctgatttggtccttccatcttcgcaaattccaatttccgaattgcgcaatgttttccttgcttatgcccaggctcgtcttttcgactttgaggtgggagagaaataattaaaaatgaattaaagagaattttaaatgcaattattattcaaaacatttttaattttaggaatattgcaatgattgtttggattatattgacaaaaatgcggacgctttgcttaaaacggaggaatttttgcaaattgaccaaaaattgttgtgtgaaattttgggacgtgaccaattgcaaatcagtggagaaatttcaatttggaatgcagtaattctacttaaaaataaattaatttcatttttttaaatattgcattaattttaattgtttttttaaaggcactccgttgggccgatgaaaaatgccgtgaaaatggcattgaatgctcctcgggaaatcgtcgttccgtacttggtcctgcactgttcaaaattcgttttcctaatatccatgaggaggattttgcaaaatgcgtcggtaaaatttttgaaatcggaaattaaatagaaattgttttggtcgataaggtattttacctttaatgcttgaatttcatacatggacaaggagggtcagaaatttttacataaaatttatgggaaaactggacaaagagaactgatgcatacagaataataaattttgaaattttacagttccatccggtgtgttaacagtggaagaagtgctcggcgtttatcagttcaattcccatccgtttctgtatcttcgtggagtgcccgggctgtactcgttgaaattcccaagccatggacgaatttttaattggaacaaagccaggggcaaccgaagagggacactttcgatggaaattgaaaaaatgtcggaatttgcgggagagtctgtcgggagaagcagatacagtgatgccgtgtatataaatggatttccatgggaaattcaagcagaaattacgaaaggcattgatgagaagaaatatttgggattttacttatggtacgatgcaaaagaaggtccaattttaattactattttaaaaatatatgctactgaaaaaggtgcaaattaactgttattaaatgctaattaacaacgatgagtaataatcattaagattcgaattggcgctgctgcgttcgttcggcaacttttcgaattatctcgcaaaacaacgtgtctaagaattccattgggacattgtgtgattatgtttttgacaacaaattgaccaatttgggattcactaatttcgtttcgtttgcggtaagtgccaattcaaacaaatatttaaatttgacattcgtggaccagccaatattgaagttcatttatttatttgcctggtgtaaagaaatcataacaaaataaa

SEQ ID NO: 74243 - DNA, 4316 bp, Heterodera glycines
  Genomic contig location: Contig_ID=SeqID_1525; Location=1..4316; Strand=-
  SCN-specific regions: Sequence locations=1-691,713-880,902-1284,1306 -1702,1731-1834,1857-2365,2387-2453,2475-2497,2521-3509,3544 -3589,3611-3906,3928-3954,3976-4163,4185-4285,4307-4316
ctgtcacaaaagttgggacgaatattccaaaaaatttgaccgtgtctaaacctgttaaaattcacaaaattgaaaggccgttggtgtcaactgcgacaccaacaaaaaatctaacaattacacaaaaacccaaaaatggagtcaaaaaatctcatttcgtgtcggaattcacaaaaattgttaccacgaccataaccacttcaacggtaaagcccatggtaacaagtacttctgtcactacgatttctacaaaagtcacgcaaaatgcgagtgaaataacagtgttgccaactgacaaaacaaatacaagtttaatgattggctcaccaattaattcaaatattttctcgggattggggaatgccaccgaagttattaagtcagaaatgggtgagaacattgagactgaatatgaaactgaaagcgagattgagatacgtacagaaaatagttctgaaaatgagagccttgaggaaatggagatgaattttataaatgaggaagatgaagggagtaatgagggagagtacgttgaatttgaagtgttagaaaatgacaggagaaaacggacaacagtgaccacgcctgatgcgcaatggcttaaaaaagttgagaaaagtaaaaaaaggggtaaagcgggacaggaaaataagaacatgaacacccgcgttaattatgcgatgtataggctggatgaagccagaaagcaacaatatgatcagatatatattcaggcatgtgagagcaccaaatttcaaatgcaattggctagggcaatcttacagataaatccaaatgagggggttagaaggatttttgatagagatgatttggtcgcgcattgggaaggtgataatttggaagttggattttgcgcaccactaacacctgaaaaaatattttgggataaaaaaattggtaatgagtgttacgaatggacgccagtttttgcagaaaacacaatattttttgttaaacccggcacaagggagttgagcattttggggaaaaagtcggaatgtgtggaaaatggcagtgtaaagggaatgcagaatgagactcaaaggggaataatacaaaaaatgggtgaaaatattgagaaaattcgacccaagtaccgaaatatacaaaacccgttaattttaaaagccggagcgctttttgaatcagacaatgtgcgaattgaggaaacaattcgtgaatatcgctcaaaaatgaataatttgcccacaccgatattacgattagttgaaaaaccaaacattacggaagttattaaattggttaaaagtgaggcaaatgaaacgcttggtgtgataattggtagatccggagattggttggaaatagtaaagaaaattccggagaaaaccaagaagcaataagttatttgaaaggcatatcatatgtactgattgcgataccattattaattcttttggcattgatgggttacattggaattaaatacagactgataatatttgccggggttcgtgctgggtcagtattggcaagagtgttaagagcaatcatgggaacaaaaaaacgaagtactcgggttttggcggtaccaaccgcaccagaattggattcaatcgatgaagaagcttatgttctggattatcttcctccgagacgggttgcagcgattacgaatgacccgaggagactcccatccattagtgtccgtcttaatgatttgttaacagcagccttggttgattgatgtgctagtgtatcctactgtagagaaagaacagcaagaaaagcaggacttaaaattttggagcaaaatgacggaaaaggaaatttgactgcggcaaacgattcgagcatagaaattttggggaaaactatggcaaaacttcgaattgaggataatgtgactggaaatgtcggagaatgggaagttgtattgcttgtctcagtggacgaacattgtcccggccctttgcttattggattaccacttcttatggaattaaaaggtgtaatttccctgggagagaaaagagttagacttggtgatgtgtggacaaacattgtgtcagtaattgggtctgaaaagccaaaaccaccgtctgtgatacttgaaaatacggaagttttagagccaaggtcggaaaatatactttcggcaaaagtaaacgaatgttttccaatggaacaaaattttttggtgaaaggaattaagcttaaatatcccggaataattgttggacgaactttggtttcaccaggaaatagtaagaatgtaacaatacaaattttaaatgcgggaaattcagcggttaaattatatggaaagtcacatttggcagatttggaatcggttcaaattaatgcatcaccaggagatgaaatcccagcaaaagattacattcctcccgagacacgatggagcgaaaatttaccaaaattaccggaaaacggactaaataggccaccatcaaaaagaatcaatcttgagggtacaaaattaagtgaaaatgcgcaaaatgatttaaagaaaattgtggatgagtgttcagaagcttttgtaggggatgatggaaaaattggcaaatataacggaccaattgtgcataaaattgacctaattcctggttcgttaccatttcattgtcggccatatcggtacccaccggagactcagaaagaaatcgaaaggcaaatcaaaatgatgctggaccagaatataataagggaatcggaatctgagtttgctagccctatagtgatggtccctaaggctgataaaaagtcgtggcgttttgcgattgactacagagcactgaataaaatgacaaaaaagagagtatttcacttgccaaacattcaagagttgttagatctgatgggggcaaagaaattttacacgtgcatggatttacagcaaggatttatgcaaattccggttgccgaggaagacattgaaaagacggcattcatttcacacttgggcatttttgaatttataacgatgccttttggtctaacagcggccccggacacctttcaaagagtcatgaactcgttgagaagacggctaacggctgcgatgttaatttatttggacgatataataattggcagcgaaactgaagaaaatcatttaacggatattaagaattttcttttattgctaaaaaaagttggacttaaattaaaattggaaaaatgccattggggaatgtcagaaatacggtaccttggctttttgttaagtgaaaaaggtgttagaattgacccaaagcaggtcgaagtggtacaaaattttaaggcaccaaaaagcctaacagaattaaagtctttgttgggtgcattgacatactttcggcgctttattcacaattttgcgcatattgctcgaccactacagacattgactcaagataaatttgaagggaaaatagaagaaaattggggcccagagcaggaacatgcttttcaaactctaaaacaaatgctcacaacagtaccagtgctacagtccccaagattcgggaggacattcacaattgagtgtgatgcttcaaaaaaggccattggagcagttctcctccaggagaatgggcccgttgcttacatttcaagagcattaaatcggcacgaaacaaattacccttcaattgaaagggaagcattggcattagtgtatgcggttaaggaattctcgccatatatagttgggtctggggttacaaaagtaatcacggattgtagtgccttgaccggcatgatgaaagctaaggaattaaaagggagacttgagaaatatcaagtaactctccaaagtttcgaattagagataacttatcgcccgggaaaaaagaataaagtggcggattttttgtctcgatataatataccgggaaatgaaaaagattgtgaaccaaaactggaagaaaattcagatgaatttgaatttcagccaaaaattttaagtgcaaaaaatattaatgaaaatttgattgccaaaaatgatggaattttgaatgaaaatccgagaataaccttaaaaacagtgattgaggcacaaacaaaggtaaaggaattggccaaaattttctacattttaaaaaccggaaagtgtccaagtgatgttctgaaatggaaaagagttgtttctgattataacttgataaatggagccatttatttcgtaaaaggcaaagaaaacatggagaaacctaaattaataatccctcattctttaagacaaaaactttttcttattttccattcagagggccattttggattcgaaaaaacgtggcacgaaattaaaaaacgattttattggatcggaa

SEQ ID NO: 74244 - DNA, 116 bp, Heterodera glycines
  Genomic contig location: Contig_ID=SeqID_1526; Location=3525..3640; Strand=-
  SCN-specific regions: Sequence locations=1-116
tgatatacttaatttcttaattctctctttctctctcttatcctctgatcattgttcccccgtcaatgtcagcccggggggcggtcctttcttttcactaatcgagactctttata

SEQ ID NO: 74245 - DNA, 1025 bp, Heterodera glycines
  misc_feature (879)..(879): n is a, c, g, or t
  Genomic contig location: Contig_ID=SeqID_10937; Location=573..1597; Strand=+
  SCN-specific regions: Sequence locations=1-112,133-309,336-661,684 -712,737-805,828-1025
  Gene Ontology: Mol. function=protein binding
caaattccggcacataaagcccttttgatggccgcctcggatgtgttcgaagcgatgttcgcttatgactcccagaatgggacaatggcggggaattgtacgaaaatcggacaattaaattaaattaaattattaagcttttttcattttaagctccttctaaccctgtggaggtcattgacatttgtgccgtgccatttaaggcgatgttacgctttatttacaccaacaaattgagtgttttggacggacaaaatgcaatggctgtgttttatgcgggtcaaaaattgaaattgatttcattaatggattaattattatttatttattatttagcaaaaaaatatgccatcatcggtctgatcgaagcattcgctgactttcccattgcaaaattgccaaatgttttccttgcctttgcccaagctcgtctcctgcaagaaaatgtacaaaaattaaatttcgatttattaaataataatttcacttttgttttgggactttgctgatcgatgcttggcttgcattaaccaaaaagcacaaatactgatcagatcggatgattttttacctattgatcaacaatcattctgtgagattctgagccgtgatcagttaaaagttggagaagaaagtgctatttggcaagccgtaagaaattgataatgttaaaacaatataatggaattaactcacttaaatttgattttggaattttattaaattaattaattttcaaatctcattaaagtctgacaattacgaaaaagtttcgggcactttttaatttcgtaattttattttgacataattaagaattttgttgtatatcctaacaaatctaggaattcaatgcttttgttaatttgaaaaatttanattgtaggcactgcgttgggctgacgaacggtgccgtcaaaatggcatcgaatgttcgggggaaaatcgtcggaaaatgcttggcccaattttgatggctattcgattcccactaatggcacaggatgaatttctgaaaatcattg

SEQ ID NO: 74246 - DNA, 511 bp, Heterodera glycines
  Genomic contig location: Contig_ID=SeqID_10938; Location=117..627; Strand=+
  SCN-specific regions: Sequence locations=1-65,88-90,112-116,141-511
atgtccaaccaaaacgaagtgccacaactccgtgcaaaacgagagaatcacggacagagcggactttccgtccaagcactcgttgaacttctgctctgtttctttctccccgttcgtctttcaaaatgactttcttttaaatgttgcccttggcgttctgtctccccctcaaaataatttcacattttttagcccgcggcggttgccatccacggcggccccagcttcaaaatgcacattttgctcaatgttctgctgtgtattctcggtttggcctgtcctccttcattcgcattgactcccctctttaggatggatccccggcattctccacgccgtttggtactgtttcatcagcaccaactgattttaaacggagggtgatacattattttatcagcaaataattggaccaaagacaatgatagtcatatttttgatccgaaaaatgattaatatcataaatataaaattatttcaagaaattctggttgctaaattcggaaacaaa

SEQ ID NO: 74247 - DNA, 103 bp, Heterodera glycines
  Genomic contig location: Contig_ID=SeqID_10938; Location=1511..1613; Strand=-
  SCN-specific regions: Sequence locations=1-103
gtcggaataaaacatcattcccctgcttgtctactgtttgtcccaatttctattttgccaaaatttttgccgggccgaatttgcctctgtttggtcccgacaa

SEQ ID NO: 74248 - DNA, 603 bp, Heterodera glycines
  Genomic contig location: Contig_ID=SeqID_10938; Location=1663..2265; Strand=-
  SCN-specific regions: Sequence locations=1-203,225-483,506-603
gtcggaataaaacatcattcccctgcttgtctactgtttgtcccaatttctattttgccaaaatttttgccgggccgaatttgcctctgtttggtcccgacaagtggtgcaacggccgggaacctctgcactgatgaatgcttgtgatcagcgggtggcagacgctggtacaagggcgacaggacggagaggagtcagtctggtcaactgatcgctgtccaccgccgcggagcggatcttcacaagcaacaagggatcagcctgggcaactgatcacctcacagattttacgattaaccaaaatcaaccgcccgcctttctcagcacagacaacccggaatgaggcatgaaataaaacaacaacatacaggcagacttgcagcaactgaaccccccgacaactttgctgtggggagtgtcgcgactcacgtcacgagaaataaaatggaaaagataaattttaaagcatgatgcaatttcattaaaaatgggaaaaccttaatttaattggaaatgttccccctcttcgtcgttctattcaaaaaatatttgtttgtttacattcaattcttattcatttctcacacaaaaatgtattattca

SEQ ID NO: 74249 - DNA, 190 bp, Heterodera glycines
  Genomic contig location: Contig_ID=SeqID_10938; Location=2315..2504; Strand=-
  SCN-specific regions: Sequence locations=1-22,57-190
gtgtcgcgactcacgtcacgagaaataaaatggaaatgataaattttataagcatgatgcaatttcattaaaaatggggaaaaccttaatttaattggaaatgttccccctcttcgtcgttctattcaaaaaatatttgtttgtttacattcaattcttattcatttctcacacaaaaatgtattaatca

SEQ ID NO: 74250 - DNA, 1111 bp, Heterodera glycines
  Genomic contig location: Contig_ID=SeqID_10943; Location=90..1200; Strand=-
  SCN-specific regions: Sequence locations=1-214,244-424,449-736,770 -772,795-929,954-980,1002-1111
atggcgtcccaattgactgcgacatttggggtgtcgctggtgttgcaggtgcgtttggagggaattgctgctgcgaggccatttgtggcgtcatcatctgctggttgtaaacgttgtggggactgaatggagttccgcctgcgttcgtgtggttgtacataggcatctgagcagacgaaaaataatttgagcctcgtcagttagcacttcacctggtacatttgttgttgttgttgtggagagggcgccacattcggcgacatattttgtggcactgcagctgatgcaggattttgtggtcgctgctaaatggggggttttatgaaaaatataagaacaattaaaaaaaggtgaattcatttacaaaaaaagtcaaatgtttggttcgtaagtgccataaatttctgcttgccatgtgtctcactgcttgttgctgctgctgttgtgcgctcataccacctcctaattgctgctggactgattgttggtaattcattgcttgccctaaaatacgtatctataaaaaaccaaaatgtgcattaatatacactaattaaattgtaaggcaatggttgtgcaacatgaatatttttgtttttttattagagaccaccgagccgggccgggtggccggcgttttttggaaaaaatccggtttgactagtttttgagaggcccgggccattgcttctgaaaaaatcagcctggctcggcagattcggaaaatctcggtctcttttttatataaaaattcaaaaaaaaaaaaaaagcgattttcaaaaattattttaaagctttttggcaaccaaattggacacttttggtgtcattcgaaagcttttctacgcaaacgaaatcaatttgatcagtttgaaaaaagtaatgatcatttcaaatttacagttattagagacatgataatagcgcgcataaaagagaggaaaagaaagcaaaattggtacttatgtggtttacagaccataaaaaaaaattttttttaacacatttctagggggttttcggggtcgctgatcacgaatctgacatccattgcgaccaatttcgaactccggacccgaattcgaacaaaaagtcgaaaattaaaatttaa

SEQ ID NO: 74251 - DNA, 531 bp, Heterodera glycines
  Genomic contig location: Contig_ID=SeqID_10943; Location=697..1227; Strand=+
  SCN-specific regions: Sequence locations=1-56,81-261,291-531
ggcaagcaatgaattaccaacaatcagtccagcagcaattaggaggtggtatgagcgcacaacagcagcagcaacaagcagtgagacacatggcaagcagaaatttatggcacttacgaaccaaacatttgactttttttgtaaatgaattcacctttttttaattgttcttatatttttcataaaaccccccatttagcagcgaccacaaaatcctgcatcagctgcagtgccacaaaatatgtcgccgaatgtggcgccctctccacaacaacaacaacaaatgtaccaggtgaagtgctaactgacgaggctcaaattatttttcgtctgctcagatgcctatgtacaaccacacgaacgcaggcggaactccattcagtccccacaacgtttacaaccagcagatgatgacgccacaaatggcctcgcagcagcaattccctccaaacgcacctgcaacaccagcgacaccccaaatgtcgcagtcaattgggacgccattgtccgtgcacaacattcaacaacccg

SEQ ID NO: 74252 - DNA, 1939 bp, Heterodera glycines
  Genomic contig location: Contig_ID=SeqID_10945; Location=874..2812; Strand=+
  SCN-specific regions: Sequence locations=1-103,128-171,196-457,482 -591,613-1208,1230-1385,1407-1664,1689-1693,1716-1765,1795-1847,1877 -1939
  Gene Ontology: Mol. function=protein serine/threonine kinase activity; Cellular component=microtubule cytoskeleton; Biological process=protein amino acid phosphorylation
atgttgatggatcgcggacgccaaaccgaggccgagtcccgacgactctttcaacaaattgtgtctgcaggtagaggtggtcgtcgcgtcgtcccaaagatgcaaaaaaaaaaaaaaatttttttttgtttgaatttttcatttctttaagtggcctattgtcatgcgcatggcattgtgcaccgggatttaaaggccgagaatctattgttggacaagcgtggaaacatcaaaattattggtgtgttggtgttttctgttttgctgacagaccgacaaatggtcgacatcaatcaattggacaaaatgcctacttctttggcttgacacaaacaaaatcttgcccaattaatcagttttttagcgtgagaatattgccatattcaacacttcctctcatttgtcaaactgctcgctttagacctcatttgtccactttttggtgacatagtagtcaccagccaattatttttggtattttgtccctttttggagcaacatttcatttgtccacctttttggtgacattttgtccaggcaatgtttttttttttgcattttgtcttctcaatttggctacaaattcatgccaattgtccttttctgtatattatcctattaaaaaaaacaatatttcatttgtccatctttttggtgacattttgtcccagccaattatttttggcattttatccatttttggttagaaatttcgtgccaattgtccttttccatctattttttgttatttttcagattttggcttctccaactaccatcagcctggccaactgttgtccacctggtgcggctcacccccatacgcggcacctgagctgttgctggcccaagagtatgacggtcgccagtccgacgtgtggtcattgggcgtcatactgtacattttggtgggtctttttttcgaaaaaaataatggacagaatgccaaaaatgccattattataaaacaggtcactgccggcttccccttccctggcgattcggtagacaagctgaagcgcgcggtgctcagcgatcacttgaaaataccgttttgggtctctgtcggtgagttcaatgaccgcataataccgtaccgttttgtgcatgtcgattatactataaagctttgacaatatacagtatgcctccgattttactctgtttttttttggtttcggtcaaatatcatttcctcaattttttgtgacttgttaaagttgatgatgaagccttgtagctctgttatggtgcagtaaaattttattcctaaaattctaccgtagcttgacttattaaaatacaaaatacggttgtaaacccatctatcacggtaccagccaacttttcttgcatcactcactactgtgactgtactgtaccgaattttttccaaattgctcaccaagtcatcctaccgtatcctggcatcatggtgtgccactgtaaacatattttcttacagaatgtgctgatctgatccgcaaaatgctcatcgtgcagccggccaagcggtgcacattgcagtacatcacccagcacaaatggttcacctgcgacatgcccgagcacatcaagcagcagttgctggtgccgcagttgtcatcatcagcagcggcaactacagtagacaaccaacaagaaaaccgcgcgccgtatacggtaggaggaggaggaggacgagcagtacagcagcaacaacaacagttggacccgacaggtggttgcgctcattcccccccccccctcccgtcgtttccacacgaaaaattaaaaaaaaaaaattttttttaacatagaaatttgtcaaaaaatcttaggaaatttttcataataaaactcccaagaattataatttatatttttttattattttccaaatatagtgttgatcttcatgcaacagcacacgggctggtcagatgagcaaatcattgag

SEQ ID NO: 74253 - DNA, 455 bp, Heterodera glycines
  Genomic contig location: Contig_ID=SeqID_10946; Location=1029..1483; Strand=-
  SCN-specific regions: Sequence locations=1-6,28-55,92-230,262-420
atgggcggggatggtggcatggtgttgctgctcggccggctccacattggcacggccggagatgatggagccgcgcgagccgcgccgcgcgtactcgctgtccaactgcaaattggtgcaactgccgcccacaattgtgttcagcgccatggccgtcgctgttgcgcgtgcggcgccgccgccaccgaagacaagcggagatgccatcatggcggccgcaattccaccgttactactactattactattactaccactgctggtgccaccggtggtggtaataatgccggtgccggaggcggaagcagccgcggcggcggctgcaaccgcttccgcctcgcgaatgtcggacagacggctcaacagcagtgcgtacgtgccaaacacggacgactcgtagttgtggcccaacacttcctgttttaatatttaataattagttaaattataataaa

SEQ ID NO: 74254 - DNA, 629 bp, Heterodera glycines
  Genomic contig location: Contig_ID=SeqID_10947; Location=672..1300; Strand=+
  SCN-specific regions: Sequence locations=1-629
tacctactaataactgttgtactcttctaatcactgttttgcctcttctaatcactgttgaacctcttctaatcactcttctaatcgctgttgtacctcttctatttactgttgtacctcttctaatcactgttgaacctcttctaatcactcttataatcgctgttatacctcttctaatcactgttgtaccacttctaatcactgttgaacctcttctaatcactcttctaatcgatgttgtacctcttctaatcactgttgaacctcttctaataactgttgtacctcttctaatcactgttgtaccacttctaatcactgttgaacctcttgaacctcttctaatcactcttctaatcgatgttgtacctcttctaatcactgttgaacctcttctaatcgctgttgtacctcttctaagcactgtcaaaaattatgtatttaaggccttttaatgacgctgatcacggatacgtgattagttttcacttttgacatcgttaaggcctcagaatccccgtgtgattggggattctgaggcatcattttaagggggggcagattcgaatccggacagtgtacattatttgatttatttatttttttggtaattttcactgcattta

SEQ ID NO: 74255 - DNA, 592 bp, Heterodera glycines
  Genomic contig location: Contig_ID=SeqID_10948; Location=631..1222; Strand=-
  SCN-specific regions: Sequence locations=1-73,95-592
atgccgctggcactttgccgttccttcccttctccgttgatggcgccttttctgtttcctcccaatggcctcggcggactgtgccaaacacggggacgaacagacgcaccaaacaatgtggcaaaatcactacgaactgttgaccaggaagctgaacaaatccaggagttattgcgacgtcgcaattcaccggtggacccgagggatcgagtaaagaaagccactttttttgatcaatttattttactattaatgcttttctgccccatagttcggctcaattgcggcgaaaaaggtgcacatgccgcagacggaacgcatttattacggctttcagccggacgtttggaacgaaggcgcccaaattgaacggctgctgcatgagcgacagaatgcgtttatggcggacgatgaacgcgtggaggacgaattcgctgagggacgcgttccacagattgtagagccagcgcaagggacatgtccgggactgaagaagcacgcgcgaatccaacgaaaacggagggagtggcgcacactgatgaaagcggagagaaagcgcaaggcggtggcgactgacccgggctgcgtttaa

SEQ ID NO: 74256 - DNA, 983 bp, Heterodera glycines
  Genomic contig location: Contig_ID=SeqID_10949; Location=285..1267; Strand=-
  SCN-specific regions: Sequence locations=1-302,324-331,353-983
atggtcgaaaatttgtgtgcgtcacttcccggccctgtcggaaatgggccgtacgacacggaaatgtgccagtttttggtactttgttaattgaaactgtcagtgacccagtaactattgttcccaattgaaaatagggccaattgctcgtcgatcggtttgctggcgacggactcaccgcccattacacttggctcgattgggatgaacacgagcgggagttgagcccacagtgagtgagtgacgactatccactggttcaccatcattcattttgcgtagttcctacttttcccctcctcccaccattttcttacaaatttgtcttaaattgttaaaacagaatttctttttaggtatttgattgtttctcaacaaattgaccgttgtccgctcctcttcgatttgctgcttttgctctccgatttgggtttccatggcctttccttttgtttgccgctcatcaaagcgcaatttgccaatgtgtaataacatattcagctgtttcctacaataattcgcttttcttctgcagactttctcaattggagtgcactcctctcaaagatttgcccatttccgtcgcaattaggcagcgatgcaggcaactctttgcacttctcatttcggtaaaatatctttttaaattaattgtttctataatatttccacaattgcaggctgattttttccccgatctgatcgacatttgcgttgaaatgctccccgagacgacaaatcacgaaatggctgtgttaatgcgtgacttgtggaactttttgaaggtgaattggcacacttctcttaaattttacttttttcccaattttcagtccctcttctccatgtcttcctctccaacgtcgcttcattcgtccgatgttcgtccgatgcctccgccgtctccgaatcgaatggacgcgctcacttccgtaaaccaatgcacaaaaaaaacattgacacataactgtttttctcgttag

SEQ ID NO: 74257 - DNA, 1413 bp, Heterodera glycines
  Genomic contig location: Contig_ID=SeqID_10950; Location=168..1580; Strand=-
  SCN-specific regions: Sequence locations=1-111,133-643,686-866,889 -1062,1088-1164,1186-1241,1263-1413
cagttccgcagcgatctccaattccaatggactctgctccgatcggtgctcgtcgggggcaatcggtgaaattctcccactatcatttcaggcattttttgaatttcagtgggaaattaaatgccaaactgttgtccatccttttttggactgtgtcggatcgcgaggaatggcaaaaacgaacggttgcccgactcatttatgcggcaaaagacgacaaagaggcaggacaaacgggcgggaacattacgatgaaaattcaacttttccaacaaattgcttttgactcccatttcagctggccaacctggtctccctcgtcattgctgtgttgccccaactttgccaacaccgacaacagtcgtcgggtgaacttggtctgatgagtgctgccattttgcttgctttggccgatgcccgtcgctttggcaccgaatgggaccaatttgtgatggccaccgatgccagtggaagcaccgacccaaaaaatggcagcaaagtggtggagaatgtgctgacattaatccgatggcaacaaaccgcgccggaagacagtccaattcggcacttggggtgagcatgggaggacgacccatgagatgtgaacttgtgaaactcacaacaatcagtgggattccacaaccaaaatgagatgttttataatttctttgcttagcatttctttgcccgaccttcgtggccaattgcaagacgcactgctcggctggaccctcgactacgttgactcgcttcttcagcaaagtggtggcactgaagacatctttttggagtcccaaaatggttccagtgttggtgccccttctttacgcgttttggacaccttttacaggtttgttggcttgccaattaaataattaatgctttgttaattgctttctttaattcccctccctcctatctttttaagtttgatgtgtattattgtgccccaagtgcaacttccacttcgttaccacaacaaattgctcactaaaatttgtgcgcttattgtctcaatgcttcggcttgtggacagaagtgaattcaatttgcatcatctacttaattatatttttaaaatattttaggccactggggcactcccgccgatggggtggactttgtgtgccgctgcttcgccatttccggcaaaattttcactgcccaaattggggccagcaaaacgcatttgttggccgcgttgatggacgaagtgtttggggtaagtgccagtctaaaaaatattatcattttcaaattaagtcctatgacaaattattctccaccgattgtgggagtggtgacaaacactgtttcaacccgtcggtgggcgggtgccgcgatgtcggtgcccggttcaatttcgacgcttttcgatgcttggattttttgaataccgacaaaaagaaagag

SEQ ID NO: 74258 - DNA, 916 bp, Heterodera glycines
  Genomic contig location: Contig_ID=SeqID_10951; Location=314..1229; Strand=+
  SCN-specific regions: Sequence locations=1-46,72-404,426-752,782-916
atgctaattgtaaacattagaccactcaaaaaactcgaaacaattgtccattttcaatttaaaaaatgttatcagaaatatgtgaaaagctgtgccggaagtaatcaccgagttggggacgaaatgagcagggaaacggcggccaattgccaacggcaccaacaaaacggcaccgatcagcggagaccaccgctgccccagcagaaggggtcggtgatcggactgacggatatgagaggaaatgcgatggcactgagccaaaaccaggcagcttactttgatcagctgagaaagtattggaactgaattgggtggcagaagcaggcggcacgggacgaattgggagagagttttattcttcttttcccttaaaattgattattatcccctcattatgctgctgtaattattttttcactgaaaacactttccttggttttcgggtcgtgaactcgaatcggatacccgttttgacgaattccgaacctctgacccgaattcggacaaaaagtcggaagactcaaaattatcgaaatatgccgtttttgaaccaaaaatgctaaattcgaagatttggactttagattttttgttcgagtccgggttcggaattagcggaaatagataccgggttcgtggtcagtaccatctaaaacgcaaggagcttgttttatgacaaaaaaatttcactgacgcattttccattgacgcattttccgggcgccctcccgccgcctcggcttttaggatttataaaacccccattttcatttcgttttttgagcgataatcacatcaaaaattttaagcaacttcatatttctgtgtatgattgaattttgaatttccatttcaaaattaattagtgattgctagggctgctaattttatgtaaaaaaatttgcgaaatatgtaa

SEQ ID NO: 74259 - DNA, 244 bp, Heterodera glycines
  Genomic contig location: Contig_ID=SeqID_10951; Location=3104..3347; Strand=-
  SCN-specific regions: Sequence locations=1-160,184-192,214-216
gcaaaatgcgctttcctttccgctgctggcaatttccttcctaatgcttctcctcgtggcaccaattcaaattcatggaatgtttggaagcaatgggagaggcagacaaatgagcgggggaaggggccaaatgggaagcaacggcatgggaccaggaatgggaggcggtggtggcagcattagaagaatgcaacaaggccaaggaatgggaggcaatggtggcggtggtggcggcatgttctga

SEQ ID NO: 74260 - DNA, 2076 bp, Heterodera glycines
  misc_feature (2069)..(2069): n is a, c, g, or t
  Genomic contig location: Contig_ID=SeqID_10953; Location=66..2141; Strand=-
  SCN-specific regions: Sequence locations=1-81,105-307,329-1894,1917 -1957,1979-2076
atggatattcccgacaaccctaaaggggttcgtcgcaccacttccgcctgcgggcacaatacagtatatgagttgagaaatgaggaggacatgagtgaaatgacaatttcggtcattaataggaaattttggtcgggaaagacggcagtgaaagtctctgacttagaggccgcccataacgaattggtcaaattggaagacggaatgaaccgttccattagggctcttaaccgttgcatggacaaaaagacaaaatgggtctcggaggttgtctcaaatgccaactcaaattttgagatagtcaaggcccaaattgaaacattggttgaccaaatcgacgatctcgaacgagcaaatgatggaacagatgccaacagcacagtgcgcgagcaggacgactcctcacaatttgaaatgccgttgaaggataacaagggcacaaaccgtggcttgttaagcacaggtggcggcacgacaacgcagacacagaaaggcgtcgggacctcttccaacaatcctgctggcccaacccgatctttctttggcatcaacatgttgagcaactcattatcgataaattcaaatttggagttatttggagaagaatcggtatacgctttcgatgattgggccgagcgattcaaggactacttatcggtgtccgggaaaaatctgactgaaggagagaaagtcacgcgtctcaaattagcgctcaaggacacgccgaggaccctgttcaaggaactcgaggctgaccaaatcgtaactcttaccagcgccttggatgccctgagagccaaattggactcgcctcaacgacgggaattggcgaagcgaacccttgcactgtgccgacagcgtgaggatgaaacggttggccaatttttaaggcgtatgactccgctagttgagtcatcaaatccatcattgtctggtgatcagcgcaaagagaaagtttgtgaggaatttttggacagactcaagccaaacatgagcttcctcattcgtcttgttgaccttacgcaagccaagaatttggaattggtcaaagcccaagcagaagagcttgaggctctatttcttgcctctaaaggagatgatgtcactcgcctctctcatctgattaatgcgctgaaggacaaatccgaaaatgagcaatcaaattcaaatccaaatgccgaaaatgatcgcaactttggaagacagcaacgcaataacacttgggggttcaggcccttcacggctgatgatgttcagcgccaacgtgctagcaacaggggaggccgaggcaacagcaatcgtggctgggcaagagggagacaggagcacatgagccagagaaattggtctaacaacccggtttgctatttctgcaatagagtcgggcatttggccaacaactgcaatgcaagaaaagcccaattccaaaaccgacgtggaggaaattcaaattggaaccaaagaggaaacaatagctggaaccaacgtggcacaaatgttggatggaaccaacgacagcaccaatcgcgacaaaattggcgtgaacaggcacatgaagtgaacgtgatgcaaccatcaacttcctcatcatcgcaaggatttatggaagaattggtcaaatcgctaatcacaatgaatattcgagggtcatccaatcaccctccaatggacaatggaagaggtaatcctggtagtatgaacttaatcgcgcatgtggactcgaacaacgagcaaactgccgtgaaaaccgaaattgagaatgccgacgagagaccagaaatcggcttggcctgcgggcaaaatacagacaaagttaaaccgaaaacctcgaattgggaatcgcgtggtgttggaaaaatcaatagccttttctttaccacggcaattatgacaattttcttctcgatttttattagccctgtctttgggactcttcccgatcatccgattttatgccagacgaaagaagagggaaaggtttggcaattgcccggggtctcagggtgttcaaaaatggccatcgacccctcaaaaccaatcgtgacccgaattttagaaattttttcccnaaaatga

SEQ ID NO: 74261 - DNA, 719 bp, Heterodera glycines
  Genomic contig location: Contig_ID=SeqID_10955; Location=205..923; Strand=-
  SCN-specific regions: Sequence locations=1-135,159-171,195-210,420-677
atgcccgatcggattggcattgagcgagtgttggcactgagcaatggacgaatttgcagcggaacaaacgcgtcggaagaagtgtacgaaatgaaggaaacgcttctgatgaaaaatgctcaacatccatcggggtaattaattaattgattaattaacaacatcaatttctaaaaaaaattttattttaaaatgcatatcgaattttggttaataaaaaataaataattatctcaatattttattaaataaaaaatattaataattaattacaatagttgatgcacattctctttttaattactaaacaataataataatcatttattaaaatgaatttttatttaaaatgtttaaaattacatttagataaaatgaatataaaataatttttaaataaaattgaattaattataattccgaactaataaatggcaatttattattgtcaaattcagtagtcaaagtgcgatgtccatactgatgagcatggctccgacctcatcaagcagtactcagcagtacaaccacaaccaacaacaattgcaaatgatgtcatacacgcggggagaggagacgggggcgggggagcggggaccacttttgccaaacgacggggacgacgaagcggggattggcatggccggcgcaggggacgaagagataattaaattagcaaaaaatttgataaatttaatttaaaaaaatttaataataaa

SEQ ID NO: 74262 - DNA, 601 bp, Heterodera glycines
  Genomic contig location: Contig_ID=SeqID_10957; Location=826..1426; Strand=+
  SCN-specific regions: Sequence locations=1-156,182-601
atggttgcccttcatgtgcatgttgttcatcgtcgccgtgtccgtctcctgctgcaacaccaccacctcaacattgtgctgctctccatgctgcggttgccgttgttctcctactactgcttcgttttctcggcatttccaactgccaatgctttcgttgttattgttattgttgttgttgctatgataatgattatgatgccgccgattgttgtaagaatggccatcaccaaactgttgctgcttttcctgttggtactggttcgacagctgttgatgatgattttggtgcgtccaccgctgtttctgttcatgcttcaacttctgcggcggcggttggccattgtgccgttggttgttattgtggcccttttcaatgcccaaccgataagcggtggtgtcgtggtcggcatcggcaacaccaaagcaatgcctttgtgccattgtgcagttattgccgacgatggcactgttggtgctcttgaacgtgctcatcggcattgcaacactacctccagcatcgccactgctgctgcaaatgttgtgattctgctgttggccaacacccatgtactgttgatggccaagtacggtagatgcc

SEQ ID NO: 74263 - DNA, 3652 bp, Heterodera glycines
  Genomic contig location: Contig_ID=SeqID_1529; Location=1758..5409; Strand=+
  SCN-specific regions: Sequence locations=1-37,60-371,411-928,951 -1038,1060-1186,1208-1252,1274-1337,1359-1514,1536-1855,1878 -1900,1922-2243,2266-2679,2704-2727,2764-2816,2838-3174,3201 -3312,3334-3410,3434-3652
atggaacatctcactgatgcgcctcaatgggcgtccgcaatgttggaactggtgaaccaaatggtcgggatgtgccgtgaactggtcaccatggtacgcgaacaggacggagaaagaaacccgaacatggtcttcgacgaggaacgacgactgcacagcgtcgtcatcgcgcagttgccagaaagcaacagccaaatgccaacgcagcgtgcaaccgacgacttggcaaatgtcaaagcattgatggaccattgtgacgtcgagtgcctgccgacgcaagtgtacagaatgggcaagaaacaatccaacggacgaccgaggttactcaaagtggaactcccgactaaattccataccaatttgttcttgcgcaacaaaaacaaaattaaaaattttaacaaattttccaaagttttgttgcgcccctccctgtctaaaagtgatctcattgaccgtgcccggctcatttcactttgtaaagctcaacgcgaaaatgacccctcctgtgattacattgtctatgcggggcatgtgcttgcccgtgacgacatttccgccttcaaatccgaccccaattttaaatgtatttgtcataacagctcataaaatcttgcggggaccacccatattgcaatctctaaaaaatttgataccgcaagattttttaaaagtcctcataaggataataattgtttacaaggtgctttagttaatataaggtctatttataacaaatgtgtacaagtagaaactgtttttgaatccttaaatttagactttatttgttttacagaaacctggggtaaaaatgaaaacccatttccttttcattctaattttctacaaaaccataccatttcttacactaacagattgaataagcgtggaggcggtatagcttttgtcgcaaaaaagaatatacaattttttgtaaagttttctgaaacaaaatttggctgtgaaatactaatattacaatttcaaaattacaattcgctgaatttaatccttgtctataggcctccttctattaatttaaaaaataccaaaaatctttttaaattcctggaaatttacatttcagaaaattgttgtttacttggggattttaaccttggaactaaagatttaactataaaaaataaaaaaccgtaccctttaagtaattttggtactttattctgtgattttttcaacaaatataatttgacatgctgcattaatgaacccactagggagcaagccttcctagatttaatcatttcaacaaaaactgaattaataaatgcggtagaagtaaaaggtggacttctagatacagatcatttaacaattctttttaatttttgtattttaaagaaaaaggcagtcaagaaacaaattattcttaggaattttactaaatctaatacttttctatttgatgcatatttatcctcatttctccctcaactactacaaaaattttatacagttgaggataaatatgctattttctttagttctgttcgaagaaaccttgaaattaatattcctgaaactattttatctattaagtccgccagaaacttttacccaccgcatttattggcttcaattagggaaaaagcacgtctatataagctaatgaaagaaaatagaggaaaatatgaacctttatataaaagtatctccttacatattaagactcaaataagaaatattcaatcccgtaaagaaaataaaatactatccggtgataagaatagattattttcgtatcttagaaaatactttaagccagtagaggatccaccagttattcaatataagacttcttttatttctgactcaatttctaaagcggaaatttttgcaaaaattttttctgaaaactttactgtaaataattattctcttgattttgatacttctttttcttctccaacaataaacgacgttgaatttaatattatttctgttggtaaagtacttagaaccttacctaacagaaataacacatcaccggacggtattacctttagactgttaaaaaattgttctctttcgtttactccttttgttactgaaattttcagactctcccttgatacaggaaagcttcccactatatggaaacaatcgattattatccccttgcataaacaaggggacaaaagtaaccctatgaactataggcctattgccttaacttgttctttatgcaaaattatggaaaaatttattgtttgggctatttccgattttcttttaaagaacaatttattctccgaacatcaatttggatttataaagggcagatcaaccacaacacaactaatttcaacccttgaaaattggtatgatggtatttataataataagaatatcgattgtgtctatatagattttaggaaagcatttgatgttatcccccataatttacttttatataaggttcatagaatcggtattaggggtaaaatcttaaactggttatctgactttctttcaaaccgtacctttagggttcgggttgataatactctctcttctgagtataaaatgagctctggcgttccccagggttctgttcttgggcctcttttgtttctgatatatattaatgtttacctgaattaattcctaaacaaatttctataaaattatatgcggatgatgtcaaattatattccgtacataaaacaaaaactgatagaattgctatgcaccgtgctttaaatattctctctgattggtctaagaaatgaaatattaaaatttccatcaataaaacttttattatttactttggaaagaataaccccagggaacaatataaaattaatgataatgcaatttgtgaagttgaaactatccgtgatttagggattcttattgacaataaattttctttttccgaacacataagcaaaatcactcgtaacgcctactaccgtatgcgtttacttttccgtgttattaaatcaaagaaaatagcaatttggaaaaatatttttgttagttatatccgtccacttcttgaatattcccctgaatcttggaatccgcaacttaaatcccatattatcaaaattgaaaaatttcagaaatattttactcgaattgctttcagaaaatgttgtctgccaaatattccctatgaccaacgactccgattttttaaattagctactcttgaaaaaagaagaaaaatttttgacctcctaactacttataaaattctacatggttttacacatttggacccaaattcactgtttaagagaactaacttaaatactcgaaacaagtcttttttccggttaaatgttaaattacaatttaaaaaatcttcgaaatcttttgttaacagaacagtcaaggcctggaatgcccttgataaaacattaatgtctagctccttaaacacctttaaaaaattattagaattgactcttgattctcaaagcaccaatgtataaagcaattattaacttttgaggcatctcattgactctgacttccattttatttttttttcattattgtttgttttaacctgtgatctcactcgatatttattcacttactctgagactattttactgtgatcagtcatcagagtaagtggtctccgcccttctgatggcaattttttctttatcgataa

SEQ ID NO: 74264 - DNA, 447 bp, Heterodera glycines
  Genomic contig location: Contig_ID=SeqID_10959; Location=1552..1998; Strand=+
  SCN-specific regions: Sequence locations=1-38,61-336,359-447
atgaaagaatttgttaatagtgggcaggtgaagaactgtttctaaaaaatattttttcttgtctctttaattcatttttcagactcataataaacaaaggacaaatgagaccattttgcctgccaattggtattgcgaccgcattaacagaactgaatatgaagcgcaatcaaaagactcggatcgtcatttgctcgaccttttggatcagattctgagtaatcaccatccaaattctttgcaacgatatgaccagcttaaaaaggtccatcccggcacattccgccgattgattctcccaattcattttcagttccgactcgcttatccttcaatttatgagaagcgtttcccaacacattcgtctcatttggttgtgggcactaaccttaatcattcttgaaactgaccggaactctgattgtgagaaggaaatctcattcataa

SEQ ID NO: 74265 - DNA, 650 bp, Heterodera glycines
  Genomic contig location: Contig_ID=SeqID_10959; Location=433..1082; Strand=-
  SCN-specific regions: Sequence locations=1-165,187-303,338-343,366-650
aatgtccaccttcctgagtccaatctttggttgcgctattaatttcaaagtgtgcgaaatgtttgaagacattttgcagacattgagcttgttctcgggggattataggcgccatcgaagtcaaatgtttttttaccaaaacgaagtgagcaaaggcatctaacgaaagagagggaaaagggcagtcaaagagactgacaaaagaggaccattggaggggggaaatgtctcttgcgattggtccgtcccgccccattgcccaagccgacgcagagagaagagcaaatcgcgatgcaattcacctaaatctatttgtttggataatattgaaaataatcatttcgtaaaatgtttatttttatgtcttttggaatatagatccgcgctcatttgaggaccgttctgttcacgaagtcgttgaacaatcccagtgttttcgttgattcttttgcaattccaacgaacatcggctccagaaaagttggcatgaaaaaaatatccgagtttattgaaggaagcaaaattagtaaacctaaacgaaaatcttaaaaataatagagcttgaatttttgtgaattgcataaattcttaacgccaagaaatgcatttaaactctaattcctaatcattactcactcaccaattgacga

SEQ ID NO: 74266 - DNA, 797 bp, Heterodera glycines
  Genomic contig location: Contig_ID=SeqID_10959; Location=2261..3057; Strand=-
  SCN-specific regions: Sequence locations=1-183,213-614,637-703,725-797
  Gene Ontology: Mol. function=cysteine-type peptidase activity; Cellular component=extracellular space; Biological process =embryogenesis and morphogenesis
gttctctcgctgcggttcgtgttggcccgactgttggtttttcaacgagaacttaacataaaaatgtgtacatttttaaaagcacagattgttttgccctccaaaattatacgcgttattacgtcaaagactacggaaaactttcgggacggtaaaaaagaaaaagaataaaattgagctggatttgctgttgtttttaatcagactgcaaatgatgtccgaaatacacaacagaggaccaatcgcttgcgcaattggagccacggagcaattcgacctcaattacaccgggggcatcttccaacaaacttcggatgccccggtaaacaatttgttttttattactctgaagggctgcacgagagtctcgacaccgagtcgaaaatagttcgggtttttgggtgtcggtgtcaattgcttgtctcgaaaccgataaaagtcactcttgagttgccctttgcttttggctgttggccgagactaattaatctcggactcccgcggcgccactaattaattctccaattgcagaccaatcacattgtgtcggtgtcgggttggggttgggacgacgtgtcgaacacggagttttggattgtgcgcaacagttggggggacgcgtgggtaagcattgagttgcactccttcaacacaacaatcattcgagcatttagggagaaacgggatggttccgaattgtgaccagcatttacaggggaggaaggggcgaccaatacaatttgggcatcgaacgcgagtgttactttgccgacccggacatttccaatttgaactga

SEQ ID NO: 74267 - DNA, 1040 bp, Heterodera glycines
  Genomic contig location: Contig_ID=SeqID_10960; Location=1467..2506; Strand=-
  SCN-specific regions: Sequence locations=1-94,117-754,776-1040
atgggacaagcgggaggagagacgaaccaaaatggcaaaggcgacaaaagcccgatgggccaacaaaagtgagtttttcaccaatttttaacataaaaattccatttttcaaatttcagacgctccacagccgaaccccaatgccgaaacgccacagcaggactaagcagggccgtcaacatctgctgcatccgtcgaagaagcgatggagccgccaccaccaactccagcaccagtgccaacggtggagatggacgagtaaatgttggaatttggcgattcgctgccgtcgacatcagcgacgccaatcggcgatttggtgccgttcccgtcgacacccactgcaccaatggacatttgggattcaatttggaaggtgctaaattttcaggagatgaagcgttgcattccgtttggcgacgacttgagcaactttggaagacgatgccggacgctgaacaaatgcgtcaacagcttgagcatcatttcgtctcgaattggcttctggacaccggcagactcgacgaattgaagctggtgagttcatggaaggcattaaaatttgatcaaacaaattaagagggaggaggaaatgcgggaacaagcggccgaagaaaaaacgaacgaagaaagtgatcaagaggccaacatcgatgtcgttgactgatcgaggattgatggttttcattttcattacacgtgacaaaaaaaaatgttaaaaattcgtaaacaattttcaagtcattttggtcacttgtccttttatttattcattaaaatcatcgaaatacagctacagcatgaactggactcgaacctgggaccctccctttggtgaccttctcacagaccacttcgccacacatgcaaatcttttctggtacagcagctcatttcccggacgctgtgataaatagcattgacaagtctgtgtttcattctcgttctcagtttgaattttgataactcaattaatttcgtaatacattcaatgtccatacatatacctatttagtacatcaaaacagctgcaaaataaa

SEQ ID NO: 74268 - DNA, 380 bp, Heterodera glycines
  Genomic contig location: Contig_ID=SeqID_10960; Location=344..723; Strand=-
  SCN-specific regions: Sequence locations=1-380
atgaatccgccgatggtccgttgggtgctttttgggaatggcatcggatggtcgctggggctgacaaattcggctccatctcgcagcgaatgcttcatctgcgtccttctttggtccgcacttgcgtcgtctttagcagtccaatcattctctcagaaagtgccttccgtctccaagcgaattgccttcccttcgaccgccttcccaaatccaaatccgaacaatgccatccctccgccgaatgtcgtccgtcgccgtgcccataacattccaagggacaaacccccgtgccttcgaccgatggacagaccattccgagaacatcggacgtacccgcgcagttgggaaatgcctggctttgaggcaaccattccccgcca

SEQ ID NO: 74269 - DNA, 73 bp, Heterodera glycines
  Genomic contig location: Contig_ID=SeqID_10961; Location=343..415; Strand=-
  SCN-specific regions: Sequence locations=1-73
atggcccaatgcctcaagctctttgtccaattcgccatctttatggctgcggcatcgcatgccactttgaata

SEQ ID NO: 74270 - DNA, 529 bp, Heterodera glycines
  Genomic contig location: Contig_ID=SeqID_10961; Location=1536..2064; Strand=-
  SCN-specific regions: Sequence locations=1-26,48-381,404-459,481-529
atgaacttaaaagtaagtacaagtcttagatccaagccaaggaaggctttaatccaggatactggtcttggaaaaacacgctttctaaggacgagtgtattgatttcctaggaaatcacgatatttttttaattgaattcaaggacacttaacaattttctccatttacaatgaaaaatggttaattttttattcaaatgtttgtattttttgccagatcaatattttttctactgatcattaaatccggcttgaatctcttatcataattaaccaaaaatggtccaaattcaagataatttcagattttcatgtacgagcatccaatttcaaagacaaaacagccggacgaaattgtattaattaagccctttaattttattatttgatttgttcactgcttgttctgagtctacggcgagttgctagagagcataagctttaattttcaatcacttatgttaattctattaaatttaacatgagtcttccttcaattaattaattatttgccaaataatgaaataaa

SEQ ID NO: 74271 - DNA, 714 bp, Heterodera glycines
  Genomic contig location: Contig_ID=SeqID_10962; Location=189..902; Strand=-
  SCN-specific regions: Sequence locations=1-42,65-120,142-714
  Gene Ontology: Mol. function=ribosome receptor activity; Cellular component=integral to endoplasmic reticulum membrane; Biological process=signal transduction
atggacgaacggcacacatttttaggttgggaccaattggaggacgaagagggaaaagaggaggattattgggacaggggaaggcccgactcgaaaagtgagtgcgatgaatttgatgaacatttcaaagaataattgtcagaattggccgaattagttgagcacgtggagcagtacagaaaaagcgcaattttgtcgaaaagtgagcgggggggacaaagggacaacaaaccaatggacaaaagggaagggacaaagggacgacaaaccaatggacaaaagggaagggacaaagggacgacaaaccaatggacaaaagggaagggacaaggacgacaaaccaatggacaaaagggaagggacaaagggacgacaaaccaatggacaaaagggaagggacacaaagggacgacaaaccaatggacaaaagggaagggacaaagggacgacaaaccaatggacaaaagggaagggacaaagggacgacaaaccaatggacaaaagggaagggacaaagggacgacaaaccaatggacaaaagggaagggacacaaagggacgacaaaccaatggacaaaagggaagggacaaagggacgacaaaccaatggacaaaagggaagggacaaagggacgacaaaccaatggacaaaagggaagggacaaagggacgacaaaccaatggacaaaagggaagggacaaagggacgagtaa

SEQ ID NO: 74272 - DNA, 446 bp, Heterodera glycines
  Genomic contig location: Contig_ID=SeqID_10964; Location=62..507; Strand=-
  SCN-specific regions: Sequence locations=1-84,106-108,130-265,301-446
atgcggcggaactcatccctttccatggacactttcggggatttaagcaccaaaatcgcttcaactcaaagtggtaaaactaggcatttattaaacaatgcaaaacaataatagaaattgttgactcatcccattcttaattttttttcctttttcaattattctattttaaaatgcaaatttgaccttttttagccgagaaagttcattttgcttgtggcgaacaggaccaacggttggaaaatgaaggagaagccataagtcggggggaggaggaggaagacgaagaggaagtggagggcggacagtccagcgacagttcgtacgtcaaggtcattgcctttgcggacggagtcagcagcgatgaattgggcacggatctcagcgaatttgtcaaggaggtcaaattggcaccggacgatttgtgctccttttcctcggagccc

SEQ ID NO: 74273 - DNA, 330 bp, Heterodera glycines
  Genomic contig location: Contig_ID=SeqID_10965; Location=335..664; Strand=+
  SCN-specific regions: Sequence locations=1-139,162-248,276-330
atgtcaatgtgcgggtcggacttggttatgacggtgctacgtcatttcgcgacaagtgcaaaaagggcacttcgcgacagtgcaaaaattgggcacttcgcgaaaaatgcaaaaattgggcacttcgcgacagtgcaaaaatggtgtaaaaatggggcgtttcgcgacagtgcaaaaatgggcacttcgcgaaacgtgcaaatttaaccgaaagagaccgggcctcatcagtacggtgtctctttgggttaatttatttaaattaattattatttgtgtttcggccctaaaccgtatacacacaaagccacagcaatcaagcaaagcaaa

SEQ ID NO: 74274 - DNA, 956 bp, Heterodera glycines
  Genomic contig location: Contig_ID=SeqID_10965; Location=777..1732; Strand=-
  SCN-specific regions: Sequence locations=1-33,56-142,169-220,400 -566,588-720,742-956
atgcaaaaattgggcacttcgcgacagtgcaaaaatggtgtaaaaatggggcgtttcgcgacagtgcaaaaatgggcacttcgcgaaacgtgcaaatttaaccgaaagagaccgggcctcatcagtacggtgtctctttgggttatttatttaaattaattattatttgtgtttcggccctaaaccgcatacacacaaagccacagcaatcaagcaaagcaaaataaattttattaagcaaactaaatattttatattggtttttaatttaatcttttaactaattatatttgaatatgattaatcaaccaattaaaaagcaaatcaatttactattttaataaaattatacttgattatttaaagagcaaatttttgttattattttaaaaaatttatgcaaatgcttttaattttataataagctagttttgctttaactccgcaggatctataattgcttggaaatgtcccaattcaacaaatttaaaattccttaaaaacccttaaaactgcaaaaaccgtattatccactctcatcggagctgccggaggggcctcatttgccctaattttggatgaatttttggagatgttatcggaaggttttgaaaattatgtaactttttaaaagctgcgttaagataacgatttattatcggcattgttccccttgacattttccattagcggcggtgaaatgcttatacaggaagaagattttaaaaccgaatatatcttcgatctttttgaacgactaacaaaacatcaccacgttaataagatctgttttcaggatgcaaacggaaagcagaaagaaatccacaaagtccaagaaaaccttccccttatcttgctatattgtttagccaatggaaaacgtttagacttgtatttgtgtaaatgattctacacagaataatgcaaatgttgaagccttgcaaactcaaaataaa

SEQ ID NO: 74275 - DNA, 287 bp, Heterodera glycines
  Genomic contig location: Contig_ID=SeqID_10966; Location=115..401; Strand=-
  SCN-specific regions: Sequence locations=1-287
atggtcccccgcttcctgaagaggtcgcaaagtggttcatctggggtgggggataattagagcatatacggtattcgacttaacacaaaacatacaaaatatttccttttcattcatttctacacattcacttttagtggcggggtgtcgcagttggtaaagcttctgcttatgcctcgatgaaacttatgagttcaattccgcttaccttctgtccaatggatcaagaccgagctgcgtcgcccatgtttttttaatgtttttaattagcttttaaaaaaattaaa

SEQ ID NO: 74276 - DNA, 1833 bp, Heterodera glycines
  Genomic contig location: Contig_ID=SeqID_10967; Location=3810..5642; Strand=+
  SCN-specific regions: Sequence locations=1-288,310-1833
atgcaaaaacctactccttctaaccgccccaattcctctgtctccaaaacccttgcctgcgggcttgaaaaaattgtgaatttgagtggaaatgagccactctcggtgccggtgctggcggatcggagtgatccgctggggctcaagtcggtccaacccgacccggtgccaatggaaagtgccgaggctggcacaaaagaattggaagtgatggaagtggatgaaatgagcggagaaaaagggaaaaagggagaaatgggtaaagaaaaggtgaaaagtggtggaattgaagaggaggaagaaagtgagtgcagtgagggtgaactgctaggagacggtggatttggcaatttgcaactaaaccccagcctgagggcgggaaataaagcagttgaaaaggaagataaggggaaaccctatctggtcgcccaagtgagaagcgacggtgtgatcgcggcacggatgaaacttttctgggatttcccggaattggtctttgtcccttttagcctcttcgacaacgcccagccgatcgaaatcggcgatttgttccgcttacataagtgtgagtggacgaataacgaaacaggatgggaagagcgcggagattggctgtatgaagcaaccggacggctgaactaccaagccacggcaacggacgtgagccaattgcgccagcgcatccccactcaggccgtcggaattttggtcgatgtgcaaagagcccgtgaccgacacgtcaaagtggccatggtgtcagcacctgagctgagctgcgtgatgcgcgcctaccgtcgccacttcccggccgatttcacggataacgacatccgctaccgctccgttgtccgtcttcaacttcggcagatcaacagtccgccatgggtgctgtattcacagcagtttgcgtatgttttgccatctgattttggtaaaaaaaggggcgatgaactgctcgttcatcacgcaaacgtcattgctggcgttgagcctgagccaatgggctatgagttccctttcagtgccgaattgagctgggcgaaggtccagctgggcgagaaagtcatggccgcggctgttgcggcacaggcattcgatgtgaaggctgatctgcggaagcacactctgttcgtcgagccggtcgtcatcaatgagatctcgacaagaagcgtgatcatccagttcgtcatgccggtgccgagcatcgaagagctgacggaattgtgcaaaatttgggaggtcgatttggcggtgggttgcaaagtcaatccggcaaccaaggcaaagccttgcgcgcatgggtatgtgctgagcatcgaaaaaagggcgttatgtcgggggtacgaaattgatgttaaagtgatcctttcctaccaagaagcgaaggatcaggacgcgcaggaggaattcgatcagatgcgctgcggcgaactcgacggatgcgttgaactcattccgcagacgtcagtcagggcactgcaggaacggatgttcaccttgcgatccaatgactgctcgaaagtggcgatggacgaaggaaaaggaaaggtgggccgaattatgtcgattttattgggccgaccggtaaaaccggaaagcccaaagggcaacaacccattaatgacttttggggctctttcaaaattgaaagagggacaggtcgacaccgcgctgtgcatgctcgacgaggtgccgcgcctggtctttcaacaggccgggcccggcaccgggaagacgttcagcgcagcgtcgatcgtggccactatcctggccacggatcccacggctcgtgtgttggcgctggccccgccaaatgtcgccgtcgtcaagctg

SEQ ID NO: 74277 - DNA, 1879 bp, Heterodera glycines
  Genomic contig location: Contig_ID=SeqID_10970; Location=609..2487; Strand=+
  SCN-specific regions: Sequence locations=1-135,157-522,544-728,767 -872,896-957,979-1154,1205-1723,1761-1763,1786-1879
atgccaaagatttgtattcatttcgaaatgattttagacgaaaacgaagacagatgcaaaaatgtgagtcgaattggcagaatttcgcgtcgtaaatgcaaagaagcgattgcacgtgctcaaaatgtggcggaccatctgagcagcacagttcacgcgtggaaagtgctgcaaaagggcggcgcattggaagtaaaaaggcgaaattagcaaattaattaataattaatgagtggtaattaattggaaaaggtccgcttccacgacgagacgaacagttattatgtgaagacgaatttcgaacacaatgcccaaggtgggaagggattaaaggggattttgaactaattgagggggattgaaagcaataagcgatttgaaactaattgaggcggattgaaaacaataagcgattaattaagcgatttggaatgcgatttggaaggaaagccataaatggaacacgcagttgttggagtcacgaataattgcaggtaaagtgtggaaaaaggggaatggacatattttttcaatgaattaaattgggataataattttaaattatggcatcagcaaatgccaactttcataccgtatgcctttcagtgattgacagtaccacggacatcatcattagtgtgacgaaggccgccggcggcggatacattgcgccaaggcatttcattgatatcaggtggattttgaaaaattgtgcttaattaaaatggaataattacttatttaaattaaagtataattaataaaactttagacgctttgtcactgacgaggcgggcattgtttttgtgggtgtttatgtttcggtcgaatcggccgaggacacaattcggccgcaccaaccgccggagaaacggcgcggcggagggggcgggggactcgaagttcggttggcactttcgaatttgacaaatgctttaaagacagcttcaaaagcataagcattgttttttccctttcagcggtcgtaacggtgtgaatatgatccgaatttctcagctgggaccgaacaaatcccttttcgaatggattatgaacacggatttgcgagtacaaaaaacaaacaaacaaatgttgtttgattaatttctcacttttcagctctcaatccctcgcatgctgataagaagggtcccattattattgaattaattattttaattaattaaattatttttattaatttgcaatattttttcagacattgaccactttcttcgccgactattgtcgaatgattgcgaactttttacatgaaaatcccagcggaatcaaatgaagaatgtgactttcaaaatcaatggaaaaccaaaaaagtgatcgctcgcttctccaaacattggcatctgatcagtccgcgttggtttggaaaggcccaaaaatcattcctttgccattccttccaaatttttgatacagacaaattattttataaatggctatgtctcttttattgtgtatttcttttgtatcatattaaatttttgtacggaaaatattcgcttaaaatgccattgtttggcatttcgtcaataatttctgacaattgccggatggaatttgcttggccttggaaattgcgcttcctttttgccgttttcgcatcgctttcggttgcatcggtgcagcaaatagcaaatgccccagcagaagaaaatcaaattgacaaaagcgactaccaaagcgatgttcactaaaaaggtggaaatttaaattatactaaaaatagaaaataattatttgccaattaaatatgtcattaattaattgcttttgcattcgcttttgccaacctcggctcattcgttctgcttcttcgtcatttttttcggccgatgacaaagcaaacaaaaaagtgaga

SEQ ID NO: 74278 - DNA, 1474 bp, Heterodera glycines
  Genomic contig location: Contig_ID=SeqID_10971; Location=748..2221; Strand=+
  SCN-specific regions: Sequence locations=1-183,205-602,625-657,679 -838,860-921,943-1474
atgtgctctttggggcccgtatttgtttcatttgcttcctctggtggacttcaagttcgggttggtcttcttctgccggtgtttcacggaatggacgagaaccgttttcagaattcaggtctcagcattgtcaacaagttgacccttcaggtggccattatttctaaatgtttaacatacgcttttaatttttcaaaattaaaaccgtaatgaatgaaaaacatgtccttctttggtttgttttccctattaaatcctaccattaattggtttggctttaattcccctcccctccattgcgtgtccctccaattttaaatttttcctccctccattttatccgtttttctctaatcccccactttagaggtatcccttccctctgaccattgctctgtcctcctgccttaacaatgtgctctattccctgcccctactccgctttttgtccatctcttccgtctccgtgcccaccgattatttgcttcgcattgttttgcccatttccgtcggtcgcgcggtggccaccgtcagcgcatattttgcgctgtggaaaatcagtgtcagctacacgcagacaagtcaaattgggaagggatttgtaaaagcagaaaaatgttgggggtttgggattagcctcttttttgcagccttcacggaccttaaaaaattacacagccaaaaatatgacacaaaaaaataacacaattaaaacaaaagttattttgagtacgtagctcatcttaaaaaggctagcactttcgcaaaatcaggcgcccaaaatcatattttttccccaactaggccgggccttgatttttatgtgacccaattgggcaaatttccaaattttaacagactttgataagccattaaatgcgctttttgctgtctttttatctgtccattttgccctttcagttaaatccacaatgcctttgttcactgtgctcatttctcgtcttttgcttggcgaacgtcagcccatgcgaatttacttgtctttgttgcccattatcacaggtgttttttcactggttttcactaaattttcaattctcatttatttttaatttttcggtgtttttattacgactgcgaccgaattgcaattcgattccttcggcctttgcttctcattactttcgacgggaattcttgcttttttgaatgttcttgccaaaaaggtgggcttaagattaccattttcaacagattttagagagaagtcaattcgaacaaagttcgaatgctcggtttgggaggggaacatagaaaccctctacgattttaaattgctttttccttcccatcccacggctttgtaattttaattttgcaggtgctcgatgagacgcgaatgcatccgataaatttgctctctctgaactcccaattggcttctctgctgctgttccccttttggctgttcaccgatgctctcaaaatgtggtcgaacattcattcgacaaat

SEQ ID NO: 74279 - DNA, 1041 bp, Heterodera glycines
  Genomic contig location: Contig_ID=SeqID_10972; Location=377..1417; Strand=-
  SCN-specific regions: Sequence locations=1-80,105-213,258-369,398 -413,435-473,503-505,548-549,573-643,665-713,736-873,942-1007,1029 -1041
atgttttttttgactggtaaatggattattttgggtattaaaatgtttttttttgactggtaaatggattattgttcttgaatatttttaaaaaataattaaatgacgttctttattaaattgtgtctttttaggctctttaattaacattctatatactttaaatggtctttttttgattcactaaattactaattcaataaatgaatgcccttttttaaaattaattaattaatttttgtttaaataatttttttcgaattatttcaactcccatttttagaacattagataacatttttcttacctaatttttcgggatactaaactatttttttgggttcatttaacgagtacttttaatgaaagattattttattttttttaataattaaatgccttttttaattaaactttgtgttttaagtcatttaattaccacaactgtacccattcctgttcatttcttggcccatttttccatttcaataaatgttcttttgtttttgaaattaattaaattatcatccttaattcaaatataaatgcaatttttttttttaaattttaatgacatttttttggaatgttaatggtaattattttttttctaaaattagactatctggcccctcctgtcatgcctcttccttttctgttgccaatgccttcatcgccgccgccttacttccctcctccgccctattacgattgccaggaggagaaggaggatgatagggcgggggaggggtggtacgacgggtggttgcacttccacaaccgctctttgggaggttgggagttttaggtgtgttaaccaaatttaaactaagaggcgagtaatttaagcatagggcttatccgcctatttacatttatttattattattttttttttcttgctaatttatttagggtatttttttttaaatttaatttaagttgtggaatgatgggtgcgcagaacacaactcgtcaacaaacaacgaaagaacaaagaatggaaattgagaattgattgttaaaaaataatctaataaa

SEQ ID NO: 74280 - DNA, 1727 bp, Heterodera glycines
  Genomic contig location: Contig_ID=SeqID_10974; Location=380..2106; Strand=-
  SCN-specific regions: Sequence locations=67-105,138-159,182-205,254 -884,906-906,932-961,983-1149,1171-1509,1531-1727
  Gene Ontology: Mol. function=histone-lysine N-methyltransferase activity; Cellular component=nucleus; Biological process=histone methylation
atgatggatgataatcatgatgatgatggtgatggaagaggaggagaggaaaaggaaatggtgaccgcgccgaagaagaggaagaagaacccagtggcaggcatggaggaagaagaagaagaggaggaggaagaagagacgaatggcgtgcctttatcctcgtcgtcctcatcatcatcattgcctttcatgttgccggcaatttgtggtggtgttgctggcggttatggctttggtggtggtggtggtggtgtaatgcttaagactcgctgtcccatgttgctgccatcgcataaaaaaccctttgttgttaccgccgccgcctccgctttggcggctaatgcctccgttacaattaaccatgctgttggtgctgattgtcgtggtggtaactttgtttcaccgcctccgtcgtcgcagtgccgtgatggcactgttcaaccggctggtggcacatcgtcatcattgttgtccaccacgtctgcgaggagcacggcgcaatcgaaggtgcgtctggtggtggtgtcatggacaacatggcctggctatttgttgtttgttgtccccgcttttttgttgcttcttttttttcgctttttgcttttttatgtgccatccatcatttttcattactatttggcacttttgctgttgggggatgtgggcgattcaattttttatggttttctgaggaagcaaaaaaaaaatccgcctaccccaaacgctaaaagtaccttgaattttttaaagtttaacccaaaaatctgcaaaaattttgttgttgttttttgttaaaacttttggcttttccattttcttttagattcttttgtggttgtccaatttatttttgttattattgtgtctgtctactaacttatcaccctcccgtttttcttttatcccttaaattcaaatttatttattttttctctaaaattgttgttttgctttgcttcaaaatgtttttccatttgtccttgttcttcgtacgtattaattaactttgtttgtctgttcagcacttgtttacgtatttggctcattcatgcacatggcttaatttaatctttttttcccacttaggtattcagatcatgaattaatcttttttttttgttaaattggaatcatacttcgaaaatggtgtgccactatattttgcaaaaaattccggattaaatccctattcaaacattcctttccctctcctgtaaaattggcatcaaaattcgaaaatgatgtgccctcatcctaaatttttttttttattgtattgctgtcgcatccctctattattttttcgtgatttgttttttttcctctctttcggtcttcaaaaaattatttgcactcatcgcttttttcacgtgaaattttaacacccttgtacagtcatcatgattacagtatctgttgaattttctgcacaacaataaataaatgggtgggggctcgggaggcgttaaaaatatgaattttaaaagattccttaaaaacattccataatttcctcccgttttcagtaccgctccaagatgatcaagtttgcccgctcgcgcatccacggctggggcctgttcgcgctggaaccgattgcgcaggacgaaatgatcgtggagtatgtgggcgacaaaatccggccagaggtggccaacgtgcgcgagttggcctacgagcggcagggcatcggctcctcctacctgttccgcattgacgaccacaat

SEQ ID NO: 74281 - DNA, 1306 bp, Heterodera glycines
  Genomic contig location: Contig_ID=SeqID_10975; Location=168..1473; Strand=-
  SCN-specific regions: Sequence locations=1-136,158-257,281-319,384 -784,806-858,907-1091,1122-1306
tgccaccgctgcgttggaagcggtctttacctgttgctggcccgtctccgcgaggcggaactgcgctccgtcaagcagtgggccaagcggtcgccagcagaggaggacgcgatgctgagcgagtacatgcgggtaaacaaaatgaaatatgttgtaattttgaagaaaaaaaacgcccacccaaatttgttttatcgaagaattttttaatttgacaaaaattttttcaaaataacaatttgacttccgtcatgacgaatttaaaaaataaaaattttatgttttctatatttcattgagttttttgaggtttttttcgaaaataatctaaataaaaaatatttcttcaaagatttttttatgtaaaaaactataatttttaacaagttgcttcccccatattaaaaatgtttttttgcaaaaattcagtcaattataaaaaattttggcccatccctgtttttgtccaatccatcataaaatttctctaatccaagttgttaaagccttggaaatttttttttaattttatgtctaaaatcattccccctcctccaggacggtcttgagctggaggaaattgagtacctgaagatggcattcaaggacttggacctggccgatttgtgtgcggacatcaacgagtcggccttccaaaatgtgcgtcgaatgccgtgtgccgatgcggcggatgtgcaggcgcagcagccgtttgtctgggtggagccggagggcatttgcgagacgccgaatgtgtttgtgagttgtggcatttcactttctctatattttatataaattataagcatttccttctcaattcacttgtttggctagcaaatacgacattcttcctggaaaattttatttttagagttttttaattaaaagaatttttaaaaaaatgtgatcaatttatgattaaccccaccgttgtaatcactaatttctttcttgaatcaaattttaaaaaaatttgcagccaggtggacttgaacccatcgcccaaaaccaatttttaactgaccgttcaactcccacaataagcgcttgttttcctcttaactcctccaaaaatgcattcccttttcaattatttacttaaaattaatattttttttgtttgtttttccagcccaaaccgtacacggatgccagacggccgggctccatctactactacgtggacgcggagctggagggcgtcatgccgaaccggaccggcagtgcccggaccgagggacactacacgcgcaagagggacctggagaaggagcaactgctggcacaagtcggtggtcaatag

SEQ ID NO: 74282 - DNA, 325 bp, Heterodera glycines
  Genomic contig location: Contig_ID=SeqID_10976; Location=290..614; Strand=-
  SCN-specific regions: Sequence locations=1-172,194-226,249-286,320-325
atgaaaggcggcgacggacacggagcggaagtgaccagcaaatggacaccgacgacgacagtcggcgaagcggtcaccatcgttatgccgccaccatcaccggtggcagcagtcagcgccgaacaaagctgcgcgaaacatccatggcaagttcatcacgacgaagcagtcacagcaccagcggcggcagcaggtcgtcatcaacttccacaacaacttcaagcagttcatcatcatcatcttcccgtcatcggtacaggtcccgaagacggaggagggacagtgtcacctcagccaccagcagcagcggtagcagcagtgacag

SEQ ID NO: 74283 - DNA, 2835 bp, Heterodera glycines
  Genomic contig location: Contig_ID=SeqID_10977; Location=80..2914; Strand=-
  SCN-specific regions: Sequence locations=1-6,32-1161,1190-1317,1346 -1850,2119-2317,2368-2466,2509-2835
  Gene Ontology: Biological process=protein biosynthesis
atggcacaatgggggcccaaaaaggggggtgagtcgcgggaggcgggcacatcaccggagaaaggcgggaggggaagggtccgggcgaatttgctctcccgcaaattcgcaattttccatcaaatgatcgccgattttcatcggctgtccgccttggtgatgtgttgtttcgcccgtcgcaccgcgatggtccgatcggcgtttttgcactgcctcgggcgtccttcatgcggagaaggcgccacctccgctttttatcgctttccttcccctcattcacgtgctcgcctgctgccgtccctcccttcgccccctttttgtcctcccttcccttcatcatttcccgtttgccctatttttcccatctttccattcatttatcactccttgttcgcaacttcattcactcctccccgttctcctcatttgtccgctcaacggacattcgcggctgtcgttcagccgcgacattcccacggctttgaaaacgtcgcttcgaacggaatgcgaccatttgtcgtttcagctccatcaccaacggtgacggctcggggtcctcttgatgtgaacttgacgtttcgttcgctctcatttcctggggcattgaaggcggtaccagctcaattgcttcaatccttgaaattgccggtgctcgccgtgtgcctcgagtagctctgttccgctgcgtccactgatttcccgtcaccaaattgcggatggtaacgatgacgggccccattaagtagacccataccaagggtatcaggacatcgcgcccaaaaatgaatgtgacgtaaatgcagcatgccgttgtccagtaggagacgagcagccgaagtttgtccatgaaccattcttcggtgaggccaatcactccgttcgggagagctcccagtgtgagcgcacgcgaatttcccctgcgctacattaacatttgcctccacgatgtcaaaatggtatcaatttaatgatatgtctgctctccttatttttctttggatgacttttgtccttatttttcttttgatgacttcgaagttaggaaagtcggaaatttactcctgaaaattttccctgcgctacattaacatttgcctccacgatgtcaaaatggtatcaatttaatgatatgtctgctctccttatttttctttggatgacttttgtcctatttttcttttgatgacttcgaagttaggaaagtcggaaatttactcctgaaaattttccctgcgctacattaacatttgcctccacgatgtcaaaatggtatcaatttaatgatatgtctgctctccttatttttctttggatgacttttgtcctatttttcttttgatgacttcgaagttaggaaagtcggaaatttactcctgaaaattttccctgcgctacattaacatttgcctccacgatgtcaaaatggtatcaatttaatgatatgtctgctctccttatttttctttggatgacttttgtccttatttttcttttgatgacttcgaagttaggaaagtcggaaatttactcctgaaaattttccctgcgctacactaacatttgcctccacgatgtcaaaatggtatcaatttaatgatatgtctgctctccttatttttctttggatgacttttgtccttatttttcttttgatgacttcgaagttaggaaagtcggaaatttactcctgaaaattttccctgcgctacattaacatttgcctccacgatgtcaaaatggtatcaatttaatgatatgtctgctctccttatttttctttggatgacttttgtccttatttttcttttgatgacttcgaagttaggaaagtcggaaatttactcctaaataaggaaagaagcagaaacggaagcgaggaaggaattggaagaggaagcgcggaaggaagcggaaaagaaggcgcagaaggaagcggaagaagcgaaagaaaaatcacagaaagaagcggaagaagcgaaagaaaagacgcaaaaggaagccgaagaagcaaaagcgcagaaggaaagggaggagaaagtcaaaagagaggaggaagaaaagcgaaagaaagaaaaggaagcgaagacaaaaccgaaaaagaaggcagaaagagaagaaaatgacacaataatcgccaggggaataaagaaaaggcgcttaacagaagcagaaaaggaagagcgaagccagaaggatgccgaggaaaaagcgcgccgagagatcacggatattgtaaaagaagtcgaagaggaggccaagcaaaggcaaatccgaaacaaaattgaggaattgacggcaaaactggcagggaaacccagagaagaaatgggagaagaagaggcaaaggagttgggaaaggagaaggagcgctttgagaaccccccggagccgccaagagagcgcaggcctttctattccagcgccgtggcgcgctttgagtgccaaagcgaattggactcagcgtcgaaaccaagaggaagagaagaaagaggggacagagaaaggaacttgggaatgagcgggaagcgcttgttcacaaacatgctcaaatcggccgtcgggacagtaaatgaccgtccctgtattccacccgagggattaaatcgcgaaatgcttaaaagaagaccgactccagcgccagtgccgcagtttacgacacgcagcgcggagaggagccccgtgaggaagacatacgcgccgtttcggaaagggatgccactggaacgcgcggaggaagctatctacaaaatccgcaagtcactgctccaggccgcggacgctttcagagctcgccgacgaactgttcccgcacggagaagcgcgagagaaagatga

SEQ ID NO: 74284 - DNA, 1000 bp, Heterodera glycines
  Genomic contig location: Contig_ID=SeqID_1531; Location=2414..3413; Strand=+
  SCN-specific regions: Sequence locations=1-25,50-253,284-478,501 -653,683-706,728-775,800-900,926-1000
atgccaaccgcaacaccagcaacatttggtggtgctgctggtggtgatcagaataagcaaagctgtgccaacggttcttccaacacttctccggcacggcatggacatcaaactcagatgacgacgacgagtcgaagcagtacaacgccaccttccacggcgccgtcgttgtgcccattgaatggcgtcggttgtgacggagaagcggcgcaacaaaaacaggacacaattcagccagccaattgtgttgctggtgcatcttcatcatcatcatcctcgtctttttcagttccgaatgaggtaaaaaaagaaaaaatggggccctaaattatggacgattttacttggttttgtgagcaattttttgcgtcttaatccggctcaaattgttttttttattacccaaatggttcaaacttcttaatgaaaaaaagcattaaagttttagcatttcgctcaaaaagcctcaaaattttgcaaatctttgtccaaatttgtaataaacggcctaaaaatggaaacatttggacttttttgtgtgccattttacggttgtaccccatttttcggacaaaaatcgctgcggacgacggaaagccaatgccaaccgatggaagaagccattgccgacatgccaatggatgatgatgagaaggaggatgaagacgatgatgacatcgatgtcgaaagcgtgttggttaaccagaaactgcaacaacaaccaaattgcatcaccaccacttatatgccgttaattgacaccgactcgtaatccattttttaaattttatttaaatttcgaatttgatccgcaaaaaaacccacgctttattagcgattatccgacattagcgccaattataacgggttaaaatacatgtttttttttgtttatcaattaaagtttatatttattcaagaaaaaataggcgatgtttatggaatttgggattgaaaaaaaacagaaaaattttgagtccaattttggacattgacgcaa

SEQ ID NO: 74285 - DNA, 2025 bp, Heterodera glycines
  misc_feature (1970)..(1970): n is a, c, g, or t
  Genomic contig location: Contig_ID=SeqID_1531; Location=3651..5675; Strand=+
  SCN-specific regions: Sequence locations=1-691,713-993,1050-1060,1082- 1313,1338-1914,1949-2025
atgctttaccgcacgccggcattgccgttgaagacgcgctcaacgccgctctattcgctggtgctcgacttggttcggttttgctttatttaaaaaaaattgccaggacgaaacgctggtacactgcagtgtgcattttattggccaaaatctgtttttcaatgcgaaataaatgcaatttggcattttttttttttttggaattgaatagattttttttaagtcttttgtttgttcaaaaccctcaaaattagctctttttttcttaaaatttgctttgtttttttaggcccgcaatttttactcagtttaaaagccgaggacgacgacgacaaaaataacaacaatcgccaactgtcgcactgatgttttcggtttgcacatttttttcacggttaaatttaaccaaaaaccctgagaaatttcaattcattgggggtttcgattgaattaaaaaatcgctacattttttaaactttttttttgccaaatttcgtttgaattttttaaaaaatgccaagcaaggactacaaactttcaaaatgaaacccttaaaatgcttccaaattgttgtcaatatcatttttggccaaatcttttgtctataaatcagctaaaatgccttggtctttcacccgaggcacctaattttcaaagcatcacactggctaaaacaaattttatggccaagactaaaatttttcgtgttttccgcccaaatccgatttttttttgttcaattatgagccctccgatttcaatggtgaatttatttttagcattttattgcctcccccgaagctcgaaggagtgttggccgaattgaacggcacaatttgcgtgttggagcaattgttggagcagcgacagcgcatcctacaaaaattggtggcttttgccgggaaaaaattcttaagaaacttattgttagtaagaaattttcaagaaaaaatttttttgaaactttctgtgatttttttgatgaacactaccaaatttttttaaaaaattttttgaactttttttactaatatttttttaaataatttcttttgtgaaatttttaaagtaccaaaacttgaattttttttgcgttttttgcgcctaataattgaaaaattatggtccaatttttgttttttttgcatttgaaacccctaacgaatttttttttgcgttttttgcgccgaaaagaatttcatgcattttttataggccaaaaactcaaatttggcctaaatttttttttgtgccaaaattattttaaaagagctttaatggattttgtaaagtagcaaaaaatcaattaatggtttaatttttatttatttatttttgcttttaaccctaaggggtttgtttccgaataattgaaaaaatgctttaagttcttattggtttttttggttttaaaacctaaaggggttatggttcctgataattaaacaattggcctattttttggcctttttttgttttttaaagccccaagggcttatggtaccggataattaaaaaactgtctattttttgtcttttccctaggggttttggtaccctattattgaaaaattgatatactttttgggttttttttgcttttaaaccccaaggggttttggtacggaatatttgaaaaaatggtctaatttttatttttgctctaatttttgggtttttcttaatccagacgccgtttcttttgtgttggccaccacagcgcaggagttgttctcgcccgatgttgctacgatgatttcgtttgccatggttcagttcgcttttctccgcttcctggtcatgttttcgcttccgtcacttttggtgcactgatcggactcatttcggcgttggtaatgcaaaattttgccgttttccgactctaaaatggcatttttgtcgccaatcaatgccatttttattatttttaaaattttaaagaatttttggtgtttttgcttttaaaaccncaaggggttctggtaccgaatatttgaaaagatggtctattttggttttttacca

SEQ ID NO: 74286 - DNA, 1393 bp, Heterodera glycines
  Genomic contig location: Contig_ID=SeqID_1531; Location=8558..9950; Strand=+
  SCN-specific regions: Sequence locations=1-150,173-199,223-435,459 -1393
atgccttcaaaacaacacgctaaaagaaagaaggagcaagagcggtaccaaaggcagatggagcaatctgtcagcccaggtcgctcacccgtccctgacggaagtgcagatgagaatggggtggcatcacacccgggcatcacaacgcccaatattagtgctttgcaattaagcacaccggcttcttcctttggaagtaaaagaaagggaagacccccaaaagccggagcggtgtcaattatgacttcccaacacagtgtgtcatcttctgacactcaaattacatcggccccccaaaatattgattcatcgcctcgcaaaaaaagagagaaggtcgacgaagttgaccatcacatatctgctaatgaatcaattgcttcaacacctgtttccaggcaaaaaagccgtggagggcggccgaccaaaaagagaggcggcccaggcaggggtcaaacaaattattcaatgagcaatggctcctcaatgaaccacggctctgaagctgccacatcagtggtcgatttgccaactgtgcctgaaaagataaacttcagcacagtgcaaattaatttcgccacatctcgaaatatggcctgtaaaattcggagatgggctgatattggcctttacgaatgtgatgagagacgctcaggcccaagattcattgaaacgtgctggaatgatctgacacagtttctaaatgatggctttgttgtcgaatatttggcatacttggcaagcatatcacaacgaaaagtggtcgttgttgatccaatggtgtggcaaatgggcatagaccgagtcatgccttacaaaaatatgacatttgggtacgaccctaatgttccggcagaagttatacttttgccagtacatttccctggacattggactctcattgtccatgatgttcagtgcggtactcattttgccgattctttgcctacaccttatggcaggttggattggcaactgacggataaaattggaaagatcatatctgacattttgccgtcagcagtgttgaccgggattgttaatgccgtaaatctgacggtccaacacgatggaaatagctgcgggtactttgtgtgcctatatgctgaatcctggctcatgaacaatcgcacgtttgttctgcctgatttgtccataaattatgaaaagcggcgcctattgtggcacattaacgagctttatggcacagacaatgtgccataccatccgagggaaggggtaccaactccttgcccaattgtctgtcgacaggtgcagtcgacatccaagaccgctgagccaatggaaattgatgagcatgatgacataacgatcatcgaacctcagacgagtgggcaggcagttaatgccgtttccacccaagcccaagtggcag

SEQ ID NO: 74287 - DNA, 1038 bp, Heterodera glycines
  Genomic contig location: Contig_ID=SeqID_10978; Location=388..1425; Strand=+
  SCN-specific regions: Sequence locations=1-479,501-608,630-636,658 -1038
atgcattgggatgagcacaacaacgcagcagaggaagaccaatgctttggcccaatggttgaatttggcggttgcgaggcgaaggaaacgccggagaaagttgaactgaacgaaagcagcgaaacgttggtggacgatttgaaccaacagctcaaagagttgaaggaaaagctgacgagtgcaaacgaaaaacttgtgacggttgcaaatcaaatggacaagacattggacgagtcattcgttggaatggagcagcaaaacgaatgggccaacaaagaaagcgcaaatggcacgcgggaaaagacaacgaccaacaaaggactaaagggcaaatccacacaaacaatgggctcctggtccatgggcttcggtgctccttttggaaaagacaattcagcagttccgaggatgtcttcagatttggaatggttggttttgtgtgggatttacacttatattttagttttttttcacacacctttctaaatattttacaataacaccaaacaaataacgcacttttttgtttatgtcgaaatttcaaactttttatttagaagaatggagatatttggatgtttttaatcggttgactgaattcatttgtctaaaaattaagcaaaatgcggatggagtgcagggagctgatgagaaagcacatcgaaacgctcagagagcatatgaaagtgcgcgtgtttttgctgcacgccaaaaggaagggaatggcagcggctgagaagaaaaagtgccagacaaaattcaaagcattaatggacgaatttgacgaagccaaacggaagataaaggcggactttaagcggggaaatgcggacaaagtgggaaatcgaagttaaatttaaattttaccattcaaattgagggaatgatggcgaagcattacgtggaaattggccaattgcagagggagacgcgaattttgcaagcgaaactccagcaaattgtcaacgggaaaaacgctgtcgcaaatgcgtcgcgattgtacgttgtttttacgttttatagacttatttgcaagaa

SEQ ID NO: 74288 - DNA, 1033 bp, Heterodera glycines
  Genomic contig location: Contig_ID=SeqID_10979; Location=169..1201; Strand=+
  SCN-specific regions: Sequence locations=1-603,625-631,653-1033
atgcattgggatgagcacaacaacgcagcagaggaagaccaatgctttggcccaatggttgaatttggcggttgcgaggcgaaggaaacgccggagaaagttgaactgaacgaaagcagcgaaacgttggtggacgatttgaaccaacagctcaaagagttgaaggaaaagctgacgagtgcaaacgaaaaacttgtgacggttgcaaatcaaatggacaagacattggacgagtcattcgttggaatggagcagcaaaacgaatgggccaacaaagaaagcgcaaatggcacgcgggaaaagacaacgaccaacaaaggactaaagggcaaatccacacaaacaatgggttcctggtccatgggcttcggtgctccttttggaaaagacaattcagcagttccgaagatgtcttcagatttggaatggttggttttgtgtgggatttacacttatattttagtttgttttcacacacctttctaaatattttaacaccaaacaaataacgcacttttttgtttatgtcgaaatttcaaactttttatttagaaggatggagatatttggatgtttttaatcggttgactgaattcatttgtctaaaaattaagcaaaatgcggatggagtgcagggagctgatgagaaagcacatcgaaacgctccgagagcatatgaaagtgcgcgtgtttttgctgcacgccaaaaggaagggaatggcagcggctgagaagaaaaagtgccagacgaaattcaaagcattaatggacgaatttgacgaagctaaacggaagataaaggcggactttaagcggggaaatgcggacaaagtgggaaatcgaagttaaatttaaattttaccattcaaattgagggaatgatggcgaatcattacgtggaaattggccaattgcagagggaaacgcgaattttgcaagcgaaactccagcaaattgtcaacgggaaaaacgctgtcgcaaatgcgtcgcgattgtacgttgtttttacgttttatagacttatttgcaagaa

SEQ ID NO: 74289 - DNA, 2174 bp, Heterodera glycines
  misc_feature (688)..(688): n is a, c, g, or t
  Genomic contig location: Contig_ID=SeqID_10979; Location=1595..3768; Strand=+
  SCN-specific regions: Sequence locations=1-316,340-427,449-661,683 -1135,1175-1726,1749-2174
atgccacagccattccaagcgacgatctctccacaaattccgccgcttaatttcgaccaactttctgtcaatgacattgaatatgatgacaatgatggcggcggggaaggcttacttaacaaaacgtttactctccccgaagaacagaatgacaatgttcatgaagaggaggcggagaatgaaaatgggagcaacgcggacgagggaatttggcaggaacaggtgggaaaggaggggagctcaacattcgcctctatttctgtatcgaaacggggaaaaattgaaacggggtatataaccggggattagctttttctttgaaaattatataaaatataaagtaaatgttttgaaaaaactttaatccattcacagatagttgtgtccaatctgtcgacgagccattcagaagtcggaaatgtcactcagaacagtgacaaaattagcaatgaagttcaaatggtcgaatgccatgccgatggtcgttatttcaataaaaaaacagttgtttgggtcttaaatctttacgtatttaaggcgttgaacactcaaaggaaggctgtggcgacaatgtgagcttttctgaactgaccagcatcgccggggggaacaccagcgacgacattacctcaatcccttacccgagtgaagcggacaaaagggcgaataaggacgaagacaatgttgngaatgacgacaaagcaaatggagaggaacagcagggattggtctcctcccaaaacagtggttcaaccccaacctcgtcacgtcgtgtcaaatacaaaatttgtgcggaagaaagagggacaaaagtggaagtgtcggctcacggacgccaaatggacgtggaacggacgcattgcgtagttcaacagcagcaaccaattgaggcgattgaaagaagcaaaactggccaaaatgaaatccaaccgatggacgacggatcggccgacgatgacgagccgagcgaacgtaccgcagcggaggattcaacccaatcgagggaggtggccgactcagtgttcgaagagacaacgcaaaattcaaattcatcgccgaccaacaaaataggggagagtggtggaccaacaaacacgggtgaatgcacaccaaatgcacaatctgtgcatggcaaacgacagagaggggaggaggaggaagaagaggtggaagtgatctcggcaaaaagtttagttcgaagttcggctttaacgcagaggacattggcggaggtcgagagtatccccgaagaggtagggggggggggtggcgaaataacgagggcaaaagaactgtctcaggaaattaacttacaatcagtgcaatttttcatagaatgggtgctctgcttcaatttttgtattgatttaatctatattattgctagctttcaatggcttcacattcggcgaaatccttgccaaactcctccgtttccaccatgtcatctgggaaggggatggtggtcgccgtggaacccgtcgctgaacaccagcaacaacaacagacggacgattcgattgcggaagaagtgttttcggaggacatcgtttccaccttcaaaccgtcggagaagtcgctgcactccattctgtcattgcgtagcaattcgatgagcaccagtgcgcgggacagcatgggcaaactgaggagggactcggccagcgaagcgctgctcaaactgagaacgatgaattgcgtgccggagctgagaagtcctcgcgagtccaaaagtccacccaagtaaagccattacatgttttcagcagtcccaatccaaaaatttacagacccctgaggtcgccacgtggcattgaccgttttatggccaaattcccgcacaactcttcccgagaggccagtttcagtgaagagctgagtgtcaagggagaaatgctggaggaattgccgaatgcgagtcaaattgggatggtaatttttgggcaatcggtcccactcactttacccttgaattttttagcttttcgatgttagtggagcgtctgttgaaggaactttgtccaaattggacagcactgccgactcaaaacgtggacagtcggacatttttttgggcacggacaaacgcacggattccgtcgaatccaataaaatggagagaggcaattcgttgggcggtttcggtgtgccggaaggttaagtcttttggcgaa

SEQ ID NO: 74290 - DNA, 865 bp, Heterodera glycines
  Genomic contig location: Contig_ID=SeqID_10980; Location=359..1223; Strand=+
  SCN-specific regions: Sequence locations=1-14,38-66,88-97,136-284,306- 320,356-385,440-678,707-720,742-865
atgtcaatttcgaacaattcaatgaattgtggagatgatttcacaccagcagcagaaaatggaggtaaatgatgaaaaaggggaaaatatctcagtgaaattattttaaatttaaagaatattataaaaattttagaagtgaatggcgattcaattagtttggacaatgatggacaatttgatggaaatagtgaatcgattgctgatcaacaacagcttaaggtgggctaaaaaaacaaaaaacagagtaaaatgggataataatgaatttatatggtacaaaagtgattttgttaattgaaattcaggaattccgtgaaaagtttgccaaaatggaaatggaattgaaaatggccaaattggaactcgaaaatgtgagttttggtataaaaaatttttgagtaaaaataaatctcaaaaaattaaaaaataaaattatgtttagaaggcacttgaacaaaagttaaagcaccaggaaatgatgggtgaacagaaggcattgaaggaaaaagtgaccaaaattgaacaggaaaaggagaaaaacggtaaaagaaaataagtaaagaaattggtaaattttaaggaattaatttaattgaataagttgataaaatactggaatttattaaatcatcattaaaaactttcatcagcgaaagcattctctccactccaacgtaaaatattttgtttaaaataaaaatttgaaaacccaagaatttaattttttaagcaattattccaaatctgagcacatccgaggaaatgagtgttctgattgccagaattgctgagctgtatcgagcgaaaacaattgaagcatctgttgcaagcagctctgatttatttggacaagtcggaaacg

SEQ ID NO: 74291 - DNA, 2097 bp, Heterodera glycines
  Genomic contig location: Contig_ID=SeqID_10981; Location=783..2879; Strand=+
  SCN-specific regions: Sequence locations=1-96,140-144,166-559,593 -779,808-929,959-1159,1181-1242,1265-1547,1574-1646,1686-1811,1849 -1866,1888-2009,2038-2041,2073-2097
atgtcttcaaattttatcggttcgccaaattgctttttccgtccaacagctgatcagggtaagagaaataattaaaaaaagaattacgaaaaaaggaaattattttatcttttttaaataaaataaaataaaaatttatcaccattagcagcagcagcagaagaagtggacaagtatgaagtgttcagttggcacggagatttgagcgaccaattggcagcacaatttttggtcagtgatcagcagctgttgaaggtgggacatttcagaacggacaaatgagcacagaggggggagcacaaatgatcacagtgggggggggggagggggagagaggccggacggatcagtcacggacaaagggccgaccaattccgagagcaatcaagagacattttgccaaaaatcatgcaattaatgagtgaaggaaattggaaattatttagtggactgaaaaactttttttatttaaggaatgccgagaaaaacttgccagtgccgaattgagagaaacgaaattgctgtgcaaaaacggggaattgaatgcagagaatgtaagaaaaattaattattaaaaaaaaatttaaaaaatgacgaaataactgagagcgaacgcgcataaaacagaaactttcaaattttgtaagaaaattcagaaggcgcttaaagcagagttggagaaacaaaagctgatgtcggaaaacagtgaattgaaggcgaaagttgataagatggaccaggaaaagcagcagcaattggacaaaaaatacggtagagacaatttaaaaaaataaataatttttattaccgtactcggacagtactgtatgcttcaaaattatttcagtttctgtcgatgtgttcaattcattggtggagcgaatcaaacaattggaaaatcggcagaacaaagaggagggcagaaagggtaaataataaatttgaaataaataattaacggaccgaaattttgcatactttgaaaaggcgaaaaaattttaacggaccataagcttttacaattttgatcagttacaaattttaaatgaacatatttaattagctgaccaatgccaattatttttaattttcattttctattattcaattggatacattttttagcagaggaaaagcagcagaaggaaagtgttggtcaacagaacaaaaacaccgaacagaaattggatggaaaatatgccgtggtggacaaaaacaatgttttgggtgggcacaattggcaaattatttaaaattaaaaattggcgttataaaaaaaatgcattttttgagaggggacaaaaccctcgtattatatcgggattttatacatatttggtacatatttcggacttttttcttacatattttcattttttttacatatttgaggattttttacggaaatttttggaaattctcaaaaaaaaaatccaaaaatttcggcaaatttttcatttttttacatagctattctgagaatttttgaaaatttttagaaatttcttgtgaaaaaattaaaaaatctttttttaaatgtacccctccaaaaataatttttcaaatgttaaaaggtgattttaaacattttggtcatttttatggcattttgtgcctatttaacactttatgaaaaaaaattttccaaaaaataacaatttaaaaaaattttatttacatattttcgtacatattttgggtttttatacatatttcttacatatttcgggatttttttttacatatttatgtacatatatgaccactttttgtacatattttttacagccctaattataaatatttaggtgttaaaaaattaatttttctttttaaaatgtatttattgctaatttagttgctttagtgacgtcatcgggcgaccattcgccgccggcggttgtctcagcgaaagttgcaaaggtgggaaggaaaccttaattatttcacaaatgccatttaatttcaggaagtgcctaattcgcagcaacaaaatggctgggatgccaaagtttgccacaaagacatcgaaatcattggggaaaagcaattgacgatcaattgcaagggcagcagatttggtatttaatataaaaa

SEQ ID NO: 74292 - DNA, 1509 bp, Heterodera glycines
  Genomic contig location: Contig_ID=SeqID_10982; Location=1277..2785; Strand=+
  SCN-specific regions: Sequence locations=1-69,97-152,191-267,289 -396,418-665,687-695,722-896,928-1285,1340-1469,1492-1509
atgacaccaaatcttctgcccacgctttatctgaccgcgttgcccctacgacaccaagacggacctggtgcagaacaccagcaacaacaccagcaagtcacccgtgtgttctaccctgattcgttggccgatgaaaaagaggtggtccgaacaattttttgaatatttaattaataaacaaatttattttgggtgttgcggggtgccaatgatggttgtcgtcggaaaaaaaaattctttaataaattattctctaaaatcagtacatttctgataaatcagagtatacggtacccttggtcgaacccaagagcgtagccaatgggtcttttcggcgggcgccgccggtgctattccaagttttcagactataactaaaattgcaacaaaaaaaagtcgaaatattttgaagttttttcttaataaatgttttacaggccataaaattttttttgctttttgtaaggctaatagagcatgtgaaaagggctttcaaatgttaccaagaattgttatttttccaggtgactgttgatggtctgcacgagaaatgttggtactatttgtgcattgaatgggagaacttcaatcggcacaacgaaactacaggcacagatgtaaaaaaacttaattaaaatttcttttagcgattttgaaaaatttctgttcatattatatgaaaattcgattgataaaattaaattacaaaattttctttaaagtgtcgtctctttcgcacattggaccgtcttggcaaaggtgcggacagtacggtgtccgaattggaacccactgatttctcctcacaaatgatgcaattccggctccgttccgtgtccgattttccgatgaggtaggtgttggattacgaaaatttcaagaaaatttacagcaagtataaaatttattaattattgatttatttttggcactattcattaggaatctctctttcctcttatctctcgttttcacagtctgtcctcttatctctcgtttttctctaactgtctgtcctcttatctgtcggttttctaatctaactgtctgtcctcttattttttgctcatactctcatcatttcctttttctttctttaacattggtcttctctcaatttgcttaagtaattaattttaaatcaattaacaaaatccctgttaaggctaactgttgggttggagggtggtaaattggcaccgacaccacctgcccaagtgtttcaattgtccggtgaacggccatttgtcgaaatggagttgattttcacgtaaaaccaattttctttattatattaataatttaaatattattttgagaaatttaattttattattttgacagatttttgcgacaactgatggattacggtcagttatgtacggttgaagagcctatggtcatacggtacacagctttgggccgacttgtgtccggcatcagcatccgaaaatgccatttccgtaggacaaaatattaatttttcaaaataatcttgatattcacaaa

SEQ ID NO: 74293 - DNA, 283 bp, Heterodera glycines
  Genomic contig location: Contig_ID=SeqID_10985; Location=1218..1500; Strand=+
  SCN-specific regions: Sequence locations=1-87,109-283
atgaaggccagcttcggccggtgggctgatcgaatgaaagaatgtttcggagacggcacattctcattggcacctccaatgttctaccaaataaattgtttccatttcttcattttgttaattattatatttaacgaaaaatttgcttggcgccaaaacgtcggcgccaaaacgaccctggcgccaaaacgtcggcgccaaatcgtcggcgccaaaacgtcggcgccaaaacgacctggtcccttcaaaatcgtctctgatgctcaacaaataatgtgccagt

SEQ ID NO: 74294 - DNA, 1686 bp, Heterodera glycines
  Genomic contig location: Contig_ID=SeqID_10986; Location=1..1686; Strand=+
  SCN-specific regions: Sequence locations=1-603,632-637,661-851,873 -1095,1171-1206,1228-1413,1435-1686
aaatgcaatttaggaacataatatggccgaccggcttgtcaatttggcacttattgccggtggggctgagcttgtcgacgcggccgatttttacagggaattgccaggacatgctgacaaagtggtgatgctctaccacaaggtgtccccttttcagcctttgctttcactcaccaaattgctttctaattaggccgggcttatcggtcgtgccctcgatttcgcttttcgaaccgaacaattcggcgccttggatctgatcacgcaggaattgaacgaacattcggacccttccgttttggcacgcgccgctgaattcttttcggccaatcagcaggacggtgtggacattttcagtgtttggcatttgtcacttacaattagcagattttggaatttcaattgcatttctataccaaattgccttcctttaaggccaagccgttcgtttgttggtttatgccaaaaaagtaaagacccttttcggaatgattttcaccgctttttgtccgtttagtattcacaagcggtcgcattatgtgctgataaaaatgtacaaataactgaagagttagaaaatgttttgacgccaaataaattaggtataattaaataatgaataaaataaattggacaatttttaaaacttagaaagtttaccctcgggggaacggtcgcttttgctagaacaaattgcgcgctgtgctcttcagcaagggaattatcatattgcggcaaagaaattcacacaatccggcaacaaaatagaagtggctaattaagactaattatcatttcgttttaattggctaattaaggcaatgcgcgcccttttaaagtcgggcgacactcaggcaaacaaatgcaaaactccttttgttttttgctcgcatattctgctgctttagcgtgtccttctctttgctcagacggcgcgagtcggcgccatttatcgcatggcgggtaattacctgcaaacgcttaattggaaggaggacgcgcaactgatgcgccaaatcgaagcattttatgtgaaggcgggcgccatggatttgctgtccaacttttacgaatcgtgcgcacaagtgggacgaaaagcaaaacgaaacgaaaagcaaaacgaaaataaaaagcaaaacgaaacgaaaagcgaaaatgatagaaacgaaaagtactttcgggaataaaagtaggatttccatttgactttttattgaaactgaataaaagtgcaaatttggaaattgaggtggaaatcgacgagtaccatgactacgaaaaggcggcggcagcgtacggagaggcgtaaaaacactgaaaattggcatcttttgatgcgttttttgttttgtttagcattcaatgtttggccaaaaaattggctgacggggacgagaagaacaaaaactatctgacagagagaagggaaaaacttagccaaacgttggacataatcgcgcactttaatgagacaaaagggtgcacttgggctggggtaattaattaattatgggtcgtaatttggagcttttcagtttgtatgagaccgacccgggggaggccattagccaactgagcgaattggcacaacggaaaggcatcgatgagcacgtccgactgggcgatatttacgctttgatggtggcccattattacaagcgggaaaattacagaaaggtggggcaa

SEQ ID NO: 74295 - DNA, 1444 bp, Heterodera glycines
  misc_feature (49)..(49): n is a, c, g, or t
  misc_feature (109)..(109): n is a, c, g, or t
  Genomic contig location: Contig_ID=SeqID_10987; Location=1..1444; Strand=-
  SCN-specific regions: Sequence locations=1-362,384-685,717-1444
  Gene Ontology: Mol. function=receptor guanylate cyclase activity; Cellular component=integral to plasma membrane; Biological process =receptor guanylyl cyclase signaling pathway
ccatgacagcactcgagacttaatcatgctgaatcagtcgcgaatgtcncaagtggagctcaagtgggcgcaatagcaaatgccgagaaaaattaggacatttaacctntaatggtcagccgaagattggaggagacgacacgaaatttgaagtgtttggccaatgcgctaaaggcggaaaagcaacggactgaggcgagagagaatgaaataataccatgttaatcaattaatgactaaatttgcctaattaactgcttgaggggttactttgcgaactgatgccgcccagcgtggcagagtctcttcggcgcggcgcaacggtcgacgcagcggaattctccgaggcgaccgtgctgttcacagatgtaatttgtaaataatgctaataattcgaaattgaaaatgaaagcagttgggccgggaatggggacgaatattcggcacattttaagctgtcacatgggttaattttcaaagtgttccttcagatcgtcacttttacgaacatttgctccttctgcacgccttacgtttgtttgcccaatgcttcatttgtcggctcttttgccttaattggctaattaaggatgtgatcaaactgcttaatgacctataccaacgatttgatcgaattgtcggccttcacgacgtgtacaaagtggagacaattggtaaattagtgacaaaggaataaaacagaaagatacaataagcaaaagcttcttttcattaacaggcgatgcttatatgatcgtcggaggggtgccgaaagagtcccaaaatcacgcggagaaaattctgaatgttgccattggttttctgatggagtcgcgatttgtcaggggtggcccctctcctgctgtactccgttctgtgctttttgcaggtgaccaaccccaccaacgaattggccatttccatccgaattggcgtccattccggccccgtcgtcgccggcgtcgtcggagtaaaagtaaagcttttccattttcccttatcttaagagtgctttaccaatcatttttttagatgccaaggtgtttctttctttacataaattgtgtttaaatttgtcgttagatattgcctttttggtgacacaattcatttggccaatcgaatggaatctttgggtgcgtttgaacaattcgcacaaaattaacggattttagggatgccatccaaaatccacgtcagcaaaactgcgaaggctttggcaatcagaaacaatccgtcatttttgttcacagagagaggggccataaaaataaaggcaaatggaaaaaagcagcaaaaacaaaagtttgattaagggaaaggaaaaattgcgcacatattttttggagagaaatgaccgccaaagtgtttgggagatttgtgggagagtgagggaaatggaccaaagcatcgacgggtatcaggtggacgaggcggggggggg

SEQ ID NO: 74296 - DNA, 969 bp, Heterodera glycines
  Genomic contig location: Contig_ID=SeqID_10988; Location=1..969; Strand=-
  SCN-specific regions: Sequence locations=1-148,189-969
  Gene Ontology: Mol. function=guanylate cyclase activity; Cellular component=guanylate cyclase complex, soluble
cagttcggatggatccacgaaagttttcggcaattgatgacgcgcaaatacggaagagaaatttggactaaaatattgtaaaatgaatgtttaccttgctaatgaatttgcacattatttatggcttttagagaaattgccaaattcgaggaagggacagaaaacgaaattggcaaatattacaaagacgaggaatcctttcggatcgtgtccgccatgggatcagtgatcggttgcctttgaaatgtcaaatgatcgacttttgaagccttcacttcccttaggcatccccgtcgaggaagtgtgggaggcttacggtggctttctgatccaatttacgatggagacagggtgggacgaacttctgagggcactttcgcccgatttggaggtgcaattgggtgaaaattgaaataattttcaattctcaagggctttttggatgcattggacgcattacattatgtaagatcaatcaaaaacaatctgtgctaatcgttggcgattggcacagttcattgatcatgtcgtctaccgaacaaaactgaaagggccggcgtttcggtgtgagccccaatcggacgggtccctgattttgcattactactcccgacggtgcggactgtacccaatcgttaagggtaaacgaactaatggggaaggcttttaaatgccaaatatgccaaaggcgtgatcagagaggtggcacgacgaatttacgacacagaagtgattatgaaagtgcaagagcgaaagcaggagcatatggacacgatgatgacggagcatgtgattttcgtgatcaaccaagtgggccgatcagcacacaaggccaataatatgtgaagcgatgccccaattgacaggtcgagaacggcataagcataagccgaccgatcgcgtgccgtccttcctcgggaagtttcgtttcatcctcccgatcagtcaatgtttttcctcctttttttg

SEQ ID NO: 74297 - DNA, 746 bp, Heterodera glycines
  misc_feature (50)..(50): n is a, c, g, or t
  misc_feature (57)..(58): n is a, c, g, or t
  misc_feature (60)..(60): n is a, c, g, or t
  misc_feature (66)..(66): n is a, c, g, or t
  Genomic contig location: Contig_ID=SeqID_10988; Location=1769..2514; Strand=-
  SCN-specific regions: Sequence locations=1-54,86-111,138-167,189 -251,273-746
  Gene Ontology: Mol. function=transcription co-repressor activity; Cellular component=nucleus; Biological process=regulation of transcription, DNA-dependent
cccccctcattctcctcccactttcggtcccttcacttttcatttttgtnccatccnncncccccnccccccccccccccccccctcttttgtcaattctttcatccatcagttttgctttgctttgcttttgcctgctgaccattgttttcattcattccttatggccgcttctttcctttctttcattgagccaatgaatgggagaacaaattggggttagccattgggagggaagcgaaaggccgagcaaaaagagggaaaagggggagaggaaaagcaggcgaaggggcgggggctaaacaaagggtgcggaattgttaatcgaattcgaatgatgagagagaagagcaaagggccacctgccgaagggacaaaggcaaatggcgggaaaagtcgcaaataaattgaaaaatagctaattttttgttttgcttaagcgaattcacacgggtgaaaagccattccgatgcgaacattgcgggagagcatttcgacagcctggcaatttgacaaggcatgcttatacgcacacgacggtgagcacaaatcgaaatgcgaatagagggattttgataaacattcaataatggtctgatgatttattcgttcccaaatgctttttggcactttgtcataattagcttcgcctgattaaggtgaagccgtttgtgtgtgccgaatgcggcaaagcgtttaatcgcgccagcaatttgcaggcgcacctccgcgtgcattccaccgga

SEQ ID NO: 74298 - DNA, 932 bp, Heterodera glycines
  Genomic contig location: Contig_ID=SeqID_10990; Location=121..1052; Strand=+
  SCN-specific regions: Sequence locations=1-124,149-289,311-438,461 -465,491-932
atgccaatgaatgaaaagtgccatttaaggcccaagagggcagaacgacaattgtggtcgctcatcggttggccaccattcgaaacgtcgaccaaagtaagtgacctcaaaatgccaattccctttcttttctttctattcttttcagttctcgtctttcacaatggccaaattgtcgagacgggcactcacgaagaattaattgaaaagaaaggcattttccatgggatggtcagccaacagcaaatccaacagggaaacgccgaccaatccctccagaaaatcggtttctgtccctctctttggaaatcgaccccaatgaaaattcgaagacaaaaatattttcaaaaaattttccagcgatttttttgaaaactttttagaaaaaaacttaatttttcatcatttagttttgaaaaaagcgctgtaaatttttttaaaggtatttttcttgaaaaattgctgtttaaaaaatttttaatttttttttcggagtttcggcggcagagttttgtcctgctccggaatcaacgacccttttttgcttctcaaaacgccctttttcaagaaacttttcgggacagtgggtccggctgcgacgataggcgctgtcttgaaaaaaacatttttagaaattctcccctctttcagatgaggcgccaaattcggaagaaagcgaaggtacggcggaaggccagcggccaattgaaaaaccgaacgacgaaaacggagatgcatttgaagacggaagtgaagagaaagacatggcgattccgttgttgggcgagggatcggtcggatcggcaaaaagttcgccgagaaaggcaaaggcggccgagggcggcggcactttgtggcgaaagcattcgccggcgatggtaaaacaactcaatgcactcactgctccaagtttacgcaaatcaaaattttag

SEQ ID NO: 74299 - DNA, 521 bp, Heterodera glycines
  Genomic contig location: Contig_ID=SeqID_10991; Location=1920..2440; Strand=-
  SCN-specific regions: Sequence locations=1-432,454-521
gctcatgcagatgcttaaaacatttcttctccttttttcacatgatcacacaatcaatgttttacctggcaatagtgcacgagatgggtagcacatcgtatccccctgttatatcacgcatcaatatttttctgaactgcacaattgccttcagaagaatctccgtatcattttggcaataggattgaagctcgtccggcaaatagaagggtgttgttgttttattttcctcatacctatgtgaaatggggaacccccaccactgaaataaccctatagttttgcttaccaactgacaaatttatcgtatttttcttgtttcattgagccagcacagtagtcttctattggcggcaaatgcggaagcctcacgtcatagttttcccttaaaagcattatttttttgacaaatgtcacagctttcggaaaaaaccttcggttgaaagcatagggaaaaaaaggtttctctgcacagtccaaattgaacgtttttggcagttgatcgagacgaacgggcatca

SEQ ID NO: 74300 - DNA, 582 bp, Heterodera glycines
  Genomic contig location: Contig_ID=SeqID_10991; Location=4837..5418; Strand=+
  SCN-specific regions: Sequence locations=1-149,171-582
atggacaatggtaagaaagaagagctcaaggatcgcaaaaatgtgaaacgacgatacccattcccgttggtgtccgcacgagcacaggactcatggtaagtatgtgcaataagacacagcccaaactgcagatcaaaacccaggaggatcaaacttgaacaaatggaggaaaaatacgccaaaatggaagaggaaatgtcgtcggaagatagcgacgatgccatcgatttcttccaagacaccattgaggatattgtggaaaagtgggttcacgtggcatatatgtttggatttaattgttatattcctaataagaatcaaccgttccgaagaaaaaatcaaaaaatgggaggagaaaggcagcagcagcattaagatggagaacatgggcacaatggtcgaatggtaggccaactacagaagtgctgctgcagatacgttttttttgataaaatttgcagcagtggtgtggacaacggcgaaatcgatgacatggatgatcagcaggatgatgatgatgctccaacgtcaactgtttatttgaatttgggcaaagacgagcgcaccgcgaaaaattcttaa

SEQ ID NO: 74301 - DNA, 1557 bp, Heterodera glycines
  Genomic contig location: Contig_ID=SeqID_10991; Location=3076..4632; Strand=+
  SCN-specific regions: Sequence locations=1-93,115-129,151-985,1007 -1331,1354-1557
atggccgatgaaatgtgcgttaattggacacggccggagcagttgccataccgcggcattctgcgtgttcgagttgtccccccacggggtctgcgcgtcccggtgctgcctgtaaaaattgacgagcgacttttgttttgctgttgtcatcattgtgcaacgatgtttcgcaaaaaaagcacgcgccgcccacataaatgtccacacacggatgcacaaagatccttcaccggcagctacacgcatattgaactggaaagagcacttgaacacgggtacaaaattgatcgtctttggagagcttggcactatgatgaatggtaattgtctttctgtttaaaatttgtatgcgatattttttttctctgtaggagcgaccaaatttttaaagattatgttagactgctcatcaagttgaaggtttgcctgcagatttttgacccatttgtttaatcatgtgtttttttttgttaagattgagtctagcggtttccccgaaggagttagcagcgtggatcagaaacagcgctatgctgatgagtatcggcgcatttacgaagtaaacattgaattggagaatgtgaaaaaaaatccggggcttcgattcattgccaagcttatgcttaacagtctctggtttgtatatatgtccagccgattaaggtgcagcctatttttaggggaaaattcagtatgagaaacgaacttggcgcaaacaaggtcatcaccagaccacaagagttctttagtctgctctttgatcataaaattgtaagtttataacataccgttttgctggcttaactacaactaatgtgtgtccaggaggtttctgcaatcgtaccattctctgatcaagcgctacgcgtgctgtacaaaccaaagaaaaacttcgtttccgaacatacaacaagcaatattgtgataagtttgtggacaacaagctgtgctcgtctcaagcttcacgactacatggtacaagtcgaccaaagagaagattctgatttgctctatacagtaaacggggttttcgtgagcgcactatatttgtgattttaaggacacggacagtgtcattgttctacataagcgggacactactccacttgagactggagagtttttggggcaaatgagtgaggagtacttggattgcgatataaaaacgttcatatgcggaggttagtcgtaaatagcttattcaaaatttttatgcattaaggtgccaagcaatatgcctttcgtatgcgccacaggcggacaaacgaactggaatttgtccaaaaaatacggggaattacttttgatgtcaacaacagcaaggctctgcaatttgaaaaatttgttgaaaaagtgctcaattatggtagagttgatgataacgacgacgacgacgacaatagtgctgtttcgcctgctgttttctcctatcaaaagataatgccaacgcgcgacagcaaagtcataactcggaagcagttgaaaaaatatttaccagtgtgtcaaaaggggatcatcaacaacagctatgaagtgtttccttttggatatgaatga

SEQ ID NO: 74302 - DNA, 672 bp, Heterodera glycines
  Genomic contig location: Contig_ID=SeqID_10991; Location=5471..6142; Strand=-
  SCN-specific regions: Sequence locations=1-100,122-163,190-210,232 -576,598-619,644-672
atgctttcccaagcggaagacagagggtgtagtgtggtaagtttaaatgtttgtggaaaaatatgaattaatttacattcaggagcgaacctctgtacgtggaactgaaggatctgatgatctgtccgggcgactcgcgggaatgtctctcacgttgcggacgagcgagcagcagcagcagttattaccagctagcggtggacgagttggacctgcacagcgcaagcaacagcgacgacgacaaagagaacgacgcgacttggtgagagtgctctgccgattcaaccgatgttcgccaacttggcttcacaaaatgcttcagaaaaggaaggaagaaaatttgaaattcttgaacaaacagtcattagccacccatcacctgaaaagaaatgtagctgtttccgcagacgcgctatcccgacatggagccaacatgatgtttgcctaccgtggattcatgggaataactgttcaacaacatttatatgcgcgtcatcgtattgtgctgaaatatccccaattaccatgtgttgtacaatttggtggcagcagtcaccaagacaattttccacttgaattactccatgttgtttcagaagagcatgagaccgattaatatgtttattttaactattactatttttctctaacataatcacgatgaagaataaa

SEQ ID NO: 74303 - DNA, 991 bp, Heterodera glycines
  misc_feature (23)..(23): n is a, c, g, or t
  Genomic contig location: Contig_ID=SeqID_10995; Location=197..1187; Strand=-
  SCN-specific regions: Sequence locations=1-249,286-311,340-710,732-959
atgcaacaagtacaacaacaaanagcagcaatgggaattgatgatggcaccactcaaagaaaaaatgctggcattacggcgagagtgccgttggcgagcagcaacattcgccaggtgcggtagtgagaatttgccaagtaattatgtcatggacacactaaaaattataactaagagaactgactccgaaagcgccagaactgaaaatgttgtgagattttgttttttatgcactgataagaatgggtcggggagagaaaatattttttgaaaattggcatttttagaaaagaatcatttaaatctatccctatttttaaaaatctcatttttaaaatagccaaaaaaacacatttgttttttcttacaaatagttacacaaatttcccaggcagaggagacttctggcatcgcaggacctaaaccccctaaatccaaaaaggccagaaaaaatgcaaatttttatggacaaaatcttttgggttggttaaatttttgagatgaatttcaatttaattttttgttttctaaaattaaactacaatttttttgttgaaaatagttttttttttcttttaaaatattccccaactgtctcatatcgtattctcgtgtttttatggtgtctcgttcgaaatgaatggcaaatttaatgacagacgtaaaattcttgtaaaaaaaattttacattccaaatgatttgaagcttttaggtgcttgtcctttttgtaaattttcggtgcttttatccccaaaaaaaaacccgaaaaaatttttgacaatttttagctcctaaaaacgcctccgatcaattcatgtctttcgctttccagtttgtgatcaattttctcgtcattgttggtgttgcggtttcctgggcattgtccgtacagttccgcaagtcgactttggtgatcgacccatcccatttctatgcaccattctcactggtgtctttgatttattaataattaaaatatatattaataaa

SEQ ID NO: 74304 - DNA, 385 bp, Heterodera glycines
  Genomic contig location: Contig_ID=SeqID_10996; Location=854..1238; Strand=+
  SCN-specific regions: Sequence locations=1-117,220-323,347-385
atgaaaggatgcttattaacttctttatttgtatttttgatcaccatcttaattagtaataattatgttggatcagtaaagaaaaaattggaacaaaaatcttttgaagaaatatttggagaaaaatgggaagaaaaaagaaacgaagaacagaaaagaagagaaataattggaaaattttataaaataaaagagaaaattaagcaaaaaggaagaaaatattcaacaaaaggggggcaccatcgatagtattgccgactggggccttattcccggttaagttaaccgcggttaacgccttaaccgtggtttatttaaccgcggtttatttttaaccaaaatatgtattctcgtctttaaccgtagttaagctaaccacggttaa

SEQ ID NO: 74305 - DNA, 842 bp, Heterodera glycines
  Genomic contig location: Contig_ID=SeqID_10996; Location=2094..2935; Strand=+
  SCN-specific regions: Sequence locations=1-66,88-96,124-372,423-842
atgtgtgtaccgaaaaggatgagatgtgaaagtgcaaatcgttctgttcagccacataaaagcctgaaatggaataaagtggaaaaaatgagttttattcaaaaaataaaacattttgttttcgcagatatccgtgccaaagtttaaaatttttaatggaaggatggtatggtaaaatagaacttgttattgtacgatgtatatcgaccagggctggacgcaattgcggattgcggattgcggattacggaaattgcggggtttttggacccccgtaattgcggattgcgggttgcggatttttgggatttatccgcaattttgatccgtaatttgactattggattatttttcgagacgatttcttgtaagattattttttataaaatgaatttttttctatttttatttaaagaaaatatgtacatttgtttaaattcttatttctttagcaatttaaaaatgtccatctgcattggagacacgacaaaaagccgaagttgaagtaaatgaatatttgcgggatccaaaaattaaatccagggccgatccatcattatactgggaagttaattcacaaaaatggccaatgattggtgccgttgtacggaaatttctttctccgcctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgattttgcttttataaatttgctttttaatatgcttttaaattgctttaaaagatttataggattttttaaa

SEQ ID NO: 74306 - DNA, 560 bp, Heterodera glycines
  Genomic contig location: Contig_ID=SeqID_10997; Location=2097..2656; Strand=+
  SCN-specific regions: Sequence locations=1-285,307-560
atgccaaacattttcaaaatccttctgattgtgcttttggccgtcgtctcattccgtctctcggcttctactggtgacaaaagtaaaatattgaaataacttttgaatattccttccaattgtgtcaaagttcaccattttggtggccatggaaatccttattctgtgatgaaccctaaaaataattgacataaaattggtatttgctttaagaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaaagccgccggattggtgcatcgcatatgacaaatcgctcaatggtagctaatagtgccaagttatcacgatacgactgaaactcatttttaccaggctccaccgcctcctcctgcgcaatttgaaaagagggcaactcgagtagaaaaaatgagggcacacctactcgaactttcggagaaaatgacggacaaagagcctaag

SEQ ID NO: 74307 - DNA, 1685 bp, Heterodera glycines
  misc_feature (1615)..(1615): n is a, c, g, or t
  misc_feature (1643)..(1643): n is a, c, g, or t
  misc_feature (1661)..(1661): n is a, c, g, or t
  Genomic contig location: Contig_ID=SeqID_1533; Location=2304..3988; Strand=+
  SCN-specific regions: Sequence locations=1-58,144-263,314-332,367 -445,467-521,585-648,685-714,736-799,821-886,942-1015,1040-1050,1099 -1140,1163-1516,1543-1685
atggtcacttttgagcagttcatcaagggtgcccaattggcactcagagaaaggtgcgaaaaatattaattaattaaaattttttaaaattatttctatttaatttaactcagaaatttaattaattaaattattttaattaacactaattgttttcttagaatgaacacggcaggccgattaaagagagtccaaagtgaaggcaaattgtttggcagtgatttggaaaatggcaaaagcggagaaagcaacagagcaaaaagtaaattatttaattgcttaaaaatcaatttaaaattaaaattcataaaatctggctaataatgcttgtcttaattttattttaaattatatataaattatataccgtatttaatgaattagacccctcaggggctctagttttcaaccgcctttgcatgggcggctttatttcagagggggttctaattcatggaagggattctaattaagggcgcgggggggggggctctaattctgtaaatacggtactttgtttgataatttttaaaagattatttattttaaggaaaaaaaaatcatttttttattttcaatttttacgtttttacctttccgtatacaaattcatattttaattacggtttccgcttccccatttaatttatacaaaaattcatattttttcaacttataaatattacgattccacccaccccccgactcgctcccattatatttatatatttaaatgtcaaattttgaatttccatttatacaaaaggtcgtggtgccccgtcctcaacccctcctcctcctgctgctgctgctgctgctggcccacatccgttgcgcagcaatgggcatccgtccatgggtttaagtgggcgcaaattggacggacgcggtggcgctggcggtggtggcgccggtggcgatgcggccgcggccgcggcggctgatcaccgcatgcaccggctggtacgactgaagagggccagccggagccagccgcagctcaacgaattgtttgacggggcaggacagcaacgaaaaaatgatggtggacaacaccagcaccaccagcagcaacaacaaaacgcagaagcagcagcattacgaaggtggacgggggggggggaagaacattatatgaacattaataataattataataattgattcttattcaattaaataagtgggtgatcgatgcggtttgtcgccctagtctcgattgccgagaattttctcgtcccggattccggacccaaaactttttgaaaaatctagacattttttgttcctaatcccgaatcctggtaccaaaatattttggaagtctctaccaaggatatcggcatttttctcaccccgagtcccggatccgaaaatttgtggagtcacgacctggatcccgactttttcatgtcccacgacaaccctgctgggatgttggatcaagggtttagggggaggtcgatatcgattaaaatggatcggaaatttcatgatcatgctcctttgcttagcaaattaattaactaattaattaattaaatttttttttaaaaataagtattttttccagaacgaattgtcttcaagaaaatcagtttaattttcactttgncgataaaaatggttctgcttcgcccgantaagatggaaatgatgtngaaattgtttatcgatcaaaaaag

SEQ ID NO: 74308 - DNA, 775 bp, Heterodera glycines
  Genomic contig location: Contig_ID=SeqID_1534; Location=166..940; Strand=+
  SCN-specific regions: Sequence locations=1-131,177-282,305-314,489 -489,576-643,682-775
atgcaatcatcgccattgtcagccgtaaatggtcagaatggaattcataagcgacaaaattcggcaattcaatcaaatggcaccacaaataattatgccgacgaattacaaccccaagtggtccgttattcatttaaattttattttatttatttttaaatataataataataattgatataggcaaagcatgagcgattgctggatgaagagttcaatattgtcaaaatgggaacaaaaaaagcgcaggaactgatggattggtatgcgggtgagttaacatttattgaaatattaaatttattcgattaaacattaaataaatttttttaaattatatattataaaatagtttaaattaaataaattcatttaaatttaactatatttgaattctaatttaaatttaactatgttttaatattgaataaagacgaattaattaaaaataattaagtaaaaaaataaatttaaaataaataaatttacaaattttttattaatttaatttgaaatagaaaataaaataattttaaaattgttaaatcgctaatctaaaatttaaatttaaattacagatcgggcagagagtttggaaaagcgcaaaagaatgctgaacaaagggatggtggcattggtagccaattaaaaattttactttttatatattttataaaaattccaggattcggctatccacgagcagaagcttaattttcatagggctcaaattgcggaaatgaatcggcgcattacggcaaaatattatcattaa

SEQ ID NO: 74309 - DNA, 432 bp, Heterodera glycines
  Genomic contig location: Contig_ID=SeqID_1534; Location=1514..1945; Strand=+
  SCN-specific regions: Sequence locations=1-11,33-311,334-403,426-432
atgctattcatctgtgccaaactcctcctcaaattgctcatcctcctcaagctcatcggcggcatcttcagcactcgacagcagcaacttttgtaccgcatctgaagcggaatttttacgcgcacaaaaccagaaattgacgagggtaattaaggcctaattaataaatcttaattccacaaatttaaaatttcgccatcttccaatatcactaaatgtttctacacagtattagcttgagaaatttcaaaaagtcccatcctgactgatgaaatagatctgtgcatccttaaagcatgaaaaaagaagattttcttgttttctagctattttgctaggacttggcaaaaagaattattgagaatcttcgagcatgagaactacactgatatgttagagctacggaatcatgtaaaagttaattggttttga

SEQ ID NO: 74310 - DNA, 1043 bp, Heterodera glycines
  Genomic contig location: Contig_ID=SeqID_1535; Location=1402..2444; Strand=-
  SCN-specific regions: Sequence locations=1-395,418-467,495-840,862 -1019
atggtgagaaattttaggtataattttcccgtttttgtgtaggtttcaattttttcatggactgttttcgaaggtcacgcgcaactcgccaccttaatttgttagtttttccataggaaagttattaattatgaatttggcatttgattattaaattaagccggttataatttgccagaccaaaattaatccgtggaaaattattaagtcaagtacagtatatacagtacgattcggtattaccctttgggacagagttcttatggtggtggaaattttcttcatgaaaaatttctaaaaagtaaaaatatggaaggtaatttaaattaaaaacctaatttttttcgatatttcaaatggaaaaaattgtaattatttccaaaaatgtgagaatttagaggtataattttcccgttttttatgactttcaatttcacggactaattggcattaaaaaacattgaataataattatttttaaatgatttccagttactaattaataaacttacaaattttctcattctccggctctttgcactcgtagcaggtgtacttggcattgcgcgtcaacgtgtgacagaaacgctcatccttgaaaagaaattaacatcaattaacaattattaaatggttataattagagaccggacgggagacttcagcaggtactgagttgggatttttttctaactcaagaattttaaaatgaaaaaatttcgaaaacatctcaaaaacccgcaaaatttgtcatttaaatgaaaacgccagcgggcaacggcatgccaaaaagcctacagttaataggagagatatttttgagaattttttcaaaaattttcattgaaaattccaaagttaaagaaaaaaaatctggtttttcagtaccagaagtcacatccgatctctagttaaaatgcttgcacataattggatactttttgagctgggccagcagtgttggcaaaaacaaaacagcaaaaaatggtgaacagaaagaaaaacttgaacatttttgctaaaaaataattaaaaataataaa

SEQ ID NO: 74311 - DNA, 137 bp, Heterodera glycines
  Genomic contig location: Contig_ID=SeqID_1535; Location=3291..3427; Strand=-
  SCN-specific regions: Sequence locations=1-30,60-137
ggtcccggttttgaccagttttgaccgggaccgggaaattcccggcttttttcccggttttcccagccaaaaagtcccggtttttcaaacaaaaaagtcccggtctcgtccaaatttcccggtcccgctgcactcta

SEQ ID NO: 74312 - DNA, 907 bp, Heterodera glycines
  Genomic contig location: Contig_ID=SeqID_1535; Location=2644..3550; Strand=+
  SCN-specific regions: Sequence locations=1-449,471-725,755-907
atgaccttcgaaaacagttcgacgaagacggatcgcgatgggaagtcgggtttggatgctgtgcccgtggtcttgcaatgccgcgaccccaatcagctgcaaacggtgcaaaaaattgcccataactttgcttaaacccaactaaaattttaattttgatatttattcgatagacctaagagttcattattagcctacaaattcagttttaaaaaaagtttggccaaaagtacacatgcaatcaggttttcaaaaattttggccatatatattttttttgaaatttgacgaaatttttttaaattttattgcttagaaataaataattttgatcatcaaaatttcatttctgattaaaactttcttagaaccaacaaaataaagtgatcttatttccatagccctaaatgttttctatagcctgcaaagtttcaaaaaagttatggccaacatttttgaaaacttagttgcttgtgtactttttgccaaaactttgttcaaacttgactgaatttcttgaaattttgaaaatttaatagagaaatgttaggactatcgaatgatatcaataagtaaaattttagttgggtttaaacaaagttattgtattatttttttttgttgaaaaatttcatttagtttttttttagagtgcagcgggaccgggaaatttggacgagaccgggacttttttgtttgaaaaaccgggactttttggctgggaaaaccgggaaaaaagccgggaatttcccggtcccggtcaaaactggtcaaaaccgggaccttggtactcagttgtccgtgtccagagtagttacccccccagattttgggggtgacaattcagtcccgtcgtttcagtcccaggctagtcagtaccggagcaattaaatactattttacaaaa

SEQ ID NO: 74313 - DNA, 1070 bp, Heterodera glycines
  Genomic contig location: Contig_ID=SeqID_1535; Location=3872..4941; Strand=+
  SCN-specific regions: Sequence locations=1-30,52-100,140-209,254 -330,354-407,429-442,513-622,649-655,840-936,1016-1038,1062-1070
atggaattcgaggaattcgacccattcctaaatatgtttgttggccctgaaaaagaccttgagtacgatcctttatttgatctgtttctatcaaacggtgaaattaattaataaatgaataattaattctttatttaaaggcaaaaaaatcaattttgaccaaggattcttggactatttactaaataacgatgatgcggaacctgtggtaaaataaataaaattaaatgaaacattaaatttttaaaaaatacagtacatggatttggacaatgtgcctacggcacccccacaatttaccatacctcaatcacctaaacatgtaaaatgaataataatatttaaaataatttgaaacagcatttcgatttggataatgtgccgattactccactacaagtggacaacccacaacaaattccttcattccaggaggaacatgtaaaataaaaaaaattaaaaaaatcaaataaaagtttaaaatatgttaaacaataaaaatatataatttagttggctgatttgggaaatttattggctaaccctgccccacaattgacatcgcaggtttccccgatttttccacctcataatgaatatgaagtggaacaaatcattgaccaacgaaaaaagaaaggaaaagaagaatttttggtagtagtagtaataataataaaaataataatttaaaaaaataataataaataataataatattaataaaattaattaaaaaataattataataataaaattataataaaaataaatagtttaataataataataataataataaataattaaaaaataattataataataataataataataatttatttgaaggttctctggaagggattccttccagaggaatcgacgtgggaacctgtggagcacttagaaagtggtcatgctcttttggaggagttcaagaaaatgaaagtaaaaaaaaaaaaaaaaaaagtctacacacctaaaataaaaaaaaaattaagaaaaaaccaaaaaagcccgccaaggcgacaaaattggtaaaataataaaattaatttaaaccaaaaaaa

SEQ ID NO: 74314 - DNA, 674 bp, Heterodera glycines
  Genomic contig location: Contig_ID=SeqID_1535; Location=6481..7154; Strand=+
  SCN-specific regions: Sequence locations=1-33,55-445,468-497,522-674
  Gene Ontology: Mol. function=general RNA polymerase II transcription factor activity; Cellular component=transcription factor TFIID complex; Biological process=transcription initiation from Pol II promoter
atgaaagtctataatccaaatgctaccgccataattttctcaactggaaaattcgtatgtacaggggcagctaatgagaaagaatgtacgcaagctgttgagcatgtcacggaacgaattaggcaatgtggctaccaagaggcactaatccataaatttgatgtgaaaaatttgattgcgactgctgatgtagggttccatataagattaggagaactttcagactttcttggtgtaaaatgctgttcatttacccccgaacttttccctggactcgcctacagaaacataaatcccaaaatgtccataattgtcttctcaagtggaaagctaaattttacaggaaacaactcgattgatgatatcaaaattgcatttaatcagttttatccgattttgtacaaatttatacattcaccacaaagggtatgagtcataataatttttgataaaatgtgcattatttgaactttcttgcgctgaagggacaactttagtaaaattttgaccaaaataaatatcagcttgatcattttcaatcattcgcacaagctcaagcggatagaatcgatcgtgcccattcttattcttctctattacacacggattgtttgcataacggagacaaattctatgccgtacataaaagtgctggtcaacggtcacattcttga

SEQ ID NO: 74315 - DNA, 405 bp, Heterodera glycines
  Genomic contig location: Contig_ID=SeqID_1535; Location=5489..5893; Strand=-
  SCN-specific regions: Sequence locations=1-6,190-295,376-405
atggacagtgggaaaaggacaccgggaaagggacagtgggagagtgacactggggaaagagacagcgggaaagggacaacgggaaaaggacaattggagagggacactagggaaagagacaacgggaaagggacagttggagagggacactggggaaagagacagctgaaaagggacagcggaaaaggacacgacaagggtaggatgatgggatttgcgcgagaagcaatagagcgtgtgtatgtgaagaacgaatgttattaaatgtacccaacagaatcattcatcttcatcttttttttgttaatttttatcttaactacttatatatatatttaaattattttttcagttatatattttttaattttatttttgcaatttaaatccgatcacgagttttga

SEQ ID NO: 74316 - DNA, 1450 bp, Heterodera glycines
  Genomic contig location: Contig_ID=SeqID_1535; Location=6425..7874; Strand=-
  SCN-specific regions: Sequence locations=1-307,329-362,394-433,455 -587,611-651,673-873,898-927,950-1340,1362-1450
atggacacagcgacgataaatcggattctaacaatgaacgaaaaaacaaaagaacattatttaggatgtttcccatgcaacaaaatacccctaaatatcaacaaattcccatcagtattagtggcgaacaacgacccatcaaataaggaaggaacgcattgggtttcaatttttatcaaagattataagaccgtgtactactttgacagttttggacgtacacctaacaaatgtattgaaaaatttttaagtcaatttaagactgtggaaggtaataaaactcctatacaatcaattattagtgagaattgtggatatttttgtatttattttgtatattgtatgtgttcaggaagtgttaattttaaaagtacttttttaaatctattaaaaaagttaatgatagatacaatatgatcccgacttctttgttgtaaattttgttaagaaaatgataaaaagtatttaaggaatttttcattaactcatttataaaaatggaccgattagacacaataattgcttctcttctgaattgcagtgcacgtaatttatgcgatcgtctaaatcatcctgatgaaattcaaaaggttgaaaatttttctcaaagataaaactctacaaacaacttataaaaaaatcaaattggagaacataaagaatttatttatggcggaattacgaaggataatgctcgcaagcaaatggcgtacaaaggattcaagaatgtgaccgttgaccagcacttttatgtacggcatagaatttgtctccgttatgcaaacaatccgtgtgtaatagagaagaataagaatgggcacgatcgattctatccgcttgagcttgtgcgaatgattgaaaatgatcaagctgatatttattttggtcaaaattttactaaagttgtcccttcagcgcaagaaagttcaaataatgcacattttatcaaaaattattatgactcataccctttgtggtgaatgtataaatttgtacaaaatcggataaaactgattaaatgcaattttgatatcatcaatcgagttgtttcctgtaaaatttagctttccacttgagaagacaattatggacattttgggatttatgtttctgtaggcgagtccagggaaaagttcgggggtaaatgaacagcattttacaccaagaaagtctgaaagttctcctaatcttatatggaaccctacatcagcagtcgcaatcaaatttttcacatcaaatttatggattagtgcctcttggtagccacattgcctaattcgttccgtgacatgctcaacagcttgcgtacattctttctcattagctgcccctgtacatacgaattttccagttgagaaaattatggcggtagcatttggattatagactttcataattacagcatgaattttacgtggattatatttagtggagggtgatattaaataaa

SEQ ID NO: 74317 - DNA, 1737 bp, Heterodera glycines
  Genomic contig location: Contig_ID=SeqID_10999; Location=2148..3884; Strand=-
  SCN-specific regions: Sequence locations=1-52,74-114,136-1737
atggcgacgaaggaagagctcaaaattattctggaagcgcagcaaaaacagtttttggatttaatttcaaaaattttgcctaaaaatacggcaccaagtgccagttcttcggacctcttcagtcaaatcaatagtcaacttccccaattccattacgaccccgaggcagatgaaacattctcactttggtgggatcgttttggacaatttgtcgagaaggacggtaaggatttgaccggcgacatgaaagtgcgtttgattttgggtaagctatcggcaacggattatttgaggtatgaacagcaagttcttcctaagaagcctgccgaaattgagtttcagcttacgatttccactcttaaggcattatttggtgacactaaatcaatttttgtcaggcgcttcgaatgctttcagctgtcatgtggcctcttgcaaaatgtcatggagtttggtgccatggtcaatgctcgctgtgaacgcgccgacatgactctgtcaaaggaggaagtcaaatgccttattttcatcacaggtttgagcgacgcgcacaaagaacttcgacaagagtgtctccgccaaatggaaaaagcgcgaaaatcaacgccgccgaggtccatgactttggaagcacttctggaagagtgccgctccatccaatcgcttcaaaattcggccgccgctttgtctggtcccggacaagttcattcagtgcaggtccgaccgcaacgagtaagcgatggaagtaagaagtcgaaccgaggtaaaatggtcaaccaaaagggcaatatttcggttccaaattcgaaagagtataattttcctttcaattcgaataggaccgatgaagatcaacagcaaaagtgcaagcgatgtggtcaatttcatgtcaacgactgtccttatgcagaggatgtgaattgctaccgctgtggaaaacgtggacacatcagacccgtttgtcctgaacgcacgcagtcaaacgctgtcactgtggcctcaacattttgtgttactcaaaagtgccacgattggatttggacgcatccactgatcaatggtcatcctgtgaagcttgcggctgacacctgctcgcatctgacgattattcaggaatcactttggataagtttgggaagtccaaaattgagaagtcaaggtaaaaaagttggtagtttttacgggcataaattgagtttgttgggcgaatttgattgtttggtgaaatttaaaggtgttgaatttaagctcaaatgttcagtagcaaacaccggagctccaaacatcatgggacttgattggattgtaccgattgagaaggccacgcaatctcccatcgcgacgacattggatttgtcaagcgccccaacaaaagtcaacacaattgatgaacgtccctgtcatttcaaaatcggtgacactgttcgtgtgttgaactacggaaaaactggcaagtcaaattggtttgaaggcaaaatcgtcgctggtaaaggtctgatttggaaagtcaaaattccattgttgaatattactgtcaagcgacatgtaaaccaaatgcgttcttttgtcccttatcaatcagaaacgacgtttccgaatgatacaattgagcaagttccgcaacaacaaagtccttgccaccgctctgtcgcgactactccgccgaccaatctcccagttcaaccaacgcaacgtcctcagagacaacgccgtccgccgatacgttattcgccgtga

SEQ ID NO: 74318 - DNA, 855 bp, Heterodera glycines
  Genomic contig location: Contig_ID=SeqID_11000; Location=1217..2071; Strand=+
  SCN-specific regions: Sequence locations=1-855
atggagcgacacgacgacgaccaattcaacgaaaacgcgaatcagggggatcctcccccctctgatcagcaggacgagaggcgagcgatcggagctcagccagccaagcccaagacagtcttggaagcgcacggacttgggacaagccaaccgggtgttacacccgccgtgacgaagaatttgcgtagcggactaatcgcagtgcggtcggcacgggaccaaatcgaaagagcagcgggcactcttgccgcgcgaatcgtcgaagcgcgggagctgatggacgacgattacacaaggggcgaagcgctcgaacacgctgctcggatgatggcaatggagcgggggctcggagaagtcaagcgaatttttgaagggcattttgagaagggcatagccgaagcgggtgcggcacctgatgaacggcaggacttcttctatgattccattgccgcccctttgccagctgcaacgaaataccttcgactgcgggagcacccaactcccgccgaactccttcaaattgcggccgagcacctcggggatctgcgagcgatgcggcaaacattcgaggacgaagaaagggagagcatctcccgatcgagcagatcagtcgagaccgagaacaatcaggcggaggaagaactcccacgtgccatgccacgacggagcatgcaagagtgggagacatcgttcagagaagcttatgttcgacagcatgacgaactgttcggccagcagcaaccattggtcaaccaagctgaacgggtggccacacccgtaatgtcaaacctggccgcgcttatccaacgacgctcaaatgctccctcggtggccagtgttcgtgtgaacaatccg

SEQ ID NO: 74319 - DNA, 1044 bp, Heterodera glycines
  misc_feature (1012)..(1012): n is a, c, g, or t
  Genomic contig location: Contig_ID=SeqID_11001; Location=208..1251; Strand=+
  SCN-specific regions: Sequence locations=1-93,115-1044
atgccatcggtcaaagcaatcgaacagttttggtcggttgaagcgatcggaattcgcgacgacccaacacaagacgccgacacggaggcgatcatccaatttgaacgatcagtgcggcaacacgacgacggacggtacagcattcggctcccatggcgggaggaacatcccgagctgccctccaattatgcggtggcttatcgacgactgatcgggctactccagcggcttcagaggacgcccggagtcctcgagcagtaccaaggagtgatcgaggagcaattgcgggctggcgtgattgaggaggcgacagtggggacgggaagtaccgagtatttcatccctcatcaggccgtgatcacccccaagaagctgagggtggtgtacgacgccagcgctcatgccaagggagttccctccctcaacgactgccttttgagaggccccgtgtggctgccagacttggccggaatgctcatccgttttcgggcatgccaagtacccgtactcgccgatgtggagaaagcttttctgatggtcggcattgaagaagctgaccgagaagtgtgcaaatttctgtgggtgcgcgacccacttggaccattgacaacggccaatttggtgccataccggtttcggcgattggcgttcggcctgacacccagcccgttctgtttggctgcggtggtacgtcaccacttgcgcaaatacaactccgaatttgccgagcaactcatccgggatacatacgtcgacaatgtgttaattccggccgacaccattgaggaagcgacgacaaaggcccaagaagccaaacgaatgttcacggacgcaaaaatgaatcttcgggagtttctgacgaatgaccaagggctcaatgacagcttttcggaagccgacgcgctgggcaaaacgacagcgaaagttctgggactggagtgggactcagtggacgattcaatccaaatttccttcccgggagttactcccgagggagagtgccgccaaacanggaggacagtcctcaagaccattgcgcgactg

SEQ ID NO: 74320 - DNA, 352 bp, Heterodera glycines
  Genomic contig location: Contig_ID=SeqID_11001; Location=1..352; Strand=-
  SCN-specific regions: Sequence locations=1-31,53-352
gaatgctgtaccgtccgtcgtcgtgttgccgcactgatcgttcaaattggatgatcgcctccgtgtcggcgtcttgtgttgggtcgtcgcgaattccgatcgcttcaaccgaccaaaactgttcgattgctttgaccgatggcatttgatcccgctcgtcctccccacatggggggatcgcgaataccgacgaatcgggagtaactcccgtcgtggtctgaaactgctccccgcaaatcacagtgccgaagacggtgtcgatcagataagtcccctccgccgtcttccgaaatccttgtacgaagtcccaaaatcgccgtattccgatcagcagctgcggttgcactgtgtc

SEQ ID NO: 74321 - DNA, 3368 bp, Heterodera glycines
  Genomic contig location: Contig_ID=SeqID_11003; Location=43..3410; Strand=+
  SCN-specific regions: Sequence locations=1-496,518-891,913-1465,1487 -1701,1724-1947,1969-2015,2038-2040,2102-2163,2185-2204,2294 -2577,2656-2675,2754-2788,2810-2956,2993-3191,3213-3228,3267 -3313,3366-3368
atgatctgctcgccgccagctcgtcaaccagcagcagcaaccgattctgtgatgggcgtgaaatttttcatgtgccgcgtcaacgggggggcggctgatcaacgacaatatgttttcctggcggatgccatgcgaaatgatgatgccaatgccaatttgaatgatgctgcattggcgaaatgttttgtgcatttttacaccgtcaaaacggacaggaagggccgctttttgttgcgatcggacggcaaactggcggaccgttcttccatcttcaaccagcagtacaatgtccatttgatcgcattgaatgacaattccgtaagcaacattaaaattaattagggcgctagttcagctctggaatatggttcgtccttgttttcaagggcatgcattaaagcgggtagacgggggcaactgatgaggcttccttccgtccttattcacatagggaatccttgtaaaggggaactcatgtttttcgtccttatttttaagggctagcttgaaaaagaaagaggttcttgaacaggttcagcagttgtaccgctccggatgcgggatgggaaagaggggtgggaccgattgtgtttcggtcaattggtgagggaaatgggagtggtcaggtaataaaaaactcagaaacacaattacggggacaaaaatgaatgcttacaaattagtcaagatgtaacggagttgaaaagaagcggagagaggatgaagagaattgttgccttacaaattggcggcacttcgtagtcaaaagtcgtctgctgataaacactttgttgatcagaacaaattaaggcgattttgaagaacaatttattttttttaaaacacggagagaggaagacaaaaaaatcggagaaaatccagaacaacgacaaaaataataaaaatatcaaaacgaatatgaaatttaaacacaaaaataacgcgaaaagtcatcgttttaaaataattaaattgtgatcccagtacgcggcaagtgaatcgtcgtccttgaaaataaggacggagcgtgtccttgttgaattgtgaaaaaattggctgaattgtggccgtaccaaaattttcatagaatgacgtcctgaagaggaaggacatgcttgtcttatgtttgtcattatacgaatcgaagttcctttttctcgaaaaaaaattttatttaaatgtttcgtcactttcagtaattaaacgctgccaaaatatgcagggtttatggctcaaaaaacaacaaaatagtaattaaaaatgaaaaaaattacctaaaatgctaatttgtgaggtaatattgttaagaaaaatttttcgtaacttcataatagcacctaaacaatttttcgtatgtttaagaccaatcagaactcatgggcagggttccatctctaaaacatcaaaacataaaatccggcacacaaagttgaaaaacccggcgaaataaaaaaaaaccggtaaagcctggaacaacccccaaaaacctggcaaattcggggtttacccgatcaaatagcaaccctacctggcaaatgcggggtttacccgatcaaatagcaaccctacctggcaaatgcggggtttacccgatcaaatagcaaccctagctggcaaatgcggggtttacccgatcaaatagcaaccctacctggcaaattcgggggtttcccgataaaatggccaaccctggctcaggaaaaaatagataaattcttaaaaatcttttattaccttccaacaaataaaaatttatccttcaacaaatttttcacacctttttgaagcagccaatcgttgatgatgtgtcatatgcggcatctaccaaagtggtggcacaacgtgtttatgtcaatgacatgcgaaactcggtggacacaatatgccaacatattgatgagcgatgtgtgatcaatttttatccgacgggatatgatcgcgagaaacaaatgaaagaaatgacaaaaagatggctgacagatcagcagcattaccaggaaatgtcggaaatggtgagattattttttaatgttgattgacttaaataatacaaaataattaatataaaaataccaaaatatttttgaaaaaatatttttttgcgtaaagggtcaggaaaagccttctattagcttataaaattaaaaaatcgaaagttatcctcaaaaaacgaaatgcttgacttaattcaaattttggcatcctaattactttaacaattaatttttaaataaagagcaattgataattaattctttcactaattgaattaattatgcaattaattattcaaggtaaatttcttcctaattgccgtttttcgcgaactgattacaagtgccaaagagaaatcggcattaaacgttggcacattgacatccaatgaggcccaattaattggccatttttggaacaaatttgcgagcacaaaaaagaacggactgttgcataaacgattgagattgatcgatcaccaaatggtgcgactgatcgacgatttttgtaaaatagacgactcatttctgcgatcacaccacgagttgaaaagtgctttatcagtgcgtttatatcaaattcattttattaattgtttttaattataaaatgaaaatcaataattatgataataatcattgtgttaaaatatttattaaaggaagtgtaataaaagtttcataaaattctaaaaaaataaatcaatcaaaaaaattcaaatttttgttatctttatgaaaaaagtaaattaaaaaaatggaaaattttcaaaatctacttctataaaagtttcacattttataaaattcattttcattttaagctaagtgaaaaatttcaatttgcctgtctttattattcataaatttcaaatttattttaggccttattttccatgaaatcttatttattattttggaggctttttcaaataaaaagtcaaccccaaattaattggtttttgaaattttattttgcagttaagcaatcagccagaaaaattttgtgaaaattggccaaaagtcaaagaaacatcgaataaatatacaaatttggacattgtaatggaagcatttggccattggctgcataccagtgaacagcttaacaatgatgaggaaaatattatctttttttggattgaagttttctcgaagcggcttcaatcaaggtgttataattggccgtttcttgaccaaaatttgttcaaagaaattggtaattttttggatgattaatttaacaattattttaaaaaaatcatttatttagcatgaggaccgcaaaagaaaaattattatttttgatcgttttttgctaaaatttttagaaatcatataattaaaatatttattaatttttgtaaaattcaa

SEQ ID NO: 74322 - DNA, 625 bp, Heterodera glycines
  Genomic contig location: Contig_ID=SeqID_11003; Location=3520..4144; Strand=+
  SCN-specific regions: Sequence locations=1-6,28-219,270-421,444-625
atgatgtttgtcacagtaaaagatgaacataaattgacattagacaaaattgtacgaataaaaaacattaataatatgttggacaatatttgtagaaaaattttccaaataagtgccaatgagcaattcaatccagtgccgtggaaggaacagctttgtacaggaagttattttcaggtaaacttaatttttctgatcattaatttttcgagtatttcgaaatattatttcaaaaagttaaatatgtttttatattttgaaattttattccatcttccagaaaaaaatttcgtatctttttttaattatgccccttaattcctttggaaatccttgtctctttaattaatccctttaattaatttgcgatacggtatttcattaataattatgcgtaatacaaaaatttaaatttgcaaatatcactaaaattttgatttcacaaacgcaattttttcagcaaaaattaaaaaaaagggtcaacaattttgataaatgttctgggttttatgtttggaatttcaaatgcaaattttagaataattctcggtttaacaaaaaaaaaataataattccatataattacactcctaattacagacagtctctcctaatgatcttagaa

SEQ ID NO: 74323 - DNA, 324 bp, Heterodera glycines
  Genomic contig location: Contig_ID=SeqID_11004; Location=1367..1690; Strand=+
  SCN-specific regions: Sequence locations=1-153,181-226,248-324
atgtccaggatctccatcgcaagttacgaagcactgcttgccgagtttaacaagcaggtgatgtcccagtgccatctgagcgcctctacggcaaagtctgagcacatcagtgctttgatagcgatgcgaaatgccgcttccgctggacacaaccccacaaaagcacaccaaacaatggcagcaaaaaatgcacaacaaagttcgacgacagcgacagctgctgagcagccatctcaacaacaacaaccgcagcaactgtactcctccaagaggccgatgactttgctcaaaatccaaccacctgcaccggccgtcaaagcataa

SEQ ID NO: 74324 - DNA, 1996 bp, Heterodera glycines
  Genomic contig location: Contig_ID=SeqID_11005; Location=334..2329; Strand=+
  SCN-specific regions: Sequence locations=1-296,318-439,461-518,540 -870,892-1593,1643-1996
atggcagaagagacgcaaagccaccgggaaaagacgacgaggggaaagtcgcaggaaaattcggaacggggacgatctgcgaatgtaagacaagtcagaagcaactcatcatcgagcaacacgtcgacagacacatacagccaggtgggtatactgctctaacaagtcggaccatatgtcaatcattcacttcaatagatttgtttacatattttttttctgctgcgtctctgcaccactaacaatgaatccccatttcagaaatttatacaaaaaagaactgaaatcttaatctgactacacatttaaattgtttattcttatttcaacataaattttttcgtttttaagtctcctcggaagcgttggcgtcatcctccacaaccgtcggaattcaacgaattttccggaagcagacacaaaattacgacaaagaaaccagcaccagaaacaaagcacaagtgggaaagaaaacatcgctctcagagaagcacagaacggagaagggaaagtcgcgtggagaaaagagagaaacggcgcgagagactgcggtcgcggacacgacagacacttggggtgggcagagagagggagagatagcctttgacaatttaccactttaattgacagaccgcgagacgaacagagggcgaaaggagcggagagattgcctcaggcggagacagaagcaaaaggggcgaacacggcggaggaaaaagcacttcagacgcaaacaaacgtagcaaaacgaccagcaaagctgagaagtacaaaggccgatcgaacggtaagccaagaaaagctttgtcaatttccttgcttgcattttccaatttgactttaaaaaagaaaggaaatgcgcgaattttttaaaatttctcttttgaatttaacatcggcgatttaggacaaatcgaacactttgcttgatattttgtaacatattttagaaagggtacacaccaaaacctcctccaacagcaacagcagcagtcaattgctccctccgccgcctgtgcctccgcttcgaattgataaaacacacgaccaacacaaaaggcgtcgttccacttcctcatcctccgattcccactcgtcctgcacatgttcctcctgttcaaggtccacccacaacttttatcattttcctccattttagttttacttacatggtttaacagtaaccctttagcaattcgtcatccaactctcggaccaaattcgttgtcggaaaatagtgactccgagttgagcagttctgagaatgaagctgaacaggagcagtcatcaacacgacgcagtcatcggagcagaaaggatgggtttgtttcaccaattgtttttgtttcgccaattgttatgcttattggtttagatttaccgacgaaccttcccaagtcgacacccgacaaccatctataaaaagagagacaccgaatgcacaagctgtgcacattaaaagcgaacaagtgccattggtcactccgattgagtcaacgacaattgtcactaagaatatcgtacaaaatgctggtaaatgagtaattgttggatatcttttttaacagcattcttttagaacgcggaaatgaaaaaattatgcaaaatgaaacaaaggaagagaacacagagaaaagcaaagacacaaagggggatgaacagtcgaaacagaaaaaccaaacggcgtcggaaaaggacgaaacggcaccgaaaaagagtactgatcaatccatgggaatttgactatggtggggaaatgctctgagcaaatttagcaactgccgttgctccatctttgcctgtgcagccaccgcaaacggttggaaaggtccaagtgccaaggccatcccaacggacggtcgtctgcatcccattggatgtccaatcgacgtcatcaccacccaccgatccgcgacaaatgcgtccaaaacagcaacgaccaagcgctgttacggagtcaataatgtgcttggatttgccacgctttgtccataaa

SEQ ID NO: 74325 - DNA, 822 bp, Heterodera glycines
  Genomic contig location: Contig_ID=SeqID_11007; Location=245..1066; Strand=+
  SCN-specific regions: Sequence locations=1-22,44-109,140-145,295 -297,334-565,627-714,736-822
atgatggctcagaatcaccaagcacacagggattctgaggccttaacgatgtctaaggtaaaacctgatcacgtattcgtgatcagcggcccaaataaccatcgaatgcatttttatttaaaaattttttaataaaatagtctttattaattaaaaacacatttaaaattattaattgaatatttattaatttgaattaaattaattttttacaaattcaaaaataaataatgaaattctttaattaaaaaaataaatttaattaatttaaaagaaatcttcaaattaattaaaaacggtgaaaataacttaaaatgcatagaaaaataatatacgccgtccggattcgaacttgccacccccctgctcaaaatgatgccccagaatccccaatcacacagggattctgaggtcttaacgatgtcaaaagtaaaatctgatcacgtattcgtgatcagcgtcataaaatagccctaatgacatgtttttgaaagatttttgatgaaaaaaatttttcactcaaaaatcatgtgcacccccctttggtctggaatcccaaaatcacttttatttttataacttttttctaataatttataaaattgtgaaataaaatttatataatagagcaaaaaattgcggatttttatagcattttacttttcgagaaagacctttcagaatcgagttctgaatttttttctgaaaatccgaatttttccagaatttctggaataacttttttcatatttatgttagaaaagccaaatataacccataaaattctcctgatttttctctatttttaaagctttaaaacaa

SEQ ID NO: 74326 - DNA, 1042 bp, Heterodera glycines
  Genomic contig location: Contig_ID=SeqID_11008; Location=252..1293; Strand=-
  SCN-specific regions: Sequence locations=1-128,151-896,918-1042
atgtcctggcccgaaaatcgtgtcatgaaatatcacaaaaaaagaaatgtggtgcataaaaagcacataaataggggtaaataaaaacacataaacaaaaaataatcaattaaattttctagtcgaaattttaattttttcaaatttgatcggcttgagtaaagactttttccaccagtgtattccttttctattgaatttaaaaatcccattggcacttggtaactgagcaagaaaaggtgatgaaaagttgacaaattatgtttgcttgggtccggggcccggaattggcctcaatggaagccgacgtgatcaacgacctcgaaaactccaggaaacgtttaaaataattttgcattttttttttaaaaaaggggacaaattacagtattatgtaccaaaaacattatttgttgtaccatttgaacgcaaatgcttaatttctgagcacttgatagactcagataagtatgaaaaagaggggaggggaggcttaatcagccgacaatcaaagcgaacatcacaaaatgggccaaaatgaaaagccgtgtcgggcaaaatttgctcaattttggagttccattcgttggcgaacaaacgcatgggacggaacacggacgaacacatcctgaaaaaatgggaagaaaacaaaactgacattttgtactcctcaaactcaacctgtggtggaaggcgacggttggggtggcccttcaaaatttgaaattgcaaaaggaaatccaaaattggacacttacaattggtcggatagatttggtaagacggaattggggtgttaatgggggcagggttataagtgcggtaggacggggagggcggaggggagggaacggtcgcgtaatgagggggctcattagtgtaatgagctgacaaatgagcaaaacgattaaggaaaggcaatgaatgccgagttaccgcgggaaagggcgaagaaaagtgttgggaaaagtgtgaagaaattcaaacggaacatttcatcaaagggacgcgaaatttgggaattaaatgtaagagaaataaa

SEQ ID NO: 74327 - DNA, 503 bp, Heterodera glycines
  Genomic contig location: Contig_ID=SeqID_11009; Location=204..706; Strand=-
  SCN-specific regions: Sequence locations=1-45,70-149,171-503
atgggaacaaagtcgagaaagtcactgaacacggaaaatgaggggaaaaatgaattggaaaagggaaaagcacgcgaaaatgttcaatgggagagtgaagagcagacaaaggtgggcaagctgaataatgaacacgacggtccttttccaactgaaaaccatcaaaaaggcaatggcagaggcaattgtggcgactaagcaaaggaaaaggacggggacagactgaaaaaggaaaaaataaataaaatacgaagaaaacgcacgagaagagaagtgtcagcagaggaccagagaaaggcgaagtcgcatttggcagcgtaaagccaattccaaaggaaagtggaaaagagggcacagagaaagacgtggccgatgacagtgaccatcttcaaaagacggaatttgataagggaggaagaaagggcagaagtacgtaccccggtggacaattcattgtcagaaacgaaggaattcaagaaatgatccatgaagaaattaaatga

SEQ ID NO: 74328 - DNA, 643 bp, Heterodera glycines
  Genomic contig location: Contig_ID=SeqID_11010; Location=1093..1735; Strand=+
  SCN-specific regions: Sequence locations=1-7,29-35,78-188,224-313,335- 356,390-407,429-643
atgggggtctgggtgagaaaggagaagtggaggagaaatttttgaaaaaaaaattaaattatttattttcatttaaagcatttgttcatatgcataagtggtcaagtggctaaaccttctgattttattatttgtcgcttgggttcaattccccactcggatagaatattcttcatattttctttaccattattttaattgaaattttaattaaaaaaatattccaactttttttctttcattttaagcatcctaaaaacccaaaaattaatcaattggtctttttttacaaattctgttaacaaatcgcattaaaaaatacaaaatttttcccggcggcgcctatcggcaccgccggccctcctgttcccaaaagtcttggaaaaaacgtgccgcgtaaaaagcggtcttgaaagcaaaaaaggtcattgatttacattaatttacatggccggagaccccttcgcaaaattggaaaattggctgctgaccccttgttttgcaataatctgaattttgaggtctacatctgaattttagtgttctttatcctgaatttgaaaaaaaaacttggtcaccctcaatatacatatacttctgaacaattctaatgctaaaaaacaggcacttgcgcgaaaactga

SEQ ID NO: 74329 - DNA, 1188 bp, Heterodera glycines
  Genomic contig location: Contig_ID=SeqID_11010; Location=2121..3308; Strand=-
  SCN-specific regions: Sequence locations=1-44,114-305,355-677,699 -723,745-867,897-914,936-1188
  Gene Ontology: Mol. function=GTP cyclohydrolase I activity; Cellular component=cytoplasm; Biological process=neurotransmitter metabolism
atgctttattttacaaagggatacgacgaaaactttgatggtaaaattaacaaataaaaattagattaattattgattaagaattaattagaattaatgattgaattaattaagatgtgctgaacgaggcggtttttgatgaagacaccgatgaaatggtaaattcattttcataaataatttaaacactcgaatatttattcattttttcaggtgattgtccgtgacattgaaatgttttctttgtgtgaacatcatcttgtcccttttcttggcaaaggtttaatgggcaataatttttagagatttttaatttatttaattttttaaatattttacgatttattaatttttctttgaatttttcagtccacattggataccttccaaacaaaaaagtgttggggctcagcaaattggcacgcattgtcgaaatgttcagtcgacgtcttcagggtaaaaacatttaaatcaaattgttacatttaaattactctatttttaattaaaattacttttttcagtgcaagaacgactgaccaagcaaattgcttcagcaattctccaagctgtgcacccgacgggcgtcggagttgtgattgaagcgaggtgaacatatatatttacattatataacggactttggggaagggcacacaaaattcaagacggcatttgtttgctttttctatttaaaagcaattctcgaactcaattggctatacaaaaccaaaaaccatatttttacgctttaaaattgagccaggtttaattcatgtgagatttatagatttttttacaaaaaattttccaagtgtaaacttatgcaatgctttagtatgatatgaaagttgaaaattgaggtgctttttaaaaattaaaaatgtaatttatttgcacaaattatgtcgctattatttttcttggggaaatttatagcttttttggttactcaaatttggatatatattatattgtttgtatgaattcccattcttcagccacatgtgcatggtgatgaggggcgtgcagaagatcaatgccaccaccaccacctcgtgtatgatgggcgtttttcggtaattttttttttcaaaaattcagaaaatttattgttttagtacccccttatttttcagcgatgatccgaagacgcgcgaggagtttctcactctgatcaaaaaatga

SEQ ID NO: 74330 - DNA, 443 bp, Heterodera glycines
  Genomic contig location: Contig_ID=SeqID_11012; Location=183..625; Strand=+
  SCN-specific regions: Sequence locations=1-16,38-130,173-178,237 -407,429-443
atgtgtgtccggcggcgttcttttttgtgctcccctcaaaaaatatggtttttctcgttggatgttgtaaaagtaggtaatcttttttttacaaaaaaaaggtaaattttttatttggaaaaattggtaattttttttcttttttttgaaattttttttttattatttttttggaattaaaaaaaaattaataaaaaaaattagaaaaaaaattaaaaaaaataataatagaaaaatttattttttatgtcggcaatagtgaagattattggtcccacaaataaaaatttaaaaaaacatttttaggggttatttgatgcgctgagcacgaatatgacatccatttcgaccaatttcgaaccaggaccggaatacgaacaaaaagtcgaatactcaatttttcaatttcgcacttattctacaattgattaaaactagcagaa

SEQ ID NO: 74331 - DNA, 712 bp, Heterodera glycines
  Genomic contig location: Contig_ID=SeqID_11012; Location=1013..1724; Strand=+
  SCN-specific regions: Sequence locations=1-399,422-434,456-712
  Gene Ontology: Cellular component=TRAPP; Biological process=ER to Golgi transport
atgagcagcacgaccagtcgggagtattattttgtgattgttggtcgtcaggaccaacctctgttcgagatggacttcccgccaaagaagcgcgagcagcagcaggagacgcaccatttgctgcagttcatcgcgcacgccgcgctggacattgtggacgagcagacacttcgcgagacgcaaatgtattttaaggtggattattcagaaaaatactctgattgtgagtcccaaaaacgtcgaaaaatcgtttgagcgaattatagttgaaaataccgataagactgatttatcaaaaatttttggttttaatatcgaaatttcttacgcctaagagcccatttccagcattgttcactttctatccattccccaacctctatatttgattgtttttttcatttttattgtcatgatgccattttcagattgtagacaagttcaacgaatggtttgtgtcggcatttgttactgccagtagaattcgctttttgatgttgcacacgcaaaaaaatgaagacggaatcaaacaattcttccaggaaatgttcgtttgttgtcattgaatttagcgaaaattcaaatatcattcagttatgagatgtacatcaaattctcgatgaaccctttctatcgacaagacactccgatcagatcgccaagttttgagcaaaaagcggcgatgtatggacggaagtttttaggggtttaa

SEQ ID NO: 74332 - DNA, 1559 bp, Heterodera glycines
  Genomic contig location: Contig_ID=SeqID_1537; Location=1046..2604; Strand=-
  SCN-specific regions: Sequence locations=1-90,118-284,330-464,486 -1002,1056-1221,1249-1418,1440-1559
atgttcacgccaaatgtgccgtaccaaacccatttgttgcaatcggtgccatactcatccaccgccgcccatcaacaaaaccaattctcctcacccgctgctgctgctgcttggacaacaacttcggcttcttccgccgggatttcccgatggagtcaacaacaacaacaacaaaataatgagtccctaataaggtaaaagtgtgtagcagtaaattaaagcgcaatttgttcaccgctaattgtcttaacccccaatcaaagctaaaaaagcgtcaatgatagtaataattaattaattaattaaatttaataattattttattttttgtttgcagaaaaataaatcataaattaactcaaacttgttagttagtgttttatgaattatacaaaaatttatgcacatcctaacgctcaataccaaaattatcattgatccgtgcggatttggagttcggaattagtgagatttaattcttccttttcctctacaattcctagaccggtctaatggacgcctcctccaaaccagggatggcacggaattccgatttccatcttccgaaaatttttggagcctcggcggaatgccatccctgctccaaaccctaggaaagtaaacctaggcaatggtttacggaaacttataatttttgccaccagaaattttgaaaaaccactttcctcccatttcaaggaagcatcgttcgctggagggtgttcatcaactgttggcggacaacccgtcctgttcctccgcgccttccatgttcccgccgccggcaccatccaccgtagtacaacagtttagcgagtcgctaccgtcctcccactgtcaccataatcatctacagcagcacaacattatgccacaaaatttgaatggtccaactatgccaaatttgaatggaccactaccaccatcgcttcttcaaccactgctccccgccgctggtggaccatcgccttattttggcgcctctggatatgctcatgtgccacaaccaacaacagcagcaacaacggcaccaattgcaacaacgacgacgacgaagacggcggcgttcatcaatgattcgtcttctaccgcctcccgtcaattgttggtgtcacaaaaatttgttaggccctatactaaaatcatttattgcacatcctgggatcccggtgttcgggattggcactctgttgaacaattttggaccaggactcaaatcccattattattattattattattttattaatttatttatttttgtaaattaaattgccgatcatgatttttaccaaaatgttgagactgtaaaccagtttctggcaaaattgatccgccattcagctttagccagccaacaacacaacatcatcacagtctatggatgccgtcgtccagcggcacagtgccgcagcagcagggcattcatccatggggaaatgagggaatggtaccaatcggagatgtggaggacggacaatcagccttgcgcattgatgaggatgatgatgtgtgtgtgtgctattttatctttttggactatttttcagggtcgctga

SEQ ID NO: 74333 - DNA, 373 bp, Heterodera glycines
  Genomic contig location: Contig_ID=SeqID_1538; Location=1670..2042; Strand=+
  SCN-specific regions: Sequence locations=1-133,155-310,337-373
  Gene Ontology: Mol. function=transporter activity; Cellular component= proton-transporting ATP synthase complex (sensu Eukarya); Biological process=energy pathways
atgtcgcttcttgttttctctcgtctccgtactcttcctcgtcttgcgccgcttctgacgaacagtccttgtgcactcagcaccagtgccgttcgcaaagacattgacagtgccgcgaaatacgtcggagccggttaataacaaaaatgattttcgtacgaattttttgcattttttaggggctgcaactgtcggagtggccggttccggtgccggcattggcaacgtgttcggctcgttggtcatcggttatgcgcgcaatccgtccttgaagcagcagttgttccagtacgcgattctcggctttgcactgtctgaagccatgggactgttctgcctcaccatgggcttcttgatccttttcgctttctga

SEQ ID NO: 74334 - DNA, 1294 bp, Heterodera glycines
  Genomic contig location: Contig_ID=SeqID_1539; Location=1..1294; Strand=-
  SCN-specific regions: Sequence locations=1-91,113-553,577-579,625 -948,972-992,1026-1294
  Gene Ontology: Mol. function=ubiquitin conjugating enzyme activity; Cellular component=cytoplasm; Biological process=protein modification
gaaaacgaagaatggacacggatgtgctgaaattgtgaattttaccatcaaataaattgactctcacaaattttaggattgaatcgaaccatgaggtggtcatcaccggtggactgaatgaattcctggtaaatgagttgatgaattttgggcatttgctgttgtggacccccgaaaagcatccaaaaagggggctatggtaaatgaattatgctccctaatgaatttttttttttattttcggctcaaaaataagttttatgaggattttcgaggatactgatcgcgaatttgaaccgaatttatccaatcccgcgtctgaattcgaacaaaaattcaatttttttcataaatatgcatttttctagggtaaaatgattcaaattaaagtgccgaattctgtatgtatttttttgtaatttaaattttcaggtaaaattttatggcccaaaaggaagtgagtggttctatatcttcgtacaattatatgctaatccatttcaacaaattttagctgcttacgaaggcggagtttggcgagtaagggtcgatttgccggagaaatatcccttcaaggtgcaaaaaataataaaaacaacaatttatttttcagaaattttttaaatgcctttccacacaatccgtttagtcaccttccattggcttcatgaacagaatttatcatccgaacattgatgaagcatccggcacagtttgtctggacgtgatcaaccaaagttggacagcactttatggtctgtttttttttgttgtggatttttgctttcttttcgggatggacgaatgtaaaaagactcagaaaaccctcccaaaaaggtaaaatcgttgggcctataggttcatgtattttttgtaaatctgcatttttttacgaaaaaccaggtccttggccaatcagaaattggaaaacatggatttcatgcaagcaattttagcatttaaaaattctgtcattatcattggctttaccattatttagaaattccaaaaaagtttcattttttggacccatacaattttttaaacgacttttcaaaaaaccaggcctgtacctagtcggtttggcacgcctgcattttccatgaatttacagaaaatacatgtcaatcaatgttaaatatgaaatccaggtccatgaacttattgaaattgtttagatctttccaacatttttgagtcgttccttccccaactgttgacctatccgaacccagcggatccgctgaacggcgaaacggcttccctgtacatgcacaagccggacgaattcaag

SEQ ID NO: 74335 - DNA, 551 bp, Heterodera glycines
  Genomic contig location: Contig_ID=SeqID_1540; Location=309..859; Strand=-
  SCN-specific regions: Sequence locations=1-293,315-493,516-551
atgaatttcactgattatgagaggaaatttatgcccgccaaaattcacttcatttcactgattggcaccgtccggttcaaagtcaacggtgcacattcgtcctcaaataaaattccatttatctgcgaatgcaattcgcgattttacactcactgtgaaagtgaacttttctgctggcgcaatgctcggcgctcgcaatttgtcatagcactgactttggcacttttggccaccactgagcagccaacagcacttgtgggctggttttttgggggaccggtaaattggacaccaaaggaaaattggacactgtcggaattttggacaccaaaggaaaattggacactggaaaactggacactaaattcctcttttaaaatataaacccaggaatttaaacactcaatatgcacaataattgatcaaatgtggcaaaaaagtgtacaaaattagacgatgattgatcaagatgccaaaaaatgtacaaaattgcgtgatgattgttcaatgtaccaaaaaatgcgcaaaaatgggaactccataaaaataaa

SEQ ID NO: 74336 - DNA, 2171 bp, Heterodera glycines
  Genomic contig location: Contig_ID=SeqID_1540; Location=917..3087; Strand=-
  SCN-specific regions: Sequence locations=1-233,261-279,321-1669,1691 -1712,1734-2171
atgggaaattgcgagtttgagttggggttagattggtcaaatcagatgtgtcagatttgtgatcataaaccctcaaggcccagagaaaaaatgttgcagttacttatacactaataatttaggttctctgacactgcctcggttaattttcctccgtcaagtggccagcccggcggtggtggccctgttgtggtccacggtggcaatgcggtcaactttgctgctgccgctgctcatcagcagcagcaacagcaggctgctggtgacccatcgcaacatgttgcggctgttcatcatcaccaccagcagcaacagcagttgcctccgcaacaaaacaaaacgcttttcacaccggcagcaaacccagcgatggtaagcgcaacgccggccatgcaacaacatttgcaacagcaagctcagacaatcttccaccagacctcagccactgcagtgcctcagttccccagctacaacatgccgtacatgtattcgccggtggccaccgcgcaaacgctgcaaggaccaaatgcggagattgaccgtttcctcatccaacagtatgggacgccgtattcgcagctggacttgcagatgggcgcaatggttggttatactttttggttttttatggtacattatttttcagtcaattggaccaccgacgactttggcaccaaaccatcatcgtgccacattggaatcgtacatggagaacaaatttgggcagcagcaacaaaacggtgggaatggggtttggtggtggtggtcattcatttgtaattttgaattttttgaaaatttgaactttcgactttttgttgtttgtgtgtgagggtcaaaaaagtgctttccttactaaactattataataatcaaaatatgcctcttttcagtcaatcaagcggccaacaatggacactatcaacaaacgcagcaaagtcagcaacaacagcgcggacttgcccaatcggagcaggcaactttgctggggggaccgccaagccatgtgggaccgcctcccggctttggtatgcccaccgcaccgacgcagccatcgtatgtgcagccggccaacatccattcgctttttcaggtaaattaaagtaaaattgtcgttatctccatgcgattagataaatctttggccccatttttccacatttcgcagatgcccacttatccgcatccgtaccagcacccgcagtacatgatgtccaatgccaatcgtttccaagctgcacagcgtcctgcacagacttcgccgccggaggccaatgttcagaaccagcgccgcggtggtggcgatgcgcagggatatgctgggggtgcggtgccggattcgactagtgagcaacattccgctgcggtttcgcaacaatacggcaacaatttcaaccacaaatatcgctcctacatgtaatacggtgcgcgaccaacactacaggcagtctaagaaaatgatggatggatgcctgttttttttttgaccaattgacgatgagtgagtgatgttatgagattttggctaaatgattttgtggcgttatcaccatatgttttcttcttttgatttgaaaaatatttgacaggaaaatttatttgttgtctcttgcattttggtccatttcttgtcttacccgaaggcttttaaagtctctggattttataaattgaaaaaatgagagattggaatttaatatttccaatgcacattttggagcaaatttaaaaaacatttctcgattctggattatttattttattggcattatgataatcatggaaaatagaatggaaacaatgttggtcttttatgctttgcttcattcattagttgagcttttccgttccgttgtttcttgtctcattcattaggcccaatttgagtaaaacatatgctggcaccaaacaattctcgggcttgttcaattccacaaggctaaatcactattaaatgtgccgttcacccgttcgcttactcggcacagtctctcagcgggtcaaatgtgcgtccgtgccgtgccaccgctgtcgttgcccaattgttgtcccaccagtgcagacacgctgagaaacagctgtgcaccaccgcctcgcggtccgtcaggcagcaaaaaaagaaaaaacatcgactttttgcaaaaaacttgcaggaaaatctttaaaataaa

SEQ ID NO: 74337 - DNA, 810 bp, Heterodera glycines
  Genomic contig location: Contig_ID=SeqID_1541; Location=158..967; Strand=-
  SCN-specific regions: Sequence locations=1-259,281-475,510-810
ttcggctgggccgcgtgttcgcactgaacgtcagggacagggattcaaggggcaaaaccgcacttttaccgccggaggagcgtatcgacgtgacaatgttgcagcgaacaagcagaccaccaacaaagttgtgggaacgggaacaaacaccggcgacttttcttcaactgttgagcaatcttatggcgaaacagcgggacacgaaaacgacgaatgggtttgtttttatgcaataattacgggtattaataccaaacaattaaaacttgtagaaaaatgggcctcgtgtgtttatgccatcttcggctgctactgttgtgatggcggaaacatcgacaaatggtggtgtgaagtggcccgctctggacaactttacgccttctgttgagccggctgaacccgccgcggttcacaagccgaaaacatttgccgctgttgctgcggctaaaaaggcatcaccacagccttcacctccacaacatcagcaacaacaacagcagcagcagacaatcacatacgaaagtcgggagccggattggacgaaagaaaattggacaacggagccgacgaattggtcgtcagaaaattgggcatcaaccggcaaattggaaagcaccgaaatattggacaacccggaaaaattggataccaccgaaaaattggaaaacaccgacatgttgggcaccgctggcaacattgaagctgccaacaatttggacacctctgtaatgctggacaccagttgcaaattggacacggccggaataatggataaccattgtgacactgctggaatggctgacaccaatg

SEQ ID NO: 74338 - DNA, 496 bp, Heterodera glycines
  Genomic contig location: Contig_ID=SeqID_1542; Location=165..660; Strand=-
  SCN-specific regions: Sequence locations=1-215,237-496
atggagcttcaaaaacagccagtcatggcaacaaaagaacagttgcgtctggctgaactcacccagatagggcatgacgctacaattgcacatgatgacattgctgagcagaaacctgtcaaggtttcattttcagtaaagttggacctggctttttcctggacgcatgtccaatccgtttttttttttgtaatctgggtttttctgggtatgtattctaaattattgtccaggagttgcaagattttctcctgctagatttggatttaagggataaagcaaaaacacgtttaatggttctaaaatggtgtataatgaatagatatcatcattttttaggcaatcaaatgttttactggtcccaaaattttttctttttgaaacttttctgtaaattcaaaaaaacacggttataggggtgtttttggacgctgagtatgaacccggcctcctttttggccaattccgaatccctaacccgaattcgaacatttaa

SEQ ID NO: 74339 - DNA, 726 bp, Heterodera glycines
  Genomic contig location: Contig_ID=SeqID_1542; Location=1555..2280; Strand=+
  SCN-specific regions: Sequence locations=1-62,101-617,639-726
atgagaaattttcttcttttactatgttttgctataattttgcaagttctttgtgacgaacatgaccatatttacaagtgaaagataatttatcctaattaaatttttcgatttttttaagtccaaatgctgaagttgtgctttggatgaatacggtgagcgcaattattgtgttgttgtctttaatggttatgattttttaaaggttggcccgtacaacaatcgtcaagaaacgtaggtcctaaaaatccagaggagggttttatgggtgggtcgctgatcacctaacattcattttgaccattttcgagtccctgacccccactcgaacaactcttgaaaaaataaacaaattcccaataactattggtcataattaatgtcctttgttttagatacagttatttctcgctgccattttgtcaagtaactttggacacaatcagtcattcaaactttttcaaaaaaaatttagggttacaaaaaaacaattgagcattaccatgagactttgggcgaagcactgctcggtgttgagttggaattttccggtttggacatacgcttcaccgttgatcagccaaaaacggttgaacaaaaaaaaacaaaatcgccaatgattagatgaattaatttatattccattattttctcaggagtattgcaacacgaagctgactcctaccgacatcgacgcactgatttttgcagttgaacacaattatt

SEQ ID NO: 74340 - DNA, 106 bp, Heterodera glycines
  Genomic contig location: Contig_ID=SeqID_11016; Location=250..355; Strand=+
  SCN-specific regions: Sequence locations=1-106
tgacgaggccgagagtagcagcaacagcgagagtttggagtcgggattgccatgtgtggcaatttacgcgggtaaaggcgcaccaaagccgcacggagagtgttga

SEQ ID NO: 74341 - DNA, 75 bp, Heterodera glycines
  Genomic contig location: Contig_ID=SeqID_11016; Location=2133..2207; Strand=-
  SCN-specific regions: Sequence locations=1-75
tagaaaaaaaagataatgtttttctctggcactctctatttattggtacacatctcgttttttcggacggtgtgt

SEQ ID NO: 74342 - DNA, 65 bp, Heterodera glycines
  Genomic contig location: Contig_ID=SeqID_11016; Location=2617..2681; Strand=-
  SCN-specific regions: Sequence locations=1-65
tgctctatccacccacgaaatttcattcggaaatcccacggacacctggggaccttcctttgtca

SEQ ID NO: 74343 - DNA, 176 bp, Heterodera glycines
  Genomic contig location: Contig_ID=SeqID_11016; Location=3183..3358; Strand=+
  SCN-specific regions: Sequence locations=1-176
gtgaaacgaatttttagcacattaaacacaaacaattaaacataagcgataataattttaaaaaacgaaatgaaaacgaaaaaaatatcaaaaagtcattaattaataattaattgtcgtcaaaatcgttttgagtgttcgtctccatccttctgcttggctcagtcctccaagtc

SEQ ID NO: 74344 - DNA, 111 bp, Heterodera glycines
  Genomic contig location: Contig_ID=SeqID_11018; Location=127..237; Strand=-
  SCN-specific regions: Sequence locations=1-111
gattttaaccctttctcggcagggcatccgtctgaagcttttcccttctacggccatcgtctggcgaatttgaccattgcgaccgggggatttctgtacgtcggcgatcaa

SEQ ID NO: 74345 - DNA, 1459 bp, Heterodera glycines
  Genomic contig location: Contig_ID=SeqID_11019; Location=162..1620; Strand=-
  SCN-specific regions: Sequence locations=1-81,103-794,817-887,923 -1173,1195-1311,1333-1360,1382-1459
atgagttcaaacaatgcgttgacccaaatgatgcggcgtgagaagagaaagttgctgggaaacgtcgacgtgcagaacccactggcctttgtcatcccagcaacgttacgcgaaaagggcggtgaggacatcgtcttgtatgacagtcgaaatgtcaggcaaggcgaaaaggacgttgtccttattttcggcagtgttaaggtacattttttggctataaaattctgtttgttattggcatttctttagactctggacattttgcgccaatgtggcacgtggcacctcgacggaactttcaaatgcgctccagcgatgtgggagcagtgcttcgtcattggtgcgtcagtgaatcagaaaatgtgcatctgtatgtggtgtcttctgcctgggaaacagcgacgctactacgaagaagcactgaactttctccgtgaacgcatctctccggaggtcccaagcaaaggttaaccctttgaaatttacaaaaaaaaaacaaatcaaaaatgtgatttttagttttgtgtgattttgaaaaggccgaaattgcggcggtgcgtacggcatttcccacggcacagattaagtgctgcatgttccactacgggcaaagcctttacaggaacttcaaacgacttggtcttgtccatttgtacggtgagaagacagaacgtggggaggaagttcgcaacacattccggttaaaaaaattttggtgaaattcaaattccttttcagaagtgttctttttttgcctcttttgcctcccagcattgtcagaatggttttctcaattattgtggcgtcagctcctgcaggaatgcatgagtttttcctttacttctctcgaacatacataggcttgacacagcgtcagttattgaatgtttaataaattcattcattttttatatttatatttgggtcctgggttaggaaatgggttaggtaaatgtcatattcgtactcagcgactccaaaaaccctaaattagatccgttttacgggtttttggacaattcgtgttttttactcttatggacatttcgaggcttggacatttcgtggcttggacatttcgtggcttggacatttcgttggtcagcgaataaaatgatatttttttttgaatttttcctaattttttcacacatttcgccaaaaaatagtgattaaaaattaatacagaaaatacaggtttttaaggcctgtacctgtacctgtattccaaaaatggcctgtacctgtattttctgtgcaaaagtacaggaagatacaggtacaggaaaaatacaggttgccgaacaatggcctgtacctgtacctggatccaggaaaaatacaggttgccgaacaatggcctgtacctgtacctggatccaggaaaaatacaggcctggatccagatacaggccgatctctagtcccaactataatttcaacgtgccaaaaatgctga

SEQ ID NO: 74346 - DNA, 1055 bp, Heterodera glycines
  Genomic contig location: Contig_ID=SeqID_11021; Location=27..1081; Strand=+
  SCN-specific regions: Sequence locations=1-170,204-233,255-259,281 -333,379-679,702-1055
atgccattcgcccttttcagcggcatgacttgcacagcgatcatttacaccgccattaatttcgcattttttgtcgttctcagcgtttgtgatattcaaaattccaccgccgttgcgatggtaattaaaagccaactaatatacatttgaaattactattaatgtgcataaatgaatgtaaaagaaaaatcaaaatacaaataaattttcagacattcgccgaccaaacgatgggatattttaccaaacttatgccatttatcatctctttggttttgttaaatgctctgaatgcatcagtgtttatgggaagtaggcacgtaaattgaatgctttatttcttaaaataaatattattaatttttttagatatttatacgctgtggcgcgtgaacggcaactcccctcgtttatcgcgtgtgtccaccgaacgcacgacagtccccgggcggcactgatagtccatgtaaaaggaaaagcatttgcaaatttaacattaagcaattggctaaaacatttacggcattcagacagtgttcattatgatcggattgtttcttggcaatgtcaatgaactgatcagctacgtcagcttcgcggtttggcttcagcgcggctgtgccatgtgcgcacttttgtacatccgattcaaacatttgccggtccactcggagtttagttttaaaaataatttaaaaaatcaaatggttaaaatgatatttcaaccaactgctcccatattttggacaaatgtttcggcattttcaaaaaacttaattttcgaataaaaatatctttaaacacaaatttaacatgaaaataataaccgaatttaggccattcgtatgccaattgttctgccatttctgtttttggcaatttgcttttccctttcaattatcacaattatcaaagacttttccaccgcttacattggccttacattaattggcagtgcactgataatctatggcatatttatatgggaaaaggcgttgaatcgaatctcagcttatcgggaacaaagcagcaattggaatggtcagtggaaatga

SEQ ID NO: 74347 - DNA, 287 bp, Heterodera glycines
  Genomic contig location: Contig_ID=SeqID_11021; Location=1794..2080; Strand=+
  SCN-specific regions: Sequence locations=1-219,241-287
atgcgcttcttctttcttctgaccattgctcttctctccgttgttcttctcctttccccaagtgcactcgcaaagaaaagagcccgccgttcgatggtaaaatgaaaagcactaattttgcttaattactaatgacaaatgctaatgattcagcccgttaacgctgccatgccggaatggaaaattttgtccgctgaagtggaaaacgatggcacagcataagaaggaggaggcaaactttggatcatcggcatgatcgaagaaggaatttgccaaaatgatgaaga

SEQ ID NO: 74348 - DNA, 604 bp, Heterodera glycines
  Genomic contig location: Contig_ID=SeqID_11021; Location=3248..3851; Strand=+
  SCN-specific regions: Sequence locations=1-55,77-80,102-604
atggaggaatatgaagcttcatcagtgagacaacgggccaaaattgaagaaagggatggcaaaagggcaaaagcgaatgcacaaaaggcaccaaaaaatggcgaaaaaagtctccaaatcggatggattgtttgctttgtgctcttcacttttgcaattggaatcgtaagccaatcaaatcatttcgcatgattacatggcttgcttatccataggattggtttacgagttttgaattacttttgcaatttttatgcaaatttttaatggaaaaaccaacggttaaccagcttttaatcattaattaccaacctaaaatttaatcataatttcgtgcagttaatgtatcaaagtcgtgaaacaccgacaaattatcaaaaggaggtgaaccgagaatgtgacgaagggacagggcaatgtattgcaatagcagattatacacgggattctgggtataataatgaagccgatttaaaaaatgttaatatttttagtaagacatggcatcgaggcattttttatgtcaatgaaacgacattcgattttgagaaaatgctcgagaaaaaaatcggagcagaagcaattctcaaatgtcctgcaaatg

SEQ ID NO: 74349 - DNA, 210 bp, Heterodera glycines
  Genomic contig location: Contig_ID=SeqID_11021; Location=2239..2448; Strand=-
  SCN-specific regions: Sequence locations=1-144,178-210
atgatttcaaaacattttcgattaatccatgaaaaagtaagttttccgtgctattcttaagccattttctgaatgatttgaatgttcataattgtcaacaccttttttaagagaatttaatacatttacacaatcccattctaaattcagactttcttttatttcctttcccatttttaggtcacattttagggtgtttcgtaaaataaa

SEQ ID NO: 74350 - DNA, 2374 bp, Heterodera glycines
  Genomic contig location: Contig_ID=SeqID_11024; Location=105..2478; Strand=+
  SCN-specific regions: Sequence locations=1-117,148-178,206-300,336 -362,394-499,521-986,1024-1079,1143-1172,1195-1272,1295-1501,1530 -1979,2013-2017,2040-2213,2235-2273,2295-2312,2334-2336,2366-2374
atggctaacctatttggtcaaaaacaatctgtagctgttgttggaatgctcaaatgtaaagggaagccaagtgctggtacaaaggttaagctctacgacaatgaccgtaagttttcagttatttacaaaaataataatacagtagtttcatcaaaaatgtttccaaaataaggacatcatttgttaaaaattatttttgtggacaataataaggtctacataattatacgctctatgtacatttgtcatcaatttttaataccctttaaattcaaggaaaatttcaatgatttgttagtctaaaaataataaaatcatagaaatatttaaaaaatcaaaggtgatatgataaatatctcaggaattaatatttttttgaatttataatattttgagtcttacaattaggacaacccttagtttttcgggatcaaaattaggatatattaagtgccgaatgtcgtcataattaaactttctacgcatatatttaactacaaattttcaatgccatttaaattcagagccaaatttaatgggtcggggtcactttggcatgggccataacttgtttgtgtatcagtcagattttgtttagaatttttgcatgcgaatagggactatcaagcgcttaaaacccatatccattttatttaatttggatgacaaatataaatgctttaacaaaatcgtagaaatagcgaaaaaatcaagaaaataggggcgaaatattgacaaatctaagaatttggtatttttgttattttttttttattaccgaaacatgcaaataggggggattaagcatcgaaatttggacaaatgctacctttgttttttttaaatattcgttaatttttcagattttacgactgatgatttgatggcacaatccaaaaccgacaattatgggcgtttcaaattgagtgggacggcaaaagaaattacgaaaattgacccaaaattgaatctgtaccatgtgagaaattaaaaatacatttaattcattactttattaattttgacaatttaaatttcaggattgcaacggcgatttcccatttacaccatgcaaatggaaaattacaattaaagtaaaaaatataaattgaataattcagcaaaaatttaataataaaatagctggaattatacatctaattagtgatatcaatttaaaaaattacatttacctctaattaggaattgaaataaatttgacaaggcttatatggtgatgaattaggttcccccttccgtatcgtgcgcgatcaaaaaattttcaaaaagttttcaaaattttttttatagaaattcctcattgaaaaaattttctcatttttgagcatatttttgttttgaatttttttttataattgctcccttttatatgtattagcagcatctccgtactaattttgtggctttattgctttttcaattccatttttttgggtaattgatcgccaagcggaattttctaacacagctcattgttttcgaaagagtttaaaattttgcatgaaaatactttggtataaggcctagcatcttgccaaattctagaattttttatgcactcagagattttttaaaaaatccgctttttccagcctgaacgccaactttgtggtcaagttttgaaaacaggcggttttttgtaaaaaagtttaaccaatataaaaaattctgaaattttgcagggtgctaggtctcttgccaaagtattttcatgcaaaatttcaagctattctgataactctgaaccgaattacaaaaatcaacttgagcaaaatgcaaacttttattcactaaaattcacagccctaataataaaataaataagaaattgccgaaatgttaggccttgggtgggagtcgagcccacgccttcagctagtggttcaagcagctctaccattgtgccaccgagacaaaaccacaactttatatatttgtagaatttaaattgtaatctcaattttatattttaatttttataataaatattagccacttttcatttattttttacagattccaaaaagttacatcaccactggaccacatgcaccgaaagtgtttgatatcggcgtgttgaatttggaaggcaaattcagtggccaaaaaagggattgcatcaactgagtgcgatggttgattaaatgttacaaaaactcaaaaacccattaattgttgacaattattaattcaatgaaatatttttgaattaaattaatgcatttcttgaatatttgaaattacatttgcaagagttaaaatgtaatcatttttaatgggattaattacgcaatttttataaaacaaactttgacatatataaaatttaaaaaaatttaaaaaacctcaaaaa

SEQ ID NO: 74351 - DNA, 623 bp, Heterodera glycines
  Genomic contig location: Contig_ID=SeqID_11026; Location=566..1188; Strand=-
  SCN-specific regions: Sequence locations=1-200,223-225,248-422,444-623
atgccaaaggagttgcgattagcatatgttagaagccacgaagaaagcaaagtgagaaataatgaattgcattaaacaatcgatttcaaatgattaaagacccaaaagggggagaaaggcgaaatgaaacggtcgctgttgacaattcactttcgaaattgtttttcattagcgtggagaaattggaataaaatgggcaacaaattacatatcaaatttaagttaaaatgaaaaatggaaaattaaaaggcaattggaggggggggggggagaattaaaaaccccccccccccccccgaaacccaaaaagtaaaaaattttcagtgaatttttttgaaattttaagcaattttcttagcaaaattgcattaaaatacttaaaaattttcccggtggcccctatcggcacgccgggaggccaaaatggcaaaaaatattaattttttggcgaaaaacggcgaaaaattttgtaaaatacaccccataattcgggatttaaaaaaaccaaaaatacacccctaaaaatcgaatttttgacttcacccccccccccccccccaaagccaagggtctggctacgcccttgcaatgatccgttcaaatagtcaaatacaagcaataaa

SEQ ID NO: 74352 - DNA, 759 bp, Heterodera glycines
  Genomic contig location: Contig_ID=SeqID_11027; Location=227..985; Strand=-
  SCN-specific regions: Sequence locations=1-191,240-265,287-481,507-759
atgacacttcaaagacgcaaaaatgactgctcttattaccctaataaaattcttttaaagaattcaaatatctgttctgtacgaaaaatttattataatcaaaataatggcggtgaaagagaagatgataacccatccactggttttatatacacagacattggtatgtttcaacaataaaatgaaagacgaaatattaaatttaatgagtaaaaaattaatattattatttttatttagatggaaaaaagtattttggaattactttacaagaagtccaaccatcaacattcattattcatcgcactgaaagtcaaagtactaaaaataaaattaatagccttttcttcgggagtcgggtcggagaataggcctaaaaatatcggggctcgggatgggcggggggagaaccattttttttaattgataaatttggtgtcgtggttctttgagtttccattgcttttgtatgatttaaaggaaaaaatttaataaaaattttttaagctttaaaggaaatgttggaggagaaggcaaaggaaaagaaacaagcatatgacgaaaatggagagccaaaaagcaaaaggagcataatgaaagacactgactgaacagaaggaaatgggaagaagctgatttatattagggagagagagagagtaatagagcatttattcagcaattattagaaagtatagacaattaatccctaaatgttttgtatatttaggacatcttttagtgcttaaacctaataaa

SEQ ID NO: 74353 - DNA, 1041 bp, Heterodera glycines
  Genomic contig location: Contig_ID=SeqID_11027; Location=2783..3823; Strand=+
  SCN-specific regions: Sequence locations=1-488,510-560,582-609,632 -700,722-771,820-1041
  Gene Ontology: Mol. function=acyl-CoA dehydrogenase activity; Cellular component=mitochondrial matrix; Biological process=fatty acid beta-oxidation
cctcaatggcctgcggactgcaacagcgcgcgttggatgaggcggatcaaatacacaacgaaacgacggacatttggccaaccgatgatcgaataccatgtgggtgaggaggaaatggcacaattttccatgaaatgccatgggttagttgaacacagaaaccgaggggagaaaaacaaaggaatttaattgtgttagaggaggtttatttttgaattttgttaacgcttcggcaaatgctcaatttcttttgagggcgtctccttcaaactcgctgaaatggccatgcatttggaggcgtccaaaggccttgtgaagcgggcgggcaaaaaggtggacgcgcaggcggaggacgccgtttattttgcgtcaatggccaaatgctttgcatgcgatgcggcattccaagtgcttttttattaggaaaatactttttctgaatttaatttctttttttaaggcggcatcaaacgcagttcaggtgattcggggaatatttccataaaaattttctgtgtttttttaaattaatagtttctatgactcatcttttcgtatatgaaagaaaataatctttcatacctatctcaacacacggttcaatttcttttttacataaaaaactattttaaagtttgtgggttattagaattttgtcatgtgattcgtcgggcgactttttgtctccggcaggcccgtagccggggggggggggggggggaatccgaccaccgaaatgaaaaattaaaaaattttcaaggaaaaatttgcaattttttaaaatttttaatttttgttttaaaagttaaatctttttttcttcggttcccccctccgaaatttttttctggctacaggcttgctccccggtaaaattatttgctgtgttcatttgaatagattttcggcggcaacggtttcaacgaacagtttccggtggaaaaattgctgcgcgactcgaaaaccttgcaaatctacgggggcaccagcgaaatacaacgggttgtgattgcgcgggagttgcgcaaaaagtacggcaac

SEQ ID NO: 74354 - DNA, 1694 bp, Heterodera glycines
  Genomic contig location: Contig_ID=SeqID_11027; Location=1230..2923; Strand=-
  SCN-specific regions: Sequence locations=1-414,436-487,510-640,663 -784,807-851,873-938,964-1031,1053-1349,1371-1487,1531-1694
atggcatttcatggaaaattgtgccatttcctcctcacccacatggtattcgatcatcggttggccaaatgtccgtcgtttcgttgtgtatttgatccgcctcatccaacgcgcgctgttgcagtccgcaggccattgaggctgaagaagtcgacacggtactttcgggttttgtgtcatcaaactttttctctttgttaaattgattttaaattaataaaaagtcgtttctatgggctttcggggtcgtagaacccgaatattatgtccgttttgacccatttcgaactccgaacccggattcgaacaattatcaaaattcaatttttttttcaaaaatgctttcccacttcattgccgactaatttccttatcagcaaattgcttcctacctacgcccacacccttttccctcatttataatgcagagaaaataaaaacagaaatatttgaaggacgaaagagcaacaatcaaacgcaacaggaaaatacaaaatttaatttaaaatcgccaattgaaagcaaaaaaacaaattttaataaagatgttcataacggggaagtatcgcaaattggaaatataaacgttcataaaagggaagagaaaaaaaccggaaacataaatgttgcgcaacaaaacgacgatgttggtcccaacacagaaagccaaaacactaatacgcaaccaaacgacgatgttggtcaaaacacaggaagacaaaacacaaatgttcataacgtggaacaaacaaaaaatgaaaacacaaaccttgcgcaaccaaacgacgatgttggtcccaacacagaaagccaaaacactaatacgcaaccaaacgacgatgttggtcaaaacacaagaagacaaaacacaaatgttcataacgtggaacaaacaaaaaatgacacaggaagacaaaacacttatgttcataacgtggaacaaacaaaaaatgaaaacacaaaccttgcgcaaccaaacgacgatgttgatcaaaacacagaaagacaaaacacaaatgaggaagagactcaaactgaaaacacaaatgttgcgcaactaaatgacgatgttggtcaaaacatcaaaagccaaaacacaaatgatcataacgtggaaaagacattaaaaggaaacacaaaaaatgttaaacaacaaaaatttgacgttggccaaaccaccgaaggacaacaaataaaagtcagtcttttatatcggctccaatttatttttgtaatatttctatccttttcggaatcaataaaactagagtagagcgggaccgggaattttgggcttaaccgggaccgggaccttttcgggttgaaaaaccgggaatttttggctgggaaaaccgggaaaaaacccgggactggtcccggtcccggtctaaaccgggacctcagtactcagttgtccgtgttttggtcccagtcccgctctactctaaataaaactaaaatcactttttttgcttcaagacgattagattttatatttttgtaaaaaaataaataattatatttattttaggctgaaaatgaaacagctaaagaaagtgtgaattccaactctattcaaaaaacaattgggagaaaaagtgtaggaactcaaacagacgaaacatatgttggtacattagtgcattataaagtgacacaaaatataaagggacactaattttttgataaataaa

SEQ ID NO: 74355 - DNA, 1286 bp, Heterodera glycines
  Genomic contig location: Contig_ID=SeqID_11027; Location=2987..4272; Strand=-
  SCN-specific regions: Sequence locations=1-186,214-214,267-280,302 -383,406-671,720-769,791-859,882-909,931-981,1003-1286
atgttaagctttcgaatgacaccaaaatgttgggtttggatgacaaagaaaaaagctatagtggaaaaacatgctgggccgaaccgtgtgggccgaactgaggtaaaccgttcgcaacacaaaacattgcaatgaacaatagaattaatgagacaatgcataaataataaaagggaccggattaatatggataaaaacccaaaatttaaagaagaaaaaatttcattaagaaaattaattttcttattttttaaaaattttaaatagaaatctaaacacgcaaagaaattttttccaaatagtgttcaaaaaaatatatatcaaaacaaatccgggccctaataataaaaacattaaattggcagttaaaatagggatgtgttaaaattttttggtcaaagttgggacgacggcgttggcgtggccgccaccgtcagttggtcgccgccgttgccgtactttttgcgcaactcccgcgcaatcacaacccgttgtatttcgctggtgcccccgtagatttgcaaggttttcgagtcgcgcagcaatttttccaccggaaactgttcgttgaaaccgttgccgccgaaaatctattcaaatgaacacagcaaataattttaccggggagcaagcctgtagccagaaaaaaatttcggaggggggaaccgaagaaaaaaagatttaacttttaaaacaaaaattaaaaattttaaaaaattgcaaatttttccttgaaaattttttaatttttcatttcggtggtcggattccccccccccccccccccggctacgggcctgccggagacaaaaagtcgcccgacgaatcacatgacaaaattctaataacccacaaactttaaaatagttttttatgtaaaaaagaaattgaaccgtgtgttgagataggtatgaaagattattttctttcatatacgaaaagatgagtcatagaaactattaatttaaaaaaacacagaaaatttttatggaaatattccccgaatcacctgaactgcgtttgatgccgccttaaaaaaagaaattaaattcagaaaaagtattttcctaataaaaaagcacttggaatgccgcatcgcatgcaaagcatttggccattgacgcaaaataaacggcgtcctccgcctgcgcgtccacctttttgcccgcccgcttcacaaggcctttggacgcctccaaatgcatggccatttcagcgagtttgaaggagacgccctcaaaagaaattgagcatttgccgaagcgttaacaaaattcaaaaataaa

SEQ ID NO: 74356 - DNA, 857 bp, Heterodera glycines
  Genomic contig location: Contig_ID=SeqID_11028; Location=1083..1939; Strand=+
  SCN-specific regions: Sequence locations=1-272,296-630,652-857
cgatgttttgatggacagtctcccattctttaaccatgctcaactcggcctcaaattggcgctggtttcgccccgttttgatgcgttggtcgacaaacatttcgacggcaaatccgcgctgacaatttggagacaaatcagaattgacaagattggaacaatgccgagactgtccgtgtttatcaactatgtcaaatctgtgccatttcctttgcccgaccgtccgttgcccaacaaaattcatttcaaggaccttcaaattgcgtaattccaaattaaaaacacatttaaaaaacattccttccgttttcaggtacattgaccatttcgtcatcgcatttctccgtgccaataaacaaattttcgatggaaatggcactgctttgaaattctccatttggtcagccaaaaacgatgtggtgccgatttgggatgtttttgccaatcaaatttggcccatttttgcgccaaacattcgccacatgggcttgaccaatgctgaccatctggacaatttgcgtcgtctcatctcaccgacaatcctctccgatctgaaatggctgaattcaatcaattcctatcgtctgttgccagatgcgattggtggtgattttgatcagtcaaatgcaactggtggccaaattctgtccaaatggttgcacactccgacaaccaatggccaacccaagcgatttaactgtgtttattatcaggagccagcaattaacatcgacgaatggatcaacaccttcaaagaagtgtgtggccacattttcctcaaacaactgattaatgattgccttttaattttgtttcccattggttatgtaggaatttggtggatggcggaggtgtaa

SEQ ID NO: 74357 - DNA, 377 bp, Heterodera glycines
  Genomic contig location: Contig_ID=SeqID_11028; Location=3501..3877; Strand=-
  SCN-specific regions: Sequence locations=1-74,96-129,165-258,288-377
atgaaaaatgataaaagaccgaaaattgtaacaaaatcggagttaccgtgcactaaaggtgtttctaactactgtagtataagtattaatttttactgcaatattatgaaactaattgacttattgtactaatttttattttttaatgcaaaataaaaatttatgacaccggtgaattttatcagaagtctttaaaacataaattattcctttccttgttatttaactactttccatttttagggtcccttttggacgaattttgaagaaattttctgtaattttaagttttttcaggactgagggacccaaatccaacatctatttcggcaccccgaaccaggactcttaagaaaatgtcgaaaaatagaatttaa

SEQ ID NO: 74358 - DNA, 689 bp, Heterodera glycines
  Genomic contig location: Contig_ID=SeqID_11029; Location=809..1497; Strand=+
  SCN-specific regions: Sequence locations=1-51,79-249,272-689
atggaggagggcggattaccgcccgagaccgcccccggctcagccaccgccgaacaacagcagcaacaacaacaggcaactcaaccgagtggaaacgaagcaccgcttgacgatgggttggccatgttgcaggaggtcagagtcaacggatggacgattgaacacaccaaaaaataaaacagcaaataaaggccgaatgatttattattcctttggaggagtcataaattaaaaaccttcactcttcgcatatttatttattttttgttcagctttaccaacgacgtcatgctgaactgctcgcgcagttccagcagtctcagagcattgcccagcaggactacctgctcaacctgcagttgctccagtccgcactgcctgccgctgctgcgatggttgtgttgcagcagcaacaaattgccgtgatgccttccgccgcttcgcagcaccgtccgctgctcggttcgttggcgcacacgagcagtgagcagtccaccgaagagtttgatgtctcggcacagcaaaccgcgcagcaaccgcaacaccaccagcagacgtgcagttcggtgccgctggccaaggaacacgcggcgggcggaattgcggcgacggcacgcaaccgacgcactttttcgggatcaggccaaacaatttcccaacacacgcgagaccgactgaaatccatgtga

SEQ ID NO: 74359 - DNA, 306 bp, Heterodera glycines
  Genomic contig location: Contig_ID=SeqID_11031; Location=440..745; Strand=-
  SCN-specific regions: Sequence locations=1-19,93-155,178-242,265-306
atggatcgtaacagtcatcggccctgtggcataatggataaggcgtttgacttcgaatcaaaagattgcaggttcgagtcctgccagggtcgaaaatcttttttggatattttatattcatcgcaaattaatactttttttcgagtaaaagtcggttattttggattttctaaaaaatatgatataacaatttagtacggctcttccaatgatcatttaccctaagggctcgttttccaattttatgccctttcaaatcttttacgactaattaacaaaatctttattcgcgttttacaaaataaa

SEQ ID NO: 74360 - DNA, 2557 bp, Heterodera glycines
  Genomic contig location: Contig_ID=SeqID_11032; Location=351..2907; Strand=-
  SCN-specific regions: Sequence locations=1-246,319-605,650-938,962 -1366,1402-1420,1442-1493,1516-1542,1624-1768,1805-1864,1886 -2203,2250-2282,2304-2366,2389-2414,2476-2507,2529-2557
  Gene Ontology: Mol. function=structural constituent of muscle; Cellular component=cytoskeleton; Biological process=regulation of striated muscle contraction
atggtctggaaggagtgggtcgacggggggggggacggtggtgcggctaggcgccgccggaaaatttttgaaaactcaatgcaatttgatatttcactgccaaattgcgattctttaacaaggcgactgcactttttttgtttttaaaaagcgtttttttttgcggcacacttttaaacaactttttttgctatttgttagaagattttgtctaaaaaatggccaaattttaagatttgggctaaattctctttttattattttttttaattctattttttttatttttcattttcacatttttttctcccatttttagacactctcatccagctgtgctatccgaaatgcgaacaatcggacaccggcacctattccattcgcattgtgaatgaattcggctcggcttcggtggacttgcgcctgaaggtggtcgatcgccctgcaccgcccgaggggacattgaaggtgcaaaacattgggaatatttttgtaaacagaaaatgatgagaggggcatatttgtaaaacaattaggaaggattttttgaatttttttttagaaattaattttaacggagtatttttcgtttttactgtattttcttttttacaaaatattcttttaaatatttaatgtataaaaatatgaacaggagcggaccgcgtccagtagccgaaggcgacgcgttggcagcacagcggcggatcggtcggcacaggcggcagcagcggcttgcgctgcgggcgaagaggcaaaggacgaggtgtacaacaacgaggaggagcgacagaacatggcggtggtgacaaaaaggatggcaattttggtaaaaaaaaaatttcaaaattattgtgtatgcttttcgggatttttgtgcttaatacctaggcgccttttttgtgcctatttcgccatttttggcgcctattttttggattttttatttattaatatttttccttgagaaaagcagcacaaaaacaaaaatctttcactttttaattgtttttttcaatttttgggcaccccttttttatttctattttttaaaggacctggaaacatccggcacaccggcacggattgtcgaaatcccagaaaatgtgacggtggttgagggcgaattggccatcatcaaatgcgtcgtggagggcaacccggcaccgacaattgtgtggaaaaagggcggccgaaaaatgccattgaccgacgaccgagtgcggtgccaaacggacggtgacacgggacatgtaagtggcaatttttaaatgaaatttttaaacacagaaatttaaaaaaaactgctgttttttggaaaaaactttttttgtgaaaaagtcatttatcataaaactgagaaatcataaaaaattttttgttttaatttcaataaaattacatttttcataccgtagccctcaaatggaggacaagaaaactttttactgtagttctaatcttggaagggatttttacggcactcaattaattaattaatgtagctcatttatttctaaactaaattcaaaacttagcagcaaatttaataaaaaaaattttatcaaatcctaaaataatgttaaaaatattttatcaaattaaaataatgttaaaaatattgtcaggtttctctgatcatttccaaatgtcggccacaagatgggggcgagtacacattgatggtgaagaacgcgcatggcaagcacaaagttggcgccaagctgcttgtcacgccagcggccgaagtgaaaaaaaattgccagccaaatttaaataataatatttacaaaaaataaatttacagtcaaatttggacatccgggccaagcagaaaaaacgtggcacgggcattagcaattcggaacaggaaaaacagcgccaacggagtgatgccgagcccaaaagcaagcaaaaaagcggagcgcaagccggtgaccttctagttcgacgatgagttgtattaaatttttttgtttttcactgttcctgttttatttgtgcccatctcttttttaaactctgtgaattgaagataaaattttattttcctttaattgtcctattttatggtatatcccaaatccccagggctggccgtgattgaatttccaatcacggaaatccgtgagccgtgatcacggggctttaaaaaaaatccgagatcacggcaccccaaaaactccgtgagccgtgatccttgattaaaaaatttttttctaatgatttttttaatttaaatttatttagaaaaacggaatttaatcgctggaaaaattcctaaaagatattttaaagaaaccaaaacacaatccgctttttttgctgcgtaccttttccaaaaaatgactaagtttacgattttgagcaaattttttgatgaaaattaggcctttttgtagaaatctccaaggaaaaattttattttttaactaagtttattaagaaaatttttcaaatttttcttaaatttaaccaaaaatctatttatatagagaaaaaaatcagaaaaatttcctctaatttgtaagctaacttttgatgctgaacaaataaa

SEQ ID NO: 74361 - DNA, 1701 bp, Heterodera glycines
  Genomic contig location: Contig_ID=SeqID_1544; Location=497..2197; Strand=+
  SCN-specific regions: Sequence locations=1-51,150-442,464-501,523 -528,550-718,778-802,824-948,970-1144,1166-1280,1339-1400,1423 -1459,1481-1510,1535-1701
ctttttttggcccatttttcttttttctgttttttggccctcttttattttgaaagagaaaagaaagaggaacggaacggaacggacaggaataaaaaggaacgaaagaaaaaagagaaaaggttagaggaagtgagagacagggaaagagtaagagattttaagtggccctattaaaagtttgagtataaagaaaaaattattgaattcccggccattataaaatccaatgcccttttataaaaaattttttggcgaggagcgccctctagtgagtgttaaatatcgaaaatttggaagttcaagggtctgacctaggtcataaactttaaaaatcaggggtcaattacggtatataaaaccatagcacttaactgaataatcgctgccgtgctctagttcttatttaataggactgaaaaaaacttttgaaggcttatataattttcaaacaatacttttttaatccttttaagaaatgctcggcagctatttccttaaattttatttgtattatttacatttttctacacaacatgaatatactaaggttaatacctcgacctggattaggccctggaatttccaatatttttttctttaagaatttcagtcgagaaacccaccagatttgtgccagccaaatccgtagttttgggaaagtctggaaatttcgccatcctcggcttgtccttttctcgatcacttgtagaaaatgaaaaaataatttgtaaatctaaaatattgtaattaacaaaaaaaatcatttatttttttcgaaaattcgcaaaattaagactttttcaatgaaaatatggtcaaaattcttaatttttcccggcggcgcctatcggtagcgcggccccaccaaaagttttttggaaaagcgccgcaaaaaaatcgagcgatttttcatgctcagatttcacaaaatgcttatttctaacaataaattgaaaatacacataacattttgaacattttaaacttgttttgaaaaaatttgtaaaaatgttaaatgcaataactaagcaaaaaggtcgcaatattgggacgacgaatagaaaatgttgtattaaaatggcgattttttagctattatctttagagatcggtattttgaaaaaagcctggacctggaccagacaaaaatccaggaaaatccaggtccaggaaaaatccaggctcttcgagacctggattttttgaaactcatcctaaaaatcaaaaaaaggttgaaaaaattaattaattgcttagaaacacctaaaaatatctacttaataataataatgtatttttaaattaatttaatctttttttgaaaattaaaaaaaacatcggtcacttgaaataataaattctaaaattttgtccaggaaaatccaggtttttcgtgttttgcctggacctggacctggatttttttttcacattggacctggacctggatttcctggacaaaaatccaggaaaatccagtgccatgaaaaatccaagatgccgaaaaatgacctggacctggacctggatccaacaaaaatccaagcctggatccaggaccaagccgagatcaaatctaaagcatactgtatcactgactcattttctattgtaccgctcagatatgttacagaaatgataggtgacttgtttacaagtatttttatgattattttctcatttatattgaaatcgtag

SEQ ID NO: 74362 - DNA, 3002 bp, Heterodera glycines
  misc_feature (1106)..(1106): n is a, c, g, or t
  Genomic contig location: Contig_ID=SeqID_1545; Location=90..3091; Strand=-
  SCN-specific regions: Sequence locations=1-143,169-268,292-507,541 -1168,1190-1269,1292-1298,1364-1661,1705-2056,2078-2255,2348 -2356,2385-2749,2771-3002
atgaaactgttgaacaaaattgaacaattgagaaactgtaaaaatgaaaccattgatacggtacggtacggtaattaagttgtctgtttttttgtttaaaaatgacaaaaatagggagcaataaaaatacacatttgttaatgtttttatggcaaaaaattttttgaaattttttttttcaaaaaagggggcgggggcaaactacattatgaccaaaaattttccaaaaaaaaaaaatcaaaagagggaggagttgttgagagttttgaaaaaaataaattaattttttttctttcgtttaaattagggttgggcccccgacgtcggaccgggtcgactgggcgccgccgactgggcgacgccaactgggcgacgccgactgggcgacgccgactgggcgacccagatcaactgggcgccgccgactgggcgccaagacccactttcaaattccctttctttaggcacaaaaatcgcaaaataggtttaaatagacacaaaaattttcgaagaggcaataaaatttttgagaatttttactttcaattctgaagggtgtattttcaaagaaattttttttgtttttatttttaaaagtcatgaaagcatgatttcaaggggttttgggtcgcttatcacgaatccgacacccatttcgacaaattacgaacccggacccaaattcgaacaaaaattgttagatttgggtccgagggttcgaaatggatacaggattcattgtcagcgacccagaaaacttttggaacaacaaaaaaaatttcttaaaagggggcctacaatcataactattacgcaaaattttatgcatttgcctaaaaaatccctatttatcacatatatggtagggggtagggatagcacgtaattccgtttcgaaaaaattttgggcttcggaactccaattttcaaaaatttttgtggtctcggaatcccttctctggtagggagggaaacggggactggcgcccagttgattggcgcccagtcggcgtcgcccagttgatctggcgcccagttggcgtcgcccagtcggcgtcgcccagttggcggcgcccagtcgacccccaccggtgtacccccccccncccccccctaaatacggtactgccatgtatttagaaaaaaatttcagaaccgaatgaaaaaataggaaatttttagccattttcaccaactttggccattttggggccaagttttggaaaaaaaacatggaaatattggatcgggcgatgctgttaggcgtcttcatttgaaaatagataaaatttggtaacaaaatttagtaaaattaaaaaataattttccattatagaaaaatagaattttttttaatatttatctgctctttttacatcacttttcattttgcaggaggccgttgccattgagcggaacaaatttgactggaaaattggaaatgcactcgtcaaattggcggccatcgaagaaacgctgaaaagtcgggcagcaaaagtaaatttaaaaaataaatcatacatgaaaaaagggggaaaagaggaatttctgaaatgtttgccattttcttacaaattacacataattcttcataatttttattgcggtttttttttcactgaacgcacaccttttggcaccgcccaccaccaaattcttagttttttttttctttaaaattaattcaaattctaaaatttttttgttggaaaaaccccttttcgtcgttgttatctgttgacaccatcggggcctcacccttccccagatgcattttattcataccagggttgttccgggttacccgaaacccggcctttttctcgcccgaaacccgacccgatgattttgggtcgggtttcgggtcgaaataagcactggtaagaaaggggtctgggtgaaaattaggtggataaggaaattgagaattttttttgaaacgattgtgttcaatggaatcgaaaattttgtatttgtttttgttcattattagggatgtcaattttatgtaaatatgtacatatttttttcctggcttctccatgctctaaatagtaggaaaaacactttcttttttatgtttgcaaacaaaaatcgggacttttatttacatatttttacatatttcggggttttatacatatttggtacatattttggactttttcttacatattttgattttttttacataatttgcgggttttttacggaaaatttttggaaatcctcaaaaaaaaatccaaaattttggcaaattttttatttttttatacatattttgagaatttttgaaaatttttagaaatttctagtgaaaaaattaaaaaaaaaactttttttaaatgtacccctccaaaaataattttttaaatgttaaaaggtgattctaaacatatttaggtcattattttaattttggattgatttagcataagagtataacaataacatcagacagaatctaaccacttcaatttatattgtatttttaggggtttttttgaaaattttttgccaaattttctggcactgaattgtcggcttttcaacggattttgaagaacacgccatcgtaaacttcaaacttggagaaacgaaaagaggaggcattcacaattccggacaaattacggctgaaggatggcgaggacatagtgctctacgacagtcgcacggtcagaattggagaaaaggacgttgtgcttgtttttgggagtgaacgggtaatcatcaggggcgaaaacagaatttaaatttaaattttttagactttggacattttgagcaaaaacagtgcaacttggcatttggacgggacattcaaggctgcaccaaacatgtgggagcagtgctttgttgtgggcgcgtctgtcaaccaccgaatgtgcattggagtctggggtcttctgcccgggaaacatcgacgctactacgaggaagtgctgaactttctacgaaaccgaatttcaccggtcgcaccgagaaaaggtgaaaactaa

SEQ ID NO: 74363 - DNA, 3836 bp, Heterodera glycines
  Genomic contig location: Contig_ID=SeqID_1545; Location=3610..7445; Strand=-
  SCN-specific regions: Sequence locations=1-570,592-598,622-720,779 -938,960-1068,1101-1150,1173-1282,1313-1322,1396-1495,1519-1660,1682 -1700,1743-1774,1796-1949,1985-2070,2109-2261,2309-2333,2378 -2596,2619-2688,2711-2898,...
  SCN-specific regions: Sequence locations=...2937-2980,3002-3437,3470 -3511,3665-3836
atgactcatcgcactcaacacgagttaatgtgtgacaataatgacctatttttggacaataaatctgaaaaaaatgctgagatgggagaggttaatggtcagtgacgcccatgttagtggtcacagtgcacacaaagttaagatttgacaggggacggataaacgtacaaaaatggaaaaaaaagatggatttgtaaggattaagcaagaagcggacggataaaacgctttaaagccaaagcataaagatccataaaactggaagggagtatgggatagtttctggtagctcgtgatgctcgagaccaaaaatttcccgaaactcgagatcgagacttaaccacgagaccgagactagaccaagagacccgaaactcaaaaaacccgacttttctcgaatcgagcccgcggctctcgagcttcactgctggaagtccagatgctcagatcacaatggttttactgagaagcaggactgtatacgtgaattttctattggaaatcagtagtaattgcggcgattttatcaattaaggaaatccgtaattgcgcccagcaaccctgtgagcagaagcctagcaaattaattgtcaccatcatcatatataatactttatcatttattcttgctgattttatctgttatccctgctttacaccttcggatatatttggtttattcatttatagagtattaactaaaataaaaatttcttaggcaattttaattttttttcaaaatttcaaaatttataggaaatttaaaaatttaaaataagccggcggcggcgccaatcaacaaaaagtaaaaaatccgaatcgaaaacggcgcttttgaacttcattagtggaccgaaacaaaatcaacaacaaattgcgccaatgaaaaaaagacaaccactttttctatgctttataatttttttccataacaattaaaaaatacagaattccaatttattgtatactaattaattatgcattattcattcattcatatttcacgccaaattgtccgatgaaaaatggggtggaaaatttgtcggatgattttgtgatgatttggccaatttataaaaaataaataaatgaataaattacttttgtcatttatcggtgtccacaatctctgctgcaaaatgtgtggtcgtttgtccgctttttcttctgctggtggcttttcccccatttttttttttacttttttacacgtcgacacagaaaattcagtgatttgtccaacgacggaatttactgcaccaaccaattccatcccaccattttcatccattcatttcattcatttgatcatttgggaatacatattttatttgtaaaataaaataaaaatattttttaatagtaaataaattaaatataattaatattaattaactagcaaatgaactctttttctctattgaccgtctttctttgcttggtcattaattgctcagctcctccgatacggtaatttcaaaagtaatctcaaaccaataaatattttaaattttaaaagcatttcaaaataatcgagtctaagccttgattcaggcctaatcaaagcctggatatttggcctgaatttttctaatttttcaaaattttcaattttcagccctttgtcgtccgacgttggcatttggaaattgtgcaatggcaaaaatgggacaattttggtggaaaatggctgcacaaagtaaaatatttcaataatttattttaaattaactatttttaaaccatttttaggctcctcatctgctaccaaagcgaaatggccaaaaacagaaaaatcggaaaacgttttggggtgggcaaaggaataattggcaaattgaaatttgtggaatgtgccgaagagattgccgaagaccaatggcacggtctgatcatttccaagcaccaagacggagtgatcagctacgaatcgaggcaaattgggagagataaaatattttaaattatgaatttaattaattaagccatggattcgacgacattttcggcaccgatcaaacgaaaaaaacggaaaaatatttggaaattaatttgaccaaaagtaaaaccaaattaataataatattttaataataattattattttacagatgctgaaccactcggaaacgaacttcaagaagcgctttcttctgccgcatttttggacgattttatgccatttgttttggcattcgaatttggcacaaaattttgcgcagaaaacggcggcaccaacaaattgtgcaaagagaaagtccaatttttttatatttaaaattctcaatttaattaattttgatttttagtgccttacaaaggcaccgtttgttggcacaaccaaatcccatggcaaaacaacaacaacaacttcaatcccgacaaccaccgaagaacaaacattttcgtttcaaccattttccgaatttgtgtcccattttggcactaattgttcgaaaattgttttccccgtggaggtggccaaattcattgtgaacatcaccgctaggccctaccgaattgcgtgcaatgactatgaaaaagagtacgagatcggaaaattaccgccgcattatttggaaaatgcacacaaagattttttcaatgcttgcatgtcagtgccgacaacaaaatgcgcaaagtgattgaaattctggcacaaaaatttggtgccaaattgagataataatggcaattcatgttttcaaaaataaagcctaagcttagcctaagcttagcttcaagtaagcctaagcctagcctaaagcttaggcctaatagacttgcataggcatagacctaaccaagggcctaggcctaagcaagtctaagcttaggcctaaacttaaagcttaagcatatgcataagagtctaggttttttaggcactatacaaaattttttcaataatttccatttttcattaaattttcttataaaaaaagttttgtacacaaaacggcaccataaaaaatttgcaaaatggtaaaattgtttgccaaattctcacaaattgttttttaggcatgcggaactgaacgcatgctataaaagcatgaatccagtggtgccaagcaacaatgccatcgccaaattatgccaagaccatcttaatgaatcgaatgctgccggatttgctgtacaaatttgcatccatcgggatgaaatggaacagaagcttgtctttgaaacattcttgaacctttccaccacagacaaattgtatgtcaattaatgatgagagagattaaatgatgtcattaattaattaattgggttaattaagcatcaaaatgacgcgcaatttcccaatttccgttgaacaaattatgaaaacaaagaaaattattcccattttctttctcgaatttggcaccgatcaacagcaaagcgcaatacgagaacaagaaaatgggaaagtgatcagcggagcactgaatgaaaatgtgaaaataaaacgtcatttttaataattaatttagaattatagcaatttgccaattctttttgaaaataattaatttaaaaaatggacaattcatttgtcaattattttcttgtttaaataattaaattaaattagccaatggcatttgccaattattttttaaatgatgaattttattttttaaagaataatttgttttaataattaattaattaaaatttaggccattggcattggcaccgttctcaatgacatcaaagcagaaaattttgccaaaatgattcatttggtgccgcctgttgctgatcggatgaaagcgttcttccagattccaacgcctaacttcaacaaactgatcagtgcccagaagccatacgaaaatgactaa

SEQ ID NO: 74364 - DNA, 910 bp, Heterodera glycines
  Genomic contig location: Contig_ID=SeqID_1545; Location=7527..8436; Strand=+
  SCN-specific regions: Sequence locations=1-110,153-166,188-207,235 -300,322-399,434-502,525-910
atgcaacgaaggatcaatgaatgtcagcagactcggaagaaaaaagtcactttccgcgaaacagttgaggaaataaatggcacaacaacggaaattggtaggaaatgaacaataattaaaatttaataacaattttatttaatttattttttcttgaaaactaagcttagatttttacgaaataaaatgacaaaatatttgccaaaatatgcaataaaatattatgcttttttggacaataaatttttagaaaaacatgaaagagatggcacaaaatgccatcaaaaagaaagacccaattaggcctaaaagaaatttaattctaaaaaatctcaaaatatgtaccaaaaagtttgaatttgtagaaaaatatgtaaaagaattttcacaacacctaactatattattattaaaattataaattgatttaaatgtacattaaaaaaagaattcactttaaatttgccctcatttgtcagggcagggagcgcggctctttcgcgtttacacaaatttatttcatttaatcttttaaatgcttttttgacttttttttttatctgtgggttttttaattaatgctgctaataataatttaattcttaatttcaatagtaattagcgcgtcttaattgctttttttttgcaaagaataattttaatttaattcagtgcacatggaaacgtcgagccatggtaatcgacgacaatcttctgacatcagcaccagcattagggagctgcaacaattacacgaaattgttttgtccatccaaaatttggcggcaccaaattcacggcgacggcattactcatctgctgatgatggtgagcatggagaagcatcggttgccattcaccaactgcaacaggccactcagcaacttcaacaagttggatgagcgaatta

SEQ ID NO: 74365 - DNA, 1878 bp, Heterodera glycines
  Genomic contig location: Contig_ID=SeqID_1546; Location=178..2055; Strand=+
  SCN-specific regions: Sequence locations=1-103,177-244,271-399,421 -430,487-593,619-838,869-972,995-1009,1053-1293,1315-1326,1349 -1390,1416-1549,1572-1644,1666-1878
atgagaaagaatggcaattatcaaaatgtgtgtagaaatgcttttcattttactccatcaccgatcacttgtgatcagcgagtgcagcaaaaagatggggtacaaaaataatacaataattattttatattattttaaacattagcattttttgaaatgatttttaaaaaattattcattagcattttaaatgatttaaattgtaaatcccaaaaaataatccgttttctagctgacaatttgctataattaaaaaataataattaatttcagttgtttgctatacatttgaaaaattgttgggacaaatacgcctgtcacattggcctcaaaatccttggcactcaatttttgaaggttcaaaaaacagatcaaagcggtaaaaaactttttagttccatatacaaaaaacattttgaagggttaagagatttttttatttaatttaaaatttaaaaaaatgtaatttttttaaattaaatttttcttgtccagtggttaaaaactgagattcctgaccaagaaatttcatgattccagggatggacaattttttgtttatgaaaaagtcaccaaattatgaacaaaaatactttgaatgtaaccaaaattaaaaaagtacagtataccattatcattattatacagtgggttggagttctgtgttcgcaacatgctgtgttccggcagaaagtgccggcattttttacttcgaagtgcgcatttttcacgtgctcaggtaaggaggcaggcactaaaaatccaggacaaatcttggcttgtcacggcatggacccatgcttgtgtaccaagatttttgaaacatattttaaaaagcaaataaattatttgaaaaaataaattaaatggttaggaaaaattctctaaatttttaattgacaaaactaattctacggtagtggaactaccgtaggccttgtgctgggggtgggaatttgaaattttgaacaaattcaatataaattattattgtcctaaaaggtccaactttttaaatatgatatttgtattaaattaaaataataatataacctacaaaagtctacggtattgatctaccgtaggcgtagagcactgctgcttctggagttggaatttgaaattttgaacaaattcaatacgaaatccaatgtacatttcgggcaaattgaacattgacaagcatgctattgtaattttaaaatttgaagttgcttcaccatcggactggccaccaagcaaatgccattggcgccacaatttgccctgccggcacacaacgcttcttccgctgctgcatctgctcccggtggcaccacccatttgtttggtggcaatgaccattttttgttaatgatttccatgagcagcattaagccaacacagcaaggatcaacaacaacgaacacaacaactacaggatttgcatgtggggatattgttggatttggcattgaattggcaaatcgacggatttttgtcacgaagaatgggcgccgtttgggtgaataagttctttattgcactttttaggcgcccaatcggtgctaaatgactttactcaaaaacccataaaaatgggcgttactcaaaaaaccatcaaatggaaaaattttgacagaaaattaattcataacttcgcccaaaaagaacagaattttaaaatttgggtattcgatagaatcaaatccctcgatagcatgcaaaatttcaaaaaaattcattaagtttcaaaaaagttatgacctgagaaactcaaaaactaagtttttttttttttgaacatttttggtcgtaacttgttgaaaccttaatgagattttttgaaatttcgcatgataattagaaaacaaattgtgctatcgaatgcaatcaaga

SEQ ID NO: 74366 - DNA, 139 bp, Heterodera glycines
  Genomic contig location: Contig_ID=SeqID_11034; Location=653..791; Strand=+
  SCN-specific regions: Sequence locations=1-139
atggtggtggagacgcaggaacagctgaatattgaccaccatccatccgcgtttcaccgtgtcggctcggccactgttgcgccacaaccgcccgctgctgtggtggagacgaacgtcgttgccggaacgatgccgacag

SEQ ID NO: 74367 - DNA, 2032 bp, Heterodera glycines
  misc_feature (1789)..(1789): n is a, c, g, or t
  Genomic contig location: Contig_ID=SeqID_11036; Location=603..2634; Strand=-
  SCN-specific regions: Sequence locations=1-125,150-254,290-433,507 -719,753-1112,1144-1340,1441-1574,1634-1812,1834-1867,1899-1908,1930 -1963
  Gene Ontology: Mol. function=protein binding
atgtataataaattaaggattttaagaccaattaattgctgctgtctgattgtgagaccgaaaaacccttgactttagactttttttttgtaaaatatgttcctcaaaaaatgaatgtttttttaagtttgtcaaaagccaaacaatcattagagggcttaaagaaatctcggtcttctaaactcgaaaacctggacaagaaaaactcgattcttttctcgctttggcactctcagagaaagactacattttaaagattatttttcctttaaattttagaattttgccaattgttgtttggcttacattggcaaaaatgcggacactttgctcaaatcggatgcttttttgcaaattgaccaaaaattgttgtgcgaaattttggagtgtgacgaattgcaaatccgtggagaaatttcaatttggaatgcggtaattttaacaattaaatttaaaaactgaaaattttattagtcatttaattatttccattaaatttttttaaaggcactccgttgggccgatgaaaaatgccgtgaaaatggcattgattgttcagcagagaatcgccgtcaaatgcttggcccggcactgttcaaaattcgctttccgcttttgtcaaatgaggaatttacgaagaaaattggtaaaaaaataagtcaaaatttcaaactcgttctctgatgagatgccgtagaatattcattgtttttgtggcgattttttaaaaaagttttttaaaatttatttttcaataagttgatacatatttacagttcccttcggtgttttgtcaaaagatgaagtgatcgccgtttaccagttcaaatcccttccaaattgtcatgggatttccgacggaattttcccaatgccattttcgactaatggacggatttccgatcgaaaaaagggcacacttttgctggacattgaaaaagtgtcagaatttgcacgagaggaggttgagagcagtcggtacagcgaaaaagtgtacataaatggattaccatggaaaatagtggcagaaataagtcagttgacggaaagcactgacaatattgagaaatgtttggacttttctctttggtgcgatgcttctgaagaaggtgtaaaattactaataattaatatatatattaacaacaattaattgttaattagtactaattaacagcaataattaataccccattaagattcgctttggcgctgctgcgttcgttcggcaacttttcgaattatatcgcaaaaaaatgggacggagaattcgattgggacacttagtaactttgtgttggacaacaaattttttaacgggaatcccgggcgggaacgggaaaaattttttttcgaaaaaatattgattttttttttataaaattttaatttacttattttttaagtaaaattttatattttaaacaattaaaaaaatttcttgctatgtaaagattaaacattgctttattaatgacgaaaaatttaaaacttgagtttttgaaattaatccggtaataatatttttgagggtaccggcaaaaactggtaatttttctgttctaaaatcctagaaaatttttttatatatgtacaataattttcattaaaattgtctattatttttaaaattccaaaatattcttagagaatttttctatgttttcaacttatttacaaaatctttttttggttaaaatctcttttttttgtgagcgccttttacaaaatcctttgtggtacagggagggggtccggcggtgccgataggcgccgccggggaaaattnttgaaatttttagtgaaatttgctaacaaattttgtccaaaaaatgaactataattggttaatttgttggcttatggctatttaaaaataaaaataaattaattttttagtgaaattgctaacaaattttgtccaaaaaatgaactataattggttaatttatggccttatggctatttaaaaattaaaaaatatattttttaaagttagacaaaatttcttattaattaaatttcaaataaa

SEQ ID NO: 74368 - DNA, 1698 bp, Heterodera glycines
  Genomic contig location: Contig_ID=SeqID_11037; Location=1174..2871; Strand=-
  SCN-specific regions: Sequence locations=1-8,31-488,514-651,673 -720,742-1268,1291-1305,1327-1623,1645-1698
atgaacgttatgaagactggagaagaacaagacatcaccaatttcaaacttgggaaaactcaaaaggtaggcggactgccacgcgtgacagtcattgcttgatggcgtcaacgcgtttggtgttcgttcggcgagtgttttcttgccccaaataagctttcaatgtttgttctaataatttttttggtattttacggttatctgtactcagggcattttttggttatacgagtcgtcgtcgtgtcattttttggttgtgcgggtcatcctcgtgacattgtgaagcgattttgtgtataaaatgtgaattttttgaaaaatggattttgactttttttcaaatccgggtttggggttcgaattgggtcaaaacagatgccagaatcggtttccccgaccttgaaaacccctaaaacaagtttatttcaaaaaaatgttttttttcaaaatctgaggacagataaccgtaaagaaccattttttataatttcctctttgattatttgcattttaagcattcgcggggcatcattttcaatccgttgaacccgaccatacgtattcacggcagccgttgtagttcggcatcaattcacccgccccctcaacaacaacattggtctcgaagtaacccatcttttctgtattttttacttgtaaacccccaaaaaacttaacaaattttataagtgtctgatcgcccgaccctttccgacttaatttttgaagtcagcagaaacatcgaccgacaagcggacgcagcgaattgagctcggaatttcgtgcactatgaaaattttgaagattcgatcatacaattctcttttttcgattcattcaatatttaaaaatatcattatttttcgtgaaaattgttatttatttatgcgattctggtaaagtattaatgaatttcgtattttgaagccttaggaatgtaattttaagactttttcgctaatttttatttggcgggatttcgactcattttggctttggcggaatttcgacgcggcgggattatgacgcggcgggatttcgacgcagcgggattttgacagcgcgcccaaataatatcaaaaatatctaagttgaatggttctaaaaaagttaaggtacatcaaagtttaatttaatccgcttaagatctgttgagtgcatgttcggaagtgagcgaggttggagtggtagcacaaaaagcacaccacaaaacaagttttgaacaaaaaacaacaaattctattacttgtcagagtttgtaattgtgttgtttctttagctttttattgtaaaaagagatagataacttttggaaagtcaaatgtagcatatcccattaaattcacaaaaaacttactcatattttctcgaatagtcttttgataaactgctcctaaaatgcgcagacaaacttcaaactttgcaggctcaatgcaaccgtttgaaggaagcgaatgaaactttgcaggaagcgaatgaaaaacagaaggaggaaattggcgaactgcagaaacagctcgacgccattttccaaacaatgcttagccgcgcagaggcggaacaacgaggaggggagaaggaggatccgcctgaataattgtccatgttcggatttgttggattgttctgtttgttggctttgttaattgttgtacggacgatatgttgttgtcattgtaatggattttgagaaataaa

SEQ ID NO: 74369 - DNA, 387 bp, Heterodera glycines
  Genomic contig location: Contig_ID=SeqID_11037; Location=7..393; Strand=+
  SCN-specific regions: Sequence locations=1-205,227-387
ccgaattcggtcacagttcgttggaagtactgtacaaatgtccgacgtgtggcaaagaaacgcacagaaattatgagtgcttcagtacgtcaaattttaccacaaatgcactcaattacaataattgttccgctttaagttgacgtctcttacaactggggccgacgacacggcgatacagaaatgtttcgctaccgtactttcgcgggcagtttgtggggacagtacacgaaaaatgtcacaaaaacgatactgcagaagcggatgaccatgaacaactttgagttggtggagcacaaatacgatgtgatgagcaatgtttggatgggcaattattacaagacaagcgatgaatggaccaacgatttgataaggcgtcttttatag

SEQ ID NO: 74370 - DNA, 2100 bp, Heterodera glycines
  Genomic contig location: Contig_ID=SeqID_11038; Location=49..2148; Strand=-
  SCN-specific regions: Sequence locations=1-666,688-1718,1741 -1864,1888-2100
atgaacaatcgcacatttgttctgcctgatttatccatcaattatgaaaaaaaacgcattttatggcacattaacgagctgtatggctctgataatgtgccatatcatccaagggaaggggtgccaactccttgcccaattgtctatcggcatacggatgaaacgcagtcgacatccaaggccgctgagctaatggaagttgatgaacatgatgatataatgatcatcgaaccacagacacgtggacaggcagttgatgccattctcacccaagcccaagtggccggtgaaaaccaagctgacacgcttggtttggtgtcggagtcttgcatcccgcaagagccaattgcgcaggctgatgatgtaattttcatcagacctaagacgccaccaaggcgatcaatgcgcgttcaaaaaaggctttcagcttctgttagccgttcgccttcaccggcgccgaaacgccccccgccagcaaattcgctgggagtggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtagcatttgctgccggaagggaagagttgtgctgccaatgcttaacccgcatcctgatgagctcaaacagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcgcaagcatataagcaggcgcgtgagcagctcactgagcttctccaacaacaaaatcaggaagagcttcgtttcttccgcatgactttgttggatagccgcagggctccagctggtcttaaagacccaaaattgcacccacaccaaataatcaccccttctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgctcagaatgcatctggcctatttgactcggaagccgagtcagataatgagtcgtgcgagactcagtcaattgcatcatctgatgtggggtcagtcgcagattcagatgctgaatctgtagcatctgtttcatcgccgcaccggcggattgacaaatccaaacaatttatctccctgcgagattattgcaagtattatctcgcaataagggatgaaaatgtggagttgcaataccaccacattctttcatgtggtggaggacttggtcagcgctggatccttgaccaggctgcaaaaattgattggcaaatagcaacatttttgcgtagacctgacatggatctgcggatcagcactccaaaaaatctgctgcagtatttggtcaaccaatacaatgggcagcaagcacggcaaaaccccaatgcccaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcacgaacaacagggaatggcctgagttcaaagagaatttacacaaaaacgataaa

SEQ ID NO: 74371 - DNA, 871 bp, Heterodera glycines
  Genomic contig location: Contig_ID=SeqID_11039; Location=1605..2475; Strand=+
  SCN-specific regions: Sequence locations=1-200,222-522,544-646,669-871
atgggaggaggaaaaggaaaaaccgtaaaaaaggtttctgaaacggaacagcatgaaaaagaaaaagtgaaatgcgctgaggatgttatttcactcgattctggagaattttatgacgatcaggctattttgtatagcccaaaagcacaatttgatcgctttggattttgggactcatgtgtcaacacggaagcaaaaagagatttaaaagaattgaaagagaaggagaaaatcgtgaaaagtgaattggacaccccgtctatcgaaaagtggggaatccgagtccaaaagttgcgagagcatgagaagaagacgaaggaggcccgaagtactccaatgccttttaaaaattcgcgaaagggcactcatggatgaacttcacaggcccatcgacatcggccgcatggactatggtaccaggaccatcaacggccatggactttccgagaatcaccggcggatttcaacagaactaatttgattggatttaattacaatgctacattttaaccaaattaatcctttttattttaatcaaaatacccaaaaaaaaaatgtagcataattacattttgtatttcgaccggggacggtcttttagcgtgccgtggatgaatatgataataatatttaacacatttattcaattatctaccatattttgtaattcacatgtcacactttatatcttatgtcctaaacaattgtctctctcctagtgggcgggtctttgagcaccccctccacctttgattacgccccgggaattttacctggatcactctattcttcatcgggcctctccctcggcagtctctgctcccgagaccgaatcgggttgagtgcctaagaattgtatccttccccctga

SEQ ID NO: 74372 - DNA, 439 bp, Heterodera glycines
  Genomic contig location: Contig_ID=SeqID_11039; Location=3019..3457; Strand=-
  SCN-specific regions: Sequence locations=1-262,284-439
atgacattccagattaaaaatttaatatcaaatagaggtaatttgatataaacccaaccttatagtaacagtttgctgagatttatttaaggacaaagttgacgattgggattaaattttctgccgaactggatttacgggattaatcagcgaagaccccgcaaatctctcatttaaaattgcgagttcctcgcgggatcttgagtcaataaattcttttctagctttttaatttttatagccgaagctttgcgtataaaatcttttaacaaatattttgaaacaatttggcgttttttaaagaatttatcataatttgtactcgaattttcaaaattttccacggcggttctaccggcaccgccagatccctctattattcaaattttcagcatcggataagcaagaatttgtagccttttatcgccaaaaggactga

SEQ ID NO: 74373 - DNA, 871 bp, Heterodera glycines
  Genomic contig location: Contig_ID=SeqID_11039; Location=4203..5073; Strand=+
  SCN-specific regions: Sequence locations=1-46,68-871
atggacaacagtagacaaaactcgctcaaccacatgtatccaaatctgtttgggagtggggggaattcgtcatcaggaaatttgggacagggacagaatttgtacagcactcaatcatcatcagttggtcaatacggaacggcaccattgcaacaatatcaacctatgccatcatcacttggtcaaggagcagccacaagtggagatatgctgcataatgtacaaatgatggcaacaaataatcagcaaattggtaccagcggaagtggcagctacaactattttaaagatcaaaaagatttgtttgacgaggtcaacccttttgcctcgccaaatgcatcatttgcacatacgcatcaggaagttgttcagcaacaacaacagccgcaaacgcaaacgccctcattgaatgcaatggttcaacaacaatcacaacagaaacaaaagctcaaaaagaagacgacaataaagcaacaaagcacccttgccactgggcagatgggtaatttgtcaattaacgagtcaaatacagcctcttcacatacggctgtgccagtgccattatcatcacaagcaaatcaaccgagcattcaaacctcgccattacaacacactggaggccgtacaagcttccaaaatttaccaccaggaggaaatcaacagtcgcatccacaaatgttggcgcactctccgctaggcaatatggctggaagcactagcatgggccacgcatcggcgggacctattcagggtgggcaacatccgctaggcaatatggctggcaaagccagcattggtcaggcttcggcactgccggcacaaactggacacatagggctatcaccgcttggtcaagcggctggcaacaaca

SEQ ID NO: 74374 - DNA, 650 bp, Heterodera glycines
  Genomic contig location: Contig_ID=SeqID_11041; Location=2190..2839; Strand=+
  SCN-specific regions: Sequence locations=1-240,262-650
atgacaggcagtggaccaatacaattcggactgcattcgccacaaccttcaactccaaccattccattgtcagaagaaagcagcttgcagcttattccacgctgggaacaagacatcgtctgtcctccacgtttcccgatctcgttttggaatgtatacaccagggctcaaatggcaattgagcgaacgaacaacggcatggaagccgcgcatggacaatttgcagtaaaaaatttcatcggaaaacattattttttggtattttcagcgtgagctcaaccatcatccatcattgagtgacttcattgctgcattcacgaaggacatcaacaaacagttggacatcggacgcgcagaacagctccagaaaagcactaaacgacgacaacggtacgtcatcaaagaacaaaatgtggtgcggatccttgacgaggccgactttgaatcggaagaaggattgacaaacgcctcgcatctgatcgggctcgtgatgcaagtctttgcggagggacttcacgtccgtggaaattcagagagtggtgaagaaactgaggccgatgaaaattgatttaaacattttcatattattgttttttttattgatattttatatatgttatgaagatttctttgcttgaagcacttttata

SEQ ID NO: 74375 - DNA, 81 bp, Heterodera glycines
  Genomic contig location: Contig_ID=SeqID_11043; Location=1577..1657; Strand=-
  SCN-specific regions: Sequence locations=1-81
atggccgcacaaaacaaaggcaatatggccgagattggcatcagattcggcttattgatgaaccttttgttggacaccttg

SEQ ID NO: 74376 - DNA, 106 bp, Heterodera glycines
  Genomic contig location: Contig_ID=SeqID_11043; Location=882..987; Strand=+
  SCN-specific regions: Sequence locations=1-106
ttggcgaatcatggaagttttgcactatttcacttcacgcggatgggttttcgagtagcgaaatgcgctcaaaatgtgggaacggttaagcgaagaggacaaaaag

SEQ ID NO: 74377 - DNA, 225 bp, Heterodera glycines
  Genomic contig location: Contig_ID=SeqID_11044; Location=924..1148; Strand=-
  SCN-specific regions: Sequence locations=1-225
ccctaccgccaattccctaccgccaattccctaccgccaattccctactaaggcatttgggccatttccataccaaaagtgttgaatattgataaacattgagagtaaaacacacaagaaaatttattcactgctttttagatagctcgtcaagagctttcggatgataccaaatttatcaagattcgatcgttttaaaaaagttagaagtgtcaaatctctcaa

SEQ ID NO: 74378 - DNA, 599 bp, Heterodera glycines
  Genomic contig location: Contig_ID=SeqID_11046; Location=1073..1671; Strand=+
  SCN-specific regions: Sequence locations=1-33,193-297,319-537,570-599
atggaaagaatagaaaattggcaccaaattttggaaggaaagatgaaagaggaaagggatgatgacgaagaagaaagaattgactggaagaaaaaaggaacaaacaaaaggaggtggaaaaaaaggagaaggatgatcaacgaggaagaggatgaaagggaattggaagaaagaatggaagagaaaagaaaatcttccaccgccgatcggtgcatcaaataataatgggaagaatggggagggggaagagattagacagactttggggcgccgggggcggcggatgatcgccctttgggaatgatgaatgaatgaatagactgatgtgctgctattgatgtgtgaagtgaagaataactagcaaaaagtaacaccacatcacccactttataagtgttttctgctgctgatgggttggggacacaattggcaatttgtgagactaatgactaatgatgatttagagagagagacccccgcttggggcgggaactgttttttgatggtgcggtgaatgtatggagaaaaatgggagagaggaaatgaaaattgaaatttgtaaagaaaatgatttgtatggttgcggtaaattcaaacta

SEQ ID NO: 74379 - DNA, 264 bp, Heterodera glycines
  Genomic contig location: Contig_ID=SeqID_11047; Location=1294..1557; Strand=+
  SCN-specific regions: Sequence locations=1-23,66-264
atgttgagcatggaaatggtcgcgacagaggaagacggagaaggacaacaactacagcagatggaggaggaggacaacgacaatgccgacattctgacccactacatcaagccggagcgcaatttgtggttgttgaagcgtcgtccaaccgttgggggaggaaaatggcaaaaacagtgggcccaatgggaggcggaggcaatcggatggaattggaccaatgcatggaatgtgatcgaagttgccaatgaagaggacgtggac

SEQ ID NO: 74380 - DNA, 1321 bp, Heterodera glycines; identical to SEQ ID NO: 11048
  misc_feature (1205)..(1205): n is a, c, g, or t
  Genomic contig location: Contig_ID=SeqID_11048; Location=1..1321; Strand=+
  SCN-specific regions: Sequence locations=1-1321

SEQ ID NO: 74381 - DNA, 1511 bp, Heterodera glycines
  misc_feature (1486)..(1486): n is a, c, g, or t
  Genomic contig location: Contig_ID=SeqID_11050; Location=1245..2755; Strand=+
  SCN-specific regions: Sequence locations=1-107,130-281,307-993,1015 -1511
  Gene Ontology: Mol. function=DNA topoisomerase activity; Cellular component=nucleus; Biological process=chromosome organization and biogenesis (sensu Eukarya)
gcacggattatgtgatgtatgtgctaattgttgcggaaaagccaactattgcagaggagattgcaaaaattttatcgaatggcaactacaaaaagctgagaggtgactaaattaattaaaaaataaaaacgagttgaaaaacattttatttttttgcaggatggaacagccatacttttgtttttgaatgccttggcaaattttatcaacaaattgtcactttccgaattacgtcgacttttgggcacattatgagtaagtcaaatggattttaacaaaccaatttaatatttattaatattaaatcgtaatttaaaattcgattacaatttcaaatttcagtaaaataactaatgaaaattcaaatttaattcaattttttgtcagtcgtccacttaattggtgctttaattcctgctttttagacacctcttttccccagaagttcacttcatggcaccgcgaagagccaaaggcgctgttcaagtgccccattgagccgagagtggccaacccaatgcacaatttgaatgaagtaagtgggtttttgcgccctaataacattttagaaattttgaaatataataaagtaagtcatggctcctaacaataagttacagaaattgttgtcggataaaaaattggtttgatgtatcacttattaggccacttttcgtcgaggtgcataaattcatttattttttttcaatctaacccaaaaattgaagacaatttgtcattttttggccaaaatctgttaataaatcagttttagacagctttatctcccccattttgttcagttcctcgctgccgaggcggccaattgcgagtttattttgttgtggttagattgtgacagagaaggggagaacatttgcttcgaagtgatcgacgccgtgcgcaaggaaatgtgcagggcgaagggactgacggaggaggaatttatggacagagtgttcaggtggacaaatggacgcattggggcaatgggtttctatgtatttaaatttctgttttttttttcattttaattttctttccccatttttaaaagctaaagacacaaataatttctgatagcgaaattccggcggtgaaattttggggtgcaccccttaaaaatgttagaccaaacgcaaaaacaaaatgccgccatttgcgtttcagggctcgtttttcatcgatcaccgccaaagagatcaaacgggcaatggctgatctgggcaagccgaacttcagcgtttcacagtccgtgcttgttcgacaggaactcgacttgaggatcggatgcgcattcacccgctttctgacgacgcattttcgggttttcaatttttgctatttttcaacaaaatttcattttttaatgcagcgtggttattgcgactttgacgacaattacgtttcgcttgggccatgccaaactccgactttggcattttgtgtgagacggcatgacgcaattggacagttcaagccccangccgtactgggtggtgcaagccgag

SEQ ID NO: 74382 - DNA, 243 bp, Heterodera glycines
  Genomic contig location: Contig_ID=SeqID_11051; Location=1321..1563; Strand=+
  SCN-specific regions: Sequence locations=1-243
atgtgctgcatattacttaatattcatcatgatggggattcggatgataatcagcttgatgagctttatgcagatcaccaactcgttcaaatacatgcaaatgggaacaatgatcaccccgaaaatgacaatctttatgataacaataacacggataagtcaaaaataattgaccatgacaaggaattgcgggatcagtcccctgagctcaccaaagtgccagaattaaatggaggagagttg

SEQ ID NO: 74383 - DNA, 473 bp, Heterodera glycines
  Genomic contig location: Contig_ID=SeqID_1547; Location=352..824; Strand=+
  SCN-specific regions: Sequence locations=1-131,153-473
atccggaattgggtgcttatggacgagtggacgcatggattcgaaatcgaattcaaaacaatggattacaggggaggtctgcaagtttcccacaggaaatgtggaatatgagtgaaaggtgaaagtggaaatagaattttaagaaacaaaaatttagagttgagcaaaatttaatgaggacaaataacagcatcgaggggtggcatcgctctttcaatagccaattccgcttccttcatccgccattaagttattttgtcaaaaaaatgaaagaagaagacagacactggaatttgattaagcaagattacaacaataacccacaaaatggaatgcgtggcaggggaatggcaaggaaaaacatttacgtacagcaggaccaagcaattcgcgccattttcttggatcgtcataacagaccttttttggcctatctacgtgcaatcgcttatcgaatgccggaaccaaattga

SEQ ID NO: 74384 - DNA, 360 bp, Heterodera glycines
  Genomic contig location: Contig_ID=SeqID_1547; Location=892..1251; Strand=-
  SCN-specific regions: Sequence locations=1-360
atggggggaaaagagagaaaaagggaggagaaaaaggagcagaaactgaagaggaaaaagaaaattgcagctgaacaccatcagaaacggctcccggacaatccgacagtggacaattcgacagtggacaatccgacagtggacaatccgacagtggacaattcgacagtggacaatccgacagttggacaatccgacagtgaggacaatccgacagaagtggacaatccgacagttggacaatccgacagtgaggacaatccgacagaagtggacaatccgacagttggacaatccgacagtgaggacaatccgacagaagtggacaatccgacagtggacaatccaatcctacagtaa

SEQ ID NO: 74385 - DNA, 647 bp, Heterodera glycines
  Genomic contig location: Contig_ID=SeqID_1548; Location=2250..2896; Strand=+
  SCN-specific regions: Sequence locations=1-45,81-349,372-398,422 -454,623-647
atgaatggatctgatttatgcttttctgaggccgaaagtgatcatttaaaagtgaatttttgtaaaaattaagcatatgtctaaataaaaaaaccggagaaactaattagcaactccttaaaataagaatcaactaaagcttataaaatcttttgagaaattatttttccatattataaaattggtaattttacatacaataaagaaggttgacgcaaattccgagtgaaaaatgcaaaaaaaaaatttgttcgaattcgggtccgggtttcgaaataggtcgaaatggatgtcatattcgtgttcatcgcccccgaaaacccccaagagcacctgaaaatcgctcaaaatctcttttttacctcttttttatgggaccagtgaaaccgatgattacccaacaacagcagcaaaaccaagaagttcaagcagtacaacaacaacagcaaattttgatgggaaacgagatgaagatggacaacagcaaaaatggagaaacaagggaagaggagggaaatagcattggggaaggaggagagacggaagagaaagagaggaaaaggaaaaattcggcggaaggaagaggagaaagaggaaagaatgaagcagaaaagagaaaggaacagcagcaaattgacactttttaa

SEQ ID NO: 74386 - DNA, 885 bp, Heterodera glycines
  Genomic contig location: Contig_ID=SeqID_1549; Location=62..946; Strand=-
  SCN-specific regions: Sequence locations=1-252,274-340,362-402,424 -540,627-688,712-720,742-885
atgtcatttttgaccaattcaataaattatggagatgctttcacacaagcagcagcaaatggaggtaaaaaaagatgagaaaatggaggaaaataagaaaaatataaaacccaaatttttagaagtgaatggcgatgcaattaatttggacaatgatggacaattatttgatggaaaaaacagtgaatcgatcactgatcagcaacagcttaaggtgggcgaaagaaaaacaaacaaaaaaacagacagaaacaattgggaaaaatatttttagtattatgtgcaacccaaaagagattttgctaatttaaattcaggaatttcgtgaaaagtttgccagaatggaaatggaattggaaatggccaaattggaactcgaaactgtgagttttgctataaaaatattttattttctgttttccctatttgtcttaagaagacacttgaacaaaagttaaagcagcagcaggaactgattggagaacagaaggcattgaaggaaaaattggccaaaattgaacaggaaaaggagaaaaatggtaaaaataataaataaaggaattaataaaattattttatggaaatatttatttaaatattcgataaaattaatgaatttaaatttacagatgccaaatatttgactgttcaccatagggaaaaggaaaagggtaaaaagttacaaattaattttcttattttattaattcacatttttttcaaaaaattggtgtaaaattattttatttccagcaattattccaaatctgagcacatcggaggaaatgagtgttctgattgccagaattgctgagctgaatcgagctaacacagcggaaccatcaatcgcaagttctgctgatttgtttgggcaagacggaaacg

SEQ ID NO: 74387 - DNA, 432 bp, Heterodera glycines
  Genomic contig location: Contig_ID=SeqID_1549; Location=1365..1796; Strand=-
  SCN-specific regions: Sequence locations=1-432
atgaactacacgggtcgtcttaagcatgatggaagcagaacacgcccgcgatttgacccaaacatttggagtgtttacactcgaacactgcaaggcgatgaccgaacgaataaccattcagaagccgcaaacagacgcctgcaatgcgcatttgcctgttcacatccatcgatttggcatttcattgaccttctgcgaatggatcaaaagttatcggatgatgacttcgcgaagtgttcaactggacaagacccaccgcaaaaggcaaagaaatatcgcgaagcagaccgccgaattctcacgatggttcaaaattatttaccactcaacaatggagaccccaatgtttttccacttgagcagcgctttaatcatctatttatcattacctttttgatcggaatttctcgaaattatgaaatgagaccgtga

SEQ ID NO: 74388 - DNA, 2158 bp, Heterodera glycines
  Genomic contig location: Contig_ID=SeqID_11052; Location=295..2452; Strand=+
  SCN-specific regions: Sequence locations=1-140,173-386,408-897,924 -1017,1074-1141,1163-1244,1274-1566,1587-1645,1671-2158
atggcgagcaaacaacctgaattcgcgacggtcgtgccgccgattgccgagagcggattctcgaacatccattggctccttttggaatggaccgccgatatggttatgaagtgagttagttggaaaagggtcaaaaatggaattttttaattttaatttatttcaaattttacagcagaattgttgggctcgttgtgcttgccggcccattcaccacccaaagcgacatcaacggcttcgacgttcggctgatttttgaccagcagaacatggaccacgaattggcaatgcatggatggcaagaatgcgtggcgcggatgaacaacatttcgccgggacaaatcgtcgaattcacgcggctgaaagttcgtgaacaagggagaaatggaaatgtgaaggggagtttccccttcacgttgctgtacaacggcgagtcgcgccaccgtgtgctcggacaggcgcctacggcggtgacaaatgcgggtgagcaaaagggttgcgattttttttggggattcttatgactcaaaaatccaattttctgtcccttttccagtgtgttctccgaatttcaacacgcccatcattgttgaagcaaatgatcaacaccaacacagcagcagcaacggcacaatcattggcggcggcgaccgggacggaaacgatttgaacaaccccagcaacaatgacagcgccgacaatgacgcactgccggcacaactgaccaatcgcccggaccaagtgaacattagcgacattggtaagttgagcggaagcccgatcacagtaaaatgattgatcaaccgcccccccctcccatttcacaggcgatgagcagcgcctgcgcatccaaagcaacaatgaggacgccgaggacgacgattttgaccgcgcagggcacagcggcggcggcagcagcacgatgtcaaacggtgcgcttttttcggccatggcagcgccgggcactgttgttgtgcgcaatgaggacagcggctcgtcatcggtgagcggccaatgaagaaaagaaaggaaaaagtgacgaaagacaagaaagaaaagcaaagacaagaaaaacaaaaaacacataaaaatcaacatacagacagacacacacacattttcatacactcgcatacgcacatgttgttttttaaattttaaatacaactcagtcaaatttttgtgctttctgttgttttttgtccttttcattattctagtgggcagggtcagaggggtgattgattgttttttgtggggttttttgcggaaagccatgcgctttttttggatttaaattttgttttgttcgaaatcatccaaactggacccgttcaggcgtggctttccgcagcacgcccaccgccacgtagtcggcccgttgcctctacgtctccgtcgccctcgccacggccaaattcgccatcgctgccgggtcgctcctcgcctccaccggttcgcgcatgctctttgactgcacagcgcactatgaccgccattgtgcagcgcatgaatgtaattgaggcggaagtggcgcgcgacgagcgcctttctcgcgagcgtgatcgccgccgccgccgccgccgtcaacttctgcaagattgcccgcgctccacaccccgctcgtcgcgcggacaacacagcggacagcagcagcaccagcagcaacggcacgaaaatgtcatcaccattgagtccgatggcgaagaagcagcactgctcggtgttcaacagcagcagccgcttgcgtccgacgacgaagtgtactacaacgacgaactcctcacgattgaggaccaagtggcgcaggggctcgtggagggggcggccaacgaggtggtgatgatgggcaaccacccgttggcagccgccgaccgcgcctggctcatctcgacggcgttcaacctgcgcgcccttccctcgtcagtgaagggcgttgtcgagctcgacgaggaggggcgccgcaacctcgcctgttgcatttgtagggaatggttggttggcggcagccaacgggtggtgcgcccatcgtgcgaccatttcctccatgtcggctgcttcgaggctgaagcgaagcttcgccgtgtgtgcccgctttgtgccggccacttcatcagcggcaagcggatgagcccttagcggctaccgatgaaaaaaa

SEQ ID NO: 74389 - DNA, 1822 bp, Heterodera glycines
  misc_feature (162)..(163): n is a, c, g, or t
  Genomic contig location: Contig_ID=SeqID_11054; Location=1..1822; Strand=+
  SCN-specific regions: Sequence locations=1-300,322-974,999-1451,1476 -1550,1573-1822
  Gene Ontology: Mol. function=N-acetyllactosaminide beta-16-N -acetylglucosaminyltransferase activity; Cellular component=Golgi apparatus; Biological process=development
acctgcgcaaaaacggcaacttacggatcaatcgccagcaaccgatttcaattcgaagagttcagcaactgccgcgcgcccaacttcttccaagccgtaatcttcaattggctcatccggaacatgaacctcaacatttgatgtacaccccccccccccccnnccctccccgtcctatcccaatccatcataccatctaacaatgcttttacttgtaaaatgaaaaaactcccgcttttttcttttcaccgctgtttccttcaatttaaactcggcttcccatccgttttttgccttcgttgcattgtcctctttttacttgccattttcactatttggtacctgcaacttgctttttttcaaaagccaagtgacaaaagcatttcaaaagttagcaaatggagagtaatccaaaaaaatggcaaaagcacttggacaaagccgaggatgaaatgcgaaagagtgttcagtggggacaaagcactggtgcgacgaatggtgcgacgcagacggaaaatgagtgacccggctgagttggagatgaattgtgaggcgattaaagcgagacacggaggagatccagaacaagatgatcaaatgatcacaaaaatcacggagttggaacgacaaatgccaatggcattcgcccgagtgatttatacggtgagtgaccaatcgaccggcccattaagtcaaccgctcacatttcccaaggattacctcttcctggaggcggaattgctcgtcaattacgcgtccaataattggtactgttacgtgttggactcgaagtcctccactgtcttccaacttcggatgcggcaacttgcctcatgtttcgacaatgtgatcgtcgtggaccaaatgtttgacattgaaggtctcggggccaacatgaacaaggcggtgatggaatgtgtgcgtacgttgagcgacgagcgaaaacattggaaatatttggtgacgctgcaggtgaaatgagaagctgaaggaagagagacgaacgaacggctgactgtgttcagaaccacgatgtgcaggcgaagaccaacgcggaaatggcacagattttcacttggttgggcggggccaacgacgtcgaagtcgaattgcaattaccactgacgaagaagcgtttggaacactaccgaaaaaagttcaattggacttttgacgaactaatgctgtttaaggatggtgttgaccagaaacgagatggactaaatatcggaaatgcatctttcagaagcgatgaatcaccggactgacaaagaggggaaaccgttggcattggcactttccaaggggtacatggccgtgtcgttgagtcggcaatttgtggacttcgtggtcaacaagttgaacgttacgccattgttggagcaactgaacaaaggcttatttggagtggacgaacatttctggcagtctttgagctcaagcgaatcattggacgcccccgggggtttcccacacgaatgttttgtgaagggaattgatgagaaggacacgtcattcaggaagtacaagtacatcaccaggtgagcgacagggagagcgagggagaaggagttcacttataaaagtcacaatcctccactttagttcgcaattctcatcattattctgaaatttcatttaattgctgactttggacagatttgcgttgtgggccgacccgtccagcaaatgtcggagcggcaattggcgccacgccgtctgtgtgtttggcttggaagatttgatgggacccgacaacgaaatccgccgacttccccacctttttgtgaacaagctgatgcaagaattcgatttcgatgct

SEQ ID NO: 74390 - DNA, 108 bp, Heterodera glycines
  Genomic contig location: Contig_ID=SeqID_11055; Location=32..139; Strand=-
  SCN-specific regions: Sequence locations=1-108
atggcctttgatcaaatggactgcgacgatgaaaaacttttggacttcgaggaggagacgccggtgaacgaaagtgtgaaatcgttaacaaaagaggaggaggagaaa

SEQ ID NO: 74391 - DNA, 2300 bp, Heterodera glycines
  Genomic contig location: Contig_ID=SeqID_11055; Location=309..2608; Strand=-
  SCN-specific regions: Sequence locations=1-103,125-388,410-597,619 -981,1003-1337,1359-1670,1692-2300
atggagtcaaccggttttcagcaaagatataatttccgagtgcgccggccgataaattatatggaacaagaggaatcgtcgcattctcgccacagtcgacgaaatggcactgaacaaaacaatggtttgaatttggcccctcaaaacattttggacaatgtgcaaaacccaaatccatttccgcgaaatttcgaaaacagtatccctcagcaagtgggaatgcaacaaaatgtcgaagaacaaatgcagcttgcaatgttccgacctcccaaccaaaatgctgtccaaagtttcggaaatccccgggctcattcaacccctcaaaatggttcaccacacatttcatacaatgggggacaacaaaatttcgagcaaaaccaaaatcggaatcctgatgcgaaccgatttggtaatgagattcatggacaaaatatgcaatttcatcgccgccaaaaccctcgaattttcgtcaactcacaaatgacgaacaaccatcagttttccgcaataaattttgaacaaaatcgggaattaagagcacaaccggttcggcatgctcataatttcggatatgaagaaatgtttggtgagcaaaaccaaaactttccaaatccaaattatggtcgagaaattggggtgaatcacccaattcagaatacaagagattttggaaatggacccaattttcaaaattttcatccggttcggaatatcaatcaaccaaattatcaacagcgaccgaatccaaattttgaaaatttggcaccacaacccaatcactttccgaacgttcaaaatttcgagtttgtccctcagcaaaatttccaacaaaatcaaattcctgatattgtaatggaattacataaagttactctgtcaaaccaatacgcaaatacgctccgagaaattccgaacctatacggaacggaaggtcgggacaaaattaaggatttcttcctaaatgttcaaatgtgtgccggagagtggagaccagaaaagcaaaaagagttgctgcagacaaagttgaaaggaaaagctttgaaagcgtatcatattgcgctgaacaaatttggaaatgaggcgacatttggcattctaaaaaccgaaataatgtccattttgagagagacagactacaaagaggcaaacgcattttccgaattgacgcagaatggtaaaagaaaaccaaatgaagacattataaagtttggtgagcgaattcaacgtttggttaattgctcatacattggtctggacgaaaaccagttggatgaggtgtcaaaaaagcacttcatttcaaacataaacgatgtgaatttagccagatttttggaatgccagaccaaagcaaaccaaacttttgatgagcttttgatgatggccaaccgtttgagtcttattgaggatgaaaaaaccgggaaagaaacgaatcagtgggaattcctgttcaatttcaacaacccggcccacaacaaaaccgtactgtccaatttcaaaacccaaattacggacaacgttttgcaaggaattttccaaactttgggatgagagcgcaaaataatttcaggccaaaccgacagagtggtttcagaaacgaagcattccgacaggaaaaccaaaactttccttccaatcgaaattttgattttcaaaacagaaattatattcccacaagtcaaaacactcaaaatttcgaagccacgggtgcaaacagaacccctctgtttcagtcaaacaaaagagctcaaaacaaggaatcgaatatgatcatggtgaaagaagtaatacctgaaaattcggattcgaaaaccgtttcccttaatcacgtgggacacggagaaattccaacttatgaaaaattttttaattctttgattttacattcaaacgaatttccatctcaaaatcccgccaacgctgaatgttctgaaagtccaacgacggaagtgaatattgtcggaatgaaggcgatcggtctaatcgattcggcagcagaaataaatgcagcaaaccccaaatttttacacaaaatcgccaacgaaaaaggcgtggatttgctaaaatggggtttttgcccaaacaaaggaaattcaaaattgtcttttgaagttgcttcttttactggtggaaaaatcccaataattggagtgcttaatgttccaatgagaaggggaaatttcgaatgtgaaataaattgtgttgtaacgaataattcctttccttacgatttcgtttttggcccgaaagcattaaactcactaggctattacatcggaaacacactacacacttacaaatga

SEQ ID NO: 74392 - DNA, 2026 bp, Heterodera glycines
  Genomic contig location: Contig_ID=SeqID_11056; Location=879..2904; Strand=+
  SCN-specific regions: Sequence locations=1-486,509-600,624-862,885 -967,989-1574,1650-1732,1761-1869,1897-1945,1967-2026
atgtacgatgaagttgaaaaatattatcgtcgagcgctggaaatttacgagtcgaaattgggaccggacgattcgaatgtggcgaagacaaagaacaatctttcgtcggcatttctgaagcaaggcaaatacaaggtaaacagtcaaaagtgggaaaagggcgagcagtctcttaattttgcaaattttggtgatttgttaaattaaggaggcggaaatgttgtacaaacaaattctgacacgggcgcacgaacgacagtacggccgagtgaccgatgagaacaaaccgatttggatgatagcggaagaccgggaggacagtaaacaagcggacagcggaatttaccacgagaatttgcaagtgtcgatgaaagttgacaagtgagtgatgcaataagacacgtgaatgttttgacgcttccctcagaattcggtcccaaaattagatcctaaaatatgttctttattgcaaaactcctttttaagtccaactgtgacgacaactttgaagaacctcggcgctctttatcggcgccaggggaaatatcaggcggcagatacgctggacgatgctgcacttcgtgcgaagaaacaggtaacgataaataattaactctgtgggtggaacagtcgtaaaaaacaaatatgattgttgtcgtcaggggctttaataatgttgttgttgcacacagcaaagacaacaacccaaagcaacacagccctatcccgaagacaatttttatttcaaattaataaggcgaagacaaaatcaatagggaaaactgccgattgcataaaactaacaactaactaacacaaaatcacaaccaaaaatgacacaaaatcaaataacaaaacgtcaaaatctattttaaatctaaatattatcacagaacaatatcctaaatagtgccgatgactcttctcaccaaaaaaaagtataattggaaaacgtttttctattcagaatgaattatcataaaatgaaaatgcaattgttgaatcctatgcataagcctgatcggtctttttgctcgattaagagttgggtacatgccttaattcttaattagcatctttttactattaaaagtcgataaaaatgctttagtcggtgggtgaaatccgacaggaagaccgattcagtaaattgttggctctgaaggagttttccgattcgtgaggtgaggacggaatgaatggattgaataatgcgctgttgtgttttgtgttgctgctttgtttttgcttttgtcggtcccttgttggtccgtgtttttctccttttttgagggtttctccgaaaggccatcggtccttccataaagcgaatgtcattaatttgccatttgtgtttgtctgtcgcttttagcctgggcctcacccgtcagtccagcaaagtggcgccgccggcgatgacgatgcccaactgctggccgggggcgatcaaatgagccagtcgctaattacttctgtgtctatgaccccgtcccaatcgtcgaacaaattgaagaatcgtctgctgaatgtgctcggtttctccggagaaggcgctggtggggcaccacaacagtgactgacgacgacggattgataaggaactgatggacggacggacggagggcgagtggagggacggagtgactgacatttgtgtaacgatggactgaggcactcttattgagcttcgattctttattttctttacatattatcgttttctttgttttacttccattttcttcccttttttgccttccaatctctcgacggggtctctctttctctctcttcatcattctctccctaccagaatttaatcaaactttctttttgatggatattgtttttcttttatgtatgactgtaaatctatttttctttttctttgtgttgtgctgttttcgttattagactttttcaaaatgactttggcattttcagttctcttctgtcttccctttcgatcgtcaacttttaaatgaagcattctgtggttatggctaagaccgcccaaattgctcga

SEQ ID NO: 74393 - DNA, 561 bp, Heterodera glycines
  misc_feature (11)..(11): n is a, c, g, or t
  misc_feature (179)..(179): n is a, c, g, or t
  misc_feature (186)..(186): n is a, c, g, or t
  Genomic contig location: Contig_ID=SeqID_11057; Location=36..596; Strand=+
  SCN-specific regions: Sequence locations=1-383,405-561
tctcgcgcgcnttgtcgatggaatgcgtcgtttgcttggaggcgatgtgagtgcgtgtccggcgcaagacaagtgcacaaattgtgtcccgcacgaggacagcttcgtgtcgcggtcggtcggccttctcccccggcacaaaccaatgctctttctctccaaattcacagattaaaccncacttcnggcattctcgcttgtacagtgacgtgctgttaacaggcgtggacttcaaggtgtacaagggcggtatggacggcattatggcgggtgccattcgaaaaatggtctcttttctcatcccacgcgctatttggcccaaaatccagcaaaggcttcgtttggtcgtcaattacaaaggcatgccgacaattccttttgcccaatctttgctgttctgaatgctctccgcaggtgtccaaatcccgcgtctctgctccgtcgagttcaatcacctccacttggattatattgcccacgcggcaattatcagcggggattttgacgtcgatttgcccctttttatccgttccttcaaggaatttatggacgagaagcaaa

SEQ ID NO: 74394 - DNA, 487 bp, Heterodera glycines
  Genomic contig location: Contig_ID=SeqID_11059; Location=570..1056; Strand=+
  SCN-specific regions: Sequence locations=1-436,462-487
atgctggacgaccaggcccatctgatgcaagtgttgtggcgagagaaggagcagctgaagaaggaggtggcactgatggacgagtatttgtacatggacccggagcgggacgaacgcaacgatatgatgtgagaaggtcggggggggggcggcacaaaagccaattccaatttgctctctctgttgttcatccttttcttgttagctgatcactgatcacccatttgggtgttattttttctgatcacttctcccaattcatccgcacagtttgacacgtccaaagcgtcgctactacgaccgggtggaggacttgccgcagaatgttgttgcccggtggcgcaaggagcgcgaacagttccaaccaccgaccgacccatatgctggaaaagaggacgaagaatgagcacggagcggataggatgatgattaatgatcatgaagatggtgttgaacaacatataattaatgaatgcaaatgataaaa

SEQ ID NO: 74395 - DNA, 249 bp, Heterodera glycines
  Genomic contig location: Contig_ID=SeqID_11059; Location=1558..1806; Strand=+
  SCN-specific regions: Sequence locations=1-249
atgtcctccacaattgctcccgtttcttccgccgatggcaccgctgggagtgccgccgccgtcgccagcgctgggccctcctccgtcgagccgatgccgccggtggagcagctgatggagggcattgaggagaagtgcccgccctcgttggaccagcgactgaacgccatggacgaggtggacatgcgcatcgacgacctgctcaccgtggtggccgaagtgatggccggtctggacaaggacaagccg

SEQ ID NO: 74396 - DNA, 721 bp, Heterodera glycines
  Genomic contig location: Contig_ID=SeqID_11060; Location=1138..1858; Strand=+
  SCN-specific regions: Sequence locations=1-17,40-481,532-721
atgaccgtaataattattaaattgataaatctaattttgatttcaccgtttgtgttggcgatctgttgtcgtgccactgttccgcctgtttttgcaagcatttgtgatgatgagcagtacccgcaggtcaacggacattgcgcagccatcaaactgacccattttgggtcagtacagcgatgggcatttgtaggacagtccgatggacggcccggcacattcaaatcacggcatccggaatttactttaggtagatcaagagtaaaatcttaagcagtactggaacggactccggcgtgtttttatggatccatgatcagggctgcacgcaattgcggattgcggattgcggattacggaaattgcggggtttttggacccccgtaattgcggattgcgggttgcggatttttgggatttatccgcaattttgatccgtaatttgactattggattatttttcgagacgatttcttgtaagattattttttataaaatgaatttttttctatttttatttaaagaaaatatgtacatttgtttaaattcttatttctttagcaatttaaaaatgtcaaacttaaagaaaatcttgcaaaacttttgtttcttcatcacaatttgcttttaaccggtttctcaattgaatgattttgcttttataaatttgctttttaatatgcttttaaattgctttaaaagatttataggattttttaaa

SEQ ID NO: 74397 - DNA, 1569 bp, Heterodera glycines
  Genomic contig location: Contig_ID=SeqID_11063; Location=203..1771; Strand=-
  SCN-specific regions: Sequence locations=1-341,364-586,625-834,856 -1569
atgcttcctcctaagggacttctttcaatcttgggccatgtgtgcaaacctttcaatcaccgagagtttgaattttattctcgaatggatgcgaagttggcaccattcactgcaaaactgtgcagtaagtatttaacactttaacacctaatttcttaatatgttttaaggtaaaatcaaagtgcagtgtttgaatcaaaatgttgaagatgggactttaatgatgagcacagagcaaattgtcaattgccaccgacacccaccggaaaatgtcgctgatttgcccacctcaattggctgttcatttcaaaaaagtattgctacagcctctataaatgcgaatggcaaaaggaagcattcaatgacatttcgtgtaaaaagcggtcgagtggaagcggagaaatcggtgaccgcaaataattgggcgtggcaatgtcaaagcaaagtttgtgggattttgggattagaaaaaacaatgcaacggaaaatgctttcagattgtacagaaattgctgaaaggacacgacagaagcttcatactcctcgaggatttggtcagcagatacaaccggccctgtgtgatcgacctgaaaatgggttcgccattttgccattttctgtcattttatttctgcttcaggcactcgtcagcacggcgacgacgcaagcgcacaaaaacgactaacgcaaacgcaaaaatgccgacagtcgacaagttcagaaattggcgtccgattggtcggatgcaattgtttgatcgagaagtgggagaatatatgtgagtaatgcgtggcgggggaattttaaatctttttttcgacggatgttgccttatttctaattattctaattacttatttatatcaatcattgtaactatttaagttttatgaataaatacgaagggcgacgcatggacagaatgcagttcataatgcgctctttcactttttcaaagttgctgcaagagcaaggacaatgcgtattattgaggcaagtgcataaacacacaatcgtcttttattttcgtcatttaattttaaaggaattgttgaaattgcgtaaaacactgctcaacgcggaagggtttcgcttcttctccagctcattgctaattgcctttgacggcagcgggcacaaaagcaaagccaacgaaggggttactgtcaaaatgatcgactttgctcattcgacttttaacggttttttggacgaccaaccttactcgagcactgacgatggatatttgctgggcatggacagcctgttgagaatactgaatgttttccagcagaatcgactgattgtgccaattggaggcatcaaacaaagcattgaattgttagcaattggagagaagaagaagagcggcacgaagcggaagtacagcgaggaggacgaagagtcgcggtcgagcatcacgtccagcatgtacacgtccgactcgtgcaccggcgaagaggaaacggaggactgtggcggaggatgttcaacgccagaagctccgaaaacgactgaaaacgctttgaactgtggcatcaacgacattccattggtgaagttgaaccg

SEQ ID NO: 74398 - DNA, 2022 bp, Heterodera glycines
  Genomic contig location: Contig_ID=SeqID_11064; Location=419..2440; Strand=-
  SCN-specific regions: Sequence locations=1-320,349-376,398-617,640 -810,884-933,989-1055,1099-1244,1269-1385,1407-1506,1566-2022
atggacatttgcgccgctcagcaaaaatggacatttgcgccgctcagcaaagtcgacacttgcgtcgctccatttgcgccgcgacatttgctccgcctagtaaaaatggacatttgcgccgctcagcaaaaatggacatttgctccgcctagcaaaaatggacatttgctccgcctagcaaaaatggacatttgcgccgctcagcaaaaataatatttttcatttcaatttcactaatatcaataagattactaaaaacccaacgacgaaaataacgaagtgaaaaatttcaaaaaatcactacttaaagataaacattgattttttttatttataatcattaaaaatcttaacattgattaggttcatcaaagatatgaaaaatgaagaagaataacaactaaacagactgacactgtttgaattagtcctactcatggatttttgaccgcccacggctcaaaaaataattgaaattgatgagtagggtggggatttttaagtttttagttattttttctgcggcttttaattcaatgagaaaagagaaacacatttttaacacgaaaatacttcatttaatgcccccccccccctatgttttctgtatgaaaaacagactattttttgctttttattcaaaaaaagatgaaatttatgtatgctggggggacggaggacgagggaatggccaatgcttcgtcgcagccgttttcgtcgtcgatcggtaaacgccgatgaatcccccgcccccggggcccatccatcccccctgataacagcagaacagaaaatggaaagggcggaaagtaaattttaaatttaattttaaaaaattcaataattttagatctaattacttaaatactaaataaatattttacattacaaaggttctttaaaattaattggaaatattgcaaaaaccatttgtttttaaattattttttgataaaaaaaattaaaaaaacaattcaattatatttaaggtatttgttagcatatggaacggtcaaaaatgtggatcaagtgttgaataaggatcaggcaatttgaaaaattaaaatttataatataaattatttttaatttattttagtccgaagcaacaaattaccaacaggaccaatcttcatcaaattcaaatggagggtaattaatttttaagtgtcattgtgttttttaagtttattcggcgctctttggaaagtgggtattttgaattttattccttttgatttaccaaattatttttttatataaaaattcgtgaaaacctgttctagagggtttttagggtgcctgatcaggaatcttacaccaaatttgatcaattttctgatcccgaacccgaactcgaacaataaccgaaaactcaaatttttcgtttaaattttttgttaaatctaggtcaggaagtcgaaattggttaaaatagatgtcagatttataaacctcagaaacaagttttcattgctagcgtcatttatccttattttttatccgttaaataaatttaaaaaaaagtattaaaatttatatttaaaaattaattactttttaatgactcaacaaatttttatttttttttaagcggaggaactcccaataatgtggtcgcattgccccgcactggtggctcatatccggccactgcggtaatgtgcatcaattaaacccaattagtgtggctaatttcaattaacacgcaatttttgcagatccgtcaaaaacgtgagcacacgcctatggcgtcggcaccatttgttgggccacttttgccaaacgttgctgctgctgcggatgaattgtcacgtcattactcaatgtggatttgacggaaaacacaatgaaaaaatgccgaaatacaccgttgtaatattcactttttgcgtgctttttttgcaataccaaatttcacacgttttttgtagctttgtattttttgtctgtgttttttaactcaattttacaaaccacttaaagtgtgctgcttttgtttggtgtttgaacaataataaa

SEQ ID NO: 74399 - DNA, 155 bp, Heterodera glycines
  Genomic contig location: Contig_ID=SeqID_11065; Location=210..364; Strand=-
  SCN-specific regions: Sequence locations=1-155
tgattgcacagaattgccgaaaaaattcgagaccaatttccgaatgttgaccgactaattgccaaaacgaaagccgtctttgtcaaagcgccttaccgagtcaaaaaatttggaaatgtatctcatatgcaatttcaaccaataaatttgaagaa

SEQ ID NO: 74400 - DNA, 636 bp, Heterodera glycines
  Genomic contig location: Contig_ID=SeqID_11067; Location=2446..3081; Strand=+
  SCN-specific regions: Sequence locations=1-96,118-636
atggaattgccctccggcggacaccgtcgtactttcgggcactgctacagtttcctcctcatctgccaatgtcattaccgtcgtgctgttgctcatactgtagtggtgatgcttttgtcgtcgtccgcttttgccgccgtcgccgtcaatttcggcaaaatgttcttgacaataatgatgccccgtgatgatcgtggtcgtcccgtcatagtagtcagttttggtgccattgccatccccgccgctggtgatggcccaacatgcgaagccaccccggtggatgatggacacgtaatagaaaagggcaaagccagccaaggacagtgccaacgcgacgaacacggcacaggaggcgaccagaagctgaacgatgaacgaaattttttggtcaagaaatgtgcaacatagaacagggaagatattgcgtctatgccgatcagggatgccggtcatgacccaatgtcgaaaacccggctttttcccgaccagatcgaattttttcttggcccgcaacagccctaatgcccatgttattgggacccatccgagtcagagttgggtccacgaatgccaccggcggagaggcgcctggaagtggaggtccgcagtttcgaaatgcggcttcttttaggccaa

SEQ ID NO: 74401 - DNA, 105 bp, Heterodera glycines
  Genomic contig location: Contig_ID=SeqID_11067; Location=1517..1621; Strand=-
  SCN-specific regions: Sequence locations=1-105
atggcttgcccgaacatttgcttcaccagtggcgccattgatttggacaccaccaaaaatgagagcgtctgttccatggaattggccgtttattgttttgacgtg

SEQ ID NO: 74402 - DNA, 812 bp, Heterodera glycines
  Genomic contig location: Contig_ID=SeqID_11067; Location=3179..3990; Strand=-
  SCN-specific regions: Sequence locations=1-270,292-553,575-812
atggcaaaaatctttttgatgggcccccaaatgatttgccgttttattttggccgcaacaattttcaccggagtgctgctcaattttgttgcttttgcttctgctcgtcaccatcaccgtcatcaagttagagcagttcctgtagaacaacaatcagccgaaaagcaacaacaacggcaccagcaacaatactttttcgacattgacggcccaatgcttgaggggcaacaacggcaccaacggtggcggcacaatttgcggctgctaatgacaatgcaacagcaacaacatgaacagcagcggcacgggtagggagaaaggcacactaaatcagagtataatggacaataccggttcagatttcccatagatttttggaaatattttgggtggaaaatacgatttttttaaaacttttttttggtacttttttgttttcgattaatagaaaattatatgaacggattaacgctttctaaatgagacattgtccttataggttgccaaaatatcgtcgtgagattgatgacacgctgctcgatgatgtagaaggatcagcagaaaatgcctatgaagggctgatcggagaaaatgacggttcaattgatgaactgatcggaggacaagacaatggcaacagtgatcagagaggagggcttggcattgctgctgatgctgatcatgatgatggtggcgacgatgacttaccacagtggtggcggcgaagcgaacatttcgccaccacggcacagcagcatcggcaacaacagacgatgagccaatcattcttggtgagtgcttccgactgttga

SEQ ID NO: 74403 - DNA, 4884 bp, Heterodera glycines
  misc_feature (53)..(53): n is a, c, g, or t
  Genomic contig location: Contig_ID=SeqID_1550; Location=189..5072; Strand=+
  SCN-specific regions: Sequence locations=1-631,653-739,761-1104,1126 -1745,1767-2211,2233-2324,2346-2430,2452-2674,2696-3218,3241 -3280,3307-3521,3543-3902,3924-4111,4133-4573,4596-4657,4679-4884
atgcttatttctggtccatcggggagtggaaaaagcagctttctagtcaagtntatgctcgagtcctcagaacttattggtcctaagcccgcttccattctttacgcattcggtgaaatgtccagcattgtgcctaccctccaaaaatgtggtattagtgtgtattcgggagtccctccggaagagttaattaaacgcttacctaaaccactgcttctaatccttgacgaccttttgctatcgattgatgaggcctatttaagtgcattattcacaaaaaaatcgcaccatcagaactttgccgttgtttttgtcacccaaaatttgtttgaaagacggattaaagttgcaagacaaaacgctcaatatttggtactaatgcgggcccccaactcagcacttgctgttaggaatattggagttcaactctttcccgggaaactggattattttctctcggcataccgtattgcgaccaataaaccctatggataccttctgatcgatatgcatgctgcctcaaaccctttgctgaggcttcgaagcgggatatttaaggaggacgaagaagatggagaaaaggtcattttcattccaaaaaatggtgtcttgtgaaattggaaatattgttcataaaaatattgattttattcgttcattggcaaaaacaaaatcgtgcaaaaacaaacaacgaattttaaaacgcgcaacagcagatcaattgctaacacttgttgaaatttgtttgaacattctttgttcgcgtttcaagatgacgacacgtcaaagaaagcgtttgttaccgtatgcaagctttgtccggactcttgctcgtagaaggaccgagaaaggagcacgcaagcttttagttcaaaccggtagcggacttggaggagtgttcgcggcgttgctcactccaattttgattgatttggcgcgcaccgctataaattcaggcttaaaatctgacaattaatcatttatcatggcgtcaaaatttattctcgtccccgatgaaatttatcatggtttaacaaacaatgattcggggaatatcaatttgggctttgcgcaacgtactttggagagaacaaaaagaaggagggaaaatgtgacggcgaagaatgttcattataaccaggaattggcacgttatctccacctgcgagatgaacagcaaaatcttccaacaaagttgagattacaagagggttaaaagcactgatcaaaagaggagatgaaagtgatgaagaacaagtttttgattttggggcagatggagtccaacgccccgcttcacaaagtcgcagacgccttcgacgccatcgccattacaatgatgatgaggaaatgccattaatgccgccttctccaccgcttcaagttgaaaatagggggcaaaaacggaaagcaaatgaattttatttctcatgggaggagggcgcaaagagacaatcgcgccacgaagatgcaccggttccttcttcatctaaaattgctaatagacaaggaagaagaaaactgcctccagtttcatggcgaagagaagaagaacaaattcccgctgacattcagcaggaagaaccatttcagccagccccacaaccgtccattcctatacatccacaacttaacagaaaacggaaggcacagcatgctttgaatgatgttcgagaatcaaaaaagagtcttattggcttggaagagttaagacctccttcgcttcaacaagaggcatccctacgtttcaaacagaaaaggacaagcaaatcccgagtaaccctaccacagcattcgaattcattggccttggcaaaactgcgtaatcctccgagggacttactggccgaggcagcctctgccccattaccggacgatgatacccatgattttgatctctcacaaaaccccggggtcgctgctcaggtcgagcctctcccacctggacctccgttgcctagtaaagccaaaaagcggaaaagcaacaaagcggaaaaagagaacgaaagaaaaagaatcaaaattggctctcgaaagagggacttactggcagaggcagcctctgcccctttgccggacgactttgaactctcacaacaacccgggacctcggatcaagtcgagcctctcccacctggacccccgttgcttagcagaaccaaaaagcggaaaaccaacaaagctgaagaagaatataccgaaagaaaaagaagcagaattggttcttgaaagagattatcttcaccaagtgttaccaaaaatctgccaaaaaggcaaaagaactcgggtagcgatgcactctccgaagagcagcgtcgtcagtttgcagaggatcaacatcttttcagcattccaaattcgcaacttaccaatgagcaaaagagaagacggcttcagttcgtatttaatagaaagcccgccaagtacggtgttcagggtgacaccattttgaacagcgcaggaaacccaataaccgacagcagtgtcgcccaagcattagactatattatcgaacgcagagagggacgaattccgcagtttagacagcctccaggaacaaaattgatccgcgatcggatcaaccaagaccttattttgcgaacatggacggctccaccagtaccaccaagaggacccaaacggaaattgatacaaacagaccaagcgccagaattaaagcaaaaatcacaaaaactcagaggaatgagacaggcgagagtcagggagcaagaaggattgatgcttccgtttccaacgaggggagtcaagcggaagtcgacggtcctgccaacagtagaaacggaaatcccaaccaaaagccagcgtctcaggccacaaaaatggaaaaatcaatagaaaatgtgttagaacgcctctacaatgacccaaaatcccctgctgcgttcgccggtgtcgacagactgtggctggaagccaaaaaagaattaggaaataaaattcgtaaaaatgatgtaaaacattacttggagggacatcgcacctacactttgatgcgcccaaggcgcgtaaattttctgcgcgctcgaacgactgcagccggttttatgaccgactgtcaggtggatttggctgattttcaagcactttcccgacacaacttcggcaatcgttatttaatggtggtaatcgatgtcctttctaaacggatttacgtaacacctcttcgtaccaagaaatccgatgacatggtagaaggctttaaacgagtgttttcaactatgccaatgaaaccacacagaattttctccgacaagggtacagaattcagaaatcaacagctgaaaaagctttttgatgaagaagtcgagaaatatgagagcgcacattctgagaagaaagcagcattagccgagcgcgcaatacgacaaatcaaaaatcgtgtatatcgctactttgcccaaacaaaaacccttaattgggtggacgtaattgaccaaattgttgatggcattaataaatcaccgagccgagtgcatgggatgcgaccgattgatgtgaactttaaaaattcacaacaaatatgggaaaagatgttcggagaagatcagcatagggccctttttggaaagcacagaaaaagggccaaatttgtgcccggccagacggtgagaatgagcatagcaaaaggacaattcgagaaaggttatataccaaactacggtgattaaattttggaaattgatgccgtaaaaggccatatgaagccaatgcgctacaagatacgtgatgcaaagggagagaagtttaaagggtttttctaccccgaagaattggctcccgtacgcagagatgcggatacaacatacagaatagaacgagtttttcggaaacggaaaatgccagacggaacaatggaagtgcttgtgaaatttgtaggatacccagagagagaatggattcatgagacacaacttgtataaatacttgtaaattagcattgacttcacattttaatttgtataaatgtctaacactttttttgtccatttgcccagtaatagcccagactatgctgataatgccccaaataaatttcgagtccgtctcccgaaaccaatttatttcaatggctcttgggtttgcggactacacagcataaattatgcatattcttggccctccacaattggaaccttggatgatcaatggattaacatccattttactgatggcctagaaaatgaaaagcttagagttgttagagtgcctgtcccaaaagcttccaacacaaccattgaacatttgagagaatttattacagcaactctaaagaatcacgcggagtctctcgaatctattataaaagataatacaccaataagaagaaaaagaggtgcagttgagcctacaactcctcctagtgcacgtattgtaccaaagtcacctccaaatgtcactaaaaaggtcatagtaccaacatctccgccacgtgttggacaagaacatcaagaaaatacagaagaaatctctgattcattaaccaatgtgacgaagccaccagaaaaacagccaaaaattgaaaaacaacccgaagtcgtaaagccaaaaaatgaacaaataaatcaaacagaaaatatttcgcaccaaaatgcacctagtccaaaacctccaccacctgcttcaattccgactacgaaaaaacatgaagaattaaaaagcaccattgaccccactccttcagtttcaaaacctccacctccattgccagtttctaatccggttaatcagaataaaaacgtgtcgatcaatcaaagtgtttcacaaaaaataactattccgaatgagaatggcattctcgtcgtcgatgacggcatatgtttgctcttctccgttcgcgtctcgacctactctttattatgctga

SEQ ID NO: 74404 - DNA, 423 bp, Heterodera glycines
  Genomic contig location: Contig_ID=SeqID_1550; Location=6831..7253; Strand=+
  SCN-specific regions: Sequence locations=1-423
atggtcttggtctttcgggaacttttcatggagggactgaacccctcaatgatcagaaagggaaaccgtctgttcgagatgaaggtataattgtccatgcgtttttatttaataattttcccatctcaggtgaaaagcagaaagaacttaaacccgaatgtgacatttcgtgattcttggaatttgattccgggaccgctcgcctcaatggggcccatgttcggcttggacgtgcaggacaagcccttctttccacacatggccaacaaacctgacaattatggatgccaaatttttccgtcgaaagcagattacctggccgacggaatgaacccagagaaacggaaacaatttgatcaatggtaccagcaaaacaaaaatattccgtttctgctggatgagtcattggcaaggtgaatatga

SEQ ID NO: 74405 - DNA, 830 bp, Heterodera glycines
  Genomic contig location: Contig_ID=SeqID_11068; Location=1573..2402; Strand=-
  SCN-specific regions: Sequence locations=1-58,81-151,175-202,225 -226,250-830
atgggtgcacacgccgagcaaaaatggacaaccgaaacgattgttttgcgaagatttggaggaagaagaaagaaacgtcaattgggtcaacagtttcaaggaggtgtgtgtggtcatattttcataaaaattgactgattactatggctcggaaaaatatggacaaaaaatggcataaatatggacataagtttgccgaactgagggttaaattttttaattttcttcaattcattaaatgaaatacatctaaaatcgctgaacaaagtataataaccgttttagaagaaaaaaagcaatgtatagagaaaaccgaacaaaaactgaaaatttccattttctaccggtttttggggtaaaaacagccaatttagctgatgggggggcaccgttctaataggggtttttttttggaaaaatatggatatagaaactccattctagaagcttcagaccaagctaaaaatatgtttttcgtgcgtttcaggcctctaacagtccatgaaaaaatatggatttccatataattccgagccctactgattgcctttgaatttcgattcctttttgtttaggcatttgcccgtgccaccacttctgtcagctacaaaattctgtttgcagtgcatacatcaattgaaccatttgaagcggtgaacgaacgaaccaaggaaaagctgactcttggcaaagtgccaagtcctgctttttattggctgttaaagcgatgcccaattagtgaaaaggcggcggcggttacattggaatacgacgaattttgggacgacaatttgaacagcgtcacaattgatcacacaattggaatttga

SEQ ID NO: 74406 - DNA, 1152 bp, Heterodera glycines
  Genomic contig location: Contig_ID=SeqID_11068; Location=187..1338; Strand=-
  SCN-specific regions: Sequence locations=1-184,215-490,512-1152
atgaatacgtatgcaacgaccggcgaattcgaagggccatttgcagggcgatcattcgcttttgctgttcgaaagcgaagcccaaagaaattgtgcggggcgaagaagccgaacaaacaccttcgcaagggcgactgtggcaaaatcggagtgatcggcggttcgcccgactacaccggtggcatattgcagagaaatgaatgcatttttatggcttttccccgttaggtgcgccttatttcgcttcgatcaccccaatgaaaatcggtgccgatttggcctttgtttacgcccattccgacgctgctccggtgatcaaaagttacagtccggaactgatcgtgggttttcattatgactagttaactaattggggttgggtttgctaattgccctccttaataggtttaccccagcgccgatttcgccacgaatagacacagcattgagcggttggacgcgctggtgttcgggccggggcttggccgacagaaacacacacaaaatttgctggcggacgtcgtaaatttcgtcaggagcaaacaaaatgtaattcccctccaatctaaatccatctaattattgagatacaatcatcattttctttgctttttaagctttgtttggtcattgacgcggacggtctgttcttcgtcaaagaatgttcgcaactgttcaaagggtgcacagacaaagtgatcattacgccaaaccacagaggcaaaacgcaccccaaaagcaaagcaaacaaaatgcatatttcttaagaatttgttcggctttatacccaaatgttccctaaccagcagaagggagaggaaactgacaaattgaaaattcaatgcgaaatggcggaacaattggcaaagcatttggaagtgactgtgatgagaaagggtcggtggcacagaaacgcaaccgaaaaatatgagtttgtattcaataacaattgtcattggcactttaggagagattgacataatctccaacggttccgccgcccaaacgcgaattgtccaagcggaaacttcgatgcgccgttgcggtggccaaggcgacattctcagcggcgcgacggcacttcgtattttgggcaaggaaagcctcagatgccgacatttattcctccgagcatttgctggacggggctga

SEQ ID NO: 74407 - DNA, 1769 bp, Heterodera glycines
  Genomic contig location: Contig_ID=SeqID_11070; Location=1074..2842; Strand=+
  SCN-specific regions: Sequence locations=1-633,655-1026,1064 -1189,1251-1341,1364-1436,1458-1769
atgccacaaaagcaacgccgatgctcattgattgtcaaataccgtcagctaatccaggtgtgaaattaatacccccccccaaaaaaatgccgtttttttcacgcaaaaatatgcctaattttggcacacacaaatttaattgaatggtttaattaagggttgcttcaacaacccgcatgaaaacattggcgtccgcattctgaagcgctcagcagagaagcgcaaagattttggccgcttttacatcagcattggggcggaacactgtgcacgcattgcggacatactaaagcaactgttgaagaaatcagtggccaacatttacggtggtgatgaagaggtacggtagggagagagagggacaaatactctgggaacagagcaatactacggtagtgggcgaattacaggaaaatcatatggtatggattaaaatggaggtaaattattctacaatatgattacgaaaggggtacggtagggagaaagggacaaaaacgataagaaatttctctaaaattacagtatacagtgagataatcagtaatttgaaactgagctatggtaatcacaatgttgatactgtaatactaataataaaaaaaacaaattatagcttcaaagcctggcaaatgagttcggtgcccgttttgttgacttgcgcttgctgggtttcaaggcggatttctttgccgttctggccgattcgaccaccatggaatgtgtactgctcgacgccgctgtccatccagcaaacgttacactgaatgctttctcacagttcatcacaatggtcaggaaatagaatatttaatcatttttcggcttaattagggtcgtgagactgattgtaaatgctcccccgaaatttttattttttaacaataatggaagaaacattctaatcttgctgggataaaggtattagaaatagtttaaatatgttactgttttaaaattaaattccgaatgtacgattcaaaaatgaagtcgagatttagggatgggcggaataggtttatctagaaataaaaacatttttcaatttttaaattataaatatgacatttttagctgttctctgctgtccgtgacggtttctacactgaaatgcgccgactgcggcgtaccagcaacagttttaccatcaacccgaacgcaccaaacacaatgatgaagaaattgtcggttgatgacaatatgaaggtggttaattcattaattaattcttttttgattaattttattttgaagaaatattttaggtcagccgagccttgcaaggtgcccgatcaatcagtccaagtccggaactggagacatgccaaaaatgtaagtgaatgtttttatttaatgaataagacctgaaaaaagtgaggcgattagaactatgaaaaattttgaaatttaaacacaaattaattaacctatctaattctgtgattaattaaaaattaagaagaatttttttatcaaaaaagatttacctagggattgggagggttaaatattactccaatataatcaattaattcattagttacatataattgcacttcattgctttagccgcgcatagctccccaattggccatggaagtcaagaatcaattacggaccgtcaatcccagcagaataacaacaatggcacaaatagtcgcaaaatttcgcccgaatcactgcaggccaaggaggaaattcgtctgctaaccgccgaattcatgggccgtgcaatggtggtcggaggcaaagaatgccagcgggactga

SEQ ID NO: 74408 - DNA, 334 bp, Heterodera glycines
  Genomic contig location: Contig_ID=SeqID_11072; Location=201..534; Strand=-
  SCN-specific regions: Sequence locations=1-5,27-140,243-334
atgaacatttatttatattccattattatttccattggcattcattccgctgtggttgcagcacaatttgaagagcaatgggtgaatgcttgtaaagagattctcgtaaaaatcaagagttctgcggagaaagctgaaagtattttttttctttacattttaaattaaaaatttacattagataattgttttttttgtaatttttcaatattaacaattaattaattcttaaatttaaaaaactgctttagaatgtgatggtgaattgaagggcaatttaactgagttagaacaaaaagtcaaagaaatgcatttttttgtgccttccaaatga

SEQ ID NO: 74409 - DNA, 373 bp, Heterodera glycines
  Genomic contig location: Contig_ID=SeqID_11072; Location=630..1002; Strand=+
  SCN-specific regions: Sequence locations=1-120,142-186,208-273,295-373
atgatattccatgcatgtttcttatttaaaaagaaattgactatgctgtataaggtaaaatgacatgtcattattgccgtttccatttatggcatatttatgaatgtattcattaatttaaaatataaaacatttgcatgaatatttatgcttcatagaattatgacgtgaaattattgtcatttccattaaaataaaaatatttgcgttaatatgtatgcttctatatttttattgcataggcttatgacgtaaatgacgtggaatcattgccatttccattaaaatataatatttgcgtgaatatgtatgcttctatatttttattgcataggcttatgacgtaaatgacgtggaatcattgccatttcca

SEQ ID NO: 74410 - DNA, 672 bp, Heterodera glycines
  Genomic contig location: Contig_ID=SeqID_11077; Location=318..989; Strand=+
  SCN-specific regions: Sequence locations=1-593,616-638,661-672
atggcacagcaattcgatcggaatcatggcacaaaagctattgagttcctcccaacggatcccgtcctgctcttgaattatcgtcttggaaaaagccattggcttccgggcacgattgtggaaaggctcaacaattcgcctacataccgtgtccacgttccaacactcggccgaattgtccatcggcatgccaaccagcttcggcgccgattggattttgaggacaattcaaattgggaaccccccattcaggaacaaatggccattgagccaaatcaaaggacaccgccacgccaacacgcagccatcgatcagcgaactccacctgttgttgatcaggctaggcaaaaggctaaaagcccaattggcgtccgacgttcccaacgcgtgccgaagccggtcaaacgcttcacgccaggttgaaactgaggatgtttcaatctcgagaagggaggtgttggagaagagcaaagtacattttctcatggtcacttatcgattgacatttgtccattccctcctccgttcctcccacatcacatttgttatttaaaggcgtggactcttcccccctcgttcacttcttctcctgtcttcacttttattattttattcattctccatccatccattcgccattttattattttattgttatttgactcttcgtaa

SEQ ID NO: 74411 - DNA, 1307 bp, Heterodera glycines
  Genomic contig location: Contig_ID=SeqID_11078; Location=321..1627; Strand=+
  SCN-specific regions: Sequence locations=1-28,50-430,452-1307
atgggggaagcaccggaccaacgggtcgaagcagtacaggaagaggaactcggtgcggttgctgggacagaagccgaaggtcagcccggggaggacaacaatgctccccgtggcttgagtggcagtgagggagaaaaaactgtggaggctgaagaagtcgcgcaagacgaagcagaggaagggcccattccaccgagtttcgttcaaaacgaagtcgggagcacctctcccgcgtcgcaaacaaatgagcagatacgggaaaccgtgaaccaaaagacggaagcggagaaagctgactcaccggagggatcgaacagcatgcgagaagttgaaccacgaaggtcgcggagagtccgacgaactcgagaagtatggtcaccggaccgatgtgccacgaaaaggagggggattggtggccccctggtcagcttggccatgatgatcatgttggtctacccgactctgacatcagggtgtcagccgactatccgacccgaaattgttggacaacagtcacaggaattgccaacaacgatgttgccgtgccatatgcggtgtacggaacgtggagtgaaagtgctgagcgggcagcgactcgaaaaaatggaaatttgttgccctgatggatgctgggcaattgtgcccatttcgacggagatcagctacgagctaccaactgaactgctcgtccacgattaccattgcagtggtcaatgctggagggggtctggccccccttataacatcacacagcgatgtccagcgagagcagaatgcgatctgatcaattgctccttctgttgggagcagctggccaacccgacgtgcaacccgcgatgggcatcctcgctcttcgggtttggagctgcaattttgctcgccatcatcagctgcttctgctcaatttttgggcggtttttgtcaggagccaagctgctctcaaaagccgtggcatggggagttcgttaccccatcgggctgatcaattgggcaaccggacgcgattttcggaaaccgaccacggagcaaatcgaacggaaagtgaggaaaggagcgagaaaggcacgaacggaaatacgggagctgcagcagcaactgcaattgggaagacgggctcgggcgatggccagagcgtggcaaaatcccgacgggactcgaaaagcctttcccgcaaaggcagtggcagccctcatcccattgctgctcatcatcgatccggccttcctccaattttcaccatataatccatcgacatctcgcatataatcatccaccaatttttgaccattttatcatcatcatcacca

SEQ ID NO: 74412 - DNA, 305 bp, Heterodera glycines
  misc_feature (233)..(233): n is a, c, g, or t
  Genomic contig location: Contig_ID=SeqID_11078; Location=2436..2740; Strand=-
  SCN-specific regions: Sequence locations=1-169,191-305
atgatttttgctttgaattgtggcttaatggcaatatttgtgctgcttttgatcgcctttttgctgtcatttcgccacataagtatagaaattaatttaaaaaaatgtttgatcgaattatatccacaaatactaattaactctaattaataatttgattttttagacactcctccatttttatcaaatacaaattctcctatttgctcggtctgcttttcatttgtgtaatntacggtgcattaattcaatattttgtggtcgattatgcattcgaaaatgcgggaaagtatgacgcaatttaa

SEQ ID NO: 74413 - DNA, 304 bp, Heterodera glycines
  Genomic contig location: Contig_ID=SeqID_11078; Location=2981..3284; Strand=-
  SCN-specific regions: Sequence locations=1-34,83-90,127-304
atgccctcaattaacaccagctcagacaatgcggtaaaataaatattaaaaaaagaatttaaattataaaataaatatttaagtgaatacaaaataattcattccttttaaacattattaaattttcgacttaaattaatgttttcagccttatttggcctaccgttttgtcggtccgtccgccgatttgattgtgccggccgttgcgctgtatttggttgcgtttgttggcattgtgatgcacggcacagttttggtggtcacggtcaaatcgaggcaaatgccattagcatttttattttaa

SEQ ID NO: 74414 - DNA, 778 bp, Heterodera glycines
  Genomic contig location: Contig_ID=SeqID_11079; Location=334..1111; Strand=+
  SCN-specific regions: Sequence locations=1-123,147-293,316-384,420 -469,491-555,578-778
aacatttgaaaattttagccaagtattaattggatatttggctagtggttcaactatatattacccatggagaacagtgagtataaattcgtatttttcatttgttttggatggggtaatgaggataaataaaagattcaaaataatgaccctgtatattgcttacaattctgaaaaaagggcgggaatgaatacggatattgattagaaaattttagcgatattcaagaatttttaaatgcatctggccagttttaaaatttcttacattctaattcgttttgtgcgggaagcttaaaaataatccctctttctgataattaccgttttcgtcaactggagcaaaacattgcgtgctattttttattttcgagaaatgtttcttgtgaaattctgcatttaaaaaagaaatgttatttaatttcatatgccaagaaaagggcggttaggactgtataaaactggtaataaaacagagaataaattaaaattccagaattctgaaagtatggtctgtaatgtgactctttctgagcagatgttcatgttgtttattaaaattttgaactattttaaagggtgaagttatatacctagaaaatgtaataatcgtatgttatatactgcagaaatgttaggcctagccgaaaaaagaatgaaaattttagccaagtattaattggatatttggctagtggttcaactatatattacccttggagaatagtgagtataaattcgtatttttcatttgttttggatggggtaatgaggataa

SEQ ID NO: 74415 - DNA, 475 bp, Heterodera glycines
  Genomic contig location: Contig_ID=SeqID_11080; Location=796..1270; Strand=+
  SCN-specific regions: Sequence locations=1-61,90-171,285-351,393-475
atgtttcaagcaattttttggttggccaatgaaaaataacaaatatattggtttttaaaggtttattttattaaaaaaaattattaattcattcttgttacttcagttaaaatagatactcgagtagtaatcaaaactttcgtcagttttaatgtttactgttgcggttagttataattatttataaattattgtatttttaattgtatttagcaatttatagttacttaaattattatagaatttttataataatctagttaattaagtttttttttataatacattctttattgttgcagcttatgtgattctctttttattggaatcatttcctattaaatcaatgcgataatttatatgattcaattttttaattttataaattttttgtgcgataattccgtaaaaaatcatgttatattttcaatttgtttaggtacaactttattttcgaaaagtaatttgattaaaa

SEQ ID NO: 74416 - DNA, 1370 bp, Heterodera glycines
  Genomic contig location: Contig_ID=SeqID_11082; Location=820..2189; Strand=+
  SCN-specific regions: Sequence locations=1-106,224-244,358-371,551 -647,669-817,906-1164,1186-1258,1300-1370
atggcgatcagtgcacatttttccgaagaaacagcacagtcgagtttgcacgcacttcaacgacttgaagacgctgtcgcacagtcactgcgcggggcattgtgagtaatttaatttaaaaattaaattaaattttttaaattattttatttattttttaaaacattttaacatttcatttaatatatctaagtgcatttataaattaactaaattatatttatgaaatttatatccttttttcattttataatttttaaaatttttttaattaattttttaaaaattactttaactttttaaatttataatttaatataaatgatatttataaaataatttaaatgaaatttaaatgcttttttactcaattttataattttttaatttttataattacaaataacttttttttttgtttcaataccattttatttttttattttttgagaaaattaatttcataatctttttttgtgcttttttgcaaatttttctctcttttttcatttatcttttttactctttattaattattattattattctttcatctttgcctctcccaatttttgcgttttgctcatttattttgtgattttgttttgtgcccctcattttgctatattttctcatgtcactctttcccacattttatggaccaattagtttgccattagaatagagaccgttcactactcactaattatcatcactcgctaattaataaaagcgatgttaattggctgtgtaaatgatggcagggcagggacgactctctccttaggttctgtttgttgattgttgtccagcagcaattctttcattttttttctatttattcagataaattatttacatgattttattatttttatttatttaatttaaatattttttaatttgccaacaaaaagggaaaatatccctttgataaacccacaaaatttgattttctagagcgctaaaatggcatttgacccgaactcgggtgacaataaatcctattattaaatatcctgtaaaggaacttttttgtcactattcagaaaaatgcttcagggcataattggaaaattatataaaaaagaatttttggcacttttaattattattctttactttagttttttatcatatattttgtcgctattttataagaattttgccattttaagcacttttctaaaaatttgcctgtgaaataactcaaaaaatcataatcaatttttttatcgtgattttttcgtgttttacgaaaaaattgattttataaaatttatttatatatgaaatattggaaagcaggctgtttgtttccttattatgctaatgtattttctgcaaaatttcaaaccacacttgcaata

SEQ ID NO: 74417 - DNA, 320 bp, Heterodera glycines
  Genomic contig location: Contig_ID=SeqID_11083; Location=303..622; Strand=-
  SCN-specific regions: Sequence locations=1-42,79-137,159-320
tttttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgctgtacattctgatttgcacatttttcagaaatgcctaacccaattgcaacaaaaaacaaaaagtaaaattgtcttacaaaggccacctttacaccttcgctaaaatgagttctgatgggatgaca

SEQ ID NO: 74418 - DNA, 313 bp, Heterodera glycines
  Genomic contig location: Contig_ID=SeqID_11084; Location=612..924; Strand=+
  SCN-specific regions: Sequence locations=1-24,48-60,86-313
  Gene Ontology: Mol. function=DNA topoisomerase type II activity; Cellular component=chromatin accessibility complex; Biological process=establishment and/or maintenance of chromatin architecture
atgtcaatcgaagccacttataagaaggtatcacagcttgagcatgtgctccttcgaccggacacctacattggttctgtggaatatacgaaaatggtttaattttaagaatttcgcttttacttcctttttacaggcgtcgtgggtttatgactcagaggatgataagctcgtctttcgcgagatttcttttgttcctggtctgtacaaaattttcgatgaaatccttgtgaatgcagcggacaataaacaaagagatccgaaaatgaacctcataaaagttgacattgacaagtaaatatttcctgaccaa

SEQ ID NO: 74419 - DNA, 416 bp, Heterodera glycines
  Genomic contig location: Contig_ID=SeqID_11086; Location=346..761; Strand=+
  SCN-specific regions: Sequence locations=1-416
tccttttccaatggtatgaaccgctgtctcgctttgtccatcttaagcgagtccaactggacaaactgagcagtccctacaccgacctgcaacacccacacaaacccttcaatttggtcttcagatccggcgctgccaattccgatttgcccatggtgtgcctctgttttttccctgaattgtcaatttgtttgccttaaggtgtgcattggcatttctcgggcgctcacttcgcctgtcggcactgcacaagaattgttgcgcgagttgcggaccaatctccaaaaggacaaattcgagctgcaactcgtcgactttaatggcactgacagcacagtcaacaatatgaacgacatgtactccgccgcactgttcggcgactgttcgtcggatgatgaaatcatcggaagttggca

SEQ ID NO: 74420 - DNA, 1127 bp, Heterodera glycines
  Genomic contig location: Contig_ID=SeqID_11088; Location=377..1503; Strand=-
  SCN-specific regions: Sequence locations=1-54,77-424,447-1127
aatgcttttcccctttcgtttcgtcctctctatcagaattggtgctgctttgcctcattctttttgttccttttctgatgcttttccatcgtctggtgatcgaattctcattcgaagagagaatttcaaccgaaataaaccaaggcttttgaaaaggaatgaaaagagtcttttggctgagaatcggcagggaattcccacggcgacggactgtgcaacactcgtgctgttctgtcagttgggctcaccatccgccgaagaaaggtgtgttctcttcacacaaagggcgaaaaggatgaagcatcatgccaacgaaatttcgtttcccggaggtgaaaaatgatttgtgaccaatgatcagaaagaaaagtgatcggcttaggacggatcgagcagggagaaagtgtagagactgcggcgatcagagaggcggaagaggagatcggactggaccggaacgacgtggtgatccatgccataatcggatcaaattttaagaattgcgcgttggattccgcaaaattcggcgcttgctctgtcttctcccgtaccgattcgtttttaactttcaggaactgtggggcactcttcgtccgctgttcttcggagaggcgggcgtcgtcactcccgtggtggcaaccattgggcaaaacgtggagcaacggttggcctcgctgagatgtgccgacgccgaagtgcagaatattttcatggcatccgtttcggatttgctcgcccgaattcactacaccacatttcggtgctgacagaacagacaaacgatcaacagaaacaaaaccattaattgaaccaaactccgttagattttctggaaaaccatccgatgacaaaatgccgtttttcttccgaatgcccattttccactcgaccaaaccgcgacttttgtgcaattcttcgctggtcaattgtccggaaaagttccgcatttggggactgaccgcgcgcactttgctggaggcgctcaatgcgtttttgccggaggacgcgaaggaaagggaggcgagcgaattgctaaggaaagggaagacagacaacagctgctgatcagatttatgagcagagagagagcaatcagtcggggatcagccaaattcacatttattggc

SEQ ID NO: 74421 - DNA, 1273 bp, Heterodera glycines
  Genomic contig location: Contig_ID=SeqID_11089; Location=1444..2716; Strand=+
  SCN-specific regions: Sequence locations=1-43,65-106,145-158,193 -459,482-601,624-1058,1080-1126,1148-1242,1265-1273
atgcgctcgcccattaatgagtttaagatcctgttcatcaacatcctcgtcctttacttcttccattctttgacttggttcgtctactttttgcgatatcgggtaatagttaattaattattaattaatgaattattaattaataaaaaatgatgacatcattttccaaaattaaaaaattcagttgcttctattcttttacaccagtacgtgtgatctgctgagccccgtttggatggtccccgtttttatgggcccttaccaagtgtattccgtcgcttatccgtctctccatttcgctgttactttcgaacgcattcgagcattgtttttggtgagaaacttcgcaaaatgccccaggctttctttgtttggtcccatcccaaaaaaacattcataaaaaaggcaaaaagcattcatttgagagattagggacacaatctctgagtaccaaatgagaaggatattcacatacaaaaaaggagacacttgcttggataattaattaggtgcacaattatgagcagatgggcccgaaactgatcatcgcaatcatctgcgccattgtctgttttactaattgctgttaattgtttcggttattaattaaccattttgaaatatcccaattcagtggcttgcttctttgctgtatttggcgtgcattgtcggcttggcactcgccgaccctcaaatctctggccacccccaaggcgttgtttacttgacctccgattacaatgccaacctgattttttgggccatgcttttcacgatgcttttggtcgttgcgacggcattgtgcgattggcgcatttatttgctgaacaaaaggctaaaccgggtcgggaatggcccatcgactgagtacaacctcagtctgaagtaccaaatcaacgaaaacaccctctccttgatgctgatcttcccgctggacttgctttacgcattgatttatcccatatacaatgttattgtgctggtccttcgcgcctaccggcaaatgctttcaaccgccaattacgtctcctattaccatatggcgaatacggtatggtagagacagaaataaactgacaataaagcatacggtaagtttataaaacaaattcccatttttcagttgcttttcctgcattctctggtcacccttgtggtgtatattcgatttatcaaatatgtcagccgcgttcgaaagccgagcattgtgaaaagtcaaccgaatgaagaagcaaatatacacttcaaacaattgcaagcgcaatggaaatga

SEQ ID NO: 74422 - DNA, 574 bp, Heterodera glycines
  Genomic contig location: Contig_ID=SeqID_1552; Location=6421..6994; Strand=+
  SCN-specific regions: Sequence locations=1-52,75-289,320-363,385 -439,461-524,557-574
atgaatggtcagaaagaagcatttggaattgtaagcaaaaatgaattaattacctaattaaaattggaatttaatttaaatgaatcggaaaggattttcttttgtctttcgctgcgtcggggcccaattttcgctgctttctttcactgtttgcactctgctaatttatttttattctcaagcagtcagaccaacttttgggtaacttttgtcgtcgattggaccaaagtttcttcgctttcgtttgtttcatttttcagtcatcgcccgaaaatgacaaaaaaaaattggaggaaaagcaaacaaaaagcacaaaatgttatcaccaattggttaattatcatcaatcagcacaaacaatgaaagaagaagaagaagaagaagttgttcaattgtattttgaggcaaagcaatcgaaaaaaagaaaaattcaatggccaaagaacacagtgaaaaggcaacacaatttgagaaaagatcaaacaaatacaacgacacactcattaagcaattaattaattatgtcattaaaatttaacaaaaatcttttccttttgagattaaaaatgaaaaa

SEQ ID NO: 74423 - DNA, 1949 bp, Heterodera glycines
  Genomic contig location: Contig_ID=SeqID_1552; Location=3248..5196; Strand=-
  SCN-specific regions: Sequence locations=1-119,142-408,430-499,523 -695,738-1106,1145-1153,1175-1199,1248-1315,1340-1535,1572-1833,1886 -1949
atggccatccaaacactgacttttggtgagtatttcttcgacgggctgaggcccttttggccatcgttggaacaaagtgaaacaatggcttttgtgctgaagcgactgatcggttatctggccatttggctgatctgcttcatcaatctcttctctttggtggcattttttgtttttaaatgggcaaatattttttgttcgcattaattcagcaaaaaatcgccgcccgtttccaagtgattttaacggtgcttaaactgctggtaattgcgctgattattttgacgggactttatcaggtgagatataagcaagtgaaaaggccgaggaaattcattctttggagcaaccaaaattctcacaaaattaaatttgaaatttaatttaccaaataattccaattatttgcctttccttcccttcgtttttccttttctgccatttgtccgcatttgctcataaaaatcattttattaattgcttgtttagtctttaaacagttttcccccctttccacacagaacagatcatctttcgcggcagaacggagaatttccgcgacacttttgcggggacaaagacagaagcgtgcgaaattgtgctggcattgtttgccagtcttttcgcttacaatggtgggcatgaaaataaattctatcattaactaacttttcgaactgctgatcacattatgcttaatttcaatttattttataatttatgtagataataataaagaaacaaattaacgaataattaggcaattagaagtagggttgctccccgaccccgaaccccccaacccgagacctttttgggacctattccccgacccgacccccaacatgtgcccctcgatggtttccggcccccgacattttgcccccccccccccccccgaggggtcggggagcaaacctaatttgaagaatagggggttttattgtgtcaaaaaacttcaaaaacattttcttttgaaaacggtaattaaaaaatggagtaaaaataaatgaatttttatgacgtggaagagactcgagcgtgattattaaaaacaccaagcttcataaaattctgataaatcatagattcgacagcatcttatgataattttttaacttaaaataaaaaagttaaattaaatcccccattctttagaatatttatattttaagaatgaggtttgattttaaatttaaccaaattttaccacaaaattgtaataaaatatttaattttaaatattacagcaggtaaaagccaataaaatattggatatccaggcaaaactaagattcactaaaattccaattagatttttttattatttaattttattccaaaaggttgggacgttttgaattttgccaccgaagaaattgaaaatccgcgccgcgttttgcccatcggcgctctgtgcggcattgccatctccgccttcgtctacgtgttggtcaacattgcttatttctcggttatgtcagctgacgaattccgtcactcacaagcggtggccgcggttcgtcaaattttccaattttttacttttaaattaaattattttattttatgtctttagctttttgccgaaaaaacacttggcaatttctcccgtgtcgtgccttttttggtcgccattttgctgcttggcaacctcaacagttccatcttcgcctcgtcacggtcaaaattttcaaattatgaaaaatgacaaaaattgtccgtttttcagttatttgtttgccggtgccaaaaatgccattatgccctccgcgttgagtacggtccatgccaattcgatgagtccgcgggtggccattctctacgaagtgcatttttattttgatcattttaaatatgaatgtaaattaaataataattttaagctgtttgctttaatcgttctgtcattcatctgcgacttggagaatctgatcggctatatgtga

SEQ ID NO: 74424 - DNA, 308 bp, Heterodera glycines
  Genomic contig location: Contig_ID=SeqID_11091; Location=134..441; Strand=+
  SCN-specific regions: Sequence locations=1-233,262-308
atgaaggaattaatagtattatatttttatggtcatccaaaaaatgtaaggtcgtttaaatgcatgaaaattgttcaaaccttcaattatcacattatttgatatgaaaagatagcttaaagatttctttatgatgcagttaaatttcgaaaaaacttattgaatttcaaaaaagttagggtcaaaattgttgagtctaaatttttcgagttttttttgcttacaactttttgtaaatttttactaattttttaaaaattacataagttgtagagaatatgtagagctacattctaataccaagatga

SEQ ID NO: 74425 - DNA, 1311 bp, Heterodera glycines
  Genomic contig location: Contig_ID=SeqID_11092; Location=684..1994; Strand=+
  SCN-specific regions: Sequence locations=1-36,58-67,89-235,263 -369,391-428,512-636,658-788,885-990,1012-1064,1097-1219,1262-1311
atgcccggcaactccgtccaacaattcaccactccatcagcgccggtggccaacaatcagacggtgatcaaagtggccatgttggtggcccaaaatgacacggactttggcctgccgagaaagaactcaatgctgcgcaatgcgggaggtgcaattccaatggcactggagcagttgtgggcagacgaagtgctgccaaaaagcgtcaatttctcgttagcttttgacatattaatacaaatttttaatttccaaatttcccctctttaattgtctttcacacggtccgtatttatccccgactctttggtgtcgtggggagggattgtagccgttttcggcatccctcttaaacataattaacggatccagaaaaagacgaaaaaacaatttagccttttttggtcaaggctgctaacactaaaaacaaattatttaattttttaaaaattaattttatttcattttcgatttgaaatttagaatatattatttttttaacttaaatttaggtttgagtgggtttatgaaaagtgtaatgaggcaactgcgatgggattaacctatcagtttatccacgattttggtgctgacgcaatcattccgacgacgtgcatggagggtaattggaaattttaataaagatattttgattttgatcgacaagcatttcttttataatatgattaggctaatatttagtggcgccacaagtgggtcatttggccgctaattttaatattccgatgatcgtttggggacagaatatggtctcaaagtgagttcagtttttttttttaataaaagttgtttttgtaaataacaattaacctttttttgataatgaatttaattttaaaattagttaattttcttaaaaaattgaaacaaaatcgcaaaattttgttatctgaattccagtagtcctatcccgacctgatgccaatcccgatcccgactttttcaaaaatcagggctttataaattaattaattatcctaattaagtcttgcctcctcaaacaatgccacttatccaactttgctgaacattgtgccgaactacaaatagtaaatgcatttatttaaacataattccgcattttgttcattattagcatggcatccggactgatcagtcttttacagtatttcaattggactcaatttgccgttgtgatccaaagtgatcttggcaatgtgagcggaggtgaaaagtgaaatttattttacatattttatttatttatttttctttttaaggctgtgattatctcgccaaatccattgatgttattttttttaattttta

SEQ ID NO: 74426 - DNA, 1191 bp, Heterodera glycines; identical to SEQ ID NO: 11093
  Genomic contig location: Contig_ID=SeqID_11093; Location=1..1191; Strand=+
  SCN-specific regions: Sequence locations=1-5,27-122,146-217,253 -368,390-705,727-835,858-861,883-912,934-1110,1132-1191

SEQ ID NO: 74427 - DNA, 2153 bp, Heterodera glycines
  Genomic contig location: Contig_ID=SeqID_11096; Location=2578..4730; Strand=+
  SCN-specific regions: Sequence locations=1-107,137-282,306-481,513 -515,544-728,778-837,867-1153,1175-1280,1324-1457,1479-1551,1573 -1586,1608-2153
atggtcgcaaatgcgggcattgacgcgtccgaggcggtgatgccattggaccaaactgatctgttgtttgccgaaacattgtatgaggcatggtaaggaaaacgggcattaattttaaaaaaattcattaaaaattccaattttccccaatcggcatcactggatccaaaatgccaataatttactatccaaattaggcataaatccagaaatgaccatttttgattaaaaaaaaacaattttaacaaaataatcaggcataaatctgtttacaaataacctaatttcataattttttaatgtttataactcgtggtgttttaaaggaaacaattcggtgacaaaaaagcggtcattcttttcgtgcacaaccaaccgagtcacataaagctcgactcacgaaaagtacagtatcaattggaaaaaattgcaactgaaagaataatgtgccgatttatcactctgtcggagggactcaaacggtcagtgacagaaacaaaattttaatttttggctaattttcttaaaatttttatttttttagcttaaaaattgatccgaacaattttaacctcattttggacgacaaatttgttgttggggttgtgttcgatcgacttggtgggccaataacaagggcagaagccgcacttaacttctcttttgagcgaacaacggccatcgtaaaaccaattataaataaacttttttaagataaataaactgggataaaaaattaaaatcattaataatggcaatatttaattattaattttagaaaactcctccgtatgtatttgctgtcgctcatacaaagaaaatgcaacaggtgaattgtaattttaaaaaaaaattattaataattagagattaatctagaattgaaatcaggccaggatttttcctggatcaaggtccaggctattttttttggcaacatgggttttcctggatttttgtccaggaaatccaggtccgacatggaatccatgttcagaaattttttcaaaatgcagaactctaataataactaagaatatccagttttcgaggggaggtgttagctaaaagacgagagatctttggcccaaagcaattaaaatggccaattaagattatttcggtttcaattttgattaggtgttcacaaagccgggcatggtggagcgcttctttcccgatcccaaagaagtccatactgttgaagcaattcgtagggtccaagcaaaaagttgggcactcggagatgacgaaaatgaagcggaggaaatcaaaaaggcaaattaaaatattaaaagtaattaattcaaaaatttaaaatttcgcagaaagtgtatgaaaacccacaagactatgtgctgaagacgaatgaatgtggttcgcctaatcaaaggatgttcttcaacgacgacatccccaaaaagttggcacgaatgacacccgccgagcacaattacttttacatcatggaaaaactgcgcccgatggtcgttaaggtgtgaattttttttccaatttaataatattaaaaagcgaataattcaataaaatgaagtattcaaataggaaaatttgtcaacctggatttttcatgggctgggttttccttggtttttgtccaggaaatcaaggtccaacatggaatacaggtccaggctttttcactaataccgatctctaataattatagacaaaatgctgtatagatttagcaaaaaaagaaaaatgcatttaaatacatatataaactggtcccgtattttacaaagaatcattttgtgcgcccaaaaattgggctcactgcgaatcttgacgtcacaccggagcttggcatctatggctgtctgatcggcaacatggtcaccggcgaagtgtcatatgtctcccgatttgggcatacgatgaaaaccaaaacggcggatgaggacgagggcggcattatgagagggaacagtgtggccgacacgccttaccttgtctagaagacaattagagcaccctaccgtatccaacacaattagcacactaccgtatccaacatattttcaagtgaatactgtattttgtaatttatagctttttgcactccttttctcattcatgtgatcatttaaaattttcgagcctatctattctattgcaatatgcaaata

SEQ ID NO: 74428 - DNA, 1347 bp, Heterodera glycines
  Genomic contig location: Contig_ID=SeqID_11098; Location=495..1841; Strand=+
  SCN-specific regions: Sequence locations=1-762,785-926,1012-1102,1124- 1247,1270-1347
atgcgcagaataatcgacgcaaaacgaaatttgggcgaggatttgcagaaatgtcgcgagttaaaggggaagcggaaaacggagggcgaagaatcgtccgccgacgaaggggacgacgattcggattttgtcgatgttgaggagaaagagggtccgagtaaaggacaattgtccttaaaacccattatttaaggatatgaacccgacttttcacataatgattgcaacaaaagcagcgacaaaaaagcgaagtgcgcaataattctcgatgaacggcctggtccgagtggattaaaagtgcaaaaggaaaagccaaaagaggacgaggaaaagggacggaaaagcgacgaaatcaatgggaagaaacgcattccaaaattggcgatgggactcgatctgaaatattggggagaggagcacataaagccggcagagagggtcagagttcaggcggaaggccatcacttttggagaccaatggacgagtgagtaaataatctaatttaatttaattaatggtcaattaagaaattttctttcccattcaagagacgctgacaatgtgcccactgaaaatgctgaagcgtatcgttcccgacagatcactttcgttggccaaatgcttccgaccaaaaaacgctgtcgagcgcccctccccagcggaaaattatgcccacgaatggaaagagagcgatgcgcacttcacggaccaatcattgacagagacgaaatgggatttccacagaaagagcaaaagtggggaaaacaaaaccaactaaaaaacatcgaacaatttaaatttcagagatgaggacgaaaacctgcaaaatagcacagacgaagcggacgaacagcgggaagaaagcgaggcggaatttttacaagatttacaagaagcgacaggggtaaaactaaccgaaaacagcaaaaaagtgaaaaagaaaacaacgaaaaggaggaaaaagaagacaaccacaaagaagaaaaagggaaaaaggaagaaaaagaaaacggcgagggaacggccaaaaccgaagagcgaaaagtcgcgggagagattagtggtgagaaaggggggggggcgggtagtttttgcgaaaagttaaatcccaaggccaaactgttcgacaaaaaaacactgaaaagggtggccaaaacactcgaacagatgcaaaaggcacgcgcaagtcgcaaattttctagccaatttaattatgcactggaaagacgatgataagacaaaaaaatttttacctttttatcattattgtaaatatattcaagttaaaaattttcgtcagaatcatattctccttcaatcgagagtataatcagagtactaaataa

SEQ ID NO: 74429 - DNA, 617 bp, Heterodera glycines
  Genomic contig location: Contig_ID=SeqID_11100; Location=558..1174; Strand=+
  SCN-specific regions: Sequence locations=1-87,122-165,240-282,304 -337,359-394,416-462,484-553,595-617
ataaattttagttaattaaacaataattatttaggtgagaactgaattgtcccggaatccctaccctaaccttcattcacataatacaatattatatattttaataatatttatttattttcttttgattcgcttattttgatgaaacacactcactcatttccgtaattttattaattatttttcaacaattttaatttaatttattatttttaaatttatttttattatttcttttttaaaccttcaattggtcttgtgatggaactggtaaacactcattaaacatcagcactcattcatcatttccgatcaaattgaagaaaaccaaaaattacaattttttccccaatttcccgcgtccccccataaaaaaatatttgaaggccattcattcgttctttcgtcgttcgttcattcgacgccaaaaattcatttaatttgcgcccattttaccgaagaaacatttgtgcccaaaaattgccttctcatctcacaaatcagcaacaaatgaattgaataaataatttttcaaaattcattgataatgatgaaaatttgtttattttttattttttgtaatttttttaaattgcaaaatgttgcatattttttac

SEQ ID NO: 74430 - DNA, 293 bp, Heterodera glycines
  Genomic contig location: Contig_ID=SeqID_11100; Location=1726..2018; Strand=-
  SCN-specific regions: Sequence locations=1-100,126-269
atggatcaggaattgacggaattggccaagataggacaggacggaactggaatggatttcgcattgtgtataatatgcattttgtgagtgtggaaaaaaattttttatttgaatttttcatactaattgagggtaattagggctaccaaattatgccaagaaaatcttaatttggttgtttctaagaaaggatatgaccaatcaatggaataatctttttaagtgatcaggttcacataacaaacgaaaaatgcttgagttttggtcagaatatatttaaatttaaaaataaa

SEQ ID NO: 74431 - DNA, 415 bp, Heterodera glycines
  Genomic contig location: Contig_ID=SeqID_11100; Location=2598..3012; Strand=+
  SCN-specific regions: Sequence locations=1-51,197-327,363-415
atggattttttcttccaaagccctcccaagccacttcaggttatacaaagctatttttataaacaaattaattaattgcattattaatttttttaattaaaactaacatttaaaatatttacaatttttcaatttttatttttatttattaaactaatacatattgacatttaattgttaaattaaaatattttttgccatgtaaaattcagttttggccaaaccctccgcccgtgccggccaattttgcaaggccccaaacatttcgtgaaaaacattttggacaatggtgccgaaatttgacgctggataggtcattggaaatccaaatttttttaaaaaatccattaatttttattttaggcacattcaatgcccaagggcgtcgccatttcattggttcaccaataaataa

SEQ ID NO: 74432 - DNA, 283 bp, Heterodera glycines
  Genomic contig location: Contig_ID=SeqID_11101; Location=197..479; Strand=+
  SCN-specific regions: Sequence locations=1-5,27-203,225-283
attgtggcccacccccaaagtggacctaagtgccgttgagccgagcttccgtgcccaattggagtccctttcctggtattcgtgcgtctccgattgggccaccgataagccgtcgccctttggtgccgctcgcagtacgcgcgtgtgccgttgctgctgctttccgttcaggccgaacccaaaaacattgaaatgcgaacacatccccggggcacccgaagcgccgggagaggagcaattggaggaggacgaaacggagagaaggagcagagaatggaaatga

SEQ ID NO: 74433 - DNA, 1331 bp, Heterodera glycines
  Genomic contig location: Contig_ID=SeqID_11102; Location=105..1435; Strand=-
  SCN-specific regions: Sequence locations=1-114,190-424,446-971,995 -1131,1153-1252,1287-1331
atggttgagcgaaaaatggctttggtgagtgaattttggtcaacgaataaatgattccgaaaaagttatcgcgaacgcatcaaatcaaaaacggaattgccaccgacgaaagacgaaagagcgatggaagagggcaaaggaggggagagaggggcagaagaggggagggggacgaaggaggaggaagagccgatggagagcaggtgatcagacgaacgggggaaagggcatgagggatcagagagataatcactggatgggtgggagagggggtcaacgagggggataaaaggggaaataaaagagggggaataaaaaggggggaataaaaaggggggaataaaaagggggggggggaaatctgtggatgaaccgtcctaaagaaggccaattgatcagctgatccatgacatagtccgaaggccaagaaaacagcaatgaccagtggtcaatcgcttctaatctccctccgctcaaaggaccattccggtgtggatggcactgtccattgtcagcggttacgtgtgcacaattgcggcaattttcctcatttgggagagtcggtcagtgtcccccccccctacgggggaatttagttttgccattggcaattccatttgccccttggccatatttgccatgtaaattgtgcccctgatcagttggtcctacttcacctccttctacttcatttgcatctcctgccttaccattggcctcggtgacgttgtgcccgaccatccgcacatgctcattctcatgtccgttccattttctgctgctgtttttacaattttttctattttctctttgccaggttcgttttcgtcatcttcggactgtcctttgtgtcaatgcttttgtcggtgattcaaatcaaaatggaggaatggctgtacaaaatgatgatccaaatgcaggcactgctccccctcctctgatcagatcactctgatcacccccccctttcattttttggtcatttgtttgttgtccagaaggaatatcaaaaagcgctccgtgaagtgaccgatccgacagaacgcgaccaaatcattgcccaaatgttcgccagggagccgtggtatatgcgccaattggccccattgtgcgtcagtgaaacgcagaaggctaaattggaaaatttggtgggattaagggaaatgaggcacattttagtaaatttaaagacgcaatgctatgagaaagtgacgaaatcggagaacacgaggggaacacaaacagaacaatcggaggaggaagaggaggaggacgaagcggaggagcaaacgaaactgacgcacacagaacaaaaggaagacggacaaaaa

SEQ ID NO: 74434 - DNA, 1591 bp, Heterodera glycines
  Genomic contig location: Contig_ID=SeqID_11103; Location=2014..3604; Strand=-
  SCN-specific regions: Sequence locations=1-396,418-653,691-750,774 -1270,1292-1591
  Gene Ontology: Mol. function=diacylglycerol O-acyltransferase activity; Cellular component=lipid particle; Biological process =triacylglycerol biosynthesis
tttgctgctttacttttgttggttcgtttgggacttcgctaccccttcgcgcggctcccatttctggccgtttttttacaattcgcccgtttggcgccatttggccacttattttccgatttcggtgattaaaacggctgatctttccgcggatcgtaattatttgttcaggcaattaattaacccctaatggcacttaattgccctacccccctccctttttacagtgcccacccccacggcatcgtcggctcaagtagtttcattttcttcgctacaaatggtgcaaatttcgcctctcttttccccggcctccgaatgcattccgtcactttggacctcaacttttggtttcctttgcgcagagaaatgataatggcctcgggtgatttgacaaatttggaaataattcaaaattacaatcgaaaggaatgattccgagtgacagcaaatccatcgaatgggttttgagtcgccccgggggcggatttgccgttggcattgtgcctggaggggcggccgaagcgttggaatcattccccggcacgaatcggctgattacgtcacggagaaaggcaaaaggacttttaaaggcaaaattttaaaaaagaaagcaaatttaggggttcgtaaaattggccatcaaacacgggtaattaattaattaataattcaaattttaaataatttccgttttggtgtcgcaattgtgccggtgtttcattttggagaaaccgacgtttatgagcaaaaagaaagcagagaggggagcacattgaagaaaacgcaggtccatcggaggaaattccatcaaaaaaatgaatgccattccccaaaaaataaatgccattccctcaaaatgaatgccattccccaaaaaataaatgccattccctcaaaatgaatgccattccccaaaaaataaatgccattccctcaaaatgaatgccattccccaaaaaataaatgccattccctcaaaatgaatgccattccccaaaaaataaatgccattccctcaaaatgaatgccatttcctccctcccctgcagaatttgttgaaacgattaacccgcgtcagttttccgttggcctatggccaaagtttcatcgctgcccttttgccggaagaaacggcacaaaaattgccgcgatggcttcgcgtcggaatctttccgtaccggcggaaaattgtaacaatcggtgagaaaattaacagcaaaaaaatgaaaagtaagatgctgcgctaaagggagttgcgcatataggatatgagcagggtagccagatctgaggatttatcctcattttgtggctttttgataggtcaatgaggattttgaaaattttaatctggctaccctggatatgagggagtaggcactatagaattcctggtggataagaaccagaatttttatttaaaaatttagtgggcgagccaatggaaattgaagaaaatgcaaattgtgaggacgaacaaacggtggacagaatacacgcggaatattgccaaagactgcggaaattattcgacgaaaataaagtgaaattgggaggactttcggaggacagcgaaatcgaatttgtg

SEQ ID NO: 74435 - DNA, 366 bp, Heterodera glycines
  Genomic contig location: Contig_ID=SeqID_11105; Location=1500..1865; Strand=+
  SCN-specific regions: Sequence locations=1-237,259-366
atggccatctctacacacttgacaagacaagtgccgatggaacgactaaattttggcgatgtgagttcaagaacagtggtgtgaacaagtgcaaaggacggatttggactcaggttgccatcagtttttaaattcaatgatctcaattttttttgattttaagcgttttaatacggagccaatttttgctgagtcagcaaaaatgctgatatcgattgcttttattcctattgccgatctcactgaagcagtcaatgtattggacgttgcgttccgaaattttcggacatgcaaccgatgttggattttatgttaatcgaagtcataaacagccagcatttaccaccgttcaggttgaatgaacaa

SEQ ID NO: 74436 - DNA, 2854 bp, Heterodera glycines
  misc_feature (1701)..(1701): n is a, c, g, or t
  Genomic contig location: Contig_ID=SeqID_11107; Location=1305..4158; Strand=-
  SCN-specific regions: Sequence locations=1-516,538-900,922-1283,1305 -1455,1479-2083,2117-2587,2610-2684,2706-2854
agaatatgggtattgaaaaagtaagaaaaaagttatgccctaagaaactgaggatggtcattcatgggacgcataatatgtcatgggacacataaaaccgactagaaccaataaaaccgactagaacccagtctttttggttttatgatgaaaaaactcaaataaacaggatattgtacagttttatgggcgaccaaaaacaaatattcaaagttgttctcaccggaggtccgtgtgctggcaagacaacgggacaggtactactaacctactattttaccatatgtcatacctaacagcaattttttatactttaggctcgcctttcaagtttctttgaaagcattgggtggaaggtgtacaccgttcctgagactgcatcaattctgctgagtcctggacgcattcgttttcctgacctgagtagagaccaggctgctcaattccagatagatttgctcaaaacattgatacaaattgagaatgtactgcgttttctaatgcacaactcatttctttacatttttaggtatttttcaaccaggccgaactcagtgaagcggaaaaaattatgatcattttagaccggggtaggtaacataaattagaaattagagtaatactaccgattgtatcacaccttttgaaaaaaaattttgttttcaaaaatcatgaaaatgtgtttccacaggatcttgatgctgctgaacacgaatcttgccttcctagtactgatgctttcagtttatttccaagtgtttaaactaattatgacccaaaaattagaagatcttaactctatcttttgtgcgaatttgggtccgggttaagcaattagttgaaatggcccaatcgtgatcagcgaccctgaagacttctagaaacaagctttgattaattttgaaaacaaaaaattgttttcaaaagtgtgtgataccaccggtagagtattacctaaattagcatcagtaatgagcattttcgataaacaaatattgagtttaggtgcgatggatggaagtgcttatatcgacatggaatcttggtcagatgtattgtcagcatgtaaggtgaccaacgaacaattgcgtgaaagataccaccaagtgagacattttcgctcattatttacaaataatatccatttctaacaataagatttgtcatctcgtcaccgcagcggatggtgcacaatcattttatcaacttgcgaataaccaagcccgaaccgaatcaatggatgaagcaattcagcttgacaaaaagaccaaagaagtatttttattattttattagcatccaatgccgaaattaaggcatgggttgggcatgaatatctatcaatagttgataattcaagtggttcgtttgacgaaaagatctccaaacttattgctgatgtttgtgaacgttttggcatttcgatttcggatcgtttggctccaaatagcaagtaaatttttataaatttggtttccataaatctaaaattccaaggaaacggaaatggttggtcagcagtatcgatgacagcgccttcttgaaaatgaagaaggaggtatttgtaattgaggatgcttacctccatatggagggttcgagtcaggtaaattttacttattacagcgtgaaatttatgtcaccattttctttgacaattttcatttctggaatcgttttacgtttctcattatcgtttanatttttcgcgcatttttaccagaaaacatggaaactgtagttccccatccctttgtgctacacctagggctacaagtttatctttgcaggttcgacttcgctcgcgtagccaaaatggaaagtacacgtacacacatacgacccgaaccattgaagacgctgatggcaagaagtaattttcgcctttaaaaaaaattctcttttgcaaatatagacttccccaaccggttgaaacacggaagcagttggactggcatgagtatcagatctacttgaaacttcttgacaaagactatcaagcaattcgcaagaaacgtgtgtgttttctcttcggaaatgtggtaaatcgaataccttcaaaagtcactagattgctaaaagaatatgcttttcctttcccagtattttaacctggacatttacattgcacctcttcctccagctttgatgtacaatgaagaacagctgatgatcctcgaggcaattaaatatttgccatattttatagacaaaaaacattgttaaaaatgtctttttatagctcgattaactttccagacatacaccacgcgccctattggtgatcctgagccgcgtttgcccgattttctcgaaattgatcgtgagataactatggagtcagcctactcaatgtaacagcagcaattctttccttcaataccattgttgtgcatgtcactgtttaaggcttaacttggctcgcaacaacccggggaacgtgacttagcataaatggagcagtgcactgaattaaagaaacgggcacaagaaaagcgataattttatcagatcgattttggtagttctatgtgcatgttccatgcgaggcttaagaagccacgactaaattttataaatctggtgtcatgaagatgtattttaaatttgttgttttatgctaaatattttactttgaaatctttgcgcctacttacaattgacctttagtctgttactaaaatgaaggaacgaacagcaaaaaagaagcaaattgacgttgaagatgatagtcgttttatggatttggcgaaaaatccaatgttccgcgagatgcgcaagaagaagcacaaagttcaaatcgatgacaaacacaaagttatcttttgattaagcccgtttatacaattcaaaa

SEQ ID NO: 74437 - DNA, 529 bp, Heterodera glycines
  Genomic contig location: Contig_ID=SeqID_11108; Location=1594..2122; Strand=-
  SCN-specific regions: Sequence locations=1-131,170-182,210-239,263 -291,336-361,439-529
atgcaaatgaataaatatttgcttatgcctaaattaaatccaaatctgaatggatgcgtgagtgggtcaacagtgagcttcactgccgaaaaccttgagaaatttttgatttgcaattacaaaaacaacagataaaatttatgaagaataaaattttttaaattaatttgcaccccttgctaatattgatatttaattcttttattttactccttcaatcttcgtaaactttttcgtatacttttcattttaattaaaatttttatgtaatactgatccgctaaaaaatccattttttaaatttgtaattttaaggttatatatattaataatttcagctcaatgactttatttttttgccaaaatttaattttttattaaatattacaactatataactctttttatataaaatttatatttaattataaattatttgtatttcattttgctcaaattttgtatcattctctcatagcattatttttcttgaacatgagtgtttcttataattttaaggcctaataaa

SEQ ID NO: 74438 - DNA, 685 bp, Heterodera glycines
  Genomic contig location: Contig_ID=SeqID_11109; Location=842..1526; Strand=+
  SCN-specific regions: Sequence locations=1-92,121-144,266-288,310 -312,485-501,530-537,576-600,630-685
atgacactggttagtttgttaacattgttgttggtctttctcattattatagtcttatttgttagctatttttcttttttatgttccataggtaattaaatattttagatttatttaatagtttctgactatttaaggcaattgttttattatttctaatataataatgctttaatattcctattttttgaatattataataaaaaaataaataattagttaaattaattagtattttttaatttattgaaaaaaatataaaattctattcttggtcttttggagtgcttttttaaatgtggcttttttggcaaatattttaattaataaagtttatttaactaattgtgttttttctaaatttaaaattactttaattaaacattattcttttttttaatttttgatctattcaattttttaatgttttttcagctttttattatttttttaaaattattaactccacaaattaattttttaattgaattgctaatataaaataataataataataataataataatataaacacgtttttaattataatatatgtttatcataatttattattgagatttgattgttttttcctatggttttatttttataaaataattatttaaatgacggtcgagaatatcttaaaatttattgtttctcattaattctcgcataaatgca

SEQ ID NO: 74439 - DNA, 3710 bp, Heterodera glycines
  Genomic contig location: Contig_ID=SeqID_142; Location=58..3767; Strand=-
  SCN-specific regions: Sequence locations=1-156,178-695,717-1778,1800 -3710
atgcaacgactcgaattcgaggacgggagcgaaagcaacatggacccagcaaatgagggccatcgcaatggcgcacagcacgacgaaaatgtgcaggacggggatggtcccgtcgcttcaacgaacgaagagcaacaaaaagttgccagagtaaacgaagcaacgagaggaagcaacatggcgacaggcttggcgacaaatcagcaagggatgctacccttcccatcacgcaatttgcggagtgtatccataccggtacggacagcgcgggacagaatcgagagagcatccgggactctcgtcgctcgaattgcggaggctcgagaagtgatcgaccaagaccttaccgaaggggaggcaggctaccaagcagcgcgacttttggccatggagagaggactcaaggaggcaactcaaatcttccaaggacatttcgagattggaatggcagcagcgggagcagaacccgcaggtcaccaggacttcttctacgacatactgacagcgccactgccggcggcaacgaaagagttgcagttgcgaaaccatccaacaccagctgaactgcttcaaattgcggacgagcacatcggagacttaaggacgatgcgactggcactcgaggatgaagaagaagcaatcgcgcggtcccgattgagcgggtcattcgggaccaacaacagccatccggtgggggacgacccacctccactggaaaatcggaacatggaagaatgggagagatccttccaagtggcggccaaacgatggcaaaacgacggacaaggtgtactgcaacacaaccgaagaccaatgggacgagtcgcgacacccgtcatgtcgaatttggacgggatttttcagcggcgtgccaaagtaccatccgtcgccagcatgagagtgacgaacccagcgcgagaatggatcaatcgaaatcgagacgagatgggggcgtttcccccagcaacagcccatcggccggcactgatgcaaccaaaaatcgaaaagcagcaggctcacgtgaacgacgactatcgggagcgtcagacatacccgattcgacggcatgctcgagacgagggagaacatgatcggaagcacgggagggacgaaatcacgggaatgacaacattcgagactgttcggctgcaaccgccgactttttccggaaagcccgaggattggacgacattttgggcctatttcaagcgagctgtggacgacaaacccattcccgggtttgaaaaacaattgcatcttctgcgctgcttaaaggagggatcaccagcccggcgggctgtcgaagtctaccctccctccgacggcaactacccggtggtcgtgcaacttttgaaagaacgattcggcgacacggacgatttacagcgggcaattcgggcccggcttcttcatttggcaccggcaaaggacaatgtgaacagcttgacaacgatgatcgacgaatttgagcgatgcgtttgccaactcgagcagctcggagcgaacgtggacgacgactcatttggcccattgctggaggcaaaattgccggtgcgagtgctcacggaattgcggatcagagaaagcatgatgggatcgaaatggtcagtgcgcgagttcaggagagcggtggcggcgcaagtacggtgcatgcggtcagcagagtcagcattggcagcaatgaaagacccggaagtacgcactgatcacaaaacagaacgtgatcagacgggactggatgttcaagcaggtcgggaaccgtttcaaagagcatttatggtacgggacagccaaccaacccgtgcacaatccaacggaacacgaagcgaggagcggtacgggacgaacgcccgtttcgccagacgatcgatcacacatgccaacgagaacgagagctcaggcgggaattggccccgtgtcgcatcaaacggaccaattgccacaacggagatatggaactgttcactatgcctaagaagtggacatcgaccaagcaaatgccaagcctatccgacagcacaggcacggaggaagagactcattgagcagaaacgatgcttgcgctgtatgagctccgatcacttatttaaacaatgccaacgagtaaaccggtgcaacgcattccgaaaagacgaccatcattggcttctgtgctggaagagcatatcgggtggccaatcccgatccttcactgagcacgaacgaagggcaaagaaccatgcgacgctgatcagtgggatggatcgaccaactcacttcactgaagtgcgagacgagcagaacgttcgagacggaatcgagacgaacgccggggaacaacgggctttcaccactttcggaagccgactcccggcccagcaaatgatatgcagagtgatcgcagctgcagaggaaggcgaagacgagtgccaaacaactttgttgcttgacccgggaagccatgtcgacggcgcagatacggagctaattcaacaactcggaccgcaacccatcgacaagcggccgcttacagttcaagtgttcggaggaaagaagcagcggattcggtcagcaacttatcgcctacgactcaaacggaccgacggcaaatgggagagcattgaggtgtccgaagtacctcagatctgtacgccaatcagaacagaactcatcgagtcgggagcaacacccgatagcgacccgcgaaccatcacacagacaacgcaacctcaaataatgatcggcattcgaaagttctgggattacgtgatcggatttcggaaaattgagagtggcgcgcatgtgattgacaccgtgtttggacaagttttgtgcggcgaaggcacacaagcgagcagcggggcaactcccgcggcatcaatcctaacaaccatgccatgcggaaatatccaccaaactcgaacaaataaacgacaacaaatcggagaagtacgtcgaaattggaagcgaaaacgaaagagtcggaaaaacaattcgcgagggattgttagccgagaccgccacaactcacctgcagagcttggtcccgatcggtcgggtgcgaacgaagttattacgtctcgagaggagccaattggggaaatggaccctaaacagcgaaagtggcccatcggacggatagtcgagacaaaaggagcgagcgaacataacagaaatgccatgatcagaatggccaacggacgaactcggagacgaccgatcaagaaaatttggccgctgaaagaagcgcggccaaaaacgggcgaaacggacgaccgagctgacgaagcagtacatgaacgactcgaagaacagcgagcaaccgagactcagagcaaaatgagggatcggaacgcaccctcggcagcaacggagaacgagaaaaaggaagccaagcgaaaaaatatcgaaaagcgaggacgagaagttaaagctgtacagcctgacgaaaaggcaaatcgacaaattcggaacgacaattctcgagggaatggccctcacgactcggacgagaaatacggcagcgcaacgacgacggagaaatcggcagttttcgaaaaagcggcagaagtgccttcggcaacacaggaagaagcgggaaattcggcaaacccgcattcggttcagagacacgagaaaaaatatttgggagatagttcgatggctcccagtctcctcaatgatcgtgccaagttacaaacgaattcgacggaatctcaaggaggagatag

SEQ ID NO: 74440 - DNA, 594 bp, Heterodera glycines
  Genomic contig location: Contig_ID=SeqID_142; Location=7511..8104; Strand=+
  SCN-specific regions: Sequence locations=1-594
aaggggtaaacatcccccgtggcccttcttttgtttgatgggcacaaatttttgtccaaatcggagttgttgatgaatggaaaggccgtcttttgttgttggccggtcgtttttggaccaacaatttttgaataaattagtgaagtaaaaaaatgtgaaaattttggcgaaaatgttggccgaagtgaggaaatggtggggtgaattgacgaaatgtccgaatttgtgatgagacgggaattaaaacccgttccgactgcttctccttttccgatcagtgccacaaatgcgagagctgccagtgatcggtagagccgaaagtgggggttgaatttgatgaagacgaaaagcgcggccaaggcgatgattcccgaggccacggcgataagcagccattgtcccgtcgagagcaatcgaagaagtggaaaggggtcaaatccccaatttggcattgtcagggtgaacgtgctgcccggctcgatgtgaccgctcgctgagtctcgctggctaaagccgaattgctgctgtttagggatgaaagcaagccccccttttaagtttaaattttgttgtccccgccgggcatttcacttg

SEQ ID NO: 74441 - DNA, 9237 bp, Heterodera glycines
  Genomic contig location: Contig_ID=SeqID_142; Location=8039..17275; Strand=-
  SCN-specific regions: Sequence locations=1-156,178-695,717-2689,2714 -4316,4338-4671,4693-5553,5575-5743,5765-6084,6106-6175,6197 -6541,6563-6896,6918-7458,7480-7934,7956-9237
atgcaacgactcgaattcgaggacgggagcgaaagcaacatggacccagcgaatgagggccatcgcaacggcgcacagcacgacgaaaatgtgcaggacggggatggtcccgtcgcttcaacgaacgaagagcaacaaaaaattgccagagtaaacgaagcaacgagaggaagcaacatggcgacaggcgtggcgacaaatcagcaagggatgctacccttcccatcacgcaatttgcggagtgtatccatcccggtacggacagcgcgggacagaatcgagagagcatccgggactctcgccgctcgaattgcggaggctcgagaagtgatcgaccaagaccttaccgaaggggaggcaggctaccaagcagcgcgacttttggccatggagagaggactcaaggaggcaactcaaatcttccaaggacatttcgagattggaatggcagcagcgggagcagaacccgcaggtcaccaggacttcttctacgacttactgacagcgccactgccggcagcaacgaaagagttgcagttgcgaaaccatccaacaccagctgaactgcttcaaattgcggacgagcacatcggagacttaaggacgatgcgacaggcactcgaggatgaagaagaagcaatcgcgcggtctcgattgagcgggtcattcgggaccaacaacagccatccggtgggggacgacccacctccactggaaaatcggaacatggaagaatgggagagatccttccaagtggcggccaaacgatggcaaaacgacggacaaggtgtaccgcaacacaaccgaagaccaatgggacgagtcgcgacacccgtcatgtcgaatttggacgggatttttcagcggcgtgccaaagtaccatccgtcgccagcatgagagtgacgaacccagcgcgagaatggatcaatcgaaatcgagacgagatgggggcgtttcccccagcaacagcccatcggccggcactgatgcaaccaaaaatcgaaaagcatcaggctcacgtgaacgacgactatcgggagcgtcagacatacccgattcgacggcatgctcgagacgagggagaacatgatcggaagcacgggagggacgaaatcacgggaatgacaacattcgagactgttcggctgcaaccgccgactttttccggaaagcccgaggattggacgacattttgggcctatttcaagcgagctgtggacgacaaacccattcccgggtttgaaaaacaattgcatcttctgcgctgcttaaaggagggatcaccagcccggcgggctgtcgaagtctaccctccctccgacggcaactacccggtggtcgtgcaacttttgaaagaacgattcggcgacacggacgatttacagcgggcaattcgggcccggcttcttcatttggcaccggcaaaggacaatgtgaacagcttgacgacgatgatcgacgagtttgagcgatgcgtttgccaactcgagcagctcggagcgaacgtggacgacgactcatttgggccattgctggaagccaagttgccagtgcgagtgctcacggaattgcggatcagagaaagcatgatgggatcgaaatggtcagtgcgcgagttcaggagagcggtggcagcgcaagtgcggtgcatgcgatcagctgagtcagcattagcagcaatgaaagacccggaagtacgcactgatcaccgaaccgagcgtgatcagacgggacgaggaggcaaagcaggtcgggagccatttcaaagagcatttatggtacgggacaaccaacaaacgcgtgcgcagcccaacggaacacgaaaagaagagcagtacgggatgaatgcccgtatcaccggacgaacagtggcacgcggcaacgagaacggacacaaaggcgggaatggaccccgcttcacgccaaatgggcctcctccaagctgcgggagggggaattgttcgctttgtctgaaaagcggacatcggccgagtgagtgccgcgcctactcgacgcctcaggcacggaggaagcgattgattgagcagaagagatgtctgcgctgcctgggctctgatcactcatttgaacagtgccaacgaccggttcgatgtgacacgtgccgaagcgacgatcatcattggcttatgtgctggaagaaccaaccgggaaaccaatcccggcccgtcggagaacccgaacgaaaggagaacaaccacgcgatgctgatcagtgggattaatcaacccacccgcttcactgcagcacgagaagagcaggtcaatcgagaagtggccgagatgaatgccggggaacaacgggctttcaccgccttcgggagccgagtcccggcccaacaaatgatacgcaaagtgaccgcagcagcagaagagggcgatgacgaatgcctaacaacattgctgttcgatccgggaagccatctcgactgtgcagagactgagctaattcaacatctgggaccgaagccgaccgaaaggcggccgctgacagtgcaagtttttggggggaaaaagcagcggatccgatccgcaacttatcgcctgcgactcaagcggatcgatggcggatgggagagcattgaggtggcggaagtgcctctgatctgcacaccgatcagaacagagctcatcgagtcgggagcagtacccgaaagcgacctgagaacagtcacacaaacaacacaaccacagctgctgatcggaattcgaaaattctgggatttcgtgaccggctttcggaaaacggaaagcggcacgtacattgtcgacacggtgtttgggccaattttgtgcggcgaacggttccaagtgagcagcggggcaactcccgcttcgtccgtgttcatgaccttgccatgcggagaagatgaacgtgatcaaatgccgccgatcagagcagttgagcaattttggtcattggaagcaatcgggatcagagacgacccgacagacgacgcggatgcacaagcagtgatccaattcgagcgatcagtgcgccaactcaacgacgggcgctactcccttcgactgccatggcgggagtgccaccccgctttacctaacaatttcagcatggcctatcgacggctaacgacaatgcttcaacggctgcaaaggactcccgaggtgctcaagcagtacaccacagtgatcactgatcagctcaatgccgcaataatcgaggaaacgacgatcggagccggtaaacgcgaacacttcatccctcaccaagcagtgatcacgcccaaaaagctgcgggtcgtctacgatgcgagcgcacacacacgaggggcaccttccctcaacgactgcctactcagaggcccagtttggttgccggatttggccggtatgctcattcggttccgagcatgccgagtgcctgtgatcgccgatgtcgagaaagcatttctcatggtcgggattgaggaggacgacagagatgtgtgcaaatttttgtgggtgcgcgacccatttcggccagtgacaacggacaatttggtgacataccgatttcgacgcctcgcatttggactcacgccaagccccttttgtctcgccgccgttgtacgacaccacctgcgcaaatacgactccaacttcgcggaggaactcattcgggacacatacgtggataatgtgctcatcccggcggacactgcggaagaagcagccattaaaggacgagaagcgaaacgaatgtttgcggacgcgcggatgaaccttcgggaattcttgagcaatgacgagacactcaacagcagcttttcggacgccgaattcctcggcaagacgacggccaaagtcttgggactcgaatggaatgcggagacggacaaaatacgaatgaagtaccccgggagcgaacccggcactccgatcagcaccacacgcagaacggtgctgagcagcgtcgccagcctgttcgacccgctcggcttggtctgcccggcgaccctcaaggcgaagctgttcttccaaaagctgtgggacgacaaccacgaatgggacactcctttgtcccgggaggaagctcgagaatgggagcacattttggcaagttgggagggggaaagtaatgtgattcctcgaggcgtaacggcgggcaggggtcacccgcttcaactgcatgtgttcacggatgcatcggaaatcgcatatgcagcagcagcttacatacgaacgggaggagaaagcgggtgcaactcccgcctcatcatggccaaatcacgcctcaagccgaagaaagcggctaccacgttcacaataccaagaatggagctgatgggcattctgttgggggtccggctggcagcattcatcgaaaagcaactccaccatccaatcgcggggcaacacatttggagcgactcaatgatcgctctccactgggtcagaacggcttcagcgcaaccacaattcgtggccaatcgactcttcgagatcagaaaagcgacagcaacgacgtttcactacattcgaaccaacgaaaacccagcggatttggcaactcgaggggaagtgcccaccctcttacaacacaatgatcagtggtggaatggtcctcaatggttgcgcgggccgagaacggaatggccaagcgaattggagtttcagcctgatcaagagggactaccctctccggcggggcaggaagaaggacaatcagcattcattgtccgaaatgaagcatccacaggcctcgagagtgaacaattcccgagttcgttgcttacgaggtgcagcaaatggtccagagtgcagcgcgccacagcatggatgcaacgcttcatcggaatcgtaaaaaagcggatcaagaaaaggcggggaagcgaaattggaggcccgccgatcatcgagactgaaaaggcagtaactcgaggatcgaaaggaaatttagaaatcgagtccagaaggattgtaggtcaaggcctccacaatgtgcctgcgaaatttgagcccgatcggtcgggtacgaacgaagttattacgcccgaagcggagcgaattggggaaatggacccaaaccagcgaatgatcaaaatcgaagggaagcatttggcatcgctgcgggcctgtgaactccgagaagctacctgggctctaattcgtgccgttcaagggcaggggtcaatgacgggatccgtgaaaaccgagccggatcaccgagggattcagagactgatcagtcgtatcggacagtgtgacgagccagggctgagcagcccgatcattctgccgagaaagtcacgggcaggagcacttatcatcgacgggattcacgagcgcctccaccattcgggagtggacggaaccttggctgagtttttgagggggtggtggtcccccagcgcccgacaacaagtgcgcaaagtgatcggacagtgccgaacgtgccgacgaatgcaaatgggagcatattcccttccgccaatgccgccgctgccagccgatcgagtgcaacgacgactgccattcgaatcagtagggctcgattaccttggccccacagcaatttcggacgagaacggacagcggagaaaatcatgggtgttgctgatcacctgcctgacgactcgtgccatttacatcgaggcgactcgcgatttgacggctcaaagcttcatcatggtcctccgccgcttcatcgcaaggcgcggggcaccctcccgcatcatcagcgacaatgccccgacattcacaattgtgggcaagactctcgcggatttcgggatcacaaatgccgacccgatcagcttcgccgactcaaaaggcatccaatggcgcttcacccctcagcatacgccatgggcagggggagtgttcgaacgagccgtccaattggtcaagagggcattgcaaaagaccctctccggcacagtactcaattacgacgcactttcaacaattttagccgagattgaggcgacaatcaattctcgacccctcacttacgtcaacagcaccgcgggtgatccactcccgcttcggccgatcgatttaattcaggaaaacacacgattggcgatcgaaccaccgcccgagcctcaaattcaagccgttcagagggagccccctcatcttcagttggcgcgtcagtggcgagactcccagcagcggcttgagcatttttggaaacgatggcatcgagagtatttgttggtgttgagagataaagcaggctgggcacacccagcgcgacgagtgaatgctcacggcacaccgcagatcggcgacgttgtgctaatcgaggacaaattccatccaaggaatttatggcccatcggacggattgtcgagatcaaagggtcgaacgagcacatccgaagtgtgatgatcaaaatggccaatggaaggatctggggacggccaatcaacaaaatttgcccattggaagaagcacccccaaaaatggccgaaatggacgaccaagcagatcaagcagtacaagaacgacaccgagatgacgcacgggcagccgagactcggagggaaatgagggatcgggatgcaccctcggcagcaacaaaagacgaaggagatgaaagcgaagaaagtgacgaaaaacgaggacaagaagttggagccgtacagcccgacggaagggcaaatcgagaaatccgggaagacagttctcgagaagagggccccaacgattcggacggaaaaaatggcggcgaaatggcgccgcagaagtcggcagtttttgaaaaagcagcagaagtgccgtcggcagcacaaggaaaagcgggaactttggcacacctgcattcggctcagagacatgagaaaaaatatttgggagatagttcgatggccccaagtctcctcaaggttcctaccaagtttcagccgaattcgacgagatctgaaggaggagataggtttggcgcagacggacctcaagcagttcgggcaggcgaaatcgggggcgaatttcccgaagcaccagcggtcgaacagcaccaaaatgaactcgaacaaactcccaacaagcccgtggaggaagtacacgacggaaaagacgtccgagaagttcaagcagtacctggagctgaacaaaggaagtcggccaggactcggagaaaccgggagatttggtccccggagcgtcatgttccacgaaagcgaggcgtaattaagcccaaaacaggaatggcactactgatcatgctcatcagcattgtcggaacgttcggctgccagccgtcaattcgatcatcgggaatggacccgaacctgccatttcaagaaggcccaaaaatgccatgtaccatggaatgtgcaaaacgaggggtcataattatgagtgggcgggaattaaataaactcgagatttgctgcgccgacggatgttgggcgaccatgcccaagtcgacggatgtgaactacgaattgccggcggaagagctgatacatggctatcattgccatggcaaatgctggtgggggaacaatgcccctttcaacacaacgaggcggtgccccgcaaaatcagaatgtgatctgatccaatgcgcaatttgctgggagcaattcgctaatccacgctgcttcccccggtggacgatgacgatggtcgggatcgggatggcattccttctcgccataatgggatgcatatgcccaattctcggacgattttggtcgggagcagcagctcttggcaaagcaattgcatggggagcaaagtaccccattcgtctcttcaattgggcgaccggaagacaaatttcgccgccaacagcagcacaagtcgagattaagctgaagagaggagcgagaaaagcgcgcacgagagttcgagagctacagcaacagcttcaattgtcacgacgggcccgagcagccgcgcacgcatggagacaaccggaacggaaccaattgacagtccgaggaacggtcgcggcggggctcctcccgcttcttctcctaattggcaccacattcgcctcaaagccgctctcggtcactgtccgatcggaggactgtgcccgaacggccaaaggacttcaatgtgccggaactgccgccacaatcatcaccttactgccagccgatcaggtcaattcgtttgtgatcagaacgcagcaggacgagctcttggggacggttcgactcaggttggcctcgatcacaatggtttgtgtccccaaaacggagagttggctccgatcatacacaatctcgactgtggcagtgaaaaggtgcccatcagctgggtcgtgccgcgacaacaactgcagcacaatgaacagtcgagtgatggtccccgaactcaacgaactcaatcaccggcctggccattcaatgtgcatgagcagcacaagcttctggcacaattcctgtgggcttccatcagcttcgtgcctgttctaccggtgggcggctgtccccacctcgaccacggttttcgaggagttcagctgcatcgaatgggacctacagctcagcgcatggatcgaaatcgagacaaacaatggcaaaatcgagactcaacggcttatacttcacccgggggtgccggaaaagtgggggaacatgaccatcgcggtcatacccacctcactcccgccaatgccaatcctctcggcatacttcatctcggacggacgagccatggcgatgggaaaacccatttcttcggatttgcactgctcggacgaagaagcagcgcgaggcttcgacaaatgccaattggcgatcgggtcatgccaaaaatgcgcgccgaatcacgagaacggaactgttcactgccattgccgcaacctcgagattgagcgggtgctgaacaacccggaacaccgcctccctctcgacgttggacggctgcacgttcacaacaaagggccaacagttcaagcggagttccaatacaccccagtgcaggttcaaatccaactcaacgagctggagctggtcagcgaatacagcaacacgaagtgctgggtcggctcgccccagctcagcggatgttaccggtgcatttccggcgcaactttcgaagcaatgtgccggacggattacggcactgcgctcgccaaaatcaaatgcgcagatggcacaatgtttggcttacactgcggggggaatggcactacgacgactgagtccatccccttcgatcgatcggaaattttcactgagtgccaagtgaaatgcccggcggggacaacaaaatttaaacttaaaaggggggcttgctttcatccctaa

SEQ ID NO: 74442 - DNA, 657 bp, Heterodera glycines
  Genomic contig location: Contig_ID=SeqID_142; Location=8615..9271; Strand=+
  SCN-specific regions: Sequence locations=1-657
aatgggttttcccatcgccatggctcgtccgtccgagatgaagtatgccgagaggattggcattggcgggagtgaggtgggtatgaccgcgatggtcatgttcccccacttttccggcacccccgggtgaagtataagccgttgagtctcgattttgccattgtttgtctcgatttcgatccatgcgctgagctgtaggtcccattcgatgcagctgaactcctcgaaaaccgtggtcgaggtggggacagccgcccaccggtagaacaggcacgaagctgatggaagcccacaggaattgtgccagaagcttgtgctgctcatgcacattgaatggccaggccggtgattgagttcgttgagttcggggaccatcactcgactgttcattgtgctgcagttgttgtcgcggcacgacccagctgatgggcaccttttcactgccacagtcgagattgtgtatgatcggagccaactctccgttttggggacacaaaccattgtgatcgaggccaacctgagtcgaaccgtccccaagagctcgtcctgctgcgttctgatcacaaacgaattgacctgatcggctggcagtaaggtgatgattgtggcggcagttccggcacattgaagtcctttggccgttcgggcacagtcctc

SEQ ID NO: 74443 - DNA, 1874 bp, Heterodera glycines
  Genomic contig location: Contig_ID=SeqID_1554; Location=416..2289; Strand=+
  SCN-specific regions: Sequence locations=1-178,207-381,403-526,555 -989,1011-1411,1433-1473,1507-1669,1691-1745,1772-1874
atgcttcgatttcgcaaaagtgcattgaatttcactaaggcctttgccattgtggaccaattcattcgcgctcaaatggcattgccacgcggcgctggcgtgtcctttgttcgccttgaccgggacgactttcacccgctgtaccaggtgtactgtaaaaattcaaaaatgcatgcattactgtagccaaaaaataaagcaaacagtacagtagtcgattgattgcacattaatcgctttttgccatttaaacatgaacagatttccgtgttgtcaaaccatccggcaaactttgacgagtccgagtactgctccattatgtggtccgtatttcgcaaaatccagcaacggacaatcaatggtcagaaaggcatacatttgtataatttttaattataatatcatccatttctgattatattactataacttccatttttagggtcttgataaatcgctaattatttcttaattagacattagacaccaatgaatttagttttgatcaatttatatcattcatttctttttaattttatatgatataataaatagaccttttaccatcaccggaaaccgaaaaaatgaatatttttttttgccgaacctaatcagttttcaggattttctgtctatttaattacaggcctattacgcaatttccttaaatttcttctcaattacccatatgggtggagataaaaaataaatcatggatataatcctataaatccctttgcagatcatctgccaattgagtaccagccaacggacagtgccgaattcttcgatatccgtccaaaatgttcaattcagctcggcattttgcactggaaaaccgtgttcaaagcaattggcttcattgtattggttggcattgtgctcggcttaatgacctattcatattatcggcatagtccaaggtaaagcaaaagcttttgatctgtaaaaagcaaagtgatcgaatcgggcgaaatcatttggccatttgaaaattctgccaatatttgatcactctttaatttttctgatcattaaatcaactgatcggtcgatccttttgccaacagatcaattgattttcgtgtcgataattgatcactctttaatttttcggatcattaaatttaagctttcgtctttttgttcacgatttactgtcaagagagcaccatgcaatacaagtcagttggcgaaggacacatgaacatgttgaagtgatcagagaagaaatcgtaagtcgtctaattttgacactttcaaaaataaacgaattttggcagaggttgcctaaaatttatatgaaattaatcataaagaattcatattcaaaagaaatgggttgttttaggatttatggttaaatttttggcaaatattggaaaaaaactttaaaaatttgaaataagataaaggcatacattcataattggcagagctttatacgagttagatgaattttgccaaagttggtcttaaaatttatatgaaaataaagaaattaaatgtcttaaaatagatattattatagcatttacgattaaaatagaatttggcaagtattggaaaagccttgaaaaatttgtaattcgtgatcgatcaaacagttttgtgatgccatctttggcatttttttttgttttgtttaggaagaacaaaaagttgatggaaatggtggcggcggtggtgcttcatttttggctgagtttgcaaaccgagcattctcatggaagatggaaaggaaggataatgatgatgataatgatgatgaagccaaagaagaagccgccgatgtcaactcacagaaagaagcattagctgctgatgaaaaagggcaacaggaaaaatagaaattttatgatttgttaaaatta

SEQ ID NO: 74444 - DNA, 810 bp, Heterodera glycines
  Genomic contig location: Contig_ID=SeqID_1556; Location=58..867; Strand=-
  SCN-specific regions: Sequence locations=1-587,638-694,745-810
atgaacaaccacacaggtgtccgtgtaatttgcaaatgggtaatagaatggggtcgacttaacggcaccttgcccgttgctccaaaaacacgcaattccgctacgttatggaattcattcgtaagtggaaaatttcgatttttaggggtgtatctttcttttttaagtcgatttttagggatgtatctttcttttttaagtcgatttttagggggtgtatttttggtttttttgaaattccgaattatggggtgtattttacaaaatttttcgccaaaaaattaatattttacgcccttggttccaaccgctctaacaaagtagccactttgttgatgttttagttgtcgttgagcatttctttaaaattcttaaccatcgattatcgggagtttcactaacgctttgtattcttccgactttggccaaaaacaaaaatttcaaaagcaaaaaaaaaaaaacaactaattttttatttttgccggcgttttcaacaaagtaaattacagggcaagaagtaataaattctgggcattttttttaatatgctaaatacatgaaggaattttattactatgtattaatgcttttttatttaaattaaaagctttaaatattataaataaatttaattaaagggaacattgttttaaaaaaataaataaaagagtttcttgctttttgtatgaaatgcattaaataatatgaattaaaattgaacaaatatatcataaaaattaattagcattatcttatgcattgattaacgagtacaaaaaaatattttttcagctcctctcaaaacggtaa

SEQ ID NO: 74445 - DNA, 1109 bp, Heterodera glycines
  misc_feature (972)..(972): n is a, c, g, or t
  Genomic contig location: Contig_ID=SeqID_1556; Location=3879..4987; Strand=+
  SCN-specific regions: Sequence locations=1-3,25-371,393-491,513 -588,615-824,847-1109
atgtttaaaattttcattttgttaaacgcttttttgctgatcaaattcgcaataactgatgaggaacaagaagttcacggtccaccggatgtacattatgcggatagcgagaagattgaggtaaaaaaaaagtaattaaacgcgatgctcgagaatctcagttttgagtcgagaaattcggaatctttaaaaaagcggtccgagtcgttgatttagatggccgagtcccttcgcaaaaattttggttgacccccccccctcgctttttccatgtataatctttggagctttgatctagttgtctcgtatctaatctcacgctcatctctcgagtctcgagagcttttcggtctcgagcataattagtaattaaaaataatttgacaaaattccttaattaattattttgtttaattaaggaactcgcctctcgtgccgtggaccaaatcaatcaagagaccaacaatacgttcctgtttttcccggtgaaggtgctttgtgccaaatcatctagagtagctggaataaattttgaactgcgagttttggtcggacaatcaaattgtgcgaaaaatgtaagtgcaaaacggggagaaattggcacaaaatggtgaggtcggcatatgttttacaagggggaagggctgtaatttttgggaaaatcgggagcacagaagtggaataagccgagatcaacagaccctggactgacatgttgaaaatcgggtttgtatcggagatttgcttttttaactcggatcgggaattattgggattagattctcaaaaaaaatttaaaattaccatttaaagcaaagttaaattacaataatggtagtttttaaagcagccaaaggcaaagcacacaaactgtacaacggaaactgacctgacagcacgaaaggcgcggactaattaattatttaattacatgctaattagcctaattatctattcttcaggtatatgaangtgagtgtgttgcagcaatcttcgaagaatttggagttgattaaattcaaacaagaaaaagtgggaaatgcgacagaatgttagggacaaagcgaccctaattaccaaattagccatttaaagcaaccatgtattta

SEQ ID NO: 74446 - DNA, 1225 bp, Heterodera glycines
  Genomic contig location: Contig_ID=SeqID_1557; Location=1852..3076; Strand=+
  SCN-specific regions: Sequence locations=1-240,296-659,690-1018,1076 -1225
  Gene Ontology: Mol. function=protein binding
atgtcatcgtcctcgaagcaggagaatccgattgaacggatgaagcatttgttgagctcgggcgaggacgcggacattcactttttggtgggggacggagacaaaaaagaggcgcgatttttttaaatgaaaatttcttttttttcaacgtcctattttattcagattctatcagctcacaaactgattttgaagcatgcttccgatgtttttgaggcaatgtttcgtttcgactcacagaaagaaaaaacagaaaatggtgaaaaaaaattttttgatttaattttttttttttgaatttagcctctgccgtcagtcccgtggaagtgccagatgttgagccagcagcattcaaaatcatgctcagcttcatttactcggaagatttgagtgaattgaacggagacaacgcaatggcagtgctttacacaggtgaaaattggcagcaaaaatttttttgaaaaaaaaattcctaggaggctggtaaattttttcggggaaaatgaatagcgccattcgaaacaatccgtttttttcttccaactcatttataaaagcgatgaatgtttactgaaatacctcatgtcaggcccattggcgtcattttagttaccattaattcgaaaaaacaatttttcgttccagccctatggaattagtaaaaaaaaaaaaaaaattttttttttaatcttttcgggagggagggaacgatgcgggggactgatccaggggtggggatagtgtaaccctttgacacccccccccccccccccactttcctgcgccggtctccatttttaaaattttgatatttttgaaaaaattttcgactcaaattttaggaaaatttcgatttcaaccaataagatgtttagattatttccgattgttttttagcaaaaaagtacgtcattgatcggttggtcagtccagctgtggaaattccaattgcacagctgcgcagtgttttcgaggcctttgctctgactcgtctttatgacttggaggtgacgacaacaaaaaaaaaaattttttttaacttcaaaaattaacacatttttagcatttttctcatcaatgtttgcgttacatttgtcaaaatgcagccaaattgttcaaatccgagggatttttacaaattgatcagaatttgctgtgtgaattattcgaccgtgatcagttgatgatcagcagcgaatttgaaatttggaaagctgtaatttga

SEQ ID NO: 74447 - DNA, 400 bp, Heterodera glycines
  Genomic contig location: Contig_ID=SeqID_1557; Location=3559..3958; Strand=-
  SCN-specific regions: Sequence locations=1-81,103-223,245-400
atgcccctggctatgcccttggtcaaattcttaaatttatgcccacctttgcacgaaaggtaaaattgcagccatttctcattgctttcttcatcaattccaatttttgccgatattttccacgagagtccatttattgacagttccatttcactgttccgttcatttcccacttcctctcgtgcaaattcagaaaatttctcaatttccatcgccaatgtgcctctgctgctgtttcctttggctgtgttccaatcagaaatccgagtttaggaaatttcaacgggtaaagccccccgggcacaccacgaaaaatttttggataaaaattgaattgataaacgccgacaaactcatcattggacagaatgccggaaggaactgcaaaaagggaaataaa

SEQ ID NO: 74448 - DNA, 656 bp, Heterodera glycines
  misc_feature (562)..(562): n is a, c, g, or t
  misc_feature (615)..(615): n is a, c, g, or t
  Genomic contig location: Contig_ID=SeqID_1558; Location=18..673; Strand=-
  SCN-specific regions: Sequence locations=1-65,92-450,472-622,648-656
atgaacccagaagttcaagcgggattggcccatttcagcctggtgggccaaattcgaaaaaataacaaaaagtttaattttatttttgcccaatcggaattccaacataatcgggaggatttgaatctcccgtaatcaaatcgcggcataatgccaatccagatcccgaactttttcaaaattgcgcccgaaaaacatgatttttgactattttttcattaatttaagcgctaaattttctttcttttggcattttcacaaaaattcattaaaactcggtttttctctgtcaaaattttttagtctttaaatttccaccattttccccaaattgtttcagctgacgcacggatttggtggtccatcggtgcaaacggtgcttgaaacaatggtcagcgtgatcaacgagtgtaacggtgtgctcactcggaattgccaatcgccgattaatgccgccgccgccactgttggccaacaaaatgccgttccttccgttggcatttggtcgccctttaattcttaattcagacggaccatcacattttaaacaagcataattagntaaatattttatttgacggatgatgagtgattgattgaaatgatgaatattgnagacatattattcacttttttgtatttcatttttgaataaa

SEQ ID NO: 74449 - DNA, 1033 bp, Heterodera glycines
  Genomic contig location: Contig_ID=SeqID_11110; Location=98..1130; Strand=-
  SCN-specific regions: Sequence locations=1-349,371-398,420-455,477 -775,835-1033
atgcacggatacatcgtcggcttcaccagctcagtggaaactgatcagaaagagttaatgtgccaaaatgtgatttccgatgtcaaatacattaaacaacaattggccacaatgaacaaatgtgtggcgggcggtggtgccaaaattgtgcgcgaaattgacgtgcaattgacattaatgggtaggttaatcaataggaagcaaatttataaacgaaaattgattaaaaaaagctaaaatatggataaaaattgccaaaatattagaaaaaaaaatcaaaaaacggagttcaaattttcgaaaaatcataaaccattttgtctttgagactaaaaacgaaaaaaatcagtttaattttaaaagaaaagaatgtataattagagtctcaattgaaattctatgaaaataaattttatttcattgagaaaaaaacttgtcagttctcattttttcactttaaaaaattaaaaatttttggaaaatatggaaatattgacaaaaaaatgaaatatttaaaaataaagaatgcaacaaaaaagcttcaaaaagttaatgactttttttattttttggcgaaaaagtgtaaaaaaacgagaaatccattatacctaaatccgctccaacgctaatcaaaagccacttaaccatgatcaaattttgttttttctaaaattttgtatttttttgtaaaaaataaattccaatctataaatgacttaaaaattaatatgtaatgtccaatgaatgagaaaattcttgttgtattattaattggaaaatatttttctttttgaaatattttttttcattacttttaaattaattatttaaattgaagatccgtgtgcctatgcgctcagttttgtccgtgctttgtttgagttagccgcaaaagcgacggggcacctgaaaagcgcaaaatgggaaacattgagcaacaatttcacgaatcaaattgatgtggttgacggagttggacacagttttaatgtcaacatcaacaaaaatgtgcacttcaccagcccggcaaatg

SEQ ID NO: 74450 - DNA, 53 bp, Heterodera glycines
  Genomic contig location: Contig_ID=SeqID_11110; Location=1231..1283; Strand=+
  SCN-specific regions: Sequence locations=1-53
atggtgagcttggcatggcatagatcatctgatcagaatggcaattctcgaga

SEQ ID NO: 74451 - DNA, 1557 bp, Heterodera glycines
  Genomic contig location: Contig_ID=SeqID_11111; Location=1121..2677; Strand=-
  SCN-specific regions: Sequence locations=1-96,129-336,358-372,430 -619,641-777,800-1124,1166-1362,1399-1419,1461-1557
atgccctacacacagctgttcaacgtgctcggcttcccggccctggtgtgccctgtcggattgaatggggacggtgagggcaattcaacaaattgttaaaagaaatattttgggtaaaaaataataaatcgaatttttttcggaatcaaaaaacaccaactttatcgaatttgaaaggtttcgaacaattcggactataacactcaaatttgtttgaccatgctgataagtgtcgacatggaaattttaaaaaattttacatgctataagatcttttaaaaagtaagcgaattataaatttaaaaagaaatatttctataagattattgcaacatgcaaaatttcttggaaaaaggagatgttattatttcgaaaaataaaattatttttaattgttaacaaatcaattttttaatgtaaatttattttgagtttgctttttgcattaaaaatttgatttgatggagcctaattgttcaacagatgtgccattgtccgtccaattagtcgcgccgttccatgccgaagctttgctgatggctgccgcgcaggaaatggagagcgcatttggcggatggatcaaagcatgaaacgcagatgatatattaaacttttctaaatgaacattcatgattttttgttgtggttatcactgttatttacaccactctcacttttacacataatatgcaatttgactgatataattattttacttcattttttttttgaattttgaaaataaaattgctttctcatttttataattccgtggcctgctctaaccaactgagctacgggcgctcccttgggtgtcctcccatgtcctttatcccacactcccttccttctggcatcacatcggcaaatccagtaagatggacaaaaaagtattgtgttttaagagtgccctaacagattaagaacttccaggtccccttatcctggtcctttttttgagaagctcaagaacagaatcccgacaattcagtggttttaatcctttaaatcctattctggaatgattctcgagacctaattctggtctctcttgttgtggatgtcaagaactctattcatgatccaaaaagaatttgtttttttatataaatgaacgaattttgaatttaaaataaataaaatatttaatcaaaaaaaattaatagtcaatttcaatctattttattattcacaagatttcgttctgttactgaacggtgctcctaaatttacagaagcaatttggaccagaaatgtgtgccgacgctctcaaaaaaatttggcttttggaagtctcaaatccgagcacaaaaatgtcagtaagcggaaatcagcattccaatacatcgctgatttggacagttaaattatcaaaaatttgtaattttttttatttaagaagccatagaaacagggcttccaacccgactctgctgatttatcatcattttgatgcatttcaaggggtcaatgatgatttatttgtactgatgagttgctgatttttgctgcttaatttgagaaagtttgctgattttgctgaatgccgcaaataaa

SEQ ID NO: 74452 - DNA, 515 bp, Heterodera glycines
  Genomic contig location: Contig_ID=SeqID_11111; Location=1..515; Strand=+
  SCN-specific regions: Sequence locations=1-24,318-515
  Gene Ontology: Mol. function=DNA binding; Cellular component=nucleus; Biological process=axon guidance
tccctcctatctctccttcttccctctctctctctctttctctccttctcccttctctctccttctcccttctctctctctctctttcctctctctcgttccctcctatctctccttcttccctctctctctctctttctctccttctcccttctctctccttctcccttctctctctctctcttccctctctctctctctttctctccttctcccttctctctccttctcccctctctctctctctctttcctctctctcgttccctatctctccttcttccctctctctctttcctctcctgtctcactttctctatcacatgctcgctcactctctgattatctcacactgactgattcagtttctctccctttcattaaaatatttgcgatacgaaaaggccaaattcaagaccactaaatgtctcagaatttttgacaaagtaataaagactgccgattttttaaacacacccgaaagtgtggaccggtgccaaaacaaataattcgaga

SEQ ID NO: 74453 - DNA, 1491 bp, Heterodera glycines
  Genomic contig location: Contig_ID=SeqID_11112; Location=273..1763; Strand=-
  SCN-specific regions: Sequence locations=1-73,99-126,149-187,230 -254,400-718,744-831,854-986,1009-1252,1275-1459,1481-1491
atgggttcgtgcttttccggcgacaaaactgatcagtctgatagtaaacattatgtgaaaaaacgtggcactgatcagcagcaccagcaaaagcaggcactttctgcgtaagtctgagcagtttactattattttttatttttaaattcattcgtaattgcatcaatttatcataaattatggtcacaaaattaaaaaaaattattttttttaactaaataaattttttgaattttcatgttaaaagccaacagaaataaataaaatacaatgaaaattaaaaaaacattatttatttttgttttttcaacaaaagattttctttgctataaaataattaatttaaaaaatcgctattcaaaattttttttcaaaaatacacattttttaaataaaaatctgctttaattcaaatcgctattttgacgcaataaatgcaaagacctctgaaaaactttctcagctataaaaaaatgaaaaaaaaatcactgtccaaaagtttagggcagtttttctggaaaaaatgtgcatgcattcaatccacagtacaaatgccagtgaatcggcgccttttccttccagaatgtccagcttcaacagcagcaaaggtgtcgggcttggcatctcgatgatgatgtaccaggccggcatgttggccgggtgcgcggcgccctcatcaatgggcggaggcgatttgggcagtttgcgtgaccaaatcagaaaggcaaaagcagaggggaggacggtacaaaatttgaattttttaaacgtaccgtaattgtacagagtacagtaattattggttagcaaaagcggaggggaggacggtacaccaaattcaactacatatttatatcataatagtcaatcctgtagccagaaaaaaatttgggaggggggaacacgaagaccttttcttttttttgcttttcaggccaaaataatcagcgcctagaaaaaaaaagaagtttttcgccaaaaaaaaggacaaatttttgccattttgggtctaaattttaaaatcaaagaaaaatggagatccgccgggaaaacatttttatttttaattttaaggcattttgttaagaaaaattgttttgaaaattgccaattttttcttgaaaattttttatttagggtgggctggctacgggcctgttaatagtacatattagagtgccacgggaccggaaattttgggcaaacccgggaccgggaacttttcaggttgaaaacccgggaatttttggctgggaaacccgggaaaaaaccgggactagtcccggtcaaaaccgggaccttggtactcagttgtactcagttgtccgctaccaggtcccggtcccgtggcactctagtacatattgtagcacagtaattattggttattcaaaaatcattgcctactggaggtatatttccggaaattcaattaaaaaatgcatttgtaaatttgtcatcccaaattgaatttaacaaattttcaggtga

SEQ ID NO: 74454 - DNA, 387 bp, Heterodera glycines
  Genomic contig location: Contig_ID=SeqID_11113; Location=755..1141; Strand=-
  SCN-specific regions: Sequence locations=1-387
cggtagggtcaactccgtctggccaactccgtctcagcaatgttcaaaaagctataacttttttctttgttggccaaacttcacaatcatggtatcattcgaaagccctagatgtttagaagatatttataagctatttcgcagtgattaatcagctctcaaaaaagttgtcagttgaaaaccgcaaaaaaggcagaattttcgaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggagttggcccgttccg

SEQ ID NO: 74455 - DNA, 1619 bp, Heterodera glycines
  Genomic contig location: Contig_ID=SeqID_11114; Location=1059..2677; Strand=-
  SCN-specific regions: Sequence locations=1-496,539-1552
  Gene Ontology: Mol. function=structural constituent of bone; Cellular component=collagen type I; Biological process=epidermal differentiation
atgatcgcaaaactaaatataccccgtattaagccaggacaaccaggtaaagttgggcctgctggtgacaggggccgcttgctgaacggcgcggcgccaggacgggccggccaaatgggtccgtatgggccacgcggaacgcctgggccaccgggcaaggacggacaggtgtgtgaaactggcacaaatgccaacatcttttatgccaccaaaatttgcgttaatttagccgggcggtgatggtgcgcgaggaatgcgcgggccgaccggggaccgcggcgacgatggctctcagggcccgcagggccctgccggcatgcccggcttgctcggcgaacctggcgggtgcggacactgtcagaggggcagtactactgctggcggtgccattcaagccggtcagcagcgtaacaacgtggcaccagtgccggtgccacaatcttccgctacaaacaatgaaggccgtcctgtcaatgctgcagttcaaatgacaaatcagcaacaacaaccgcaacaagtacaacaacaacagaaacaagaattgcaagaaccacaaccattccgacaacatgctgaacagtcgtcgtctgctgccttagggtgtgaaacagaatgccaaaaaaaaaaaaaatttgtggcaccagaatttaaaaaaaaaatgaaattacatcaacaatgaatcagttttccgggggatttcccaaccaaaagcaactaaatttttaattcttgatatcgccctattctctattagcctaaaaaattgcaaaaaatttcgttaaatctgaacaataatgtggtcaaaagtacacagttaccaagttttcaaatttgatcataactttgttcaagcttaatgaaattatttgaaattttgcaggctgatggagaactgataaattttaaagttttcaaaattttcaattttagacagcaaggctcagatgtccaagcaacacaagtgtataaggcacaggcacatgcggcacctatttcatcaaatatgccaaaagcagcggcacaaattggccgaccagcaattccgttgccaatggcaccgcctggccaactgccgccgtccaccgtaatgccaacggtaactgttagtggcaaatttgtcgggaccggctacagtaacaacaacaacaatggcggtggttatggtgccgcggtgatggcagccaatcaaaatgaggaaatgatggaatatttggaggaagtgcaacaggcaagtttgacattgaatgacatcattttatatacgaattagtgccgtaattttccgagggcagatgaattcgcgcacctcggatttcacaaaaaaacatatataccgtatattctctaattatcccccatggggagttatttttcgatctcctcataaaagggggggggggggaggaattcaaaaaaaaatcactagttttttggtgcccataaaattgaaaagatgccaaaaaaaattataaattcattttgtatatgtatttaggattatggacaaaaggcaaatgaagcaacaaagggaaagaaatgaatggcatttggcatttaaaaaaaattaattgttgtttaaaaagatttttaatttgtttgaattaatttaatttaataaa

SEQ ID NO: 74456 - DNA, 471 bp, Heterodera glycines
  Genomic contig location: Contig_ID=SeqID_11115; Location=32..502; Strand=-
  SCN-specific regions: Sequence locations=1-6,28-403,457-471
atgtccatgatgctgtccaatgtccagcaatgtcaggtgagattgaaatgccaagaatttttatgccaaaacaaaaaatgccatttaaatttcgcttaaacatcattagaatttaaaatgatcattttgctcaagcatcaatctgccaaattatggcaccaattgatcacgcccgatgatgcgcaattgttgtccggcacaacggaaaggcaaaagcgtcgcaacggcatgccattcgaagaagaaagcagaagcacgggaggcttccgaggctcatgttgtgcatgcacacaatgtgtcattttgtagctgaccttggtcgaaattcgtagcttttttttattactttttataaaatctattatgcttccgaacgccatcaaaattttctcctcgagaaaactatttattcaaatttttttaattttcaatttaattcctatttttaaaaattatctacactatattaaa

SEQ ID NO: 74457 - DNA, 467 bp, Heterodera glycines
  Genomic contig location: Contig_ID=SeqID_11116; Location=145..611; Strand=+
  SCN-specific regions: Sequence locations=1-71,136-215,237-254,297 -407,429-443,465-467
atgccgtttacatttaaagatggcagtttttatattaaaaaagcatctgcgtggtaaaaagcataatgttcttaaataataaaaaattaaaatatttttataattaaaatattaatttatttaaaatttaattttctggagagtaaaaataaagatttagcaattgtttaatattatggtgagaatctttataattggttttctcatttaagcacttttaatttaatttttatgaactcctaattaatttgtccatttataaattatatgtatttactaaataagatattaatttacaggataacagagaatttttatggcttcctatattctattattgtttatacaacctttttggttaatcaaaactaacaatttatatgtttaaaattaaactcattgacttcagtaatactattaatgattacagcattatcaattgctatttagattaaatatattatata

SEQ ID NO: 74458 - DNA, 3522 bp, Heterodera glycines
  Genomic contig location: Contig_ID=SeqID_11116; Location=641..4162; Strand=-
  SCN-specific regions: Sequence locations=1-141,170-261,284-297,321 -445,467-889,913-1125,1164-1210,1245-1327,1350-1629,1652-1877,1902 -1930,1954-2106,2145-2228,2253-2353,2398-2408,2430-2687,2713 -2721,2747-2936,2989-3305,3340-3522
atgaaaacgtcaaccggtgtcgaactcctaacaagaaatactgttagtattgaagcactaaccactaaaccacaaatatattggaaattaacagcaaaatttactttatttcataaaaaatttgtcaaagatggttaaaaattcaaatttgtataaattttttgccttttatcccacgaatatgccattcttaggggtgtattttcacccccgtgcccccgcgggggcgaacgtcgcggggattgctaaggtcagagtcgcgggcgcggggacgggggagaggccaaaaaacctgctcccgcccccggcgggggcgggggtgacgggggcggcgtccgaaccctactatatattgtggaaaaatctgaaaatatatttataaaataggatataacccaaaaattttcccgtacattccgaaaaagcgtaatttcctatgatgataaatacattttgatgaaagaaaattattaacatttattttattcaatataacaaaaaggttaacataaacaaaatagattttcttagacacgaagttggaattaggtttatttttaggtccaaaaaaatatagaacaattcgcatgaatacattttatatttatgattgggcgacatataactagggaattgtttttaagcattaaaaaacattgtttaatcgcattgttaaaaaacaaaaaataaaaaacacacttacttcaaaataaaaaagccaaataaatcattaaaatgcaaaaaaaaaaaacaaaaaatacatccctaaggatcctaaggatcaactttttgagaattttcaaaaaatacaccccttagaatcgacccataatttttcaaaaacacacccctaataaatgaaaaattgctcaaaaattcattctccaaaataatttattttattttcttgacaaaatttagtttttccaaattatttagctcaatactgattttgcttaatttttttacttttttgaataaattttgtcattttacacccctaaatttttaagtttttagaaactattttcccatttttagcacctatggggttttttagaaactaaaaattaattcttttggcagtttttagcatcgataaattgcatctctatttatcactaatttttggatttatttctttaatttttaaatatttcttcatccttcttaattcgtcattatttgtctttggtgctgaaacaaacgtaattaatgaaaaataattaaaatggaatttacttttatgatgactggcattaaatcttttttccagtctttttttcatttgtatattttttcacaactttagcaaattgttaagtaatttcttgtcattttcttcatttggtccttttgctcaatttttagtttgtttatatccatttcttatgccccgaagatttcaaaatttatttaagttttgccgaattagctcaagcttagtcaaattaaataatgttggtattgagcaatagctctaggtgtcccgcaacatgaaactttcttccaatgccaaaaaaattatcaaataacattctatttttcaataaacgtatcaatttctgactttaattgcaaagggtaaagaataatttatgaaattgttgtggtttgtctaataattcgtataaaaattaatgaaacaaagttaattaaacgaacacatcaattctgacttttttttcttttacggggcggcgaatgttaaaatgttgtggaattatttgaaatttgtcaaaaattcagacaaattttagttgaaattaaatctgatcaaacaaattggtttacaataaagattcactcggttcattccttgacatataaaagggtgcaattatcaatggaaatgtcataagataattcgaaaaatcaaaataaatttaaaatttatattactcttaaatgctgcctttaatttcattgtgcataatttttacccaaatttcacaactcaatgccggcttatgcaaattcccaaccccgaaaatgggactagagtttcgtcgtgactttgccggggcttccacttccggcttttggggcaaacaccgggcaaaacgggaattcttttaatcattttccacccatttccagtaaaactataaaaaaagaattcaaatttaaatataaaaatataagaattcaacagaatttttagaataccgactatcagaacactttgtttgttagcggttccggccttttgaacggagcttgtgatgtgaaaaacgccaaactgaagaacttaatgattctgaccgatggtgtcaccattgaaaatgccattttcgacacgcccggttatggcatttactgcaagggcagttgcaccttaaagaacatttagtaaaaaattttaagtttaaatttaatcatttaattttaaaaaatgttgaagctacaaaaaactgtgttatcatgctgttggattagcatacacagacacaagcaaatcgtacacatacaaagtgattggtggcgctggccaaggcactgcagacaaagtaaacaattaactaatttatctcataatcccagagatccacataacgttctcgatataaactcatatacctctaacttcattaaatttaatatttacacgaatttttcatttttagtatttcacccaatcgggcaaaggcacaacaatcattcaaaatttctgtggcgaaggtatgattaaattaatttttatttaaaaatgcaaaatgcttttaataaatacaaatttattcatctttaataaccaaggcaaatacggcaaattgtggtgttcatgcggaaattgtccttttcaaccgaagcgtagcgtcgaagtttataacacggtcatgaagggccccggacaatcggttgtctgttagttaatttttgtaaaaaaataaagtttactaaattaacaaaaattgaacaatttttcatcaaagaataaaaataattttattaaaaaaatatgttagaaattaaaaaaaataaattgtattcaaatcagcataattaatcacaaggataataatcgaattttacaatttttaaataaaacaaccttttaaaaatttaaaagaaatttgtcaataaaatcagcataatttaagtcataaaaaatataaatgtttgaatcacgcagaaacatgtaaatatttcattcttttaaaacatatgtgaatttattttcagcggttaatttaaattacggtgacactgtgctcttttctggactgactttatacggccaaagctcgtcaagcaccgcaactaaatacgcttgccaagtaaattgtttgtttaattctgtcaaataaaattgaaataattttttaattattatttctttaagaatgttaacgcattgacttatgttgctcaattgtttgctgctagcagttttaagccgaccgaatcgggcactggttcttgcacatacaaagcttcgtccattaaaattgcgaattgatcgatgttcaacaaaagaacgaagtttcactgacaaactaaacaagaaatttaattaaa

SEQ ID NO: 74459 - DNA, 80 bp, Heterodera glycines
  Genomic contig location: Contig_ID=SeqID_11116; Location=5280..5359; Strand=+
  SCN-specific regions: Sequence locations=1-80
atggcgccgagaatccgaaatttcgttcaggaattcgtaattgagggcgagaatttttctaaatttgaatggactgccgg

SEQ ID NO: 74460 - DNA, 783 bp, Heterodera glycines
  Genomic contig location: Contig_ID=SeqID_11118; Location=168..950; Strand=-
  SCN-specific regions: Sequence locations=1-42,65-159,181-226,253 -344,429-581,614-644,675-783
atggccaccactgtcgcctcaatcggtctccaactgcttattcttggcacggttgtgcagctgtcgtacggtaattttggctttattatacaaacactggggaagcacattttctaatggtactcgagaatctcgttttcttgagcgacacgacaaaagttttgggtcttttggttttttgtaccgaattttgcgtgagaagtctcatgtatacggtatttggttcaaaaataaaaataattataaaattttggggtgaatgtttttgttttttcttcagctaagccagtttaatcaactgacaaacccaatgagctaaaaatgggtcctttcgaaattgactgatttatttgaaaataattttttttaaatattttttctatttttttgttgttgcttatttctgttgttgttgttgttgttgttgtagtaaaagcacagcagagctttttcaataaatgatgatgatacctaatcactaccagaatttggctgcatgcattccttacgggctgtcggtcacacgaaaggccaaccgttgccagcggagtacaaaccacttttggagttcgtgagtggtaataacatatcaattaaaaatgtaatgaattttatggtacagcaaatttcgatttttgaaaatgttttttttatttttacttttttttttttttgcttagaaactataaacatttccccatttgaattcagctgatatagtaaatgagagattgcgcggttgttttgacgggaatagttgtgtgacagcgagctgtgtcagag

SEQ ID NO: 74461 - DNA, 443 bp, Heterodera glycines
  Genomic contig location: Contig_ID=SeqID_11121; Location=1082..1524; Strand=-
  SCN-specific regions: Sequence locations=1-76,98-403,425-443
atggtggtgtaagtgttaatctatttagaagagttttttaactaaacaatttaagtgctttttaacagtattgaaaatattagaaaacacattgaaattgctgttgcgccagcaacaggagcacatgaaactgagaaatggatgaacaatttagacatagcatcagccagcaaattgtttcgaattaatataattgtttgcgaacgtttacaggaaaggattttccgttggcaactttattcaccagatttggaaacatcggttagaacgttttgattgtgtaaattcattttgaaactttagctttcgaacctgagtcaaaaagaatcaacagcatcaatctttttgtattttaatgatggacattttgaactgattaaacagccaatgaagataaattaaattttttgttaaattattgtgtgataacctttctaaataaa

SEQ ID NO: 74462 - DNA, 2142 bp, Heterodera glycines
  Genomic contig location: Contig_ID=SeqID_11122; Location=366..2507; Strand=-
  SCN-specific regions: Sequence locations=1-501,523-1480,1502 -1509,1532-2142
  Gene Ontology: Mol. function=receptor signaling protein activity; Cellular component=axon; Biological process=cell surface receptor linked signal transduction
ttggaatgggcccaattcccggccgaagctgaactgctcgaaattgaggcgaacggaaacgaaatgcgaagcattggcacggaggacgaggcgaggaggggccgaaaactgcgcaaactcgaggcatttgacattcttctgacaaaaaggggaggaccatctccaaatttcaaatttaagttgcgacgaaatcacttggccaatttggccatggattcgcttccgccgtccttggaggaattggacgtgcgcgagaatcggctaaccgaagtgacctttggtaccgcctacgaattggcagacacggcaatggcacagctgaaaaaagtgccgaatgatttggcatttaatgccaaaagacaaaattaaaacaattggtggaatttcttaggtcgacttacgctccaacaaattgagcacaattccgcgcgaactttacgaacgatttgttgtcgcaaatgcaccatttggcgaactttgggtcggaggttagagtcaattaaagcaaaaccaaatcagtcattaattaattccaaaacctaaattccgtttaagataatccgttggaatgttcttgcgagatgaattggctgctgaacgcctcggcctccgcagttggcacggccatttcgcgcaagcaaatcaatgccgcaaagggcggagtaatggacatagaaagtgccaaatgtgtggtgccattggatgggcagcggaaaaggatcattgagacaacggtggggggagggcgtaattaggaatttacatgctgattatcggggggtaattaggaattgatgctaattatgcgggtataaataggaaggatttgctaattgtcgtaattttccttttcaggcctttgattttctgtgcacctattcccttttctgtgccatcggctgtcagtgctgccaattcaacggatgcgactgcaaagtgcgttctcccaaatttcgcttaattgctagttgccttcttaattggccctaattaccccttttgtttagtcccgctgtccccccggctgtcactgtttccgcgatcggagttccgccacaaatgtcgtcaaatgttccggcgattccgtcggctccgattttagtcttcggttcacaatttgcctttgttattttttctttgtcattgtcattttcctcttttcagggctttgccaatgcatgcttctcatgttttcctctcgggactgaatcttcccgtgctgagcagcagcgaatttttcggccggaaaaggctgcgcgagttgcacctcaaccgatcggacattcggaggatagagccaagcgcattcgaatcgctggccaatttaatggtaagagaacgaagcgacgcctgatcggaactcaaccactgttcagtgggtaaatgaatcaatcaacggatcaatcgataacgagtcaattaatcgataagtgatcgctgatcagtgccggccaacaacaaaaaacagaaattggaaaatgacaaataaattagacataatgttgacccattaaattatattttaaatattccgcttccttttcagtccctccatttgtcgaacaaccgactgacgcatttcaatggcagcgaatgcacagaaacagaaaacattcgtttgttggacctcagcggaaacgcattgaccgaaatgggcacagaattgggcgaagtgctgcccaatttggagacacttcttttagcggacaacgcaatggaggaagtgccagaatacctccaggcaaacaacccatattaattaattattcgctaattactctttaattaattagttgctaattattctttaattatttatttgctaattacccttcagagtccctcctctgccaatttgcgtcgcgtttcgcttgcgggcaatccgttccgctgcgactgcgccagcgtcgaaccgtcggcggcggagcggcggaagcgccggccgatggacgcggcccattggctggagggcaacagagggcgcgtgacagacgcgccggggatgcgatgcgtggaaaatgtgacgcgggcgaaggaacgcaacgaaagcacagtgttggccaaagtgttcgcgttgcccaaccacgcggacgaccacctcttctcaatgccaatgctcgagtttctgcgcgaggagaacag

SEQ ID NO: 74463 - DNA, 847 bp, Heterodera glycines
  Genomic contig location: Contig_ID=SeqID_11123; Location=530..1376; Strand=+
  SCN-specific regions: Sequence locations=1-164,188-326,348-795,820-847
atgcgtcagtgccgtgccggtcaaagtgagccgttccaacgcgtgaagaccgtcaaagaaatgggcactcaaacggaggagagacggcatttgggagagatgaagcagccgaagacggggcgtggaaaggaaaagccgacgcggcggggagagaagccaacggaggagaatgggagaagaggagcaattctgaacaagcacaccgtaacacgggctatcacataacgcatcattccgaccaacagcataccgtaacccatcgtatcccttgcctttttgcccaatttttgtttacagtactctgtcgttttcccaatttattgcttgcacatttttagtttattgtactctgcatccccaattctctaccgtaatcctcaactcctgtagctcgtcgaacccgtcaaacggtgcttcgtcctccccgtccccgctttgctcccccgcgtcgtttggctttgtccccgtgcattgaatgctcagtgattttgtgccgccgcgcggaaattggccaaacgaacgcaattttggccaagcacagatgacaatgagcagttcatgcttcacatcgtcgggcatacagctgcaactgaaaacggaaagggaagtcaattgcattaattaatttttaagtgccaaatttggccaatgaattggcactttccgtcaaattttaattgcctttttctcggccaatgttcggggaatggcattcgtttggcacacattcatcaaaatgtctctctccctttcacatataaacaaaaatttgtttatcgttcgttgacaatggagaaaaatttaaaattaaaaaattttccgtctcataaaattaggcgaaccaaaa

SEQ ID NO: 74464 - DNA, 1791 bp, Heterodera glycines
  misc_feature (1761)..(1761): n is a, c, g, or t
  Genomic contig location: Contig_ID=SeqID_11124; Location=1..1791; Strand=-
  SCN-specific regions: Sequence locations=1-478,500-1246,1268-1791
atggaaggaggagggagattactcggcggaaaatttcagattagcattttcaagactttctgcacttatacggagactgaaggaatcgccacaactttttagcggttgtaacgacattatacaggaatatttagagaaaggaataattgaaaaggcccatcgcgctaaaagaccacaacatttcttgcccatcatacagtgatgggcaaaaagcttcgaatcgtttttgatgcttcatcccacgaaaagggtgcccaatcattaaacgaaatgttattttcggggccaaatctctatcctgatttagccggaaaactcattcagtttagggccacaaaatgccctatttgggccgacatagaaaaggcttttctgatggtaagtctgaaagaatcggaccgtgaattttcaaaatttttgtgggtaaaaaatatatttgcaccactttctggggaaaatcttctcgttttccgctttcggaggataacatttggaatagtgtcttgcccttttctattggcagcgaaactccaacatcatttggaagcatttcccagtgagttagcagaggaaatccgggaaaaatctctgctttacgttgataaccttctgcttttggctgattcgcctgaggaagcacgcagaaaggcagccgaagcacagaaattttcgccgcggctaaaatgcgtctgtgcgaattcattgtggctgatccgtcaagtttggacgaaatacctgaaaatgatcgcctccaaaatgaggcaccaacggttctcggagtaaaatggactatttgtgaggacaatttgtctttgacttttcctacagttcttagtccggatggtttaactcggagaacggtcctaaaaacagttgcgtcatttttcgaccccttggggttatgttcgccctgtttggttggggcgaaattgtttttccaaaaattatgggatggttcaaaaagctgggacgatccaatcccagtagaagagaccaaagaatgggatgaaattaaagccctctgggcagcaaaaatgatgcgcatagcgcgcttcacgcctcgaattaacactggcgaaattcaattgcatgttttcaccgatgcatcacctaatgcttttgcctgcacgatctatttgagagctgaaatgccgcagggaattctctcgtcgttggcttacgctcgttctcgtctccgcccgaagaaaatggcggtggaccaggcggatggtctaactatcccacgattagagttacttggaatcctaatcggatctcgggcagtaaaatttgtgcataaacatttaaattatgagatcggacaaattaatctttggtcagattcgcgcattgcgctttcgtggctagcatccaccgataaaatgccgattttcatagcaaatcgtgttcgagagattcgcgccaatcggcacataatcttccgctatgttcgatccgcggacaatcccgcggacctcgccacacggccagtgacacctgatgtgttaaaattatcagaattatggtggagagggccaaattggctcggcaaacacctgaaaattggccggacgaactcaccgtcagcctcccaccggaggaaagcgccatttcagagccaattgtctgcgctccgttgaccactccgccggcagtgttcgatattgaccggtttagttcatgacaaaaactgattagaacggctatgtacgcgttgaaatttctgtcagaaacgggaaaaaagagaaagggaagccccgnaatttagagggactgaaaatttagcccaga

SEQ ID NO: 74465 - DNA, 260 bp, Heterodera glycines
  Genomic contig location: Contig_ID=SeqID_11125; Location=1691..1950; Strand=-
  SCN-specific regions: Sequence locations=1-260
atggcaacttcaatggcaaccgcaatcgccgatcaaattcgactactatgtaagtgtaccaaaatagcagataaccatgggtggcagtttgcacttctcacaaaatcataatctaaatataacaaaaatacgattttcagggttatggctgcgcccgtttgacgctgtacaacaaaagcaaagggatgatgtggtaattgcgttctgaaatgagagaggccagaatagaagtgaacttctgattattgttgacaaataaa

SEQ ID NO: 74466 - DNA, 1273 bp, Heterodera glycines
  Genomic contig location: Contig_ID=SeqID_11126; Location=569..1841; Strand=+
  SCN-specific regions: Sequence locations=1-594,616-686,708-733,757 -879,901-987,1009-1067,1089-1273
atgccgaggctgccaaaatattcatcatctgtttgtcgtacattcagcgaacccaaagtttgcagcaacaaatgcaaccgcagcaaaggaacaaagcgagcaaatacgacgtggtcagtcaacggaacgaatgattcgcttcgtctttttcattttgtttgcctcgacagattggcaaaacgaatgagcagctcttccacctgctgaccatctgtttgagtctgcagccgcaacgcatcgacgagtccatccaatcgcaacttcaggataaatacggggaaagaatgctgcgtatggccaacggcgacatcgacgagttccgaaacgccttccagcagggatgtcccaagttcttgtcccccaccactgttgtctacgaagggagcagtgtggccaaagtccgacagacccaaacaacttgaaaatgccactttttctttaggagcctttgcttcgccaatgcaatgcgtttttggaaggcatcgaaagtcaaattagtctgccaattttacgtggctatcttaaactgtagatgaactaaaaactgcattgaattcatacactaatttcagctacacaactcttcccgtccaaaagttggccagtttcatggatattcccgactcggagttggactctttcatcggcaagctcctaacctacaaaatgattgtcaccgaattgggcaaggaaaccattgacaaaaccgaaggggtaagcaactacaaacagaaacaaatcccttcaaaggatttaatctgtctgacttaaggccgatgagaccaccgatttggatttctacgttgataaggtccatacggaatgtttttcttattttcatttttagaatattatatttaggacatgattctgatcgctgacactaaagtggctcgtcgcgtcagcgaatatttcatcaaacaaatcggaaaacttcgtgaggtgaatttggagggggaaagaatccttagagttctcctattctattttcgtttctttctcttttcagatttctcgaaaaatcaaatcatctgtcactcccgttggtcaaatacacaagaattgatgttttgtcactgtaattgttaattattttagacattcattcgttttcgcttggcatgatttgttcttacacattttctgttgtaaaatgttaattcaatcatatcatttggcaccattttatctgctagtacaatgacaatcactgtcaccataaaggtaaagccattgttcccttttctgattttgagggtccaaattagacaaa

SEQ ID NO: 74467 - DNA, 407 bp, Heterodera glycines
  misc_feature (403)..(403): n is a, c, g, or t
  Genomic contig location: Contig_ID=SeqID_11127; Location=549..955; Strand=+
  SCN-specific regions: Sequence locations=1-121,148-292,339-407
atgtcctcccaaaatggcactgattcttcccttttggacgatggtcaatggttggacgggcatttccccctgcaccacgcagtgtttgacaacgatgtgccaaggctgggacaattgctcaaagaggcagcagcagcagcaggtttggacattggaaaatgggaaatacgcttaaaactccgtttttattggccaatccttttcagctgaatcttcggtcatcgacagagaagacacccacgggaatacgtcagttttccatagataacatttaaaatttgtttgtccttcctttatatttttaaaaatttaatttttttgtatttttgtttattttagggccatgcacatcggctgtatgcttggccacagaggttcctctgacaatcatttggttgatttngtag

SEQ ID NO: 74468 - DNA, 385 bp, Heterodera glycines
  Genomic contig location: Contig_ID=SeqID_11128; Location=566..950; Strand=+
  SCN-specific regions: Sequence locations=1-48,71-385
atgagcaccaaacccatccattttgtgcaggcgaaaaattttctcaatttcccaaaatgggtgggcaaaacttaaattttatttcgcgctctttaaattttcattatttaattttttaggacaagatcgacaattataaagcatttctctatcacataaagggaatgcagctaattacaatgaaaaggtgcattcataattgtaaagtaatttaatccgttttgatttcagacgcgagcatttgtcccgtgaggatttggaaaggaacaaaaaaatgcaacttttcttttcgagcggtaaaatgccgaaaggagatgacaacactttggaggatataaatacggaaatccctgagcatgacccggtcaaattcagtgaaatataa

SEQ ID NO: 74469 - DNA, 361 bp, Heterodera glycines
  Genomic contig location: Contig_ID=SeqID_11128; Location=115..475; Strand=+
  SCN-specific regions: Sequence locations=1-29,53-361
ctcttctctcgcggattctcccctccgacactttcaaaatttacaaaaaagggcatcgccttcgctttgacttttcgcttgtcgattttaacaacaatggcccattgccaaaatggtatgtcggaaaaatgattacttttaccacttttttatatattttttgtttgttttctaagggaacgtggcgatgtgtctttgcttttggacattttgtcaaccgatggacgaaaggcggtgctaatggacaatcggaagagggtcagcagttggatagtgattttcagcataaccaaatgggactttgaatgattacaggtttaccaagtgttgcgggaaaagaaccaaaatctgagcgatgaat

SEQ ID NO: 74470 - DNA, 724 bp, Heterodera glycines
  Genomic contig location: Contig_ID=SeqID_11129; Location=426..1149; Strand=-
  SCN-specific regions: Sequence locations=1-50,339-345,375-724
  Gene Ontology: Cellular component=cell wall (sensu Fungi)
gtagtatatttcatagcggtacaacaacaatttgtcaacggttgcatgagaactgcaacgacaacaattagccgaactacgacaatagcatcaatatcaacaactacaatacccatacaaactacagcaactactactccaagtacagtaacattgactccgactacaacgtctacaacaactacgattccaactacaacaactacgactccaactacaacaactacgactccaactacaacaactaccactccaactacaacaacaacgaccccaacgacaaccagtacaacaacaacgactacaacaacaacaaccacaacaacaacaacaacaactcgtatgtttaaaatgataattttatatataatatagctccggagttatattttggatatcttccggatatttaaagcgatagaaatgcggattttaattgtagtgtgtacggcatgcactgccacattggtctttgaccgtcagcaaggcggaattgctgcaccaactcagcccgcgtgcccagtgaccgcttgcccgggcggcacaaacgcggaaccgttgccgcgcgggacgacaccgtttgatgttcagcaaaacgcacaatgcgcgaatccgtgcgtttgcgacgcggccaatgtgtgctatcagccgtccggggagcgcaacggggacattttggtccgactgaccactcagtgtccggatagctgtgccacgactgacg

SEQ ID NO: 74471 - DNA, 1218 bp, Heterodera glycines
  Genomic contig location: Contig_ID=SeqID_11130; Location=1619..2836; Strand=-
  SCN-specific regions: Sequence locations=1-19,89-89,259-264,287 -376,414-539,563-1218
  Gene Ontology: Cellular component=secretory vesicle
tacagcaatattggctccaactactacttctacaacgactacgactgcgactccaactacaacgactccaactacaataactacgactccaactacaacaactaccactccgactataacaactacgactccaactacaacaactacgactccaactacaacaactacgactccaactacaactacaactccaactactactagtacaacaacaacaaccactactaccactactacaacaaccacaacaacaacaacttgtacattaaaaattattattaatatagttccgggcttggaattcggggaatttgcatgttagttttgtttggacaactgaacaattgcttgagtagtgcgggtaacttggatttcctaatatttatatttagcaaaataatattaaattatttgtaaatgcgcaaattttctaaatgaccaagcgccggtgggtacttcatttctaaaaagtttaatgttgactagaactcaaattaacatttaaatattctcgaccattcctattaaaagagcgatatgaaaaaatgaaattaggattttaattgtagtgtgtacggcatgcactgccacattggtctttgaccgtcaccaaggcggaattgctgcaccaactcagcccgcgtgcccagtgaccgcttgccctggcggcactaacgcggaaccgttgccgcgcggagcggcagcgtttgatgttcagcaaaacgcacaatgcgcgagtccgtgcgtttgcgacacggctaatgtgtgctatcagccgtccggggtactcaacgggaacattttggtccgactgaccactcaatgtccggatgactgtgcaacgactgacggtaatttggcatgaggggcccacccatatagggaatagacctgtgtcttaaaccgagactctcgaattatatccttaattatatgaattaaggttgcacaatccaagcgctggtccgtggcacaagcccaaacacacggggctgtttggcacggcaaggcactaccgtatgcgcttaccaaattggttcaacattcaatgttaaatctgtgtcttgtaatggctgccccaatctggacacattgacttgcggtggcttgattccttaatgcgctaatttttttttgtcaatgacctatttattgttaattaccaaaaataattctttaatcttattcatggcacataaactttcacatgaaaataaa

SEQ ID NO: 74472 - DNA, 1171 bp, Heterodera glycines
  Genomic contig location: Contig_ID=SeqID_1562; Location=449..1619; Strand=-
  SCN-specific regions: Sequence locations=1-254,276-1171
  Gene Ontology: Biological process=growth
atgcgaaaaatgggtgatactgtgaaatgccaacagtttgttaacgtatttttagtgaaaggactgatctataacaaaatttgtggtcagttggctggaggattttaatctcgttgctgcggttattttctttggcaaaatatccggtgaaaatgtgcaatatttctgtgtttggttgaattgcgtggaccatccatcgattagtgtgtggattttgcagtgggtacttttgagagatcgccgcgctatattcacattggaatgggaaagaaatgctgcggttgactaacaacgcgccattgctggggggcgggtggcgagtgaacttaccgctcccccccctccctttcctctcgactttttcaaatgcttttgtttgcctaactgttttcctgctcctatttaatttgactttgttttgccgtatgcattgttaacagaagaagaaatgtgatggtatgtgagaagtgccccccccccctcatctccttcatcccctttatccattttgcattggaatgtttgtcagccgacgattagtgggaagattgatatcttttcactatttaggtcattgatgggcatttcgttaaaaaatgatacaaatcaaagaaataataaaaacaaaaaattgttttaggagcaagcagaacaaagcggcgatgtcgcgagggtgcgcgacttgcagcagcaagtcaacgaattggaagagaaggccaagaaaattgtgattggaaggaattcccgtgttaatacacaaatggttatttttgaggaacaccaaagaacgaagaacttaagtgccatcagtgccatcaaccagcggaatagggaccatatgaaacaaacattccttggtgccggaatggtgcgggaagagcaggagaaggacgacgacccattcacacggaagtcggcgcggatgaaagtggtctcgggatccgtgaagtccaaaaccgccggcgaaggaagtggcggtagtgttgggatatcccttttccttctttacaatacctttggctctagccaatgccgagttatccgttatggacacgatggtttcttcgttgggttcgttgtcgtcttcgtcggagtcctctccaaacaaaaaagtgcaacttccctcaactcacgatttattcaacgcacatggaatcgacataaatattga

SEQ ID NO: 74473 - DNA, 756 bp, Heterodera glycines
  Genomic contig location: Contig_ID=SeqID_1562; Location=1962..2717; Strand=+
  SCN-specific regions: Sequence locations=1-389,411-432,456-756
atgaacgccaaagtgaaatttattcccgagtcacgaaaggggcagctcaacacacaatatctggccactctcccaggacttctcaaaatcgtggaattggttgacgaaatggccctaaatgtattcttgtcccatttttcagattctgggcttcgtcgcgtttattcttgcaatttgtgccagacgctcaacaaactccgcctgggtagaacacatcacttttgagacgacaattgttgtctccgttttgatcattctctacgtggtttttccacatttgacttttgctgacgaacgcacgcgcgaaggactcattgtcgtggtacgctccgaatgtgttagtgttctaatagaacacaaatttggcaggaaatgttcttttatggaataaacacactcttctttttcattggggttggtcagctaaaacctattttattaacattttgtattcagatttggctaatggttcatttgagtgcgagttttacggctgaaggacgaggagcggccattttgggatcggttggttgagcaaaaacatttgagcaaattctgattttccagattttatgcttggcactctgtgttatttatgcgggagaagcctatataaaattcaaagtgtggacaaatcccgcgggaaaagtgcaacaatcaaaaagccaagcgcagggacacaaccaagtgccaccagcaccgacgcattacgaagagaaaacaatccgacgaaatgaaatggaggaaagggcagtc

SEQ ID NO: 74474 - DNA, 611 bp, Heterodera glycines
  Genomic contig location: Contig_ID=SeqID_1563; Location=212..822; Strand=-
  SCN-specific regions: Sequence locations=1-519,555-611
atgaagacaaataaaaggcaaaaagtttcttcatcagaagaagaattcgacccgaatcagaaggtgattcttttcaattaataataatcatatatttaaaccattaacaggatgaggattatgacctgctcatggatgacgaagagcgagaaaaattcgacaaaatgactgaaaaggagcgagaaattgaaatttacaagcgactcgagcagcgtgaaatcatgaagacgaggttgggaaagggggaataattccacacaagttttaagaaacaatttttaaaaatataaatcatcgccaatgcttttcagagagaaaataaaaaagaaactcgaaatggctgctgggaaaaaggcagacggagaagttgccgcaaggcaaaaaaagcgaaaacgaaaaatgtccgacgaatcaaacggagacgatgaaagcgacgagaaggactcggcatccgaagcagaggaaggttggtgcgccgaacgagcagatattgggcaatcatggagtttactggtcccgttttttttttctttaaaaataattgaaaaatttttctagggctattttactgtgctgagcacgaatccgaccttatttttgaccgattctga

SEQ ID NO: 74475 - DNA, 338 bp, Heterodera glycines
  Genomic contig location: Contig_ID=SeqID_1563; Location=1359..1696; Strand=-
  SCN-specific regions: Sequence locations=1-222,262-338
atgaaaaaatttctttttttgacaattataattctgttgctaccaaatactcatagttcgaacaaacagagacatcggaaacaaagggcagtttcggctttagctcgtttgacagtggctttatcacgtataggcacctacattaaagcccacccgtacattaccgcctcgacaattttgatggaaatgggctcagtttccctcaacatttatttgctaatacaagaaataaaaggttaaaaatctttattttttgaaaagatataattattttagcttgcgaagagaaacagatcttaaaggactttttcccatttgtgctcactctgaatttttag

SEQ ID NO: 74476 - DNA, 218 bp, Heterodera glycines
  Genomic contig location: Contig_ID=SeqID_11135; Location=102..319; Strand=-
  SCN-specific regions: Sequence locations=1-61,119-218
atgaatcaaattaaagtagatcaggaagaaagcaccaaactttgggattggccattgcaagtaaaataataattaaaatatttaaattaaacgcagaaaaataatttttaaaaatttagtcccatgacgaacttgtgtcaatctacgatggtcgtgacagatgggaagttggcttggacaccggatttttcacgcccaacgaaatcgaagcatgctaa

SEQ ID NO: 74477 - DNA, 886 bp, Heterodera glycines
  Genomic contig location: Contig_ID=SeqID_11135; Location=1411..2296; Strand=-
  SCN-specific regions: Sequence locations=1-234,257-293,344-549,571 -609,661-886
atgcaattcggaactggcgctgatccggtgcttgaagaatgcgcattttgtggtgaaaaagtgacattgactgatcgattgatggtcgaccgggagacaagtcataatttatcataattatttgaattaattaatcattaattactcaaaatttcaaagcaattaaatttggcatattttttaagtccacaaaaactgcttcaactgttgcttttgtggcgcaaaattgcagccaggagctgctgcaatggaactgtcattctacaaccgttatgggccacgatggtattggcaattaaaaaatatatttaaaattaattaaataaatttataaattattttaggtattgttcgggccatgccggaagttgtgcaatgactccggtggcacaaaaagatgcaaaactgaaggagaaagggctcaacgtcaagaagttcaagaaggccaaaaaatgatcggatggaatctgcaaaaactatgtgatcattcattgatcggcaaatcaatgtgatcattggtcaaactttttgatcagataaattgtcggcaaaattttaattggagtaaaaatggaagtatccgttctaaaaatgtccaacactattcagaaaaaaacttttaaaaaaatacaacttaaaaatttttaagataaatattttgccattaggtctgtgacattgcttgccactgaaaagtggggttgattagcttatcatcatttcccattctaccaagaaactacaatatttcgagaatttcgtttttttttttttttgaaattttagtcgatttttaaaaatttagactaaccataactctactaaaagtggtcaaaagcgcaacaaattttaaaaagaaaatatggggccaaggaaattaaataaa

SEQ ID NO: 74478 - DNA, 647 bp, Heterodera glycines
  Genomic contig location: Contig_ID=SeqID_11135; Location=2726..3372; Strand=-
  SCN-specific regions: Sequence locations=1-53,78-135,157-647
atggaactgtcgttctacaaccgttatggtccacgatggtatattttgagcgaaaattaattaaaaaatggattttattaatttttgacgaataatttcatcatcgactactaaatctacgattatttggtccttatttggaaaataatttaaaaaccgtattagaaaaggttttttttccattttagtcagcaaagttcaatgttgaatatttgtcttcgagtttttcataaaatttgttgaaattttaaatagaatacataaatttcatatttttcattttttaaaacttccattttgaaaaacacatttctaacaatcatatttatactgttcatctccaggtactgctcgggttcggcgggcggttgtgcgttgacgcccgtttctgaaaaagatgccaaacttaaggagaaagggatgaacacgaagaagttcaaaaaggcgaagaaatgagatacgtcacgtacatacaaacagcagtattcccagactgtaatatttaaaattggttacggtagtgatgatactatatttttcgaaatcggactttgcctagaatttagttggttctctttcatttatgaatatactttggctattgtaatttgatgataaattaaatccgagtttttataattaataaa

SEQ ID NO: 74479 - DNA, 173 bp, Heterodera glycines
  Genomic contig location: Contig_ID=SeqID_11136; Location=107..279; Strand=-
  SCN-specific regions: Sequence locations=1-173
atggcctctgtcaacggtcaaacggcacttttcgctgatcatggtcgccattttctccatcgttttggtggtgaacaccgctggacatctgctcgaattaccattggacatcgacgctggtatggtattataacaaatgcaaaaatacttggaccctatgagtttgagatacg

SEQ ID NO: 74480 - DNA, 1652 bp, Heterodera glycines
  Genomic contig location: Contig_ID=SeqID_11136; Location=3416..5067; Strand=-
  SCN-specific regions: Sequence locations=1-155,231-294,369-594,628 -852,1067-1201,1253-1263,1286-1344,1387-1420,1442-1652
  Gene Ontology: Mol. function=glucose transporter activity; Cellular component=integral to plasma membrane; Biological process=hexose transport
accgtggcttcgccgctgtctgttcattggcatcggtgtggcaatgtgcaatcagctggccggggtcaactccatcatgtactacggcaccaacattctaattgagcaaggactgatgacaaatgtggcactgactgccaacattgctaatggagtaaaattcataattcaaattaataaaaaattgttaattaaattattttttaaatttaatttaataagaatttaatcaatttcgttgtatttcgcaaaattgtacaccatatttttaaaacaagattgcaattttttctgaaaaataatcaaaaaatttagaaatttatttttatctttttttgaaaaatcaaaatgaatgatattttttaaatcttttcactcgttttttctatcatttcatcaaaaaaaatattgttagttttttcttttaaaaaaatcctctctaggcaatttcggtgttggcgactgggcttggcattatgttgattggaaaaattgggcgtcgtccaatgctgttatctggccaaattggcactgttttggcacatttggcgattggcacctgctcattgttaatggccaagggaatggcaaggcaaaattttatttatattttaaataataatttttctgtacgattttgttttccattcattaaaattgatgaacgaattgaaaaaaaaatttccatttcccagggcttttgtggtcctttctctcaccgtcactttcctcctgttccaacagtgcggcatttccccaatcacttggctgatgcaatccgaaatgtttccgttgcgcattcgcgggctcgccatgggcttgtccacctccatactttggctggtctgaaacttttatatcaataattttttaagtaattttaaaagaccttttaaaaatcaatatattgatgttacttatattaaatgattttaaaaaattcattaatttaaataaatataatgagttttttttcaaattttatgtttttaactaattttaaattaattccataatatttaaaaagcaaaaataatttttatgaaatttataactaaaattatttctcatgattcaaataaactcatttaaactgaggtttgtccgaacccgtagatcaggaagaaaattcacgacaaatttgtcggggatggctgagaaattaaaaaaatgtcggggagcaaccacctcataagggagcaaatttttataaaaagccaaaaatataacagaacttttctaaaagaaataagtcttcaaaactcatttaaagaaactttcatactctttgggcgtgcaactgacaacattcgaaattccccaaattaagtcggagaagaaccctaaaaaaaattttaaaaaaatttaattaattatttttattatctgatgatactgtgtcatagaatatttgtgttactttttgtcccaaggtcaactgtctgctcacgttcggctttcccattctgatcagttgggttggcatgaccgccaccttttacgcgtttgccgtgatcggatgctgcgcgatgcttttcgttttccattttatgccggagacgagacgcaaaacattggaggaattggaacggcaatttcaaacgaaggacatcaaagctttgaagaagcatgggccggtagagggtgctgat

SEQ ID NO: 74481 - DNA, 480 bp, Heterodera glycines
  Genomic contig location: Contig_ID=SeqID_11136; Location=1063..1542; Strand=-
  SCN-specific regions: Sequence locations=1-66,88-257,281-480
atggataacagcacaatagcaacagatcctcagaccgtactgaactcgcccgttctgcaattgcccgactatttgccctacttggagttgtgcctgaattggattgcgctgatttcgcacggcattaccgcattgaccatgggtttcctggttttggtgagccaattttacttaaaaccgattaagacataattgggtcgggtcaacattattccaacccttcagtttgttcacaacctgatcaaactccagatcagattaatatattcagatcaaaatcaataagcaagacaaactttgtctattcagggaatttgtgacaaatattatgtactatttcagtctcaaacattataaatccgatcaaattatcgaacgccaaagatatgattcgaaaaaatccgacgagttgtgatcaagtcttttttatcaggcacaaaatcatagactcgattaatggtttaatataaaaatattaaa

SEQ ID NO: 74482 - DNA, 1006 bp, Heterodera glycines
  Genomic contig location: Contig_ID=SeqID_11136; Location=2211..3216; Strand=+
  SCN-specific regions: Sequence locations=1-66,210-217,239-250,332 -347,370-864,920-925,947-948,995-1006
atgtcattcaattttaaatctgctgaagttcatgaaagtttgtaaaatgggaaaaaggcattcatgtaattttttttaaattatacttttttaaaagatttaatttaatataattcttttgttttaatattaaaaaatgatttttttttataaaaatggagaattatgtacaaaaaaaaattttaaataataatcaaaaatgaaaaattgctgattaaagtaagaatatttatgttttattctatgtatgaatataaaaaaataataataacatctactgaacaaacaatagcaataaaagaaattttaattaaattaaaattatttttttccactaattaatgaactaaaaaatttttggcttttgtccgtgccaataaaataatatattttttcctgattgtgcttacatcgtctatcatggttaaaaaattcagaaaaaaattataaaaccctcgatagaatttttgcaagatcaaaaaagaggcaacgattgaatttattaaaccttttttgtaaattcatttatttccattttgtaatttttctcgattttctaaaaatgctcatttgtcatcgattattttgtcaatcatttttggattttgtcgttttgtttttcaattcacttttttcaatttttctgttttaatcattttttacggcttaaatcaattgtttcttccatttcgaaattttattttttgatttgatgagaaaaaataaagggatttttgttttttaggattaattccaaaaacaaaatcagatatagccaatatgaaattctacactgatccatatattttcaaacgtgtccttatttttatttcatgtttgtcctgggaataggaattttagagcattttttaaaattattgtttttgttgtaaattaatgtatatatatttttaaatttgtcctgttttggagaaaattatcaaaggcatttattatataaaagatttatttaaatatgataatattaaattaagttatgctttta

SEQ ID NO: 74483 - DNA, 918 bp, Heterodera glycines
  Genomic contig location: Contig_ID=SeqID_11136; Location=4235..5152; Strand=+
  SCN-specific regions: Sequence locations=1-206,240-465,540-603,679-918
atggaggtggacaagcccatggcgagcccgcgaatgcgcaacggaaacatttcggattgcatcagccaagtgattggggaaatgccgcactgttggaacaggaggaaagtgacggtgagagaaaggaccacaaaagccctgggaaatggaaatttttttttcaattcgttcatcaattttaatgaatggaaaacaaaatcgtacagaaaaattattatttaaaatataaataaaattttgccttgccattcccttggccattaacaatgagcaggtgccaatcgccaaatgtgccaaaacagtgccaatttggccagataacagcattggacgacgcccaatttttccaatcaacataatgccaagcccagtcgccaacaccgaaattgcctagagaggatttttttaaaagaaaaaactaacaatattttttttgatgaaatgatagaaaaaacgagtgaaaagatttaaaaaatatcattcattttgatttttcaaaaaaagataaaaataaatttctaaattttttgattatttttcagaaaaaattgcaatcttgttttaaaaatatggtgtacaattttgcgaaatacaacgaaattgattaaattcttattaaattaaatttaaaaaataatttaattaacaattttttattaatttgaattatgaattttactccattagcaatgttggcagtcagtgccacatttgtcatcagtccttgctcaattagaatgttggtgccgtagtacatgatggagttgaccccggccagctgattgcacattgccacaccgatgccaatgaacagacagcggcgaagccacggttcacgcatcacatcccttcattgataggggtaattatgattaattccaacaaaattagtaagaatatttttattatggtagtata

SEQ ID NO: 74484 - DNA, 2253 bp, Heterodera glycines
  Genomic contig location: Contig_ID=SeqID_11137; Location=1059..3311; Strand=+
  SCN-specific regions: Sequence locations=1-213,250-806,828-998,1021 -1369,1391-1480,1513-2181,2203-2253
atgaacaaggaagaatggaataatgaatggaaagttcaaaaaatctttcgtgaaaaacacgactaccttaaaaccattaaagaaatagatgaaattctcgatacattaaaagacgtaaatttggaggtaaaaaggagattaaaattacttaaagcaaaatcatcttcagactcagacctggaagatgaatcaaatgattatgaacatgaaaatgaagacgaagtagaagaacaagaagaagaaaaagaatatgaaagtgacaatgaagacgaatcgccagaactctccttgaatgaccaaatacaccatgatcgtacaccatttgtcaattaccgatcaagaataaagcttccaccccaaacgcttacgcattttaatggcaaattctcccaatggcccagtttctgggatgatttcaaatcctcagtggacaatgacccaaatttagaaaatatacaaaaactcaaataccttcgagggctcttacatgatgaaccgtacagaatagtgtcaccgtatcctcttacgaataaaaattacactatcgtaataaaattactaaaatcaaggtacggaaacccccaattaatcagagaaaatcttcatagcgaattacgcaacctcaaaagacccactgaatccacaattgaattaagacgatttattttgttaattgaccgaatcattttacaaatgaaatcccaaggggaagacataaatcaccctcaaatcaaacaatcaatcgaaacgaaactcccctataacattagacttaaattgaaggaaaaattcaaaatctattcaacaaaagaaataatggaatttttgaatgatcatacccaagcacgtgaagacatagaaagaatggaagaatcgaatcgccaaatccggaatttcccctctaatagaccaccccaaaacggagtacagagacaattctatccaaatttcccacacaatcaaatgaaaccaaacccacggaatcaacagaacacatcttcctctccttttccatatacttctgcatttacaacgaaatcaaacccagtacgcctggcacagtttaaatcaaatccaacacaaactagaacacaaaataaaatattttgtcgcttttgcgaaagagaaaaccatgcaagtaaagaatgcaaaatttattcaactcccgaaaaacgaaatgaacgtgtacgtgaactcaaactttgcctaaattgtctaaacaagggacatatggtcaatgattgcaaatccacttatttatgttttaattgcaaatacaaacataatactctcctttgtacccgcaaacaaactcagtacaaaccgaaagagcaaaaaaccagagtgaatatggctaaaaattacgaaaatcatgaagagacacaaacattcatgacaatggattatgataaaaatttatctaattatgaggaagaagaattacttatgactgctgaagtaaactgcataaatcccgacaaacataaagtaaaaaaggaaataattttatttgataatgggtcacaaaagagctatataaccgaagaatgtgcccaatctcttcaattaactacgattgaggaaaaattattagtaatttccactttcaatcaaaataagccaaaaatcattaaatcgagactagtcaaagttggcattaaaacattaaaaggtgaagtggagtacataatactacaaacagtggaaaaaattactgatgttacaaaaatggttaataaagaaaatgttgatgtactcggagtaaaaatcccaatcagtcacgcatctcctcaaattctaattggaatcgaccattattggcatttcatgttaccaaattcacaaattcaattacttccatcaggattttactcgataaatacaaaattaggaaaaatattatcaggaaaaggaactattgaggacacaaattgtaactcagtgaccgaaaaaagaaaaaaggatgaaacaaaccaaatacttcagaaattttgggaattagaaaacattggaattatcgactcaccacatatgacggatgaagatgcagcaatgatacactttgataaaaatgttacatttaaaaataatagataccatgttcgatggccttataaaagagagaacccgaatttactaacaaattttggattatgcatgggaagactaagaaatgttgttaaacaactaattaaaaacaaacaattggacaaaaaagacagaatatgcaagaacaaatggatactgatgtaa

SEQ ID NO: 74485 - DNA, 601 bp, Heterodera glycines
  Genomic contig location: Contig_ID=SeqID_11138; Location=32..632; Strand=-
  SCN-specific regions: Sequence locations=1-384,420-539,561-601
atggacacattggacggatgggcaaaagacgcggccaaattgggacttggccaagccgaactcggagcatttaacgcacttagggaagtgctgagcagcagcgactccaagcaaattttgggaatggcggcgaacgaacgcggaatagacggggcggacgaagcggcgcggagacggctgagcacgatcaaaggcggagtggacagcccacgggtgcggacattgaccgaactgcccaaaatcacattgagggccaaaaagagtgagttgccaggagagggcattctgatctgtgatcggacaactcaaacgagcagaattatggtcggagggatatgacaaagagacgagcagtgcggaggaggaccaggacaacgcgaagcgaagggtgaaaacggttttggccaaattggaggagggcgaagagagcgaactgttcgagaagatcacgccgacagactacaaacggttggcgcggctggacgacaccttcaccaccgaacgattcgaggatattttgacggatttgaacgggaaaagcgtcgtcgaattgcccggggggcttagcttggctttgaaagatgctgctggatgtgagtga

SEQ ID NO: 74486 - DNA, 350 bp, Heterodera glycines
  Genomic contig location: Contig_ID=SeqID_11139; Location=15..364; Strand=+
  SCN-specific regions: Sequence locations=1-350
atgcgctttttagaatgtgcagcacatgttcaaccatatgaacaaggcgaaggcgcaattattcgtcgccgaagggatcgtcgacgtcgtcgcggaaacggtcagcggcgattcaaatatgctttttggatacttataacaattaagtccgaatatgttgccaactcggtcattttgttgtgccaacgccacggactcttttcggatgtgactttgccaacaattaatcaacggagagacgtggaaagtgccacatcgccataggataaacgttgtgctgaagaaagcgaaaaagccatcgtgggtcggattatccagtctctgatttgatttttaaagcttacaatcga

SEQ ID NO: 74487 - DNA, 529 bp, Heterodera glycines
  Genomic contig location: Contig_ID=SeqID_11140; Location=714..1242; Strand=-
  SCN-specific regions: Sequence locations=1-165,187-253,276-427,449-529
atgagcccacagctgcaaaaagcgtcgattgtacggcatattgagagggaccacccggggaggagcagcgaagagttcgactacaattacccggcattttcaaggaaaatccatcacaaattggccgaatgtttcccgatgcgaaatgccgaagtggtaaatgaatgggaatttagtggaatggaacaaattgtcatttttcagagccaacaattttgatttctgttgaaccaaaagctaaggaggatgaaacaaacataaaattgatgatgatattgataatgtgacagatgattcttcatttcttatccaactattctaattccattttttcctttcgtggcaatggttttaatcaacataagggggggggggggggcttacctggcaaatctccgaaattttgtaagaaattttcgtatttaccccccacaccccttggatttaaaaccacgaatcacaacctttaatatacacttaattcacaatctcatgtataaagaaatcctttgatttatctaataataaa

SEQ ID NO: 74488 - DNA, 1412 bp, Heterodera glycines
  Genomic contig location: Contig_ID=SeqID_11141; Location=395..1806; Strand=+
  SCN-specific regions: Sequence locations=1-52,81-268,299-562,648 -707,745-1068,1225-1412
atgaataaaagattaaaattgtaagcacgtaaatcgaccattttataaaggcttttattatttttttaaaatttttttttgatgagtttaagccgatttttattttcttgcagtttcatctttacgagcccgtccacaggcacttgccgtgtccggcacgaaatgaccaatttgtggccaaagcggaactgttggccagaatacgaaggtacatatattctttgttttttttattccggagagatttcgaaaagaatttggaatttggaattttaattttttttttttttttaattttcagcgcggacgaattggcacaaaatcgaatggcacgggcggcgtacgacacgctgtgcagcttctacaaactggcggagagcaagatcaaccaggcctatgttgaggaggtgggtcgaccgagagccgggttaccctaaagcgcagatgccggtccgggccgtagtttgaaaaaacataccctccacccctcggatttttttttgagcgattgaaaaaaatttttgacaaaaacttagtattcctcataaacatgaaaaaatcgttaattttttaaatttcttatataaactactaaagatttttgtttaaaaaataaaagttataaaatttaaaaaaaaaaaatttttccgaggtgaaatgatgcggaaggaggtgggagaactatttttctactggaaaaaactaagaaaatttaaaattgaaattcaattttttttttaaattccggaggtgtggggaaatacggcaaatctttgttcatgaaatatttctttgtatttgtatcggcacagattgtcgacgagcgcaagtggcgcttggaattgcgctggaacggcttcatcaacgtgtacgaggggccgcgcacggcgcgcgagttggagctgaagcttgtggccaggcaaaagacggagaggggcccattcgacgaggtcaaaggggccgacccgttgagcagaggtaacggcagaaagtgcaaatttaaaattcggaaatcctttttctctcgtcgcacacactatctttttcttactctcttaatctcaactcctctctctgtctccttcacttactctctctctctctctatttctctttgtctccgctcctctcgcttactctctcactcactttctctgtctctctctccatctctaacactctctctctctttctctctcgcactctctctccccttctctctctaccgcacgctttatttccgctcccctctctctctctcgctccctctctttttactcttcgtccattttgtcctaatcgtctctaatattttatccgttttttcagcggatcggtcccgtttggatgaacttgcctctttgttgcgtacggaagtgaacaaatcggtgagttccgctgccgaccgatca

SEQ ID NO: 74489 - DNA, 533 bp, Heterodera glycines
  Genomic contig location: Contig_ID=SeqID_11142; Location=218..750; Strand=-
  SCN-specific regions: Sequence locations=1-255,280-282,334-357,379-533
  Gene Ontology: Mol. function=chromatin binding; Cellular component =polytene chromosome; Biological process=chromatin silencing at HML and HMR (sensu Saccharomyces)
atggctggtggcaaaggaaaagcgggcaaggacagcggaaaagcaaagtctaaggttgtgatgggtaaaaattttaaagcgcgccaaaaaaacttttcaaaaatgttcgcataattttttttttttttttgcagaaaatcatctctcgcagtgccagggctggcctccaattcccggtgggacgcatccatcgcttcttgaagaaacgcacaacaagcaccggacgagtcggtaatgtttggcgaattttcggtgaaaaaaaattttaaaaaaaaaataggcgccaccgccgccgtgtacagcgcagccattctggagtatctgacggccgaggtgttggagctggccggcaacgcgtccaaggacctcaaagtgaagcgggtgacaccgcggcacctgcacttggccatccgtggcgacgaggaggtgagcgagagggtgcgccatcccggcattggggccggaaaaaattcctgaatcgccttggcacttttgctgttgggggcccacgaaaaaatgccaaaggggggacc

SEQ ID NO: 74490 - DNA, 753 bp, Heterodera glycines
  Genomic contig location: Contig_ID=SeqID_11143; Location=832..1584; Strand=-
  SCN-specific regions: Sequence locations=1-28,50-524,546-679,701-717
atgtcacgtgttttggcaattacggaattttctgaatcacacacagggaaaaatattgcgctcaaaattgaggatttattgctcaaatggggtattcctaaggaacgtgtgcatgcaattatctcggattcagcagccaatatgaaaagagtgataatctaattaattttctttacacttgctcttatttgcaggcatttgttgagagggatgaaaatgaaaatcgaattttgccgatgccaaacgggccttgcgctgctcatttattgaatttggctgtacaggaggcattgaaaaaggatgaatcaatcagcagtttattggccaaaagtcgtcatattgttggacgtttcaaacatagtaacacagccttcagcgaattgaaaaaaattcaaaaattactcgatgccccctctcacaccttttgcaggttaaagttaattacaatacacttaattttatttatttctaatgtcattcagatggtatgtgtccggtggaatagtgtgcttacaattaattaaattcctcaagaggagaggtcatatatccccaagcgaagcggaaaccatgattgaagaaatgaaaaatattcaaagacaaccaccaatattttttcaatcaaagtagtgtaacttacttttttttatgcattatttttttcttataagaatttggtataattttaattgttattggaaactttttgttaaagacaaatttttaattatttaactgtttaaaaataataaa

SEQ ID NO: 74491 - DNA, 1591 bp, Heterodera glycines
  Genomic contig location: Contig_ID=SeqID_11143; Location=1720..3310; Strand=-
  SCN-specific regions: Sequence locations=1-61,83-140,162-294,316 -332,387-495,541-761,808-1000,1022-1069,1093-1306,1333-1372,1401-1591
atgaataacacgacgaaagaaggaattgaggtgttacgttcatcagatgagactaatgacactctttttcatcttttgctcctttcacattatgcatttgccttccctgtttttctactctgttggttcataataattaaattcctcaagaggagaggtcatatatccccaagcgaagcggaaaccatgattgaagaaatgaaaaatattcaaagacaaccaccaatattttttcaatcaaagtagtgtaacttactttttttatgcattatttttttcttataagaatttggtataattttaattgttattggaaactttttgttaaagacaaatttttaattatttaactgtttaaaaataataaattattgtttataataaaacttaattcctgttattaaaaaaaaagtttagtctctcgccgccacacgtccgcctccgcagcgcttgtggtgaagcaaagggaaaatttttcaccatttagtcaacaattatcccattcctttcaactcaccctgtggccaagtggttaagttcctcgcttccactctcaacggttcgagtccactaccatgtttttgatttttcacaatttttcggaattttcatcataaagtcaacaattatcccatacctttcaactgcccctgtggccaagtggttaagctcctcgcttccactctcaacggttcgagaccgcgaccatgtttttgattttccacaatttatcagaaaaagtccgcgcagctctcgcgcatttaaattaattaatttaaatttaaattaatttaaattaattaaattctcgcgcacaagtccatccaataggtttcggctgaagggatcaaagatcatccaataggtatggggcgggggggggggtccgaaaatatggataaaattgaaaaaaatcgataatcaaagtactcgtacattgtagtttcaagttgaattttttaattctaatgtttgcttctttataattattaaataatgtcttttttgtttagattttatgcaaatgagtcttatttggcaaattggcctatttaaaaaaacgtccaagactacagcaatttgtctcgagtgccaatcaaatgaaaagccgaaatatgaattcaagctcaccaaaggaacggtcaaaagcttgcacacccatcttcactgctttcacgaaaactccgaattctctgaaaagctgaatgctcttgaatcgaaagctgaaaaggagaaacaaaaacagaagccaatctcagactttcagtcgtcctgcggaccgactttttcggactgtaattcagccaaatttttttaaattatttaatttttgtttcagcacaactctcctcgtttgataagaaaattcttcattttttggtgacaaaaaacatttccttcggcgctgtggatcaccaaacttttcattctttatttccccatcaaaaagtgaaaagtgaaagtttctataggtgatgagttacattaaaagttatgagaaaattacatttttgaaattttcagaaaaactgccttgccaattgtttaccaacgtgtcagacataaaatcaaagatgaattaaaagaataa

SEQ ID NO: 74492 - DNA, 533 bp, Heterodera glycines
  Genomic contig location: Contig_ID=SeqID_11146; Location=4..536; Strand=+
  SCN-specific regions: Sequence locations=1-41,243-251,326-327,525-533
  Gene Ontology: Mol. function=pre-mRNA splicing factor activity; Cellular component=nucleus; Biological process=mRNA splicing
gaaaagccgaaagggaaggaaaagcgaaggaaaagccaaaggaaaagaaaaggaaaagaaaagcgaagaaaagccaaagtaaaagaaaaggaaaagccaaaagggaaggaaaagcgaaggaaaagccaaaggaaaagaaaaggaaaagaaaagcgaagaaaagccaaagtaaaagaaaaggaaaagccaaaggggaaggaaaagccgaaggaaaagccaaaggaaaagaaaagcgaagaaaagccaaagtaaaagaaaaggaaaagccaaaagggaaggaaaagcgaaggaaaagcggaaggaaaagccgaaagggaaggaaaagcgaaggaaaaggcaaaggaaaagaaaaggaaaagccaaaagggaaggaaaagcggaaggaaaagccaaaggaaaagaaaaggaaaagaaaagcgaagaaaagccaaagtaaaagaaaaggaaaagccaaaagggaaggaaaagccaaaagggaaggaaaagcgaaggaaaagccaaaggaaaagaaaagcgaagaaaagccaaagtaa

SEQ ID NO: 74493 - DNA, 686 bp, Heterodera glycines
  Genomic contig location: Contig_ID=SeqID_11147; Location=1944..2629; Strand=-
  SCN-specific regions: Sequence locations=1-189,218-505,528-652,674-686
atgcatttggaagtccgatactgcgcgataggccaaatcttcatgaatgggcgatgcaagcacccgcaaagtcgctacaaaagacagggagtggccggatcaggtcattaaggaacgaggcaattagggggcaagacaattagcggaatgggggattaaaggcgaaaaacatcggaggtcattaattaacgttagcatttaatgaaactcttacataaaaactaattaaggtcgtgtcggtgatttctgttcttttaacaccgattgtcttacggtactctgttactgtaattgctttttcaactcaattgctcagggcatgttctgttctgtcggcacctgcatttgtctgtccaattttgtggccattcagggatactgttacctgagtataacccatttctgaggataattcttcggtttaattgaaatttcagaaaaaaacccgggcgaatcaggctgccaatatgctggttaatttcgacccatttttggtttgttgggtgaatttgtctttctttctcatttcagaacaatgtgccgcggtttggccggaaagtcgctgtgagaagagccgttgtgagtgtccagaggatgtgaatggcattccgtacgttcagtccaagacacgggacggcgtcgtgtgcattttgcactcgggagaagacggggacccggtaagataa

SEQ ID NO: 74494 - DNA, 1856 bp, Heterodera glycines
  misc_feature (1718)..(1719): n is a, c, g, or t
  misc_feature (1813)..(1813): n is a, c, g, or t
  Genomic contig location: Contig_ID=SeqID_11148; Location=1..1856; Strand=-
  SCN-specific regions: Sequence locations=1-32,54-74,96-210,232 -346,368-435,457-618,640-707,729-1008,1030-1212,1250-1856
  Gene Ontology: Mol. function=single-stranded RNA binding; Cellular component=transcription factor TFIID complex
ggggaatggcacgggagcagaggagggttaaatgggggacaaggggaatggcacgggagcagaggagggttaaatgggggacaaggggaatggcacgggagcagaggagggttaaatgggggacaaccaatggggaatggcacgggagcagaggagggttaaatgggggacaaccaatggggaatggcacgggagcagaggagggttaaatgggggacaaggggaatggcacgggagcagaggagggttaaatgggggacaaccaatggggaatggcacgggagcagaggagggttaaatgggggacaaccaatggggaatggcacgggaacagaggagggttaaatgggggacaaggggaatggcacgggagcagaggagggttaaatgggggacaaccaatggggaatggcacgggaacagaggagggttaaatgggggacaaggggaatggcacgggagcagaggagggttaaatgggggacaaccaatggggaatggcacgggaacagaggagggttaaatgggggacaaccaatggggaatggcacgggaacagaggagggttaaatgggggacaaccaatggggaatggcacgggagcagaggagggttaaatgggggacaaggggaatggcacgggagcagaggagggttaaatgggggacaaccaatggggaatggcacgggaacagaggagggttaaatgggggacaaggggaatggcacgggagcagaggagggttaaatgggggacaaccaatggggaatggcacgggaacagaggagggttaaatgggggacaaccaatggggaatggcacgggaacagaggagggttaaatgggggacaaccaatggggaatggcacgggagcagaggagggttaaatgggggacaaccaatgggagaacgggggaaagggtcaaatgccaacattattatgactggcgttgccaacaacttttacttcctatttcattaaggttacgtcaatttggcgatttctgctccgtctctgaagactgtccacccgccttcgaatgcattgacaataaatgcgaatgcgaaagagagaagaagccaattggggagcaaaagcaatgcgaattggcgggggaaagacacaaagagggaaaacgacgaggagcggaaaagcaaaaacagaaagccggggaaaaactgcggaggagggcgatcggagagacatgccgcaacaacggacagtgccaatggaacggggcaaaatgtgtgcggagaaagtgccaatgcattggcggaagggcggcattcagaaaccgatgccgaagtgagcaatcaaagcataatttagtctatttatttggctcttggttattatttgctgattccactttccgcaataggaaatgtctgtgatcgcttccattcgccccaatttggcccttttggcaccgtcgtcccatgtgccgttcccgtctcgcgttccaatcgctgtctgtggccccaccgctgcgttttctcgcctttgcttcatttttacatttgttgccgtttggcggacgttcgagtcggctcttcggcggtcataggaacaattgtaataaaatcgccgacagaacggcgaacggagaccaaagcgaatgcgcaacaacattttgttgggtcgaggaaaagtgagtatccattgccaagggccttaccaaatcccccccaccgggggacaggcgggggaaaggnncgggggctaatctaatccccctcccctctccctacgccctttccgttgcgacgactggtcgcgggtttttctgccattgtcagcctattagcangtgctttgtccgctccccgtctcacttttccattgaatcctcc

SEQ ID NO: 74495 - DNA, 757 bp, Heterodera glycines
  Genomic contig location: Contig_ID=SeqID_1565; Location=1679..2435; Strand=+
  SCN-specific regions: Sequence locations=1-757
atgacccactttcagcatttgcaacagcaagtccatctgttgacacaaaaattagaagacgaagagaaacgagcaaacattttggccaaaacttatggagacacccagaagaaattagcccgttcggaagttagacttcgccacgttcagcggactgttcaggaattggaagcggtccaaatgcaatttcgaattgccgtcccttcctttttgtaatgatagattttcaggataattttgagcttaacaacgaattggaaagatggcgcaacatgaagcagtcgtcggtgacattggacgatggccttgaagtgtgggataatgacgaagagaacaagacggaggacgaagaagaaatgagagagttggaggagcagggcaaaggcaagacggagcaggaggacgaacacatggaattgcttcaacgtgaaattgacaaccttttggtagcaattggaaatgcatctctattttcgcaaattcaaatgaaccatttcctcaagacggactcgggcactttctcttcgcgcagttgcgataccaacggtgtcaactactgcgatcaaaacaacggcaccactgtcgaggaaagtggatcggcgataggccctttcgacatctttggcggcttttctccttttatcaaagcgtcactgtcgcgcagccaaagcgaatcgaagccgacgaattcttttggcagtctcgctattaaacctccgactttggcaaacactcattgtcagttcaactacaacaa

SEQ ID NO: 74496 - DNA, 702 bp, Heterodera glycines
  Genomic contig location: Contig_ID=SeqID_1566; Location=324..1025; Strand=+
  SCN-specific regions: Sequence locations=1-175,197-319,341-391,424-702
gcaacttcgcatgataatgccacaaccttcggtggtgtccaaaaagaattcaccgacttcacagaatgatgtaaaacttaacatttaagcagtgtgtttggcaacccaaaatttgatttgcttgcagaaacgaatggataaattggaaaatggtgagacgaacacatcatcattgtgtggggatgaagaggagaaacctgcaaagaattaccttcacaagacccaaatttgtcttttttggaaggcatatgtaagtggaaaaagtcggactaaatgtcgtaacggcgtcaactgcaactttgcgcatggggagaaggagctgaagaaattggaccccttctactttaagactgaactttgcgaggtcggtggtcaaacgttcggctaaaatattttttccattttccagttttggaatttggacgaaccgtgcccttacggcgacgggtgcaatttcgcacatggaccagatgagttgcgtcagatgggagtcaaaggtccctttccattgcgcttttccaaatttgatttattcgacccgtcaaatttccaaaaggtccgaagtctgttgctaaagcgccgtctttctacaataatcgtcaacgtctgcgtaagacgcgcaccaaaactcagactattcagccactcgcgagctatgggaaaccggtagaacagaaagtcacaattattaatggacattga

SEQ ID NO: 74497 - DNA, 121 bp, Heterodera glycines
  Genomic contig location: Contig_ID=SeqID_1568; Location=523..643; Strand=+
  SCN-specific regions: Sequence locations=1-121
ttcttctcacacttctccaggcgcacaatgctcaaattcttgaagaacaaaaacagcgacgatcagccgagtggcggggggagcagcgcggggggcaaggaaaagtcatcggctggcaatt

SEQ ID NO: 74498 - DNA, 396 bp, Heterodera glycines
  Genomic contig location: Contig_ID=SeqID_1569; Location=2951..3346; Strand=+
  SCN-specific regions: Sequence locations=1-71,93-363,387-396
atgtcaatcgatgcaaattttgtccttaacattcactctccgacgacgacaacaaataaacgggaaaaagccggcggtagcaacagcagcagaagcgcatcggatggcacaaattcgcttaattcggccgctttcactgtcattaggaccccaacgcctgcggagcagcaacgccatcaacaaaaagacgaaaagcagcatcaacaacagcgagactctcgcgactcagcgaagaacggagacgacgacggcggaacattcatggagagaagcgaatcggacaattcgaccgcttctgttgttgtcgaacactttcctcatcagcaacaaaatgccaaaagccgtcagcagccgccaaacattggggaggggtcaaaggtgaaaaagcatttttaa

SEQ ID NO: 74499 - DNA, 432 bp, Heterodera glycines
  Genomic contig location: Contig_ID=SeqID_11149; Location=482..913; Strand=-
  SCN-specific regions: Sequence locations=23-74,96-432
atgtttgtggtgatgtaaaagttttagcatttctcgcttttcttgttatttaaatttttttgattattgacacgataacattttccttttggcattgtgtctttatttgaaaaaataaaaaaagcagaggcagaagatatagagactggagcgagacgggatcacgcgcgggattttagcgggatcccattacgaggcgggacaccgtcccaaaaaaaatattccaaaagtttgaatttttgttctatagcagccgaagtagaggagcgccaagtcaaatcaaatcaaggcgactcagatttttccctcatcaaaatttcatgtttttgattttttccactccgattttcctaatttacagatttgtttttgtcgtattattatttattgttttggcaaaggtgtagaattgtggtcccgacggaaaataaa

SEQ ID NO: 74500 - DNA, 1646 bp, Heterodera glycines
  Genomic contig location: Contig_ID=SeqID_11149; Location=1100..2745; Strand=+
  SCN-specific regions: Sequence locations=1-152,174-295,324-461,486 -867,891-910,932-1303,1327-1646
atgggttccctcaaaggtttcaaaacatgataacaaaaatgcgaaaaaatcgggtttttgaattctttcgtttttcctgtccaattttttccggtgaatttttacggtcgggaaaactgcaatagaaccgccctcaaattctgttttccgaattttctggttttcccattttttcagctcaaaccacatacaatttcacttcacacactcaacactgctcccatctgcttcaccaaaaacgcaacgccatggtgctcttcgcattgctccctgtccagctgatgctcgacaaatgaatatatttgaaaatttaattattaaaacgaatgcttcagtttattattttctgttaacatattacactcaaaattgcataatggaaaaattcttcgaatttctccccacaaatgagaattaaaaaattttatgggtacatttttgaatataggcaatttttcgtaacaaagtgcactcaaattttcaaattttttttttaaatttcacgggaaaattcccggttggtcccagtctcggacgaaaatcgaggtcccggtcccgacttttctggtcccggtaagtcccggtcccggtttttgtcaaaattcccggtcccgtgcaactctaataattaccttttttgctaacttgctatagcctaatatgcacgaaaacgagtttttaacttggtttgaagcttttatcttgaactttttggtgcattttttttgccttttttgcgatttatttttttgaaaaaacggtaaattttttgaaaattttgcaacttttcctaccatattttattacaatttccaaaaaattttccggcggcgcttatcggcaccgccggaccttcattttaccttaatttttgaaattttaaccacaaaatgagtagaatttgtcattttctatctgagaaaaagatcgaaccggaaaatgcagattttttttttgcatcacaacctcaagctattggcaaaatttttaaaaaaaatttcgcttttcgcattttcgcatattttggcttttcgcatttccctttttttcatttcgcatttttcggtttcgcaaatttcgcatttcgctttttatttttcaatttggcccatccctgggaggtagcgatgtttcacccatgaactgatttttttaaacatcattcccctctttttgcaggaggaggagccgcaaaagccgacggaactaattgggcgatgaccgggaaacatcaacaatggcacgaccgcccagatatagtgtgtcgtctttttattggcaagcgtgatgaactgctcaatgctctgaacaaaaagatgattcttggttacatcacagcctggttcttctcgctcgagttccagcttcggtagtattacattggattgggaatgcatccgacttcatggcgtaatccagagtccagaagattacatgagtgagtacatttgtgcggacgtcccttctatgccggaaacgcgacttcagtcagcagaagaggcaaagaggatgcgtgaactctacaaaacaatcaccacaaagcatacccattcatactcagcccaacgttatcttgttgatggaaaatgcaaaaaacattttccggctggaaatccttctttgggtaaaagataatattctgtata

SEQ ID NO: 74501 - DNA, 396 bp, Heterodera glycines
  Genomic contig location: Contig_ID=SeqID_11150; Location=526..921; Strand=-
  SCN-specific regions: Sequence locations=1-179,201-396
atgcttcttactccactgttcctgctggtgatggctttcatggcattgctcgtcgtccaatgttcttctgctgcagccggtgatgtttcaccggctttagataatcaggaggaaaagcgagtactttccgccgatgaatcgggaccactacaaaactttcgtactgtgctggaaggacgtcacaaacgaagtttaatgggacgctaccgaaactcgacgggtcgaaaacgaaattcgaatggacgcaaccgaaattcgacgggtcgaaggcgaaattcgacgggtcgaaaacgaaattcttacggacgtaatcgaaattcgaatggacgcaatcgaaactcatttggtcgtggcaaacgaagtcctatggcctttcctcctgctgctgacaaatga

SEQ ID NO: 74502 - DNA, 705 bp, Heterodera glycines
  Genomic contig location: Contig_ID=SeqID_11150; Location=1919..2623; Strand=-
  SCN-specific regions: Sequence locations=1-404,426-451,473-633,657-705
atggcatacttaaaatggaaagtgaaaaaaagtttaatgattattaaaaaagaaataaaatggttaagcttcggacaatatgccaaacatcgagcggtgattgatagccagcccattacactgtcatacgcttcgatggaggacatcttccgcggcatgggcggacttgacacatataacctgtgcaaattcaattgtcaggactggtcgagagaatttatggccaacggttatttttattagtcgtcaaataatacgtacatatcatcatcaattcaagaaatttcggcaccgtgccgttcgtgtgactgttgtatgtactgtgtgcggaacatcagcgccacgtacttacgacttcaattcgactgggaaatatacaagtttgttctttggctttgaaaatgtctcatttttgaaaattaaaagtaaggcaaaaatgccttaagtactaagcattttcaaaattagagccgaaaaggaaaaaagtaaagccaaaaatcagggcctaatagacattttggtttcaaggatactaaatttctaggaaaaattcttagttgttccttttagcgtattacgaaaaatcgaagtcaattaaaacctccgattatgctatttgtctatcatttcgccagcacacaattagaagtcttttcagcgcaattctcgaatgccacgatcacgctcaaattcatcgtcctctga

SEQ ID NO: 74503 - DNA, 521 bp, Heterodera glycines
  Genomic contig location: Contig_ID=SeqID_11152; Location=6..526; Strand=+
  SCN-specific regions: Sequence locations=1-521
tgtgggcgttccacaaaaagctcagtgtgggcgttccacaaaaagctcagtgtgggcgttccacaaaaagctcagtgtgggcgttccacaaaaagctcagtgtgggcgttccacaaaaaaagctcagtgtgggcgttccacaaaaagttcagtgtgggcgttccacaaaaagctcagtgtgggcgttccacaaaaagctcagtgtgggcgttccacaaaaaaagctcagtgtgggcgttccacaaaaagctcagtgtgggcgttccacaaaaagctcagtgtgggcgttccacaaaaagttcagtgtgggcgttccacaaaaagctcagtgtgggcgttccacaaaaaaagctcagtgtgggcgttccacaaaaagctcagtgtgggcgttccacaaaaagctcagtgtgggcgttccacaaaaagctcagtgtgggcgttccacaaaaaaagctcagtgtgggcgttccacaaaaagctcagtgtgggcgttccacaaaaaatgctcagtgattgataaa

SEQ ID NO: 74504 - DNA, 810 bp, Heterodera glycines
  Genomic contig location: Contig_ID=SeqID_11152; Location=610..1419; Strand=-
  SCN-specific regions: Sequence locations=1-553,575-586,625-721,743-810
atgaataagacttttatttttatttttttgttatttcgatttgagtattcgacctctaccaattccggttttgaagaatttataaaaaatcacaaagctatagaacttgtcaaaagctatcaaaataaagaaattaaaacattaaaaaaactccatgaacaaatgcaactaaaaggtattgacttaagtttttgtaccttaagacgctacgtgtcaagactaactattgtttctgcgcatacaaataaaaatgatgcttcaaactcgaatgcttcaagccatgaaatgccaaaacatgaacttagatttgaaaagtgcttttcaaaaactttaagaaaaaatgtttttataattggaaatgaatctgcttggagaaaatatgttcaaacaaatgagaataatgaagacatatatatttcttgttcaaaatgtcgttattttcgcgaacaagaaaaaaatgttaatgtcaaatcgatcgtcgcatcagctgttctgcgacagggaacacaacttgttatgttgcagtcaaaccataatgctaactgtaagcccgaaaaattagagaaactggaagcagaacaggttgatagagaacaaagaagagaaaattataaatgtgagtcagaaggcaagattatttggccaaagaaaattagcaccttatcaattgtcttcaattaatttgtgaatttttcctttttttagttttgtaataaaattataaattctttacatgaaatgcaaagaaaattagcaccttatcaattgtcttcaattaatttgtttttccttttttagttttgtaataaa

SEQ ID NO: 74505 - DNA, 1047 bp, Heterodera glycines
  Genomic contig location: Contig_ID=SeqID_11153; Location=646..1692; Strand=-
  SCN-specific regions: Sequence locations=1-56,78-346,368-395,417 -472,500-659,683-738,816-819,847-1047
atgccgaaagttgaattcttaattggtcatttgattttgaactgctctgctggatctttcaatttattaaaaaatttatcggaaaaaaggtaaattttactttcgaacactgaaatgtatatggtttgcgattgtgcggtcgaaaatgataaagaatgagaatttttgggtttttatgcaaaaatccaatttttaacacatattttattttgggatttttatccatatttcagcattttttagaacatattattacatatttggcggtcagggtcgttttcgcgtggccattttcgcgtggggacgttttcgcgtgagtacctgtttaggactgaaattggtcggatttgtgcaaaacatccatgtttccaatcccgaacccgaattcggacaaatttcttaacttttttatttcttgcggctagtatcttctacaataattggtcagtttggtcggatgtgcgtcaaacggaaaaaaataattaaaattttataaaaacacatagatagtataacaaaaaatatcaaatttcagaacaaactaaggtcgcatttcatagtttcgggaaacaccagtgagaaaattgttaatttttagaacatattattacatatttgggatttttagcacatgaaaatcccagctttaattattacttagaatttcaatttacaaatattcagagcacatttatccaaaaagtttaatttcgaatgttaacatgttcatgtacaatcataatattaaacatttttgattgatatttcaaattttactaaaaattaaaatttttaatgaaaattgttaaaaaattggcatttttattcattttttggtactttgctaaatccttccaaaatagagtgtttctattcagctaagacaggacatttttcgacaacaaattgttaatttttttttcttttactaattatgttgcttctaagaaattatgaaatttttccagtaagtgcttattttggcggatttataattcccattaccacacacattttccagtttttaagatttaaattagcaataaa

SEQ ID NO: 74506 - DNA, 91 bp, Heterodera glycines
  Genomic contig location: Contig_ID=SeqID_11155; Location=1060..1150; Strand=+
  SCN-specific regions: Sequence locations=1-91
atgaaaattttccccaaagattcgtttccaaaatttttgttcttgataagttgcaattgtaagggcgaaatgaataatgaatgggacttag

SEQ ID NO: 74507 - DNA, 3143 bp, Heterodera glycines
  misc_feature (3132)..(3132): n is a, c, g, or t
  Genomic contig location: Contig_ID=SeqID_11156; Location=29..3171; Strand=-
  SCN-specific regions: Sequence locations=1-453,492-756,801-876,902 -1029,1056-1071,1093-1235,1339-1372,1395-1412,1434-1458,1486 -1490,1513-1601,1632-1822,1903-1920,1942-2147,2195-2677,2747 -2870,2899-3143
atggtactggctgaacctgcccgtgttggacccggagatggacgagctgtactgctccgcgtcgctgaacggcacatcggcgggcacggtgagcatttcggtgggtgggggtgccattggtttcagggcggcggttggcggtgccgttggcacaccgcgacggcagagccgaagcggcggaggtgcgggcattgcatacggcggatgccggtgccgcattacaattggaactttgcggcggcggtgccgacttcaacaaccgggactcggcactgggcagcgatgtgagtaatttcatttttttgtgccgttttttgttttgttttggaaattgagtgtttctggcggtgccgagggcatccacaggacaattttttgaaaatttcttactcagtttgtctgatgtgctctcactcacaatcagcacttgtgagtcaacaaaatatatcattcattttttactttttttttttgtaaatttttttaattttgaagaaatttcgtcaaaaaattattcatttttttagaacccaaccagcagaagtggcaccatccgttgtcggcatccccaaattgacccggacaccggacgatgtcggacatgctcataccggtgagcagaatgaacagagggtcatctggggaacagtacgtcctcccctcccgaaatttttttttcaaacaggaatttaaggaaaattaaagaaaaggcatcttgaaaatatcagcgatttcttctttcaaaactttatgatgaatttaatttttttttttttaattttctaaaatattaaaattttccttgtgatttattggttttccaacttcgttagaaacaaatttcaactgatctttttcaaaagacaaacatttgtgatttaaataaataaaaataatatttctctccattccagcccaacaagttcaacccgtacagcaacagcaactgccactctgatggactcgggtcgtccggtggcggtggtggcctcaacgcgtgcgctccaacctcattctgttcgttttgaggtaggtgtatatgtatgtggtggttggtgctgcacaccaatgttttaattttaaaaaattaatccattttcatggaaaattttcaataagattttttaaatttttttttggcggattgttggtgggcgattttcatctttcccagctgaaatgaaaaataatattttgagtcaattggcgtcgaccgtttttcttcccttttttgcatttgccttttcatttgcatttatttgtccattttttacatatttttcatccattcgtttattttcatatatattgtttattcattctttcatttgtttgtcttaaacagatgggttcatcaacaaattgtgctgataaaatcattttttgtcatttacccctcctccgtcgaatgatttctctttaattgaatcaaaatttacaaatatatatacctaatcctattttattttccttattatttgcactctctctccccaaaatgctttataaaaatcccttttcattcaattttaggtaattagggtaaaagccggggggatcgccgccagtcaaacggtgataaaaaaatcacaatttcaccgataaaattttaataaaattgtaaattaattccctattactttgaatattgtacagaaaacagctcgacatttccatacagtatgcaaaaagcaataaagtactgtaaaatcaatgattgagaaagaagcgagagggggggggggagaagtgacaaactgaaaaaaacattgtgagaaaagagacagacagggcgagaaaaggagaaagacggtggaaaaaggagaggcagagagagagggagagagagagagaaaaggggagaaaacaggagacactgagagagagaaaagagagaaagagtgcactatttaaataacggcagtgcaaaaaaggaataaaaaatgatagacgattggctgataatggcggaccgatggggcgggggggggggagaggggaagggcgactgacgcgtaaacaatcccattgccccccccctttcatcattctttttttccccccgcaatttcttcatcgatttgactctttcgtttcattcattttgcttaaacgtgtgccaatatttgttattgacattaatttgcaattaaattaaattttaatttatttaaatgtaaaataatcattttttgtgacctcctttaatttttttcgaccaatttttagtgaacattgtcggcgcgggtcgtctcttcaagcgtcaaatgtgcaaagcgttggggcaagcgccgggcattgtcacgcgggagggaatcgcaaaaggcgtgcgcggatcattgacaacggcggacagtccaaagcggcaattggtggcggacggtgagtgggggggggggggacggacgaaacttgcctggtccaaaaacaatcgtttgggatgggttcgagtcgacttggcctaaagggtttttcgggcatcccgtggcactctgttgtgccctcatcaattcataactgtttggaccatttaaagcgtaatatgcgtgattttttaattgccaaccaattaaaaattgggttattgatttatttttttgtgccaaaaatgattgtctttctgattttttttgtttatttttattttttgtcattttacagtgcatctttcgtcgtcctgctgctgctactgcttcaacttctgctgctgttctcccattggctggtgccctcgttgctgctgctggggaccatcgccacaacaatttgtgtgtgattttggagaaaacgcgcaaaactgctgacaccaccgtggagtgtgttgcggaactgtggcgcatcgccggtggccttaaaaattccattgaatcttttttttcaaaaaaaaattttttttttgaagggcatatctaatcattctcccaattttcttgcagtttcgtctttacgagcccgtccacaggcacttgccatgtccggcacgaaatgaccaattggtggccaaagcggaactattggacagaatacgaaggtatatagtgttttttttgtctgatgaaaaattgaatggaattttaatatttttttttcaaaatttcagcgcagacgaattggcacaaaatcagatggcancggcggcgggc

SEQ ID NO: 74508 - DNA, 976 bp, Heterodera glycines
  Genomic contig location: Contig_ID=SeqID_11156; Location=3453..4428; Strand=-
  SCN-specific regions: Sequence locations=1-274,297-419,442-543,574 -672,734-976
cccttggccaacaacagttagcgctgactgatggttctgccgtggcgatggaccacctccaatgggagaccatccgggagtgggtgatcaaagcggacactgtgccaaggctggtggacagtctgatcgacgcggacggacaaatggactcaaaacaggtttttttggaaatgcgggggaattttgggttttacaaaaaaaaaaaattggaaaaatttggcccagctttaaaattgggtagccattttttaatattagaaaaatgcgcttgaaattgtattcccgtggctttttgagatggcataacccgaattcgaacaaagagtcgacaaatgacttttcgaactatcgaatttggtttcgaaatttgattaagaatccagaattggctgaaattgatcatttgaagccgttttttgccaaaaaatgaccatttttgccattaaattttcaaatatggtaaaatgggggcacggaaatgccgagaatttttttattttaatgtattttgtcaagataaagacggcactattttttatttccaatttattaaaaataaattttcaaatttttgtcggcgcctaaattcaaaaaaatccctcccccccccctcttttttttatttcaacgttttctttgccacttatcgcgccttttccaccgcggccgaagataaatttttttgaaaattattaattttttagaaaaaataataattttttgaatttttttaggcaatcgaatccaacaaaaataacaacagttgcagcagcagtacctggacttggagtgcatttggaacaatgtgtggtcaaagaatgagtcggtccgtgccctttaccctccggcagtgtacgtctcgctcaagtcgttcatggtcggactgttgtgccgggaggacaaccgaatcatgttggacggtcagtctccggcccaaccccgaaatgtgtggataaaccaaaactttttaaactga

SEQ ID NO: 74509 - DNA, 159 bp, Heterodera glycines
  Genomic contig location: Contig_ID=SeqID_11158; Location=46..204; Strand=-
  SCN-specific regions: Sequence locations=1-159
atgtatgtggtgtgtagtcatgacaatgagtttttccacagcaaattaaaattgaaattagatttttaggtaaatattagagttcggcattttgcaaaaagtctggacaacatggattctatgttggatctggatttcgaatacgggttggacccgtaa

SEQ ID NO: 74510 - DNA, 964 bp, Heterodera glycines
  Genomic contig location: Contig_ID=SeqID_11158; Location=1273..2236; Strand=-
  SCN-specific regions: Sequence locations=1-750,775-920,942-964
atgcgtcagtttgccccgtcgatgctcatcgattgtccaccacttcgctgtgtctctttcgaaggcgacattctcccggaatttccgcccgatgacagtgccaatgcgacggatggccaagcggtggcaaaatggctgttctcgcctcgtccggacggtgtaccaaatttgttacattgtcatgacttttcggttccgcaatggtcgtcaagaatggaacaaatcaaaacggtgattttcacgccatttttaattacattttttatgattttaccccatttttaggcattttccgatgcatcttctcatgtttgcttcatcatttactttgaattttcgacgttcccttcgcttgacttcgtcgtgccatttgagttgaccaacgcattgactggggagcaattgacactgtcacaatattatgattttgatcaatgttttgtgctcatccgttgcccaattgggcagaaggagatggcattggaacagtttaagaaagcagggactagccgagggagccgaattttcattggcattggagcggacggattgaaaatgggtgaacaattccaaaagattttcggtttcaattttttgtccttttttcagacttctcaacgctttccctgggccgagtggtcagcatcagaaagaagtgaatgaataattaattgatgcgaagtgtttgtgatcccgaaatgttgtcatttgactattatttatgtatatgtatatgcagttgtatattttgctcacaaattcatccatttcaattatggtaattggagtgaatgctttgataaaacgattaacagtcagcatggtattctttttcggaattccttagggcttacgattattaaaaacaaaaaatagtatttattatgtggctgtcaaaaagtgggaaaaagtgaatttcaagattttttaaaatcctgaatatgtattcattgtactgaataaa

SEQ ID NO: 74511 - DNA, 405 bp, Heterodera glycines
  Genomic contig location: Contig_ID=SeqID_11161; Location=853..1257; Strand=-
  SCN-specific regions: Sequence locations=1-198,220-275,318-405
atggccgaatggcaaaaggcactcggaattgtggaaaagttgcgggcccaactcagccaacgccaatatgtgacggtgcgagtgcttttgctggaggaacgcttcaaagagctgatcgaacggggcgaggtaaaaaacgaaaagcaaagggacactttggaaagggcgaagaaaaaaagggaaaaacatcggaaagcgaaattgaattagcagaagaataacacggtgttatcagatgatcagattaaaaagggcgctccaaaattgcgccgccgaaattttcttaaaaattttcaaaaaaaaaaaaatttttatatgaaaattccaagaaaaaaacatttgaaaaattttcagcgattttgagttaaaggcaactaactgtacacaggcaactcttacaataaa

SEQ ID NO: 74512 - DNA, 1598 bp, Heterodera glycines
  Genomic contig location: Contig_ID=SeqID_11162; Location=161..1758; Strand=+
  SCN-specific regions: Sequence locations=1-508,530-1343,1365 -1374,1396-1560,1584-1598
atgtattttcttgtagtgttccttgcaactgacgccgagttgcagcatttcgctttgcattttcaggatttgctgctgctcttggaacgccaaaggcatccgcgagtcgagcgactcgaccgcctaaaagagttacggaaaagtaagtgccaagagctgaggagtcaaacctcgatcaaattgttgacgaccgctggagtcgaagtgacggtcgggtcgatgtcgggcaaaggcaatatttgaaaggcatcgtcggccaatttcctgcaaagaaacaaaatcagaatccgaaccaaatttctcattttgccggacttgaatatttctggcacttcggcacactctttaacgctgaactcagactccgctaccgacgatacattggtggaatggacatcgtctccgatactcggagtgaacgtgacgtgttttttcatttttaaaaatcaaattgcaaacttaaatggttaaaaattcataggttatattgtaatttgcaataagagcgaaatactaaaaagttataaaaatacgtcgcactgaaatgtaccgcactaaatgaccctaaccgtaatcttttgattgactaccgtaagaaaagaaatttaattttggcagcgccaaatagataatttgagtaggtggtatgcacgtctaatgctactgctactacgactgttacatttatttcttagtgtttaaatccgaacagggggggggggggggtgggggcaaaaaaagaacccaaaaacggggtcggttacataaaagctgcatttagcggtttcttgtttcttaatatcagtactagctcatttcttaaattataaattacagagaaaagtcagtattaccgaatgtctgatttgaccacaccatctccggaagtgacaactgatgatggcaccacgccacaatcatcgaaggtagcaggtttaaacttcacgcaacgggctgacttgtcctgtttaggctgctgagaagaccggacaagatggatgcaactccgccgccgcctctgttgatgatgatttggcatgtgcacagatggtaagaaaaggcatttaatataaacgtttgcccccccctccctctcgcatgtaactgcatatagccacgaaatggggactccttcgaatcaggtgtagaggtgggggtaatttttcataaaaattgtaattttttctaaccaagctaggtaacaaaaattttgatttaaaaaaaaaatgatgcggcgacgttttgtctacccacgcctctccctctaccccgctagccttaattcataaacggccagaccgaccccccccccccccccaccccatttaatccgttatccattcaactgccaaacccaaatcccttttcgattcgcattcatattccatttccttttataggttctgtcgccagcattcgagaacatttccgaagattcatcaagtcctacaactgattctgcacacattgtcgacgcgcatgctcagaaggttgttttttgcgattctgagaagtactcgggggtatcgagggcgctgatcacgaatctgacaccaccttgtcataaaaataatctaatctatgatttctcatcgtga

SEQ ID NO: 74513 - DNA, 467 bp, Heterodera glycines
  Genomic contig location: Contig_ID=SeqID_11162; Location=131..597; Strand=-
  SCN-specific regions: Sequence locations=1-467
atgaaaaaacacgtcacgttcactccgagtatcggagacgatgtccattccaccaatgtatcgtcggtagcggagtctgagttcagcgttaaagagtgtgccgaagtgccagaaatattcaagtccggcaaaatgagaaatttggttcggattctgattttgtttctttgcaggaaattggccgacgatgcctttcaaatattgcctttgcccgacatcgacccgaccgtcacttcgactccagcggtcgtcaacaatttgatcgaggtttgactcctcagctcttggcacttacttttccgtaactcttttaggcggtcgagtcgctcgactcgcggatgcctttggcgttccaagagcagcagcaaatcctgaaaatgcaaagcgaaatgctgcaactcggcgtcagttgcaaggaacactacaagaaaatacatgagcagtccgtgatgcgttacaatctcgag

SEQ ID NO: 74514 - DNA, 272 bp, Heterodera glycines
  Genomic contig location: Contig_ID=SeqID_11163; Location=869..1140; Strand=-
  SCN-specific regions: Sequence locations=1-272
atgaatgaccgtcagttcttcgggcgcaaacatggcacagttcatgttgacggacagactgtcgtccgacgagtggaaagagcccaaaagggcggtgccgaattggtagttgtggggctggacgaaggtggtgccggtgcccgtgccgagtccgcccaagtcggaggggaagccggagccaagagtggtctgaaaagggcatggggaagaactaggtaatttacgacaattaatgctaatgaagccataattgataatgtgatggtaataaa

SEQ ID NO: 74515 - DNA, 2207 bp, Heterodera glycines
  Genomic contig location: Contig_ID=SeqID_11163; Location=708..2914; Strand=+
  SCN-specific regions: Sequence locations=1-880,906-913,936-1564,1586 -1660,1706-2207
atttccattcggtacgtaaagcgatcgacagaatggcagcaaaggttggcaaatctcagatattcaggattctcgcccatggctcccctagttgtttcatttgttttccattttctcgtgtttaggtcgcaggggccttaattagaaattgaaaaaaatgttttattaccatcacattatcaattatggcttcattagcattaattgtcgtaaattacctagttcttccccatgcccttttcagaccactcttggctccggcttcccctccgacttgggcggactcggcacgggcaccggcaccaccttcgtccagccccacaactaccaattcggcaccgcccttttgggctctttccactcgtcggacgacagtctgtccgtcaacatgaactgtgccatgtttgcgcccgaagaactgacggtcattcatttgttgccgttggcattatcaatgaaattttctattttaggtgtctgttgtgggcaaccaaattgttgtggtgggaaatcacggcgaaaagcaggactcacttgggtcgatgtgagtgtcaaattgaaattagccaattaaaaccatttaaatttaattcgtcggattagtgagcgccgatttgtacacaaattttccatgccgcgcaacgccaccgccgactcagtgaaaagcaatttgaccagcgacggcgtgctgacggtgaccgccagcgcaccaatcgcaccaaaaacaaaggcaacaaactgggcgagatgggatggggggaatggaatgaaaataggaacaatacatctgttatatttagagttgctcggtaccggtaccggtactggccggtaattaccggttttttagcaattaccgattaccgagcaactctagttatattatttaaaaaacaaatcttttgatggtttatttggcattagcaatttgtatgggttggtgctaatttataagctaatccgcagcaaaaagtgggctaactcggtaattacggccatttttaagatttaatattggcaaaataatgttaatattgagcatgtttgaaatgtttttttcatttagaaatccgtgtttcttcaatcactcgaatcgctctccaattctgccaaacttttgccagaggaaattttcgagcaaaatgaagagctcttcaactaccgtattcagtgtatgctgacatttattttgacaattgttattttcttctaacaataactcttattttaaccattttcagatttccattcggtacgtaaagcgatcgacagaatggcagcaaaggttggcaaatctcagatattcaggattctcgcccatggctcccctagttgtttcatttgttgcatttttcaattttcccgtgtttaggtcgcaggggcccagcacatcggtggagacggcgccggaggaagtgggatcggccccaccgcaccgaagcagacacgcttggccagtgacgaatcgatttaagcaacgattatgttgagaattttcgggaacggctttccataccaattctcgatgtcctatttcaatgacttatttggttttttacgatttctttaaattttttaagtaattgtctcttctcataatcagacgatgcattagagacggataaattatttcggtctctgtccatttaatttgcttcggtaattaatctattttttttactattttttattgtttttttaaattgttttttcaattttgatgccattgaaaattgttacaattgccgtttcgccctctttcaactttctgcgtcgtccgttgccttcgttggactttcgtcgttccctttttaaaccgccattggactcgccgttctgtggcatttacaggacaaatggcgaaatttgccggacggatgacattttggtgtgccaacgcaagatgaactatcaccctggagcaaatgtacccaggatttttgatggattgaacacaaaaattccacattaacctcaatgttcccgtgtttcaggtccgccatcaacgggaccggaaccagcacttgttgaaagcggtctgtgacggaacggttgtgatcacacgcgagcactgcgaagtgaacccgaagaacgagtggatgtacgcgcagtacgcgtaccgcgactttgagaacatttacaagctgaccttcaacgtgataccacgacggatgtccaacacatttaaactgatcagcgaagaatga

SEQ ID NO: 74516 - DNA, 655 bp, Heterodera glycines
  Genomic contig location: Contig_ID=SeqID_11163; Location=3078..3732; Strand=+
  SCN-specific regions: Sequence locations=1-548,570-655
atggaagcgcctaattcgccgatggcatcggcacagaacaggggccatggcgttgacccgtccactgtcagtgccgatttaaacgacatttgtggggacaccgacggaatggcaaatgaagaagaggcggacgactctattgtgaaggaaattgtgacggcattgttgtcgggcggaccgttcccagcagcggaagagaacgacgagcaaagccaagccatggagcagcaacagaccaatgggacagcgatggatggtcagagtttgttggcacaccaaaatggtgtcaaatgaaatttgtttttttttaaatagaatttggttggtcggcttgcctaagtttatgtgttcagatgcttctttttcatctgggctctctcctcttgcgtccgatgctcatcaaccagtgctatttgcctcatttttcgagttaatttttttttgcaattcgttttacaccgaattagccgacaattaccgagtgatttggtcaattttcaggtcccaacttggtggaaaaaagttggagtgcggtggccatttgtatcgacggagtcggcaccggggcgacagcatttattggcgctgtgaccaaaaccggcgctaccgctgtgccggttcggcgcggacagtgggcgaaacggagggaaccgag

SEQ ID NO: 74517 - DNA, 925 bp, Heterodera glycines
  Genomic contig location: Contig_ID=SeqID_11166; Location=519..1443; Strand=+
  SCN-specific regions: Sequence locations=1-925
cgacgtgagttgccttcgttcgttgggtgcttctctctgctgatcagttctgtcaggaatcagttggaatgggctcctccgatgcgaattatcgccgtgatcactttgctcgcctccactttggatctgatggcggactttctgctctgcagcagattggccgagtaccttcacaacttccaggtttctgtttccctttgtgccctttgcccatttcgactttctttgccctttccgacggaattcgcccgttattgcgccctcggctatttctttttcaccggtgtttccattctcgtgtacgtcttcgaaatggtcgacgtgtgtctgacgcttaaatacgacgaggagaatgttttcttcgcgcgaatggccaagtcaatggttttggtgctggaagaggttagctttggttggtggacagggcagcgcatttctggccaatttccaaccgattggtctctttttgccggtttttggtgccactgttttcaaatggttgctgatcaatcgcttgttcggtttcattttgcttccctcggcaggtgccgttgcccgccctgctttaccttctgttcacttccgagccgcgtctgtccctggctaatccgatgcatatcgcctcgtggatcaaactgatcactctcagctgggccatagtcaaatttgccaagctccgtttcttctggccactgctccctttcaatccgaaggtgcttcttccaaccccccccccttttctgttttcccttttttttagcatgacaaacgcgaaaacattcggcgatgtttccatctgaacctttacagaatgacaatgatcgtcgtcaacgctttccatctgttggccattttcattgtgattaacaatttggtggtgtcgcggaggggcggaaggtcaatccaagcgcaaagttcgctttga

SEQ ID NO: 74518 - DNA, 1016 bp, Heterodera glycines
  Genomic contig location: Contig_ID=SeqID_11167; Location=162..1177; Strand=+
  SCN-specific regions: Sequence locations=1-733,755-824,846-883,907 -988,1010-1016
atgtctcgtggaacaagccgttcaaggagcgaattcggcatttctacaacacttggatgtccaatgatgcagaaaaagagttcacaccggcaggcaacccgaaggcaccagcgcttcacatggcacttgactggatccaccgatcgtggcaggaaatttcgtgatcatcaaatcattcgagggtcagtttaaaaaataaaaatgcctacgaaagacgcagaaacttttaagtctgtgggttgactacgccattggacggaacaggagacgaaaaaattgcttgtttcaagccggaaggagcaattggactgattgggatcaaatttttgcgcgactttagagcaaatgagacgatgaaagatggacgaaatgatcaggaggacgccggcctatctgttgatgatgatgtagagttgtatgcagtcggagatgatgatgaatttttcgtttgttaagtttttttatttactgttgatttggttttgttttttgaaaaaaattggtgccaaacaatttcttaaaattctatttatatcccatgggggataaatagagactgggggattatttttcgaactcctcagaaaggggggggataattggagactgcgaaattaatagagactgggctataattagagcaaatacggtaagtctgtttgacaaaaccaacctgaacaatttaaaaatttcctatacatattaacattataataattctcttggaagcgtgtttttccaacaaaaactttttggaacgtgaaaaaaagaaattttgggggtttgggtggtgcttatcactgtcggtggtggaaaattggtaatttttgacatttaacagatttttactaaaagtttgcaatttttaggtcaagttttgaaaagtttaaggaaattttgggctgattgtgccaataagctaaaaatggccattttgaggatttttccaaaaaatcagcaaattttcacaaaaaaatatcccgaatgcaaatttaaatataatttttttcttataa

SEQ ID NO: 74519 - DNA, 139 bp, Heterodera glycines
  Genomic contig location: Contig_ID=SeqID_11167; Location=3598..3736; Strand=+
  SCN-specific regions: Sequence locations=1-111,133-139
cggtgcaaattaataaggcaaaggaattcaggggtttactaaaagcaatgagttctgagtaggattttccatgttgccatatttacactatattttaatcacctgtgaatttttaacatttgatttatttttattcatt

SEQ ID NO: 74520 - DNA, 638 bp, Heterodera glycines
  Genomic contig location: Contig_ID=SeqID_1571; Location=1277..1914; Strand=+
  SCN-specific regions: Sequence locations=1-159,182-545,567-638
atgagtgagttattggcatcagagtcaaagatgctcaaaaatgcaaaaaaattcttgcctcaaacctcaaaaaccatcttaaagttggtttaaaaatctgaaataattcatgtttgcttatcttttggtgttgaacaaaaattaggaaaattttattggaaattttaatagtctcattgaaaagagcacaaaattctctaccgaattatctttagaagggaggggctacgacttgttcacaaaaagttatacttagttgaaaaattggagaactcaaaaatgatcagtttttgatcatttaggaatttttttcgaaaattacccaaattttcagtgtgttttagggtgttcagatcaccatgaaggagtgatcggatcaagtattttgaggtttgaggcaagactttttccactcatttttgggcatctttgaaccaatttttgcctctttgaggcaagacttttttggggcattgtaactagtgctgcgatttttaggcagaaaaaattcgcaaaataagcattaaataggcacaaaaaaaggcaaattaatttttttaaattaacgcttttaggtagaaaacacataaaaattaatcaatacttactttggttatatttaaatttaaatgaaatta

SEQ ID NO: 74521 - DNA, 250 bp, Heterodera glycines
  Genomic contig location: Contig_ID=SeqID_1571; Location=2651..2900; Strand=+
  SCN-specific regions: Sequence locations=1-250
atggcgcccccacaaagtgtccaagccacgaaatgtccaaaagagtaaaaatccaggcaatgttcaaaatttttcaatatttataaacacaaaatgagtctaatttaggatttctagggttttcggggtcgttgaatatgaatataccctttatattaccccttgcctaaccttaggcccatctgaataataaaaaactcaaattcgagacttggacatttcgtgggctggacattttgtgggccagcgg

SEQ ID NO: 74522 - DNA, 453 bp, Heterodera glycines
  Genomic contig location: Contig_ID=SeqID_11168; Location=1011..1463; Strand=-
  SCN-specific regions: Sequence locations=1-221,243-378,400-453
atgattatgattgattataatcgacacattgtctccgactcgaagcttgggtaaatttataaataaagctcaaaattatatttgagaaaaatgaataacacgacgaaagaaggaattgaggtgttacgttcatcagatgagactaatgacactcttttgctcctttcacattatgcatttgccttccctgtttttctactctgttggttcataataattaaattcctcaagaggagaggtcatatatccccaagcgaagcggaaaccatgattgaagaaatgaaaaatattcaaagacaaccaccaatattttttcaatcaaagtagtgtaacttactttttttacaatgcattatttttttcttataagaatttggtataattttaattgttattggaattttttttgttaaagacaaatttttaaacatttaactgtttaaaaataataaa

SEQ ID NO: 74523 - DNA, 1017 bp, Heterodera glycines
  Genomic contig location: Contig_ID=SeqID_11169; Location=151..1167; Strand=+
  SCN-specific regions: Sequence locations=1-83,119-705,728-1017
atggcaattcgccagcacaaggatctcctcttcggagggaaaacagtcattttcagcggtgacttcaaacagtcgctgccggtcgtgcctcatgaaggcttaaccgctcaggtgacagcctgttttcaaacatctccattgtttggtcaattcaccacgatgaaattgaccatcaaccagagattgggcaaaggtcagcaagcgtacttgcaaatgtgccgccaaattgggctcggagaaaccggagagcacttctggattcctcggcagttcctcgttaagagcaaggaagagctgatagactatgtctatcctaacttccaacaactccttggcaatgacaaggagctgctcaatcgtttgattctcgctccgcacattgacacgtgcgacgaagtcaacgacatcatgatggcgaatgtgccaggtcatatgcgggaatacttgtccacggataagccccttgacgaccgcccactggacatcgatgagatcgagtccgaagtggctgcgttgaaccggcgcacagactcgggcatgcccccacacagtctccggcttaaagtcggatgcgtcgtcgtccttcttatcaataaaagtgataaggaaggactgatcaatggcacccgcatagttctggaagaacttggcgatgatcgcctcattggtcgtgttatcaatagcaatgctattggcggccaagtgaagttctttcttgaaagaacacgaaatgtctatgaagacaaatcgcctggcggcataaaatatgagcgtttgcagttcccaataaagcctgcattcgctatgaccattcaaaaaggtcagggccaaacaatccacactgtcggcattgatcttgaaagggaagtattttcccacggtcaattgtacacggccttttcacgggctacggacggaaacaatgtccgtgttcatgctcccaaccgggatgttgacgcccaaggccaggccaaagtgcttaatattgtagctactaatatgctcaagttacaataa

SEQ ID NO: 74524 - DNA, 1423 bp, Heterodera glycines
  Genomic contig location: Contig_ID=SeqID_11171; Location=387..1809; Strand=-
  SCN-specific regions: Sequence locations=1-107,129-195,491-680,737 -845,867-875,941-992,1014-1075,1127-1150,1172-1423
atgtttgtgctgttgtcctgcgtgttgccgatcagttcatcgctgctggtcagctgttatttgcttcgattgatgtgctataagcggggccaacagttgcggacagattccattcagtcaaattcttcatcacagaggacagtgaaaaatgccaattttgtaccattggcaccagcattttcacacaaagtaaacttttaaaaaatatttttcaaaaagatttctttaaaagttttttaatgaagattttgtaaatattttttttattaaattgttttagttaggcaattaaaatttcttttttcgataataacacaaataaaaattccatattttaaattaaaaatttttttaaatgaatatggacaacataaattattaaaactttaatgtagcatttataataaaataaataagaaaaatagtaataaacagactaattgataaaatacaaatttaaaatatttacaattttaaatttaattttttacagctccgatctctggttttcattttcacaacaactgtttggacagcgattagtctgcttccattccgaattttgatcataatccgactcaattttattgatgcaatttcactgttgtccaactgtgagctgttaagatttatggtgattgctgcttggattctgcactatattttgatgctttctccggtaataatttatatttttaaaatacaacaatttagtttttttaattaaatttttatacattggtcagtaattattagatacaaaaaatttaaaaaaccgagataattgggtttgaaaatggattaagatatctgggattaacgtagaaattcgaaatctttgataattttattttttctcaataaaattgcaaatgattaaattcattttattaaaaaatctcataaaatattttgaaatattaaataaaaataaaaaattgttttaggtgatcaatccgttcatcactgctatcatttatcatccttatcgggtgacatttgtgaaacaattgtcattcagtggcagcagcatcagaagcacacaattatgagaaagtgaactgattgattgatgttttaattttatttaatttttttatagtacaaaaaaattatatttaatttagtcaattctttttctaccaaatggaaaattatcattaattattgtctcatattaaattcgttaaataatacccaaaatattatggccatataattttttgaaaattttgctgctaaattggcaatggtcggacaaaagtgaaagataagaaaaaaaggttgggaaaaaagccaaaaattgaacaaaaagaccaaaataacaaataatagaaactaagcagtggataaatggattaagaaatgttgggaaaatgcatacgatcaaagtttctatcattgatttattacataaaataaa

SEQ ID NO: 74525 - DNA, 587 bp, Heterodera glycines
  Genomic contig location: Contig_ID=SeqID_11178; Location=99..685; Strand=+
  SCN-specific regions: Sequence locations=1-85,107-216,238-250,327 -450,472-587
atgttaaacggcacttaccatttgtggtcgcgaccatttgcaagtgcattctgtcgtttgacgagctgagaattttttaaatgccaaaatttcaaaaacttaattttgctaatgataaaatggcactaaaatttggggcaaaatatattgattaactgatccatacagtgataattctttaactgtttggaaatgggagaactgagaagcagcgccactacatcataattaaatctttttaaatttgggcattaaaaataaaacaataagaatgatttagtaaaataatattgcattttttttaatataatattttaaaatattttcacttaattctgatcaatcacaaatcctcccccctccccccggaatactcactttatttgaagaaatgagtgcctcataaaggggtgagttcgttttatgtcgatcagcatcaatttgattatttaattgtataaaatcagttcttgacgatgacgaaggaatttggccaatctcagggccaaatgattgcacaattgaaaagctaaaagtgcgcaaaatgagaatgcatttttaaacataattttcaatttaattggtaa

SEQ ID NO: 74526 - DNA, 2357 bp, Heterodera glycines
  Genomic contig location: Contig_ID=SeqID_11181; Location=305..2661; Strand=+
  SCN-specific regions: Sequence locations=1-196,218-458,498-658,716 -740,872-1882,1911-2118,2148-2198,2221-2357
  Gene Ontology: Mol. function=glutathione synthase activity; Cellular component=intracellular; Biological process=neurogenesis
gtcgaagtgaacattgggccaattgggggcaatgtaagtgcgcaagcagttcgccaagtgcacggacgcgtgttttccaaattgggactgtccgaggacaatttgcccgagaatcgtgcaagcactgccattggcgaggcattggtcaaggcgtggtcagtcagtgccaaattggccgaccaatttggcgtcaattaactttatgtaataaattattagcatttccgttgtttcagggaactgttcgaagatcccagcgccgtcgttgtgataatgtccatcaaaaataaccatggccacttcgcacttcggcacatccaatacgaaattgagcaggcatcggcctacaaaatcaaagtgattcggctcacattagcagaatgtgatgaaaagttcgttagtttacacagttttattgttaattggtctgaaaataaaatcattcgagagtctcgacgtaatttaatttatttatcaaaaaaaacattttatttttagacttattttggatcccaacgattcttcgctgcgtttcaatggcagaaaagtggcggttgtctaccaaaggacctatctgtccgagaaggattggccaactgagaagcactgggacattcgacgcaaaattgaacggtcgactgccattgtgaggaaattgttaaattaaatttgaattaaattagaattatgttgttttttactttaattaattttagttcttttgaaagaatggaggaggaaattaattaatggatttgaaattattaatggattgaaatttttaaaattaaggattaaaattcattaatagatttgaaattaattaatggatttgaaattaattaatggatttgaaattaattgatggatttgtgccaatggcaattttcatttaggtgacattcaatgtgaacattcatctcgcgggttccaagaaagtccaacaggtaatttattataacaaattaagcgccaaatcccctccgttcgacttttcagactttggcattgcccggaatgttggaacaattcttgccggacgtcgacgaaggaatgatcagttcaatccgaaagacattcgccgaccttttggcattggacaaagaggacgaagcgacagaagcagtgattagggtaaaagcaaagtgaaagttaaggacacgcacttgagaaatggggaagaaattcaccaaattcaataaaatcgaccattttggacaaaatgacaaaagtctttagaaatcacataaaaatatctatgtttagggtagttttttgagagattttaattgcgaagtaattagaaattactaaaaatgaaaaatttaagaaagccattgaaaaccctgaaaattacgtgttgaaaacgaaccgagacggaggcggaaacaatttctttggagaagaaattgccaaaaaactgagcggtttgccgctggacgaacgctcgtcgatgattttgatggaaaaattgaaaccgatggaagtgaaggtaattgggaggcaatggctaactcaacaatggcatttcgacatttgctataataaaggcaattttcacatattttcagaatttcccaatacgacggttaagggaccacaccgtgcgaaatatggtcagttgccaacaattatcaatggtttgggaccggggctgggctagcccaaacttcggcttctaaaacttcggggttttgagcttcggcttctgatatagtataaatttcagggaaaaacataactcctaaagattgagttttcagtgttaaatacaccccccccccctaatgatgggctcaagaactgagaaagatagtttttaatttttttttcaaaaattattccctttttgaggaaagtttcaaaggaaaattaaccttttttcctctaaaaatctaaagaaaaggaaattcaaaaaaatgaagaacattttataatgttaaaaaaaattaacggtgcgggaggaaacggcgtaagaaatttgggggggggggatgtattgcacccttttggagcaatgaagctcctgctctcccggtcaaattttaattgatactttcgaatgttcatccgggtgcaggattttgtaagtgagttaaatgcttatcaatccaaaaatataaaacataaaattcaatttaaaactgtacattttgcaggagaggggggggggagtaaataggtttaattcttaccaaatttatttaatttctttgttttcccgctttttagagcagtgaattgggcatcgtcggttactttttgggcaatggccaaacgatggcaacgattgccaatgttcagcaggggcatttgctgcgcacgaaattcgccgagtccaacgaaggcggcgttgg

SEQ ID NO: 74527 - DNA, 451 bp, Heterodera glycines
  Genomic contig location: Contig_ID=SeqID_11181; Location=4703..5153; Strand=+
  SCN-specific regions: Sequence locations=1-82,111-284,306-421,443-451
atgcccccgggggagaacattggcggcattcatccgcccgccaaatatcagctgccgaaggattatggccgagatgaatgggtggcattggcatggcatttcactttctttttggcaattccaaagggaattttgtcattgaacattttggtcaatcagccggtaaaattacggtaattttgcggaaattcactttttcaaacaaaatatttcacccgaataaatgaaaaaggcacaacaaatgcatttttaaaccaggtaaaaattctcattttaaaacccatattaaaggtttaattttcttacttattccttttgtacaggacaaaacgtcggagtgatcagacaggacgaaacttatcaaagtaattaaatatcgtaattaggcagacaaaaaaaaatcctcatttgattgagaaccattatttacaatattcaaaattaagtgtta

SEQ ID NO: 74528 - DNA, 764 bp, Heterodera glycines
  Genomic contig location: Contig_ID=SeqID_11183; Location=1590..2353; Strand=-
  SCN-specific regions: Sequence locations=1-131,153-251,273-473,504 -628,651-764
atgccattggtgtcgaccggccatggcaaccaccgatttcgttggtgccaaaccctccccccagcctatttcgtgatccctgcaaatgtgccattggagcggcccatttacgatcaaaatgatagtgccattgaggacgaattggcggaggaagcgaaggcgaagcgagcgcaaacgttcgtccgattcggcaaaagggcacaaacatttgtgcggttcggaaagcgggcacaaacattcgttcgcttcggaaggggtcagtgggaaaattggggaggcggggggaatggccaagcgaagggaaatggccctaattaagggaattagtggcgcaagggaaaataatgaccaaaaataaataaaaatgtccggcattttcagatgcgcaaaggcagcaagaaatggcaaatgagcaggcgcagaaaaaggagtgaaagggacggcggcgaagtgggagaagcaaaagaataatcattttaagaaagaaaggatgtaaagtgacatgacccttttgatcagagaatgttgcacctttacccaaccgaattgataaaatgtaaatgaaaatacggcaaatgactaaagttcgacctgaatacaggtctggatttttggccaggaaatcgaggtccaacaattggggagtggttttgtgtgtaccagctttaattgaaaaaaggacgaatgcatttagaacatttttatgtgtctacgaattacatacgttgaagcttgtcaaaacttacgcgaaagagaggaataaa

SEQ ID NO: 74529 - DNA, 1389 bp, Heterodera glycines
  Genomic contig location: Contig_ID=SeqID_11183; Location=46..1434; Strand=+
  SCN-specific regions: Sequence locations=1-266,293-358,390-653,680 -810,833-1389
  Gene Ontology: Mol. function=CAAX-protein geranylgeranyltransferase activity; Cellular component=CAAX-protein geranylgeranyltransferase complex; Biological process=C-terminal protein geranylgeranylation
gtctttcgccctcccgtcgttgcggtggcttccgcggctgcgtcctttccgtcccttccgccggcctttgtccctacgagtcggcccatctcgcccaaacgtacacttccctctgcattttgctcattctcggcgatgacttttcccgtttggatcgtcgcgccattctccgcgcagtcgccgattcgcaaggggcggatggaaggtggcatttttggaaggggcgggggtttggtatggacaaaaaaaagcaacggaacttcgaaagaataatttttaaataaaaatgtttggtttcaaattccattttccgttttcagcttttttgacggcgatcgaagcaatgaaaacgatatgcgctttctatattgtgcctgtgctatttgttaccttctcgacgatttctcgccaattagtccgtcccaaattaccctttggaattttctcatccaatttcccgatttgttcagacattccctctctgttggactttgtccgtcgttccgtcagttacgacggtggcattgcccaagggccgtccctcgaaagccatggcgggtccactttctgtgccgtctccgccctgttgctgaccggccacctttgggacggctccgtgttggacagtgccaaaatggaacggctgaaaaagtgggcactgatgaagcaggaggagggcttccacggccgaaccaataaattggacgactcgtgctacgctttttgggtgggcgctacactttcggttcgttcgaactcattcattatcatcaaattaaattacatacattttgaaggagcgctgctggccatcccaccttttccccctttccctgaaataccgaaatttgaatttagctatggatacatccttaacttaattaaatttaaaaaaaaccctggtgggtctaaaaatgtcttcgtctgttgcgtgggtggaggcgttacaaataaataaaaatttgcatgattctgctgctactatacttttatgtttattgtgcattttcagatgctcaacgccctccccttggtggattggcccgttttgcgttcttttctgctccgtgttcaggacgcgaccatcggcggctttcgccgggacgacgactcggcccactccgaccttttgcacacgtatttctcattggctgcgctcggaattttcggcgaaccgcccattcgtccgctgttcgttccgctgaacatttccgcacggacctacgaacattggcaacggattcgacgccaatggcacgacggaacggcgacgggggaggaaaagcaggaaagaagaaaatgaacgggggaaaagcggcgccaaagaccgaccgattgactgctttgttttcacccgaatgtcttaagattgagtccaatttctactga

SEQ ID NO: 74530 - DNA, 787 bp, Heterodera glycines
  Genomic contig location: Contig_ID=SeqID_11184; Location=93..879; Strand=-
  SCN-specific regions: Sequence locations=1-131,153-251,283-651,674-787
atgccattggtgttcgaccggccatggcaaccaccgatttcgttggtgccaaaccctcccccagcctatttcgtgatccctgcaaatgtgccattggagcggcccatttacgatcaaaatgatagtgccattgaggacgaattggcggaggaagcgaaggcgaagcgagcgcaaacgttcgtccgattcggcaaaagggcacaaacatttgtgcggttcggaaagcgggcacaaacattcgttcgcttcggaaggggtcagtgggaaaattggggaggcaaagggaggcggggggaatggccaagcgaagggaagggaaatggccctaattaagggaattagtggcgcaagggaaaatgatgaccaaaaatacaaaaataaataaaaatgtccggcattttcagatgcgcaaaggcagcaagaaatggcaaatgagcaggcgcagaaaaaggagtgaaagggacggcggcgaagtgggagaagcaaaagaataatcatttgaaagaagaaaggatgaaaagtgacatgacccttttgatcagagaatgttgcacctttacccaaccgaattgataaaatgtaaatgaaaatacggcaaatgactaaagttcgacctgaatacaggtctggatttttggccaggaaatcgaggtccaacaattggggagtggttttgtgtgtaccagctttaattgaaaaaaggacgaatgcatttagaacatttttatgtgtctacgaattacatacattgaagctggtcaaaacttacgcgaaagagaggaataaa

SEQ ID NO: 74531 - DNA, 57 bp, Heterodera glycines; identical to SEQ ID NO: 56798
  Genomic contig location: Contig_ID=SeqID_11184; Location=2096..2152; Strand=-
  SCN-specific regions: Sequence locations=49-57

SEQ ID NO: 74532 - DNA, 664 bp, Heterodera glycines
  Genomic contig location: Contig_ID=SeqID_11186; Location=28..691; Strand=+
  SCN-specific regions: Sequence locations=1-86,120-201,223-282,317 -491,513-664
atgaacaaaagctacaattatagtagttatttacaaaagtctttcatcttttttttgcttaatttttcaatatttctttatgtaagtatttttaaaattaatttaaaaatatttttattcaaattcattatcagtaaatttttccagctaaatttacttttcttcctttattgtttttcttattttttaagaatttggtgtaaaataatttaaaatttcaatataagtccctatttttctcttgcgttgcctaacgacagaccaacaccgctggcctatgatttttcataatttttaaattaaagacaaaaaattagttatttttttgttaatctgttcacaaattcccccccggaggtgtctgtcagcaccactagatcacaacattcctttaaaaatttcaggatctagtcaaaaaaaaagaaacgacaaaataccagaagaacgtgaatgcagatttattccgcccattggtggacattcgtgacaaaattttgtatttggcaatcaaatattttgggatcgacaaaacggaaaatgaaggaaattgttcaatggtgcagaagtcgaacagcttgaatcttaagaaacgcatcaatgatgaattcaaaaaattaattcgaaccacaagcgacaaagtttaatatatataaatagtcaatca

SEQ ID NO: 74533 - DNA, 1358 bp, Heterodera glycines
  Genomic contig location: Contig_ID=SeqID_11186; Location=1170..2527; Strand=+
  SCN-specific regions: Sequence locations=1-16,38-752,782-1358
atgaagaagcttgtacagaaagcaatgtgtgtgtatgcttcaattgagggcgcaatgcaaaaaagtgagaaggaaaaattgaacaaaatgctaaacaaagaaaaagaagcgaacaaaaacaaagaaaatattcaacgaattggtgaagaagtggaccaagaagttgaagcgagaagaaaggcactgatcaaacaggaaaatgtgagagaatatcacattgatcagctgctgcttgatcaacaacacgctgtagctgatcaccagccgcaacagcaaccgttggcggtgatggagcaaggcgaatcatcggcaattaaagaaattgttgctgttggagaagacggagcagggaaaaaggtaaaagaattcaacaacttgttcagttgagctatagaagcgcgtcgttgagcagcggaagtgttggctaaaggacctttttgggcgtaggagccaattggagttggggacaaattactgaagcttcggggttctccatatattcattcccgaaggaaaggccccaaggggtgattaggcccagggatcccatccaactcttgatggataaatagggaagactaaactgataacagcttgaatggcgaacattaaatgcatgtgtgaaatgaaatgtgatcgataatgattggtcgcaaaaggagcggataaacaaagatatgaaattctaaataagtaaaaattctagggcttcggcaagtataaaacaagaattgaggccctcacttaaacgttcaaaacttttaattttgaaaagattaaaattaaatattcttctgcttatttttaattccatgaagccaaattaagacttttgcgagtttttaagggtatttttgtgaattttccagtcagattgaaagaattgtaaggaaaaaaccaaatgctagcatgagtgattataaacgagagattaagcgcagacaatgccaataaacacatgtgcttcggggtgtaatctttaaaattcgaaaaactgtgattttttaaatacggacttcaaataaataaattgttctgaaaaatgattgaagaattattattaggctaatcaagcactgatcactgaacaacagcaaactgaaaatgttcaggcccaagccgaacaaaattcaaatggaaagaagaaattacatcgtcggaatacgttaaaagatatttttgaggaaacgaaaagtgatgaacacattgttgatcagaatttgagcagtaaacgatcggactcaatcaaaagcgaagcgattagccaagaattgaccaaggaaacgaacaagccagaaaatgagagatccaattcattgcgtatgaaattagtagaaaccgtggacacaaaatgctaa

SEQ ID NO: 74534 - DNA, 353 bp, Heterodera glycines
  misc_feature (50)..(50): n is a, c, g, or t
  misc_feature (57)..(59): n is a, c, g, or t
  misc_feature (62)..(62): n is a, c, g, or t
  misc_feature (65)..(65): n is a, c, g, or t
  misc_feature (68)..(68): n is a, c, g, or t
  misc_feature (92)..(92): n is a, c, g, or t
  misc_feature (101)..(101): n is a, c, g, or t
  misc_feature (106)..(106): n is a, c, g, or t
  Genomic contig location: Contig_ID=SeqID_11186; Location=4298..4650; Strand=-
  SCN-specific regions: Sequence locations=1-20,42-212,234-235,257 -265,288-353
attgagtgggcagtttggtcagaaagtcactgtcttcagagtcgaaatgngcagagnnnggnatnagnattggccatgtgcccataaacggncccaagggnaaagncaattaagaaaggaataatcaaatccatttaatctcttaaggtgtccatgttcaaaatgtgcccaactcggaaagtgtgatttctatgcctggattggccggctcacacacccaatgaatgctgaaccgaaataacattgcttgaaattagatgatgaattgagaagattattattatttttgatatttatttgtagttggacatgaagtagttagtgaacactctttttataaataaattaaagca

SEQ ID NO: 74535 - DNA, 344 bp, Heterodera glycines
  Genomic contig location: Contig_ID=SeqID_11186; Location=2999..3342; Strand=+
  SCN-specific regions: Sequence locations=1-254,276-344
atgaacaagatcctttttttatttattgctctttttgttgtgcaaattattgccgcttatgagccaagttgcaaagtttgtgatcaaaaaaataataaattaacaaattttagtgccccgaaaatgaggagccgggccaaaagagttgcaacggatatgagccaagttgtgacaatccgaagccggagatttgcactgcgcgcttttgtgactgttcatgcgactgtgtgaaggaattgttccgcgacaaaacgaaaaaatgtgtgcccaaatgtccgtattgaggaaggaaattgatactaacgatgtaatgatatcaaattatttaatcattcattaatcta

SEQ ID NO: 74536 - DNA, 1200 bp, Heterodera glycines
  Genomic contig location: Contig_ID=SeqID_1573; Location=655..1854; Strand=-
  SCN-specific regions: Sequence locations=1-296,337-394,459-479,501 -522,545-619,642-718,741-751,774-947,969-1090,1113-1149,1172 -1174,1196-1200
atgcgccagagaaagccagaaagtacaccacggccaaataagctgccaaacgccccggataaatacagacctgtgaatgcagccccggacaaccatgatcagataaaactttccgctggacagctcggcccgacaaaatggattcccaagcaaactaaaaagaaaactctcggcaaaccgttagcaaataatgcgcattgaaaacctgtcaaatttcgagcctaaaaaattatgccccttaaaaatgcagataaagtcaacatcatttcgactatgtgaattaattagtcccatgattatttttaaaggtgttaataaataaaatggaatttaatgaaagccaaaacaacaacaacggaaacgcaagggaaggacatgtcgatctggcattggcagaagcaaatgaaggccaagcggaggaggaagtgaatgaagtggaagaagaagaagaggaagaacagcagattggatattagtgtatttaaagcattccccataagagtgtctaaggggatgggaccatccccataagagtgtttaaggggatgggaccatccctataagagtgtttaaggggatgggatccatccccataagagtgtctaaggggatgggaccatccccataagagtgtttaaggggatgggagccatccccataagagtgtttaaagggatgggagccatccccataagagtgtttaaagggatgggatccatccccataagagtgtttaaggggacgaccaccatccccataagagtgtttaaggggatgtgatccatccccataagagtgtctatggggatgggattggttatggtaccatccacctaaacagtattatgtggattgtttggccatccctctagcaaacggtatggggatggtggccatccctctagcaaacggtatggggatggtggcaatccctctagcaaacggtatggggatggtgtccatcataggattcatcactatacgcagggattctgaggctttcccgaagaagtaaacgaaatctgatttcagattcgtgatcagcgtcctaaataacctctaaagacatatttctggaagtttttgggcgaaaaaatgtccccactcgaaaaccatgtgcacccccctttggtcccgaattcaaaaatcacttttatttttataactttttactaaaaaatgataaaaacatgaaataaa

SEQ ID NO: 74537 - DNA, 1059 bp, Heterodera glycines
  Genomic contig location: Contig_ID=SeqID_1574; Location=238..1296; Strand=-
  SCN-specific regions: Sequence locations=1-13,35-279,301-425,447 -504,526-532,554-683,710-711,733-968,990-1020,1048-1059
atgcgtttggtgattttgatgggccaaatgcaacggctggccaagttttgtccaaatggttgcacattccgaggaaagatggggtgccgaagcaattgcgttgcaaagattttaacgaacaagcggactttggttgggtcaacattttaaaggaggtggccaccagggatgggctttcgcgtttcgcattttattttccgatttggggaaaaattgccgattgattttttaatttccattgcttttaagaatttacccgtgccaccatttcttccgtcatctaccaattcattttactgttcatgcgccgtcaatgccaattatgccatttgaatttgtcatgactagggcctgtattatatggaaatccatatttttttcctggactgtgggaagcctgaaacgcacgaaaaacatgtttttagctcggttgaagcttcttggattggtttctatatccatatttttccatatttggcgatttatgtccatatttccatattttggcatttaagtccatattttatgtccatattttggcatttttccaaaaaacctctattagaacggcccccatcaactaaattgggattttgacctcaaatcggaaaatttttcgaaaaaggcattttttatcaaaattttgtcgaaaatattgattaatgtatcgtgtttttttcttcaaaaataatttttaataatatatttagcaattcttgaaagttttactttgcatttagcgaatttgaagaaattttgagaaattatacccctaattttgaaaaatttatatccatattttttccattttatgtccatattttgagatttttgctattttatgtccatatttcgcgatttgttgtccatattttatggccatattttgcgattttatgtccatataattacaggccctagtcatgacggcgcttggtcttcaagtcgagggatatgcaggaaaattgatgaaaacatggaaaattcaaccgcagatttcaattagaatttatttactttaatgttttatttttgttgttatttgcacaattaaataaa

SEQ ID NO: 74538 - DNA, 492 bp, Heterodera glycines
  Genomic contig location: Contig_ID=SeqID_1574; Location=961..1452; Strand=+
  SCN-specific regions: Sequence locations=1-36,58-302,324-492
aattcaaatggcataattggcattgacggcgcatgaacagtaaaatgaattggtagatgacggaagaaatggtggcacgggtaaattcttaaaagcaatggaaattaaaaaatcaatcggcaatttttccccaaatcggaaaataaaatgcgaaacgcgaaagcccatccctggtggccacctcctttaaaatgttgacccaaccaaagtccgcttgttcgttaaaatctttgcaacgcaattgcttcggcaccccatctttcctcggaatgtgcaaccatttggacaaaacttggccagccgttgcatttggcccatcaaaatcaccaaacgcatagggcaacagaccaaatgaatcgattgaactcaactgattgagatcagtagaattgtcggtgaaatgagacaaagtccactcttgtagtagttttgttcacggtgttcagaatttgcttcgttttcactgttgttgttgcacataaacccgcgttt

SEQ ID NO: 74539 - DNA, 673 bp, Heterodera glycines
  misc_feature (569)..(569): n is a, c, g, or t
  misc_feature (629)..(629): n is a, c, g, or t
  misc_feature (670)..(670): n is a, c, g, or t
  Genomic contig location: Contig_ID=SeqID_11187; Location=811..1483; Strand=+
  SCN-specific regions: Sequence locations=1-319,341-673
  Gene Ontology: Mol. function=biotin carboxylase activity; Cellular component=cytosol; Biological process=nuclear membrane organization and biogenesis
atgattctacacgaggaagaaggcgaattggaggtcttacgtgacgaagaacaaatgtacaaaaggatggcccggggacgcaatgacaggggaatggtggcatgggaaatgcatctgtgcactccggatgcccccctcggacgaaaggtgatgatctgactccgtagtactatgtatgggcatcattcattaatttgggtagaccaaaattttcgcgatggcttccggggggggggaagtctgaggctgaatttgcaaggtgtaaactttgttatcacttgtttattcaatctcgtttgttatattcctctcagtttcaactttgcagttttctattttttattccatcccatcttttccagattgttttgattgccaatgacattaccttccaaatgggctctttctcaatgcgcgagcatcggttataccaaaaagttcgtgtcttttccctttgcttattacggtgcccactttaaggcaagtgaatacagtcggaagcatcaaatgccacgcatttatgtcgcagcaaattcgggcgctcgaattggttttgcatcggacgttanaaatcgcttgaaaattgtgtggaacgacgaagaaaggcccgaggacggcttcaatacctntcgatggattgtgggggagggaggaagcgacattctctccncca

SEQ ID NO: 74540 - DNA, 1628 bp, Heterodera glycines
  Genomic contig location: Contig_ID=SeqID_11188; Location=514..2141; Strand=+
  SCN-specific regions: Sequence locations=1-241,265-1405,1427 -1473,1496-1572,1594-1628
  Gene Ontology: Mol. function=acetyl-CoA carboxylase activity; Cellular component=chromosome; Biological process=mitosis
atgattaatctttccccattgaccaaagacgactatgcaagacttgtaaatactcacccaaccaaaagtgcctacgacccgaggacaattttggactctgacgacgaaggattgtttgaccgggggacttttgacgaaataatgagcggttgggcgaaaacgatcattgcgggaagagcccgtctacgtggcatttccgttggagtgattgctgttgagacaaggaccgtggagtgtgaattgccagccgacccagcaacacaggactcacaagcaagattggtccaacaagctggccaagtttggtaccccgactccgctttcaaggtcggtttggtgacagccgttaaacttattgttagtttcattgtcacattttgaagacatctgaggcgataaatgactttaaccgtgaggggcttccgctgattattcttgcaaacattcgtggattcagtggcggacaaaagggtatgcacagtgttggttgcatgcagtattatttttatattttacactttagacatgttcgaaatggtgcttaagttcggtgccaacattgtcgatgcacttcagacgtacactcaaccgattgtcgtttatttgcctccgtttggcgaacttcgtggcggtgcctgggcagttcttgataccaagatcaacccaacatgcattaccatgttggccgatccgaattgtcgtggcggtgttttggaggccagcggtattgtggagatcaaatttcgcgaaaaagacctgctcattctgctgagaaaatgcgacccgaaaattaaccaattggaagaatcactcgccactgcttcggacccaacagccaaaggacaacttcaagacgaatacaaaagacgtatagaaaaacttcttccgatttgccgcgcggccgctgtcaaattcgccgacttacacgacacaacggcgagaatgctccagaaaggagcaattcatgtgagcattgggtgtcacccaatcagctttaaaggtattgcgcttttaggacgaagtgccttggcaaaatgcgcgaaattacatgcacggattgatcagtgtccattcgaccaaacttcaaatggcacgccgttatttggatgcaattggtcgcggaacaacaaacgtttcggtggatgagctcgctattggcctgcaatgggtggatgaacacctccaaaaaaccgatgtgcaagtcaggcgagaagtgaaaccagaagaacgtggcacgaataactcgtcgaagaggacgcggttcatctattttgacgagcagatttccaagtacgctgatggagatgggttccgaaaggcactggctgccattcggcaaaaatcgctgcttgagcgactcactgcgttaagcaaagaggagcgtgaccaacttatattagtcttgtccgaaaaataatttttctttaattcccgcatatataattttccgttccaattttgtacctttgtattagttattactgtttttaaaattttattgtgacttaagaattctaagacattcccttttggtgtaatcctcctaacatatcttgcctttgacttaagcccaatgagtttatattttttgtcccaatggctgctataaatatttctgattgtggtga

SEQ ID NO: 74541 - DNA, 114 bp, Heterodera glycines
  Genomic contig location: Contig_ID=SeqID_11188; Location=3301..3414; Strand=+
  SCN-specific regions: Sequence locations=1-114
atgcgaggaatcgctagtaaattcctgtctaaattttccggtgccatcccccgtctcgacgaatttgctgactgtcgcttggccgacataattccaatcaccgaccaacacttc

SEQ ID NO: 74542 - DNA, 374 bp, Heterodera glycines
  Genomic contig location: Contig_ID=SeqID_11189; Location=59..432; Strand=-
  SCN-specific regions: Sequence locations=1-153,175-176,198-374
atggtaaaaacattgtggattgtcagacacgccgaaagagaagacaacataaactcgaattggcaaaaaaatgcgaaccctcaaaaattgaaatcggataacagtccattatcgtcgagaggcataaaacaggccacagaattggcagaaaggtaacaaatattctaattcattttatgaatagaaaaaacaggttttcgaatgtccaaatcgatcatatttttgcgtctccttttgagcggactgtgcaaacagcgacttttcttatctcacagaggaaaattccgatcaaagttgagcccggacttgcagaggtcaatcccttgtaggctttcaggtaatgcttcggaattggtgtcccgacgaaaaataaa

SEQ ID NO: 74543 - DNA, 1353 bp, Heterodera glycines
  Genomic contig location: Contig_ID=SeqID_11190; Location=6..1358; Strand=-
  SCN-specific regions: Sequence locations=1-528,550-994,1016-1353
atgggtctgagggcaccgacgcagttcgacgatttttcaaggaattttgatgtttatacggcggaatggcctgagaaaaagcgcatcagtgcgctggagagcaaagtgtatgggcgtgcagaacgtgcatttgaagccgcaaaagcgacccagccgtttcagtacgcgcttattcgtcgcgatatgcttaaccaactagaggaaaccgacgcaacacaactaaatgcgttcgacgaattgatgattggagtaaagcggggggcaaatgaaacgattgacgcattggcgaatcggatttctggcctagtacgcagagcttatgtgggattgggccaacatttgtgtgatgaatacgcgatcaaatttttgatccgcgcaatggcaagccctgagctggcattaaacctcgaacttgctcgcacgcaaggcatgaatctcaatcatttcgtctcacttgcagcgcgtgcggagtctacccaaaaagcagcaaagcgttttacgaaccccaacccgagaaatgttgatcgaatggacagctatgacagccatggcgtaccaaaccagcaaactcgaaatttttcgtcacgcccggccaacacttttcagcgtcagtacccaaattctttgaagtgctataattgtgatcagcctggacacatttcgcgtaactgtccgcgtaaccgacaaccattttcgccaccgcaaaatttcgaaaggcaaattgtgtcaaatttttcggcgactggtgctaaccgagttcctttaaaccatccatttggcaacaaccaaaaccaagatgttaagcaccataacccatcaagaaattttctccgtcaaaattgtgtgattgtacaagaagaagtgcctcatttgaatgtgcgcctcggaaaagtcgaccttgaccccgaagtcactgacttctttgacaaactcggtactgagtgcagtaaaaaggaagctgtggcatataccatcggaaaagttatggtaacgcgcctttttgtcagtgattttgagaccaatgccatgatggatggtggagcgcagacttcactaatcagtgcaacgttttttatcagttggtcatcgaaaagcatctgaatttgtgggaggcaggattttgcaattcgtgcccgaaaatctcggatgtaaacggcaaattgttggagtgccttggaacagtttcaattcccgtccaccgaaagggattgactgaaccaaaactgtgcactttcaacataacaaaagccccgattggtttcaatttgctgttgggaacggtacctttcgagacggttaagcccgaacggaaggacttttcgaagcacattgaatccgttttccaccgaataa

SEQ ID NO: 74544 - DNA, 1131 bp, Heterodera glycines
  Genomic contig location: Contig_ID=SeqID_11193; Location=1907..3037; Strand=+
  SCN-specific regions: Sequence locations=1-240,266-284,327-373,398 -491,582-742,774-946,1017-1109
atgccaaatattccatcacataaaatcagcttcagcatactaattgttgataatgaatttgctaatggaacaaaatattttttccattttcaatgtgctagccgtctaacaaacaatttttatttggaaaaaaaaatgggcgaaaaaaatgggcaaattgaatttatggacgaaatttgtgaggacaatttgtacagaattggcgtgatggtcactcaaaacacatcacttccgttacagtttcaaataaaagtaatttttgattacttaacatttggtaactgaaataaaaaataataaataaaaattgttgttttttttaattaccaaaagcaacagttcaataaatttccaattttgtcataaattttggaaaaataaaattttttaaaatttaccaatgtcattatttcattttaaatgatgctccaaataggaaaaaagcatgcttttcgaatttcgttgtcagggtacaattctggttgaaaaagttaaaaaaatattatttttttgaaaatttataagtaaaaacgaaattataattaaaaaaatgaaaatttatttaagaaaagaaaatatatcgccctacgaaaatgccctaatccgagaaacgaacgaaccgaagcgaatttgaaaataaactatgaattggtcgatttttaacgaatttcttcggtcgaattgccgagatattgacttgtgatggaaaatgcctacacaaaaagcaatgccaaaaagtgtcaaaatatttaaatctaattaatttttattttcattaatgaattaggacgtcgaattaatgagaaatccgatggggcaggaccaagcttgaaaagagaattaccacaaaatgaacaaaacgagataaaagttcccataataacgcaggatttgttagcaaacttcggcgggggtgaacaacaaaatgagcagcaaccgaatggagtaataaaaaaatatcgatttttaaaaaataattaaaattaattatttattaattatttataaaaaatttagccacgaagaaattttgttgaggctttaaatttgttgggcaattttgcgagtggtcatcaccagcaacatacagaagaagtgctgaactaaacttttaaaaaatgaattaaaaaa

SEQ ID NO: 74545 - DNA, 697 bp, Heterodera glycines
  Genomic contig location: Contig_ID=SeqID_11194; Location=9..705; Strand=-
  SCN-specific regions: Sequence locations=1-122,153-352,374-460,499 -511,581-632,661-697
atgaaagcaaatggacaaaatgggaggatgaagcgaacgattggcgaattcgtgatcagtggaatcaaattggcctttatatttatgatggtaggtaacatcgtggacgggtctcgattttcaaaaaattcaaatttatttatttatttttaggcttcgaataactcccggcccaagtgatcaatagaagtgaatgattgttgagaattgttcgaaatttatggaatattgacgtgatcataaaaattgttgttgtttattttcgttggaacgaccaatttggatttgtgttatgatgccgttaggatattttatggttttctgaagtgtaaaaattgttagcaaatatcagctcaattttaaaaattttcttggcgctaactattgtcatcacctgatttctgcgttaaaattttttcatttgaacggtcatttttcgtcactagaaattagggttcgagccccgcccccgtcacccccgcccccgccgggggcgggacaggttttttggcctcacccccgcccccgcccccgcgactcagacccccgcaacccccgcccccgtgaccttcacccccgcgggggggcgcgggggtgaaaatacacccctaagaatgtcatattcgtgggataaaggcaaaaaatttatacaattttgaatttttttaaccatcttgagtaatttttatgaaataaa

SEQ ID NO: 74546 - DNA, 389 bp, Heterodera glycines
  Genomic contig location: Contig_ID=SeqID_11195; Location=3..391; Strand=-
  SCN-specific regions: Sequence locations=1-72,98-389
atgtcagaccgcagaaaagaagcggaggaaaaaatggaaaaagcaatgtaaaattaaaatgctacatttcacaaatttaaattttaaaatttgttttcctttttttcagcttcatctctgctgactgttggctttgtgtcttcgatttgcttccgacttctcaacttggccttggaattgcgctgatcagtcaccgatttgacctttacatcgatgaacacttcaaaacgcgcaaatggacattgaaatctattcaaattgatcgaaaatttggaaagaatggcaccaagcaaatggaaattatcaatcactattggaaaccattgccaattccgcaaaatccgctgccaaagaaaatcgtcggattcaaagacatttcaatagagtaa

SEQ ID NO: 74547 - DNA, 738 bp, Heterodera glycines
  Genomic contig location: Contig_ID=SeqID_11195; Location=577..1314; Strand=-
  SCN-specific regions: Sequence locations=1-38,61-333,355-385,409 -582,604-738
atgtcagacaacggaaaagaagcggaaaaagagatggaaaaagcaatgtaaaattaaaatgccaatttttaattttgttttccctttttttcagcttcatctccgccgattgttggctttgtgttttcgatttgcttccggcttatcacttggcctcggaattgcattgatcagccaccgtttcgacttttacgtcgatgaacacttcaaaactgatcactttggatttgtgttatgccccttatgataaattcagtgatttcctgaaacttgaacatttccgaccaaacaaaaatgcactactttccagcagaatttgtttggggccaatattttggttttgcaaaaatgttataattttgggttggatgtctctgaacagacctaaaaatgtatttttgaaaatttgggattttcgaatccgggggttgggaatcgtcggatgtcagattggtggtcaaggcaatattttaggccccattttttcttcaaaaattcatataaaagacggagaaaaatggcattgactgtcactttttttttgtacaaatgttggttaatcagcaggcggcggcgccgtgcaaatgtttattttctttgcttttttagctcctccattttgtttctaaattatccaatcacttttttgtttaatttaaatagactaaaattagtttttttggttcacacaaaaagacgaaattgaccaactgaataattgtgtccgttttaaataaa

SEQ ID NO: 74548 - DNA, 863 bp, Heterodera glycines
  Genomic contig location: Contig_ID=SeqID_11196; Location=2437..3299; Strand=+
  SCN-specific regions: Sequence locations=1-230,252-404,485-863
atgattcataaccagcattgtaacggtgttcctcttgaacagcttactgctgaacaaattgatagaagccaaagaagagatttagcgcaatgttctacggatcctaaatctatatggcgagaagtattgtaaaattttaataaatcccaaatagaacattttagggatcagaccggtccagagaacatgatattgctgaggatattggggttgaagatacgactggaataccatttaattacccgaattggcagacagtacggagtgcatataaccgtagaagaaaaaatcatttaggggattcgttagacccctttaatgttcccgaaagtattttcaagtgaaagcactgaaaacagcatttctagccaagaaaatcaagggggtttaatttacttaaaaggaaatataaaatataactaataaataaatattaaattttaaaaccaaaataaattttaaaatcaaaatattaaaaattaatgaactcataatagttcaacatgttgctaccatgatgcgttctgttattaaatttgtttttaatcctataaatgaagatcaaagacaagaactatgtgaaacgtggttttacagatttagtaagatttatttctgatcaaaagtaatagcaaatataggtgatgcaccgattgaatatccagtaccgtttgattttgtttcttctgagtacggacccggtgaagttatcagtatattaggagatggtaattgcggttggcgagctgtctctgttgctatgactggaacagaatcaaatcacgccgaaatccgaagagatgtcattgagtatttgcaagagaccattaaccaaaattcttatacagaaaattcttggtggt

SEQ ID NO: 74549 - DNA, 861 bp, Heterodera glycines
  Genomic contig location: Contig_ID=SeqID_11198; Location=626..1486; Strand=-
  SCN-specific regions: Sequence locations=1-27,49-174,196-599,622-861
atgctgaagaattacgtcaacaagtacatgcaattcgactttgtgctgtatgcctatttctacgaagttcgtgtgaacagaagaaagtacgtccacttcttcccgtggcatgccaattggtggatgcacgagagcgaaacggcggacatcgcaacggtggaggtggcctaattaaattattgccaattttgggtgggccaaattgaatagtgccaatttagggctgggcccaatacattattgccaattcaggggtgagcctaattgaattattgccaatttagggctgggcccaataaattattgccaattcaggggtgagcctaattgaattattgccaatttaggggtgggcccaattaattgccaattttgggtgggccaaattaattgagaattttgggtgggccaaattaaactattgccaatttaggggtggcctcaattaattgacaattttgggtgggccaagttaaattagtgccaatttggtgcatcattgtgaaaattgctttgatgtagatccattaatcacccttttcagcttaacggcagtctttttccggagagtgggaccgctgaaataattgaggagacggtaaaaaataatgaaaaattacactaataagcagtggcttctaaatatttttgccgatttgggcattaattacacctttttgaaatacttaaatgcgcacatttttctttgcttagtccgaacagtatcgggatgaaaagtcatttctgaatctcggcacgccgctgttagtcggggaaagcgttgtgattcagggccaaatcgaccaaaatgcgacatccgtgcacttttatttgttgcacaatacctttgacaagaataaa

SEQ ID NO: 74550 - DNA, 585 bp, Heterodera glycines
  Genomic contig location: Contig_ID=SeqID_11198; Location=2049..2633; Strand=+
  SCN-specific regions: Sequence locations=1-97,119-320,344-360,383 -430,456-536,558-585
atgtcggctaattgtccgtggttcccacctcaattagtctcaattagtccccctttgtctctgcccctgctcgccgactctcaccaaatcatcggggctaaatttggtgccattctccgtcatggaaatttccatgacaaattcgccctttttgttgagcaaccgaaccgaaaattcctttgcttcttcgccaattcggaattgcactcgcaacattttgccaatttcaggtgttccttcaatggtaagctgcgaattgttagctgcaatccgacaatgcttgggaattcgtggcaaaacgtcggcgaaactcgctttggtcgctttatccggattttcagtgggatggaggaactttaaatggacggaaaagtggaaaaattattggaaaaatgccatccccagactcattcttattttggtgactcagaaattattttttaattttttttaaagcatttagttgaaaaattgttgattttaattagagccttatattttaggctctagcaatttccaaaataggtatgttataggctctaaaaaatccataaaagaggcactaaaattggaaaataggcacta

SEQ ID NO: 74551 - DNA, 523 bp, Heterodera glycines
  Genomic contig location: Contig_ID=SeqID_11199; Location=82..604; Strand=-
  SCN-specific regions: Sequence locations=1-201,252-283,315-467,498-523
atgaaccacaaaagcttgatcatctttgtatttttgactgcattttgcagtttttcttatcaaattgaacccgaaaagtaatttttgaaaaatatttttgtgaaattttattttgcaaatttagggtggtttatttgagtgatgcgactaaaaattatttcaatacggaatacaatgccatggaccaatgctttaagaaagaatcaaaacaaaagaaaattaattcatttttgttaaaattcaaaataatcggaaaatgcaataaagggtttgttttttaaggtttttaattaaaattataattaataatttaacctaattaacaatttagtatgctcatttgctaccccggagcattggacgccgaacaatcaaaattttcctttggaatggtcccagaaaagcaattccgaatccaaaatatagcgggggtaattcggacaaattgcacacaaaaatttgatcatttaaccaattaattaattaattaattgatttttaatgatgattaaaaaccaataaa

SEQ ID NO: 74552 - DNA, 1471 bp, Heterodera glycines
  Genomic contig location: Contig_ID=SeqID_11199; Location=1613..3083; Strand=-
  SCN-specific regions: Sequence locations=1-357,379-1257,1279 -1350,1373-1471
gtgtttccatcccgtgccatcttcccgcttctcgtcgtgacacttcgcttggcatttcggaaccgctcaacggcactttttcccccgcagaagtgtcaaatcgtgtcggattgtgcaaaagcgcacgcactcccaaactttcatctcaaatgaagtccttctcattggactgtgccgactttatgccggcatcgccgcccgtacagccgaaaaacggaggaatacggcacaaccattacagtaagttagcatgtaatactgtaccacacatcggcaaaattaatccaaaaaactcccaacgatgctttgggacttcaatttatgccacggcattttttaaaattttctacccaatgaataaatttttaaattaacaaatttgtttttaagtgcataagccgcccattcgttctgcacgggcggcgtttgtgagcagcggcggcgcacaaatggcaacaattgtccccggccaatttgagaggagggaaaagcggactgagtccgcttgcggcgccggtgccaatggttcggctgttgttgttggcactgtgagacggcagcgccgtcttccgcccgtccccacgcaaaaaaaggaaaacgcgcaaacggcgcccagcgaacagccgccgattcagcacacggcaaaatgtgaatttcaaatcaaagctgcaaattgaacagtttggtgtcgttttagtactcatcagcaggccgcaactgttgcacattgtcacccacgagtacgcttcgtccgaatgcgcacttcgcccgggcgaccgtttggtggtggtgtacaacggggacccggactggaagcacgggttcaaggtggtcaaacaaccaaaatgggcggcaacagtggtgtaaatgcccaattttatacagctcaatgatcggttggagcagctgatcacttttcccagcagttgtgtcgcttcgtataaagccgaggaacagccgatgcgattgttgcaaagctgcaatttgtccgatcaaaaattgcgcttgtacagggatcaggtgggaaaacgcctttttgaagattatttcaacatttaattaatgtaattaattgtccattagtcggctatttctttgacaataaaagtcaagttcaaaccttcgaataagtcatgacaactcgtacaaaaggtaactcgtacaattgcttaggttaggcctatgcttttggtttacgcttaagcctaagctttaggctaggcctaggcttagtgcttgagctaggctttattttgtaaaatataagttggtttttgtacgagttgactctgtaaaacagtgtacgagttgccttaaattcaagcgagaatctcgaaacattccatcatttgcccattttcaggttgtttttgcccagcccgactcattaagcaaagacggcaaagtgatggtcagaaatgaacacgacaaatttgccaaatgtcccctccaattcctttcattggcttga

SEQ ID NO: 74553 - DNA, 405 bp, Heterodera glycines
  Genomic contig location: Contig_ID=SeqID_11201; Location=27..431; Strand=-
  SCN-specific regions: Sequence locations=1-59,81-260,296-405
atgacaatgttcaaggaactgaccaatcgacaattggtcgccattgttatgttggcaatttcaaatctgtgcagcactgtggtggtcagttgcataggaccaatttacccgggcgaagctaaacgaagagggtcacttgagaattcacatgcaaaaagctaagaattacggcttcagaatgtcagaggctcaaatcggattggtctttggtttgttccaattggtgatgttcatttctgcacctcttcttggcaaatacgtaaatatttttttgtttttatttattgttattttactaattgaaaacaaattcagatgcatgtgattggctctaaatggatgtgcatcgctggccttcagatagccagtttggctgcaattgcatttgggtacgttgtttcttga

SEQ ID NO: 74554 - DNA, 356 bp, Heterodera glycines
  Genomic contig location: Contig_ID=SeqID_11202; Location=791..1146; Strand=+
  SCN-specific regions: Sequence locations=1-221,259-356
atgtgtgcaccacacgtctatttttttctggatggttattgcgctcggcggtaatttgaattttactctaaattttttttactaattttcagttgttatttccgttttgcatggcgtcattttgtcggctcccatttgaatgccttctgtaatggaggaagaaaaaaaaacaatgaactgagagattgtttgcttaaaaaagatgcactaatgtgataatcttaattttttattcatcataatatataatttaaaaaaccctaaaaaattcacttgccgtatgtacattgtgacagaataggcatgttaaatggaataattcagttataaaaaggtccatgtgcaattttatcgga

SEQ ID NO: 74555 - DNA, 327 bp, Heterodera glycines
  Genomic contig location: Contig_ID=SeqID_11202; Location=11..337; Strand=+
  SCN-specific regions: Sequence locations=1-182,205-239,287-298,320-327
gcaataagtatttcaaaactgaatggggttgcgctgttagtcaagaccgtgttagcattaaccaacaaattggggaagctgtcaaggctgaggtggactgtgaagcaatgtttggccaaaaggacgtggatttctcaaatgaaaacttcacaattgatatgttggaagtggaaacgaccactacgaccacgacgacgacgaccagcagacaattggaagttattaccacggcacaaccaaccacaactaccagcagcagcaccaccaccaccaccaccactaccacgaagccaacaattgaggaatcaacaaactcaacgaatgggg

SEQ ID NO: 74556 - DNA, 2015 bp, Heterodera glycines
  Genomic contig location: Contig_ID=SeqID_11203; Location=1346..3360; Strand=+
  SCN-specific regions: Sequence locations=1-40,112-312,361-451,473 -524,546-678,700-763,786-1165,1210-1371,1401-1429,1451-1795,1831-2015
atgccgaaacaaaaaactgtctatgaaggaggttttcatgtaatattataatttatatatttagaattacttaaagattataattaaaatatctaaattacttttttttttgcaactccattatctagttgcctatttataaaattaagtgcctacaaatccggtctctatttataaaaaagttattctataaattgataaaaataggattttttcatttattctatttttcatgactttggtattttttgtgactttttggcgattttttatgaagctctgaacttgctatttttaacagattttctattgatttttttaaaatataaattataaagatttaaaaataaattaaaattacagatcacggattacggaaaataccttgttttcgactcccccgtaattacgattaagaatttgcgtaattgaaaatccattttcatgcagccctgatttataagcataaaaataatttgcaaggtcaatttaggttttgtggaataaatcttgttttataatctatttccattttcttccatttagaatagattgttttatgtgtctggttgtccgaataactgtgtttgcggagagctaaccgaatttataacacttggggcgtgctgcgaccactcaaatgattgtgcttgttgttcaaccgtaataaatgctaatattatttttccacaaattttggcaaaatgttattgtcaacaatttttagatttttttacaaattaactagctgctaccttttatgatttttaatatataaatattttcagaattttagcacaaataaataaaaccatctgttatttaacaaattccggcaaaaagttattcaaaaagttgaaaaactttctgataataatgttacacccctgaacttggaagccttttatcttttttagccatttttattacttttttcttgttgaactaatttttagagattgaataaaaccctctatatgtaacatttacatacataatattcattttagcttcggagcacagagcgtccacctcaaaaacgttctgaaaataatattacacccatgaacttggaatcatttagtcttttttaggcatttttattgtcttttttgtttttgagcctaaacactaatgatttattattttttaggaactgaagaaaaccctctttatctaacatttacatatataactttcattttagtttcggagcaaacagcgtccatctcttccaaacgtacgtaattgatttaattttgctaattaaattacgttttattaaaaaaaagataatcacggagacaaaagaccacggagaagtcaaaggcacttgcagtaccagctacttcggtttagtatttgtggtttgaatatttaaattttttaaaacaattcttagatcttaaactaagtgagcaaatgaccaatttctacaaaaattttaaactcttgtttaggacgtacgcattgttcggatcaaagcaggaagactgcatgctatttacaaatcttgtctgcctaccgttacgaaaaaactgaaatcgaacaagatattctttcgagctactcaaactctggggttgatgagcgcaacaaatattggaataattggctaaacgcttttaaatgccattggatggaagggaagccggaatccgggtgttgtgcagaaaactataacttaattcgtcatactaaggtgctggctgtaatgatctcaaattttaaaatcgattcaagaataaaaaaatgtcttccaaaaagacagccggatacattgttaattgaaaatgaaaattttaaaatagattttataaagacattttttaattctttagttagctcatagtccggtacaacatcctcattgcgcgaagggaaaatgtttttattccggtgtttattgggtagtatatagcatgtttatttttgaatcacttaattggtttagatcatgcatcctatctcagaggctacatcaaaatcggtaagtacattaatatttcagttaa

SEQ ID NO: 74557 - DNA, 762 bp, Heterodera glycines
  misc_feature (199)..(199): n is a, c, g, or t
  Genomic contig location: Contig_ID=SeqID_11203; Location=3363..4124; Strand=-
  SCN-specific regions: Sequence locations=1-6,84-591,613-762
atggtcaattatttgaaatataaagtaactataaattttaagaactaaaaaaaattatatttatttaatttaacaataattttcgcaaggtttttgatcattgctttaaaaaaatttgctgacgaattgtccactgacggattatccactgacggattgtccatttactggacggattttcccttaactgacggattgntccattactgacggattttccttaactgacggattgtccatactgacggattgtccgctgacggatttttttacataatgttattcataacttggccccaaatgaaccaaatattgaaagccctatatgctttcttttatcctgcaaacaatttactgaaacttaacgaaactttttgaaattttgcagggtgatagaaaacacttagagcttgtaaaattatatcaagaattaagattattaaaatcaccaattctccgttcctaccgtatattgtttttcccaagtcatgcgcctattctccaattggctcagctattaacggaatgttttatttaatcttcttataacggggagtcaaacgattgattttttgtaaaaattaaaagtaaaatacataattcttctcaaaaagaaacctaagaaacaaaaaagaatactcttagaactgttttaaaatcgttaagctatcgtatgaaaaatactaaattatatagttatcaaaaagtttttcagttcataaaaaaggaatgaaacgtcattttttaaaagaagataataaa

SEQ ID NO: 74558 - DNA, 3722 bp, Heterodera glycines
  Genomic contig location: Contig_ID=SeqID_11204; Location=716..4437; Strand=+
  SCN-specific regions: Sequence locations=1-119,151-1251,1273 -1358,1381-1391,1413-2026,2048-2262,2284-2620,2643-2709,2759-3722
atgcaaaatcagcctcccaagcatccctctttgttttccattgaccaaattctatcggccccaagcaaaaagccgcgtcgcggcttcctcatcaatgaattgcttggagaggtgcttcaagagggcggcggcagcagcagctcatcatcatcaaagtctacaaaggaatacgtcaaaaagctggacagcaccattgagcatgtgccccgcttccaatacagcaaaattaagtcgcgattcagcattgaggatgtgccagcagcaaatcctgagggactcctggccggcatcttccagtactgccttgacgcagcgatggaggagagtcgtggacgtggaattgaacccacgcatctcggctgcatgatcagcagtccgttgctcaccggcggggacattcccatccccgttcgacaaatcacagacaacaccgtcaacaccatcctcaaccaattcaccaaagtggcacagagcaagcagcagcaaaacgtcacactgtggggcgagccattcactgtggtggtgaccacagttgaccgtactggactgcccggccgaagggtgctgaagggcggtgctcgacgaagcctagcaccagtgcatcatcgggtgacggaaacttgtttgattaaggtccaacatcacaacgcaagtataattttagtgacaattttgttaagatttgcaatccggacgggcattgcctcttctacgccttgcaggcgacaatggtggccaaaactagtggttggccccgttggaagttccatcgctatgtgcacagcctgcatggtcaacagggatgtctgaggcgggatgctttacaactgatgcagcaaattggtgtacggaccggtcggaacacctatgatgctgagatttgtgtgccgcgtgtggtcgatcactggaacaacacgcaacagcagcatcggtttgcagtgttcatctttggctcatcgggacaatacaagcccttgtacaaatacatcaacgatcattacgacactcccattgtgctctatttgaacaaccagcattttgatggtgtgcagaaattacatggcttgtttggacaaccctactgcctcgactgcgaaaagccttatgagcgtccgtcaaggcacctcaattcctgtaaggcgcgctgtttgctttgctcacgtgtcgggcctgcattcccttgtgttccattgggcggctttttccatcaatgtgcgggttgcaataaaaagtttcgcaataacgggtgcctccaacaccatttggcatccaacttttgcgcccagtcaaagcaatgcaaggactgcggcgttatatgggacacacgagtacataacagagatgggagaaaagtaaacattaaaaataaaataaaattttgtatttcttgctggatttagggtcacaaatgccacgagagctattgtcagctatgcaacacgtttcacaatcccgagcgggggtgcttcattcagcccattgagccaaaagagcaggacccgtaccacattgtggctttcgacttggaaaccatgcagcatcaaccagtggacccccagcagccagagaagagagagcaccagcccaacttcattgctgcccgagtcgcgtgccctgagtgcattgagagcggaaattggcggagggcaacagcgggctgccgattttgtggtccacatcgaactgtcgctttctgccagcgaccctttgaggacactcgtgtggacaaacgagtggtggcggacaacccactgcaggcgtttgtggattggctcatcttccaactaccagccaaatacgacacatacgcttactcacactttggcggacggttcgacatggttggttctggtctttcgcgagctattccggattgggttcaacccggagatgcttcgacgggtacacacaattatgaattgtgtccaaaaatttttcaaaatttcagggcaacaaaatgtatgagatgaaggtgcgcaagcagaagaggcgcaacccgaacattgtcttccgggactctttcaatttgatgccgtgcgcgctggctgcgctcatcccctcctacggcctggacgtcgaggacaagcccttctttccccatttggccaaccgacccgagaactacggccgtgagattcacccgacgcccgaagactacttggctaatggaatgatgcccagcaaaagacagaaatttgacgagtggtacgccgcgcatcgccatgagccctttaaattggatgaggcgttagcgaggtactgtaaaaatattttgctataacaataattttgttctcgattttcagttattgcaccaacgatgtggaaatattgatggcagctctggtcgcctttcgccgggaattcttcgaaatttcacggcgccaagactacgttgatgggattgacgacaaggagaaccacgacgggattgatgtgctgcgtgagtgcatgaccatcgcgggggcatgcatgcggcacttccgcaccaaccacctgcccgacgagcacttggccattgtgcccgagcgcggctatgacaacgcgcagaaccaaagcctgctcgccttgcgcttcttccactggtacgccaaggagcatggagtgcaagtgcagacagcccacgcggctgaaggagagaagcgcattgggccctactccttggatgagtggattgaggcggaacgacgcgcaattgaagtcaatggtaattgagttaattatttttcaccattattataaaatgggcaattttaaggctgcacgtggcacgggtgcaaaaagtgctacccaaacgacaacatgctgctccccagtgggaagactgcggggcaagtgcgcgaacgggattccaagcggatggaatttctgagagagaaggtcaaccgagtggacgtctacttggaatgcgaaatccatcggatgctggagaggagcaaggaaatgcgcaaggcatttgaagactatgtcgatgatggcccgctggtgatccgcgacgcgtttatgggagggcgaactggaccgctgaagctgctgcgcaaggctggaccgggagagaaaatctcctattatgacttcacatcgctctacccgtatataaagtgagcactgttaaatttgtaacaacttttaacattgttttctttacagcttcacaacccgttaccccattggcactcccaaagtgcatgtgttgaaccaggaagtggattggcgcagtgcagcggacaacccctaccctttggcattgctcaaagtgtgggttgtgcctccccgacgcgtcgacgtccccgttctgcctgtgaaagttggaaagcggctttgcttccccctgtgcatcacttgcgccaaagagcacccgacaggaggagtggacaacgactaccactgcgagcacaatgacagacagcgggggtgggtgatcacatgcacctccattgagctcaacgagacgcttgacgagggctacaccgtcacgagggtgttccgtgtcctcgagtatgagcaaagtgacgacaagctcttccgcccgtacatcgctgagtttatggcccagaagatccaggccagtgggtttgacaacagcatcagaggcgatgcggagaaggaacaacagtttgtgcgggagtgcgcagagcagttcgacatcaccatcgacccgaccaaaatggcggtcaacaaagggaagcggtccctggccaagctctgcttgaacaacttat

SEQ ID NO: 74559 - DNA, 747 bp, Heterodera glycines
  Genomic contig location: Contig_ID=SeqID_1576; Location=186..932; Strand=-
  SCN-specific regions: Sequence locations=1-124,148-357,384-605,627 -693,718-747
atggaaaatgagttgaaggagtcaagacacttaaacaagatcagcaaattggaacaacaaaatgtgcgtttcaattggcaaaaagttgttcaaaatttaaaactgttggcgaacttaagatagtgattttaaaattatttaaaaacaggggtggagattggtcggattgtcatatggcttgttgtttcgatattagtcctttctagtgcccagataagcacattttggcatttttccaggaatttcatagaaaaagtgaataaaaacgaaaaatacactcctaagaatcgtcccaaaattttcaaatatacccctaagaaatgaaaaaaaaagttttttttaaaaatcatttccaaaatttattattgtatttattttcttggcaagttgcaattgtgcgggcgaaattgggaattttgtgcataaagacactggatttttcatttttaacacctatttttgcacctattatgtaaataaatatgattttgagtgaaaaaaaacaaatttttatgacaaaaatatttagaaggaacttcgagaaaagataaagcactgtggattggtggcagagcttaatgtactacaggagaaagtggccaaaattggagaggaaaagcaaagggaaaaagaattgacaaaatacggtagaaattaccaaacattgctttagctgtattttttattgaatcgatttaaatttatattttttttaatgacccagtttcagtccatgctaatattaaa

SEQ ID NO: 74560 - DNA, 278 bp, Heterodera glycines
  Genomic contig location: Contig_ID=SeqID_1576; Location=2461..2738; Strand=+
  SCN-specific regions: Sequence locations=1-278
  Gene Ontology: Mol. function=transposase activity; Biological process= DNA transposition
atgttgcgttcttaacgcaacaaaaaattgagcaacttcgatgggcggttcttcctcatccaccatacagcccagacatcagcccgtgtgaccactatctgtttcgatctatggagcacttcttgagagggaaataatttgctgatcaaaacgaggtcgaaaatgcattggatgacttttttgtatcgaaaaatgatcagttttataaaaaggggattgaaatgttgcccgaacgatgggagaggatcattgatcaaaatggtgagtacatcattgat

SEQ ID NO: 74561 - DNA, 1804 bp, Heterodera glycines
  Genomic contig location: Contig_ID=SeqID_1576; Location=1658..3461; Strand=-
  SCN-specific regions: Sequence locations=1-90,151-644,667-1187,1210 -1264,1286-1359,1384-1524,1546-1684,1706-1804
atgtattcgattttgttgaacaacaattcctctcgtattttttactatgaaatttcgctcaaacatttgaaagggtgagagaatgtatagatttttaaatatataaagtgataaatacattaaaattatatttttaaaattagatttattgatttttcagttgggccttcttcggatttgccctaaggcagcagcaaacatcaaaagatgaaacaattcgatatagcacgggcacatatgcttatgaaaagaatggcgagctgtggattaacggaaaacgaaaggaaggaagtgatggatattcttacggtgtcggagatactgtcggaattggcgttaatttgtcgagtcgaaggatcattttcacgaagaatggacgacaattgggttggtaataaaaaaaaaaaagtttttttaatcatcatgccaaggattttttggtacaagataacggcgtgggaagagatcccacgcgggattaactggggtcccagtccgcaattcccgcagttccccgacgccatggggtgcctaattagtaattactgcattttaatttacaaaagagtccccctttgattttataaaatttaaaacccatttgattttaaggtcacgcctaatttccttctagcttctttctattgggttgatgaaaaagttctgaccctttaagcacttcaacattaaacaattttttatttcacaaaaaacaaatgttcaatcaatgatgtactcaccattttgatcaatgatcctctcccatcgttcgggcaacatttcaatcccctttttataaaactgatcatttttcgatacaaaaaagtcatccaatgcattttcgacctcgttttgatcagcaaattatttccctctcaagaagtgctccatagatcgaaacagatagtggtcacacgggctgatgtctgggctgtatggtggatgaggaagaaccgcccatcgaagttgctcaattttttgttgcgttaagaacgcaacatttaggcgaattttttccattttttgaaaatcgttcgattttgcaaaagtaatgactatacaacgaatgcaaatggccaaaagatggccaaccgtccgctgattcatcccccaattgcctgcctccctttttcaatctctttagaattaaatatcatttttttgcataatttgttttttcagagggtcagaactttttcatcaacccaataggaagaaaaacttggagcctggcttgtcggcaccgtctatcccttctttcccaaaaaacccaaaataattttcatttccttcaaatttcccgtgcttttttatttagataattctgagttgatggctacatcctcctgtgctgattgtttctttttccctttcgtcactttgagtttgaatggcgctggtgataaaattgaggccaactttggccccaacttcagatttgatttggtcactctttgaaggaagaaaatatcacttttgatcagctttattgattttttcctttttcttttcctcagtattttcataaaattattttacttaaatatttgatgaattatctcaaaatttggcattttgtcagtaggatttcgtatttgtctcaccaatccctaaacttatgggactgggaatcagggaaccggaattcaatccgattcggtcagattctcgatcccggcccggaaagcagttaatatgtgcattttgaccttttaatgaaagaaatgtataaaaaaaaatcaaaagaaagcggagcgaaaagataaggccaaattggacgacgaaatattggggaaagaataaa

SEQ ID NO: 74562 - DNA, 3010 bp, Heterodera glycines
  Genomic contig location: Contig_ID=SeqID_1576; Location=4785..7794; Strand=-
  SCN-specific regions: Sequence locations=1-127,149-518,540-742,766 -995,1017-1216,1290-1374,1396-1408,1430-2053,2077-2078,2100-2123,2178- 2802,2824-2878,2987-3010
atggaaaatgagttgaaggagtcaagacacttaaacaagatcagcaaattggaacaacaaaatgtgagtttcaattgccaaaaagttgttcaaaatttaaaactgttggcgaacttaagatagtgatttttgttgtgtccccgggtttaaggcttaaatacatttcaaatcatcattttaagagagaggaatttattataaggaaaagcattgacaaataattatgtgttaaaaaccgggaatatgtttaggtcaacaacaacctcagagcattttgggtgggtcagtgcaattggttatttgggaaggcataacacaaagggaataagagaaatggatggcatattcaacagaggggaaaaggaagaaatggcacgataacattggaaatgagagggataggattggcttgggatgggacgaacagagggacaagtttatgacggtattgggtcggggaaagtagggcaatttacattatgtacaaaatatgaaattttgaatgctgcggatacagcaattttaaaattatttaaaaacaggggtggaggagattggtcggattgtcatatggctacatgttgtttcgatattagtcatttctagtgaccagataagcacattttggcatttttccaggaatttcatagaaaaagtgaataacgaaaaatacactcctaaaaatcgtcccaatattttcaaatatactgaaatgaaaaaaaagcttttttaaaaatcatttccaaaatttattatttattttcttggcaagtttcaattgtgcgggcgaaattgggaattttgtgcataaagacactggatttttcattttttttgacacttattttcgcacctattatgtaaataaatatgattttgagtgaaaaaaaaaacaaatttttatgacaaaaatatttagaaggaacttcgagaaaagataaagcactgtggattggtggcagagcttaatgtactacatgagaaagtggccaaaattggagaggaaaagcaaagggaaaaagaattgacaaaatacggtagaaattaccaaacattgctttagctgtattttttattgaatcgatttaaatttttttaatgacccagtttcagtccatgctaatattaaaacaatttagaaaaaatcagcgaaatgattaagcatcagaagcaaagttcatcaaaaacaaaaacggaaaaaagtgatgagaaaaacaaatttattaaaatatagttttcatttataaaagttaaaaaatagaaaattaaaaatataaatattaatttatcatctttaagccccaatcgatgctttcgaggcaatttttggacgaatcggtgaagttgagaaaaagccggcgacaaaggggaaatatggaaaaagaatatacagtaggaaattaatttgccaaaaaatttacagtaggaaggaaattgctcaaaagtcccgttgctcgataaaaaattttttcttaagcacaagacacttggatgttcgagtcgacttcagcttttttccaaattctttccgattgggtcggtagggaaaaggcagcatcgtccgacaccaccgcgcaagtggaaattgaactcactgagcaaacattcgctgattgtcgggaagcaattaagggttttgtgcatcatttgatgtgtacaattagcataataatttgcttaattaaagcgctcggaattttttcgaacaccgaccccaaagtgctcctccgtcgttggcgctccggttaccgcaaacggcaccccgaagcaaccgcccaagtccaatgcggtgtgtttgtgatcgatggtgaacagatggacgagcaggaaaaacggacgtgtggtcagcgtcgggaggcacctgcaagattgggtctgccgggcgcttggattggaagggaatttgtgatcataagcagttcaattgcaattttggcattataatttggaaatttcacgcctaatagacacaaaatgccaaaatagtatgaaatgggctcaaagagcgaaaattctcctgcttttacgtacattatgaataggactgactgtcaattatattaaatatatttttttcctgtattctttcgggattttaacatatttggtagataattttatactttttagcactttttcttaaataaccatttaaaaaattttatttacttatttgatacatatttcgggatttttttttacatatttatgtttttgaccattttttgtacatatttttgacagcccgaattatgaacaataaatttttttgaacctaaaacgtcttatttttcaaatattcaaagaaaatatttttgctttctttaaacagttggtcaacggaaggaccaaaagacacttttggacagaatcgatgaattggaaggtcaactgaaatcactccagcggcaacaggaggacgagacgagcaaatacggtaaaggaatactgtaaatacaatatgcaacaaaacaaaaaaattacaaatttttagtttctgtcgaattattcaatgagatgcaaaaggatcataatgaacttttggagaaattcaatgcattggaaaagcaaatgaatgaactgcagcagaacaagacgaatgaatgttgttgggaaagtgttgggaccagcggcggatgtgcacggacgcagggacatttcacacggaagggggacttggtgaagggcaaggaacatctacagccacaggtcgaacgtggcgataatttgatttcagatagaatttaaaaagaaaattaaaaaacccaagaatttatttccggtataaatttgtttattattaggttataattttatgattttgcacatttttctgcgcatatgctttgaagaaagggactcaaaatagcatttctacattaaaattttttgatttaatgaaagttttctttaaaattgaaaaattttgaactttttataaaaaaaatttttttaatttaaatttattatataaaatataaaaattcggaaatgcatataaaaaaataaa

SEQ ID NO: 74563 - DNA, 881 bp, Heterodera glycines
  Genomic contig location: Contig_ID=SeqID_11205; Location=746..1626; Strand=+
  SCN-specific regions: Sequence locations=1-212,241-537,559-881
atggcattgctttccgaccgtttcgatgttttggtggacaaacatttcgatggaaaaagcgaattgacaatttggagagcaatcgcaattcgcaaggacaaaggaccaaaagcgaaactgtctgttctgatcgatgacaaatgcgtggcatttccatttcccgaccatccgttgcccaacaaaatccgttttaaggaccttcagatttagtaaatcaaaaaatatacagaaaaccaatcttcatttttccccttttcagttacgttgaccattctgtgctcgcatttcttcgttccaacaagcaaatttgggacagaagtggcatcaaattggatttgtttctgcctttatatatgaccgacgtcaagctcatttgggatgtttttacccgcgaaatttggccactttttgcgaaaagcattcggcatttgagctttcatgccgataatttggaaaatttgcgtcgccgcatttcaccgacacttctcactgatcttgatcaattgtattcaattgattctggtgctctattccccgatggaattgctgatgatgggccaaatgcaactgctggccaagcgttgtccaaatggttgcacactccgagcaaaaatggccaaccgaagcaattgcatcgcaataattattttggtccaccaaagctggaatgggtcaacaacttcaaagaggtgtgtctagccatattttctataaattcagtttaagggtagtatgcaatacgttccatgtaaaaaaacaaattgtttagtttttttccattttttatttagacatttcgccgtgccaccacttctgtcagttacacaattcaactttatattattgtggaaccaatgccaattgaccatttgaattggtga

SEQ ID NO: 74564 - DNA, 415 bp, Heterodera glycines
  Genomic contig location: Contig_ID=SeqID_11206; Location=474..888; Strand=-
  SCN-specific regions: Sequence locations=1-101,123-137,163-259,285-415
atgtccaactgctataagtgggaagactgcgaaaattcgggtgccaatgccaatttgaaccatatccgatttgatctgtggagtttcgataaatccattgggtgagcagcaaaaacagcaatttttgattttgtcgaaaataaaaagaattaattaattttaggccattgtcgccaccagcggaagaagaaaaagaagaagaagcggatcaaagcaacaatgaaatgttctcgacgactcccgggccaagtggatcagcggaatgaataatttattgtatttgtgaagatgtcgtctaattgcgtggaaatgaattaattatttttgagaaatgatcgatctcgccaataggaaacggattttatgccatcatttctctttgaaatgcttttgttgattctttcgttcgaataaa

SEQ ID NO: 74565 - DNA, 960 bp, Heterodera glycines
  Genomic contig location: Contig_ID=SeqID_11206; Location=1551..2510; Strand=+
  SCN-specific regions: Sequence locations=1-621,643-850,873-960
atggttgcacacgccgagcaaagatggacaaccaaagcgattgcgtttccgtgcttatgtgggcccacgaaatctcgaatggctcaacaatttccgagaggtgatcactgatcagccatattttcattaaacgacgactaattgatttaattgtccttgattttgacgagcagacaacggaaaatccacaaaattgccaccaatcgatacattgccatcgattagtaaagacattttctgttctggtccattatcgtttgcttttggtacttcgtccttgccaattctgatcatcctccaaattaccaaattggatttgtatgtgcctttatatatgaccgaaacttgggatgtttttgcccgtcacatttggccaatttttgcgacaagcattcgccatttgagctttgccgatggcgatgatttggataatttgcgtcgtttggtttcccctacaattctcactgattgcgaccaattcaaaatcaaacttctggccaggcattgtccaaatggttgcacactccgacaactgatggtcaaccgaagagattgtttgcagtggttatttggatccaccaaaaattgattggatcaacaacttcaaagaggtgtctcgccatttttctcaaattttgtttttcccaattttgtttagacatttctccgtgccacctcttcggcagttacactgttcgaattatttttcgtgtgaaaccaatgccaattgcgccatttgaattgatgaacgaagtgacaaatgagaagctgacactgattaagggtggagcttttcgttggctgttgaaacggtgcccaattgttggggagacggcggcggtggttcagaaacagcagaagaaagacgagaaattggaccgtttgaacggagtctacttctgtctttacgatgccattttctcgactcccgggcacattgatcagcggaagaaaaagtga

SEQ ID NO: 74566 - DNA, 880 bp, Heterodera glycines
  Genomic contig location: Contig_ID=SeqID_11207; Location=84..963; Strand=-
  SCN-specific regions: Sequence locations=1-77,99-193,219-294,316 -347,380-385,417-431,481-738,760-880
atgtcacaacaaaagagcttttcctccaccgatgtgtgcttaaaacgaacagcgactcaaaacaaagaaacagaaaacaatgatgaagaagatgaaaaggagtcatcaggtcagttttaaaaggaggcgccataaattaatattttcaatttttgcatttttatttaaatttcagccagcaatttttgtgtccaattaataaaaaataataataatttcgaatatattttgaaatttgaagtagaacctgcgcttttttgaattggtttaatcttcaattagtttaggcattttattataattggttttaaattcgttttgccacattacttacccttttgagttgcatcatttttaaataaaagtttaactttgaatttctttcaatattaatttttaattctttttttttttttgcaatttacccacccattttttattaagtatttttcttaattttcgtttttttttttaattttacatcttttgaattgtgaaaaatgattcttttaaatagataaattttccgcataattttcttctttttttttttgcacttttgttattttattataattcattttcaaattctttgtgccaattcaggcccgaacactccgccgttgccccccgggctctccgcattctccttatccggcttttacgggcagcataggctgggctggagcaacaccagcagtttggccagcgtttggtcaccgcccgcaacgacggaacagcaggcagtgccaacatttagcttctttgaggccaatagtccgattggtggcggaacgccaagcatagaaaggggccaacaattgttgagggccgggaagagaagccccgactttgagggcattttaatgggtcgtaggag

SEQ ID NO: 74567 - DNA, 585 bp, Heterodera glycines
  Genomic contig location: Contig_ID=SeqID_11208; Location=1438..2022; Strand=-
  SCN-specific regions: Sequence locations=1-8,31-82,122-365,388 -407,430-585
atgcaaagaaaaattgacaataattccattcaaaattatgagcagagtaaggaagcggcggccactgctgctttaatgtaatggcattttcattttcacactttgttaaaatgccaaaaaacaattgttttctgttttttcagaaaaaaatacaacgaatcattcccggaggcaaactttcccgaaatggtaattactacctaattaattaattacccttttgtttgtagtttccgctctcgacgcctcaggcgcaaccattttccatggccaaacgttcgcttttggccaagaacgcgtcaaccaatgacctcacccaatacatcaatcctgtcctcgcaaagtaagttaaaacctaattaatcttaattaattaattaattaattcggtttgccacatttagtcgtcgtcgttcttctctgttctgcaccgctgtcgacccggcaatgaaacggctgcggcagcgcgaggcgtacaaaacggcaatgtgccaagtgggggctttcactgctttaggaaagaagcattggcttcgtttattttaatttaccttatttgtttaattatttggaataattaataaa

SEQ ID NO: 74568 - DNA, 1476 bp, Heterodera glycines
  Genomic contig location: Contig_ID=SeqID_11210; Location=35..1510; Strand=-
  SCN-specific regions: Sequence locations=1-255,277-286,308-311,333 -379,401-450,505-754,777-793,815-875,899-906,928-932,959-964,986 -1016,1038-1177,1225-1476
atgctgcgcttcagtgagccaaaattggctttggattcattttgtcattggattgtgccaattgaagcagaggacaaagggtcggcggatggaatatccaaatctgacgaaatgtccgaggaaatgcggcaaattgtcaaattttggatggcaattttaagcgcaaaaatgttttctcattgtagcaactggacagaaaatgagttaattatgctgagagacattggtgaatttcgaattaaaaattaattaatagggcttccttttttatgtaagaaaaatcgcgaaatatgtaaataaaagatgtataaatgctgacatatgtatgatatatgtataaaaaaaacccaaatatgtactaaaatacttagaatcaccttttagtatttaaataattaatttttggtccattttttttttgaaaaaacctatgttttagggtactttttcaaaaaaaaaaaattatattttttcacaaaatattttttttaattttcaaaaattctcaaaataagtacgaaaaatataagaaaaaatatgcaagaaaaaatgcgaaaaagtccaaaatatgtataaaaatatgtacatatgtaatatatgtagaaaaatcaccaaatatgtaaataaaagtcccaacttttgttcgcaaacacaaaaaaagaaagtgtttttcctactattcaaagcatggagaatccaggaaaaaatatgtatttacataaaaaaaggaagccatactaattaaattcaataaagctttgggctagaaaattaaaccataacatctatgatcaaaattttatttttattttttggttttaggtgtttttaattgaagttcaattttgtatttttttcttacaatttatagtctctatatttattttgtttaaaaatgtccaaaattatttgtaaaatttcatttagtaaccaacaaaatattttcactgaaaatatttttgtcggaaaataataaatttaggtgaaatgatccaaattgttgtgattagggctggaaatagaagcaaggaaaaaatcgacgttttgatgaaaaccgtccaatctgagtccgaatttgagaatatttacgcaaaattttccaactttttggtggcctgtcagcccgaacatcaacttatgctctccccgtgggacaaaattgtgcagaaatttccagtaaattttgaatttaaaaagataattttaaaaaatctttaatttaaagggcaaccaaaatgaatttggtaatcttttcgatgtacaaccatttgagcgaaaagcatccttcgaaatacccaaaagctctgaagcgtcggcatcgaattgtgccccaaaaaatagcaaaagaaaagtgtcgccaaaacgaaaagagcgaaaagggaccgaaggacattggtccggcatttgttcgttttgtcataaggcggaggtgctaattgccggcttttattgctctaatagggttgctatgacgaa

SEQ ID NO: 74569 - DNA, 409 bp, Heterodera glycines
  Genomic contig location: Contig_ID=SeqID_11211; Location=175..583; Strand=-
  SCN-specific regions: Sequence locations=1-146,181-215,237-409
atgaaaaatgtgcttccgtttctcattttgcttcttgcccaattttcttcttctgtatgccaaatcattcggaaatatgaccaaaacgtagaaacaattaacgaagcgacgcatcatttagcacaagttagcgacgaaaactttgcaattaaaaaatttaaatttttaattgttaaatttcgtaaagatttcaccgccgggcaattaccgaattataatttgggccaattttaaacaacaaaaatttgaatgtgaggaaaactcaattttctttaatgttcgacgattggaaaagcatgggaacgatgaaaacaataaaagtttgtatttccgctggacgacccttatttggcaattagagcaattgccaaaatggttttgggggtttttacactgttacaacggatga

SEQ ID NO: 74570 - DNA, 734 bp, Heterodera glycines
  Genomic contig location: Contig_ID=SeqID_11212; Location=2212..2945; Strand=+
  SCN-specific regions: Sequence locations=1-17,39-388,410-448,470 -545,578-685,707-734
atgaacattggcagtgtggggagctcggcgatgggctctcggacagccgaaatgcaccgtcgaatgctgcaaaggatgcgcatggacgcgtcgaatgtgccggaaaatcgagcatttaatacactggcacggggacttttccaagcctggtaagtgcaaaagagagcacagaaaagtgtcacttttatagaaatttcttagaattttcattaaaatcgatacaattttttcttcgttggtgccaatcagcacttccgacccatcaaatattcagaaacttacttaaaatccaaagattcaaatcaatcatgcatgatggaaaaaagaatcctaattaacacaagctgaacgtaactgcattttatcacagacaatccctgatcacggacaaccaaaaacgttgtgattcgcttgatccgtgatcatgtccactccgccctgaaattaattattttcacttgatttttctaactttaaaaccctatttaattgacccctttttgctaagagaaaagtccaaggcgattttttttctcttataatttattacacagatttaaaaagcatttatttttaaggctccgattcggcaatccgaatgccgtggtcgtttttgccgttctccaagggtcaatgcgccgtttcgatgagcgcgccgtcgaatatgagctgcagcgaatttctgattggcaagtgaaagttgtgcgcttatcgtcgaaagaggcctattcaaa

SEQ ID NO: 74571 - DNA, 537 bp, Heterodera glycines
  Genomic contig location: Contig_ID=SeqID_11213; Location=499..1035; Strand=+
  SCN-specific regions: Sequence locations=1-2,28-537
atggacaaagttttattaaaaatttattacggcctcaaatccccagcaagttatgcaggggtacaaaaaatattagctgaggcaaagaaagtaaatccaaaaattacacccgaagatgttaataaatttctcgaaaaacagagaacatacacgattcacaagcccataaggaaaagattaccaagactgaagacaatacccagttccaattctgatcacgttcatcagtgtcagcttttcttgggtccgttcattcaccaattcatatggcacaattggcgttgtaggagccaatggaaattgaacaatgtaagcggcggccaaagtggtggcacggagaaatgcccaaacaaaaagccaagttgatcaaatcaaacgagcgctggactcaaaggcaagcacggtcttgttcgattcccctcaatggaacggacatctcggctgcttggcaaaacattgtgacttttgaacagttgaacagttcatactcgtaaaattggtatgaacaaaaaaaaagtccaacattttagtataaaa

SEQ ID NO: 74572 - DNA, 293 bp, Heterodera glycines
  Genomic contig location: Contig_ID=SeqID_11213; Location=1070..1362; Strand=-
  SCN-specific regions: Sequence locations=1-72,96-240,269-293
atggtggatttaatttcaatattcctatacggtattatactgctatcaaaaatgggagagcgatttggtaactttaaatttataaaaaaataattctctaatatatcagctcaaaattttagaaaatgccgaatcaacataggcggcgtagcgcagttggtaaagggttggcttttgagccttgggccttatgagttcaattccccttgccttctgttagccgagactagaccgagctgtgccgcccaatttcttttttatttgttttaaaaaaatttcaacttcaaaataaa

SEQ ID NO: 74573 - DNA, 526 bp, Heterodera glycines
  Genomic contig location: Contig_ID=SeqID_11213; Location=1799..2324; Strand=-
  SCN-specific regions: Sequence locations=1-452,515-526
atggcgatagatttggaaaagtttttgttgttatccccctattcagatgtgttgtggttcagcaagatggtgattttcagtgggcagacttaagcatcttcggcgttggcacagtgatttaaaaagccgctttcttaattctttatcaaattattgcattctctcatataaagtttgccattataaaaaaaatattgaaagcgcagcagacaaagtttttattttgaagcgccatatgatttcagcgatcgttgattagaaatgaaaattctcaacagggtcaagtcgccttcaatcgtccacatgaaaattcattttaatttatcaacaataagaaatgattgacacagaaattaacgaatgttattttgacaaaattttcaacaaattttatgataaaatcaccgtgaatgctgttgaatattcgacttttttctttcatttgattattcattaaattaaatcattttaaattattaacggaattatatataatttcatataaaaattaaatcacttcaataaa

SEQ ID NO: 74574 - DNA, 91 bp, Heterodera glycines
  Genomic contig location: Contig_ID=SeqID_11215; Location=1376..1466; Strand=+
  SCN-specific regions: Sequence locations=1-91
atggatgccggattcgtaatcagcgaagatcattcatggcgtcgatcagccagaattgctccgatcgagttgcggaaatgccaaaaaaccg

SEQ ID NO: 74575 - DNA, 843 bp, Heterodera glycines
  Genomic contig location: Contig_ID=SeqID_11216; Location=615..1457; Strand=-
  SCN-specific regions: Sequence locations=1-843
atggcacttcgcaaagcacatcttccatcggcatctgctaggactcagttagcaagcaaatactttggcaattatcttgtggtttttcaggaccacaaccgcagcatctccagcgccggtatctgccaggactcagttagcaatcaaataatttggcaaaattatcttttggtttttcaggaccaaaaccgcagcatctccagcatctgcatctaaggggtcaaacaacaagcccaagcagcaaaagaattcggcctcggcatctgcttcaatgacatctgtgatgacgctgactcagttagcaatcaaataatttggcaaaattatcttttggtttttcaggaccaaaaccgcagcatctccagcatctgcatccaaggggtcaaacaacaagcccaagcagcaaaagaactcggcatctgcttcaatgacatctgtgatgaagcggactcagttagcaagcaaatactttggcaattatcttgtggtttttcaggaccacaaccgcagcatctccagcgccggtatctggtacgatggcatctgcgatgacgtttactgagttagcaatcaaataatttggcaaaattatcttttggtttttcaggaccaaaaccgcagcatctccagcatctgcatccaaggggtcaaacaacaagcccaagcagcaaaagaactcggcatctgcttcaatgacatctgtgatgaagcggactcagttagcaagcaaatactttggcaattatcttgtggtttttcaggaccacaaccgcagcatctccagcgccggtatctggtacgatggcatctgcgatgacgtttactgagttagcaatcaaataa

SEQ ID NO: 74576 - DNA, 1223 bp, Heterodera glycines
  Genomic contig location: Contig_ID=SeqID_11218; Location=913..2135; Strand=-
  SCN-specific regions: Sequence locations=1-8,32-212,237-485,508 -630,685-925,947-1223
  Gene Ontology: Mol. function=DNA binding; Cellular component=integral to membrane; Biological process=cell adhesion
aaaatgacaaaaaaaaatattattaattaatgtcattttggctgaaggaatgtggcagaaccaaaaatctcatggagaaggaacggtgcaacgttcactcgtgtcggcgtttgctgagtgcccattcggagggtaattagcaaattaatgattccgttttaattttcatcgtttgttcctttttgagagatttgcgaggaggagaaagagacgggccagtgccaaggccaattcccgcgctattggttcaacaccaagcagcagaagtgcgagcggttcgtttactcgggctgcaaagggaatcgaaaccaattcgaatcggaggaggagtgcaagcagttctgcatccccaattatcggcccgtcatcagtccgttttggcattctttttttaaattggccaaattgttttcacagcgtccggtgctgatttgatcagtccttttgcggaagacattggcggcgacgaacggtggcaaaacgacggcgaagagggggaggaagggacggacggagacggcggcacagcgacggactgcgaaatgagcgaatggtcgccgtggagcgaatgctcagtttcatgcggcagaggcaaacggagtcggcatcggagtgtaaaggtaaagcggcagagaaagagcggagagagatgacgagagacagagagagagagagagagagggaatagggagtcagagagaataggatgaggagcagggaaataagagtgtatatggataatagagaataggaagaggggaattatgtggattaggagagagagaaggaaaaaagaaaaagattggacctcatttaagtcgttgcctcaaaacggtggcaacaaatgtcccccgcgggaacaccgagtgcaggaaaggcactgcgaaatgcgcccgtgcggtaagtggattctttgctcgataatttctttggtattcctttgccttttagcgccgagcacatgccgagtgagtcgttggtcgatttggtcgccatgttcggtcagttgcggcattgggtaccaaacgcggaggcgacgagtgcatcgatacggactggtgagaggggagggggggagtgatcagaccgacaaactgatcaaaagggagaagagacctgctggtcaatttcgatctgacaagcaaacgtccattcagatcgaccccgatgatccgaattgccatgcccaagaactcgaacaacggcagtgccgaatgccatgt

SEQ ID NO: 74577 - DNA, 1423 bp, Heterodera glycines
  Genomic contig location: Contig_ID=SeqID_11219; Location=161..1583; Strand=-
  SCN-specific regions: Sequence locations=1-118,141-294,348-1199,1230 -1423
  Gene Ontology: Cellular component=extracellular space; Biological process=axon guidance
ttaacccatttcaccgatgttcttggcgcttctcattccaaacactaccgtttgtggcgttttggagacattgcgaggtgatactgtaggaagaggcaattaattaccattattaaaatggatgaattttctttgcttttagcgacggtttaaaagaaattgccgaatggggaaacacttacaaaggcgaggcggagatgaaagcgaatgcaagcgaagtgcggacaatcgtcaaaatgaagggcctttggtaccccggtgagtgggggaggggcacccgggggagggggaaaagccccccccccccggaggagcggcgcccggggggaggggagggccccgccgccagccttttcattgctttggcattttgttgcactttcttttgccgtctaagaagtacagggccgtaccaatggacactttcgcgtcaacaaataccaccacttggcctcgttggccgcgatgtttggtccaagccccgattggtgtgtcggcatctccgaggtcaacttgtgcttgcctgactgcagttgggtgcaggaacgcgcgtttgacttgcgtccgttcgacgcgggcactgacaacggatacacgtacatggtacggtagaagaatggggtggggatacggtgggaggggtgcactacgtctccccccccccccccgttttttttaatttcccaggggacgatgcggtgggggggggggtgaactgcccccagcatgtgggcaggggatgaagcacggaacagcaagtcaatcgaagggtttcagtcgccaaatgagccggcagagccgcgagtgccaatcgctgcgattaccactcgtgacgacccgcgctcgccgttctttgacgagcacagcgaagagattgcgccgctcgcccgattggtgctgagacggaagaatgttctcacggcacaatgccaatcggaagaagcctatcggcgcgaggcgttcaattcgacgaacacttcggaggacgaggaataccgggacagaagttggttggccagcggaggattcgacggtttttaagcgatcgatgcttttccatttgaggggagtgcgcggtcagccaatggggctcatggtcactgtgttctgcgacttgcggcaaaggcattcgaatgcgatccaggcacaaattagcaattaattgggcacttagagagagagacaattagcaaatgaatgagagagagagagagaggagagagagagagtgcgataatgacccaatggtggagaatctcgaattcagagtgttcgttttcccggtgaaggcgcaaatgttccattgccatcgacagaccaccgaacgtcaattttgcaatgcgaaacaaagcgaatgcggcgccgactcggacgcatttaattcgcgttgtttggtcagcggatgggacgactggacggaatg

SEQ ID NO: 74578 - DNA, 351 bp, Heterodera glycines
  Genomic contig location: Contig_ID=SeqID_11220; Location=329..679; Strand=-
  SCN-specific regions: Sequence locations=1-110,221-351
atgaacggtggttgttgggattatggtgattatgatgattctggtggtgattgtgtgtggggctttgaattaattgcatttgctgagcaaaaatttccaaaaaaaaacgctaaaattaaaaaattattttttaattaaattccatttttagattaattttaaaaatttacaaaaaaaaataattagaaataggcaattaataattttctaaaatttttatgagctagattaatgagtataattatttggtactttcggtgagaaatttataatttctccaaaattagtcaatgtgaatttggcgtaccgttcggttttatgacaaaaaaaaattgagtattatacaataaa

SEQ ID NO: 74579 - DNA, 1933 bp, Heterodera glycines
  Genomic contig location: Contig_ID=SeqID_11220; Location=709..2641; Strand=+
  SCN-specific regions: Sequence locations=1-54,82-172,320-351,382 -469,491-508,555-800,822-926,971-1077,1163-1179,1201-1221,1251 -1316,1361-1372,1395-1490,1617-1651,1713-1879,1901-1933
atgacgtcaccgtcgacattcagtgcggcacggctttttgccaaactgtccggcaacagcaaccaacaacagcagtccattgagcacaaaatggcggaacttcgagcagcatacgcaatacaaccagcacagacgccgacggtggcaaaaaggtggagtcaaaatgggagggaaattttcattaaattttaattagtttaattatagaatattaaaaaaattatttatttaaaaatttttgttatttgtaatatatgaaaatttgaattttcaactttcgaatttattaaaatatgaatttttaagttttaaattttttcattcatatggtcaaccatttttcatagatagattatttttaattattaaaaaaaaatttttgtcgatttatatggaaatttgaattttgaaaattttcgtattcctcaaaatgattgggaattttcattatcagcataccttattatatgaattttaatttcaattttttgttctaaatgcggcaaccatttttataaaagattaaagtttaattttttgaataaaaaattaatgatctgtttcctaaatatgccattgatgccattttaaaattccacaatattaacggatttaaattttaagtgctctcaaaaagaaatgttgggatgtagcgaatcggcggaatagaaaatggttgcttaatgaggagcaaatggattttgaaaaaaattgtgatccataaatgtaaagatagttaactgagaaaaaccagagtttatatactaattgcgtatcttaaaacagattttattccattccaattttcaaatcctttaaaattcttttaatttaaattgtttaagactcaataatttttaaacctttaaaactcaacaatttcaaatcttttaaaactcaattaatttcaaattcttttaaccctcaaattatttaaaatttgtttaattttcaaattctttaaaattttcatccttttataccattttcaagtgcatttaaagatattgaaaacaaagcatttcatcccatttactataagctttttgggaaactaaagtgtgcttaagcaaattgtttaaaatttttgtaattttatttgaattaaatatttttacaatgtaatttttatataattttttggaaaataaaaaattttaatggttacattgtcagattaaatgaaataaaaccaattaattcatttttagaaaactttccataataattttaataataaaaataaaattgtctctaattgaattgataccttattttagttctatgctcatatacaatttattttctatcaatcctaaattaaattaagaatatttatacatacaaaaatttaattaaagaaacattttttcagtggtgccaattccacccaaaataaatcgtcggcaccaccacctcgtcgacctggacgaacctcattgccaactccgtcactaggcgacatgcttgaactaccacaattgagtcagtttaaataaataattttcatttatttttattttttatattaaataggcacaagaaattgtaatatttagaaatttaatgaaaaataattaaattgtttaaatcaaaaaaattttaagtttaatttagtggggggagggcgtctgtattttaggaaatacggtaatattttattacctaaattatttaaattatagttttttaataaataaattttatttaaaggctctcgcagttgtgtaccgtcgagaagagcaagcacagtgactgcctgtttttcaccagccccatccctaatggatttggcatcgtctgccggacttttgtcgctgtcgccaagcggtactatttttaattttggaattcgtcattttaataaattctagatcctggatcctgagttttctggaaaaccccagaaaaaaattataccctaaaaaaacaa

SEQ ID NO: 74580 - DNA, 1226 bp, Heterodera glycines
  Genomic contig location: Contig_ID=SeqID_11221; Location=364..1589; Strand=+
  SCN-specific regions: Sequence locations=1-69,157-198,220-230,531 -716,875-889,945-1096,1119-1226
atgcggcgactgatgcgacgggcgagcgaagtaagcacatcaattttgtatcatctaaatatttgtatgtttatattaatattaatttatttaattattttcaaaatattctaaaccaaaaaacatatttttaattatcactatttttaaaataaagtttattcatgtgaatatttgtatattttgtatgaattcttaaaacaatttgaatttcaaaaaattacaaaccaaaaaaaatttaatttaattctcattattcttaatttaaaaaaatatttgttttattcgtgtaaataatttagttctttgtatgaattttttgaaataattttatttcaaaaattttaaaatgatttttaaatcaattttatttcgatatattttaataattattcatttctcagtatttttaataaaaaaatatttaattacatatttaattgattgcaatatttataattatttttgattgaaaaatattattttttttaaagttttaaaagatttaaaaattttttcatatatttttagaggcttcattggttgaaaatatcgctcagttggctgaaatttgtgaggccgtcactgacactcgtttggatggttcggaccatagtttggctgtctaccgactacttttggccaaattggaccaaaaaacgaatgtggaatggttcgagagtgttctggtgccagcggtgagcaaaaaataaaaataatttaattttgtaaaaataaatttaattattttttgcgaaataatttaatttaaaataaatgaattattttttttgggaataattgtttaattaatttaatttttttagatacataaatttaatttttttgagaaataatttaatttaacttatttcttagaattaacggctttaaataaaattgttatttatttgaatttttttatttaaaaattacaaatttaaggcattgcttgagcgcaatggcatcccagtcagcgagttgtccctgctgaccatgggcattttggtgtggcgctgcacgctgaacaacgcgcgcctgctatgcctcgttaacagcatgccacagcaacaaatgcatgaggatgggaacgcaactgccgcctcgtttgaggcgctaaagcgcgcagcaaacaaatataagtgtatgcaccatgtgttgaccattggccaacgacgaccgtccgctggcagcacgcacagctcatgctcaagctcaagtcgcag

SEQ ID NO: 74581 - DNA, 394 bp, Heterodera glycines
  Genomic contig location: Contig_ID=SeqID_11222; Location=758..1151; Strand=+
  SCN-specific regions: Sequence locations=1-163,185-223,245-394
atgtccggaattccaggtggaatgcgaaaccgccgatcccggtacaaaaaattgctatggtcgcattttggaccttatcttattttagaaattaatgactcatcagcatttttggttccaatcgataaccggaacactgagccgagagccgaaagaaagagtggggaagccctttacgcaattagggacaattgcataaataggcggtgaaggagggataatgaaatctgatatcccgggaattttggctccggaaatcaataaaatggagaaacataaaaattgcttcttttcagtgatggaagtcgatgaggaagacgacgataaaacgtttgactgggacgtcctgtgtgctgaggacctggatgaccacgaattttgtgccgtgttccgc

SEQ ID NO: 74582 - DNA, 385 bp, Heterodera glycines
  Genomic contig location: Contig_ID=SeqID_11224; Location=286..670; Strand=-
  SCN-specific regions: Sequence locations=1-36,60-385
atgagcaaatatttcatgtttaaacaaactttccaattaattaaatataaaggtaagtagtaaacaattaatactgaataagattttttttgctttcagagtcattttaattgtcgtcgaacaaatcatgaaacaacaaaacaagatggaataacaaaacagtgataagcttgcaaatttttaatcaaataagtaacttttccacatcttctttaatcttctgaatctgagacttcaactgagatccttcattttgaatgatcgaagttgcgatcacctaaaggaataagcgaacaagtaaattccctgtttacaagggagttcttcaaagtttaggattcgcagcgagtcttataaaaccctagatacataggtatttaataaa

SEQ ID NO: 74583 - DNA, 1210 bp, Heterodera glycines
  Genomic contig location: Contig_ID=SeqID_11225; Location=1379..2588; Strand=-
  SCN-specific regions: Sequence locations=1-223,245-582,605-678,700 -1210
atgaacaataaaatcgcttcctcctcatacccggcaaattcggcagcaccgcaaaacgattgtaagtccataagctggccaaaatgcaaacactgcaggtattggcgctcgcgcataaagccgggcaacggagaagcccaaccctcggcaagaacctaaggaaaagcgaaaagaaaatggaaaaacggagcaaagccaacccaaacgaattgacctggagccattggagatcaaccaaagaaagatgaactgctggacaaagaccgatcccattgagtaaacgacgccgagaaatgtcgtcgggaacgaaaagctggcggacggactgaccgcaaaattggaacatcgcctgtggaaatgggaattgtcggtggttagaatttgacagcggatttacattttctggcaaaacgtttcgctcgaagagaaactgtagcatttgctggaggcatttcgtctccgagtcgacgcccgagctcagcacgaggtcggcttgcagcggcacttcgtagtcgctgtccacgccggtaaagccgcgaattttgccggcgcgtgcttttttgtagagctctgaagtcaatgagaaatgaatacagacagacagtgagcgatgaattccgcacttttggggtcgcgtgcttcgcacacttcgattggcgtgtcaacaaatatttcgaaaaagggaatattttcctgaacaatctctgttttcagccttttacaaattcccactttgctgtgaattcggcgcgcctcttcgcgacccgcgcggaaaggcgaaatgaaagaggcgagcaccaccattcccaagtcgctgaacagtttggccacttcggccaccctccgaatgttctccgctcgttcttctgccgagaatcccaagttcttacacaatccgtgccgaatattgtccccgtccaatgcgtaagcgggaacgcccaacttaaactgaactcaatcatttctatttgaaaatgcgaacctgcacaagggccttctcaagtgcgaatgcaattgtcgttttgcctgcccccgaaaggccggtgaaccacaaagtgcagccgcgaaagcccgggaaacggcccaacgcattggcacgctcctcccgcgtcactttgtgctgttggaaggtcacatttgttgcaccactggcaatggcctaatggacagataataatcagtttcaaaacagagggaaattggaaataaa

SEQ ID NO: 74584 - DNA, 1290 bp, Heterodera glycines
  Genomic contig location: Contig_ID=SeqID_11225; Location=1306..2595; Strand=+
  SCN-specific regions: Sequence locations=1-584,606-679,702-1039,1061 -1290
  Gene Ontology: Mol. function=adenylylsulfate kinase activity; Cellular component=cell; Biological process=nucleotide metabolism
atggacaaatgctttaaggaaatgcttgcaatttccccagtgagttttattaaaatgtcttttgagccctcgttttatttccaatttccctctgttttgaaactgattattatctgtccattaggccattgccagtggtgcaacaaatgtgaccttccaacagcacaaagtgacgcgggaggagcgtgccaatgcgttgggccgtttcccgggctttcgcggctgcactttgtggttcaccggcctttcgggggcaggcaaaacgacaattgcattcgcacttgagaaggcccttgtgcaggttcgcattttcaaatagaaatgattgagttcagtttaagttgggcgttcccgcttacgcattggacggggacaatattcggcacggattgtgtaagaacttgggattctcggcagaagaacgagcggagaacattcggagggtggccgaagtggccaaactgttcagcgacttgggaatggtggtgctcgcctctttcatttcgcctttccgcgcgggtcgcgaagaggcgcgccgaattcacagcaaagtgggaatttgtaaaaggctgaaaacagagattgttcaggaaaatattccctttttcgaaatatttgttgacacgccaatcgaagtgtgcgaagcacgcgaccccaaaagtgcggaattcatcgctcactgtctgtctgtattcatttctcattgacttcagagctctacaaaaaagcacgcgccggcaaaattcgcggctttaccggcgtggacagcgactacgaagtgccgctgcaagccgacctcgtgctgagctcgggcgtcgactcggagacgaaatgcctccagcaaatgctacagtttctcttcgagcgaaacgttttgccagaaaatgtaaatccgctgtcaaattctaaccaccgacaattcccatttccacaggcgatgttccaattttgcggtcagtccgtccgccagcttttcgttcccgacgacatttctcggcgtcgtttactcaatgggatcggtctttgtccagcagttcatctttctttggttgatctccaatggctccaggtcaattcgtttgggttggctttgctccgtttttccattttcttttcgcttttccttaggttcttgccgagggttgggcttctccgttgcccggctttatgcgcgagcgccaatacctgcagtgtttgcattttggccagcttatggacttacaatcgttttgcggtgctgccgaatttgccgggtatgaggaggaagcgattttattgttcatgcgttag

SEQ ID NO: 74585 - DNA, 349 bp, Heterodera glycines
  Genomic contig location: Contig_ID=SeqID_1577; Location=3073..3421; Strand=+
  SCN-specific regions: Sequence locations=1-85,107-349
taaaggtattgactttgggaaattttgccctaaataaattatatcattgtccttcactttcacaagttcaagtgggtagaaacgttcattgccattcttgtgtttttcgatcacgcaaggattgcttgaatagcgaagacaaatgcggtgccgtacataaaaatgctggtcgacggtcacattcttgaaaccattgtaagccatttgcttacgggcactttctcttgtaattccaccgtactcaaaatctttgtattcatctagttgatttttgtatgttgtctgtagagtttttcctttgaggtatttttcaactttttgaatctcatccgggtgatttaagcagtcg

SEQ ID NO: 74586 - DNA, 1754 bp, Heterodera glycines
  Genomic contig location: Contig_ID=SeqID_1577; Location=1262..3015; Strand=+
  SCN-specific regions: Sequence locations=1-191,214-445,467-688,710 -843,865-1093,1181-1188,1211-1270,1292-1370,1392-1690,1734-1754
  Gene Ontology: Mol. function=general RNA polymerase II transcription factor activity; Cellular component=transcription factor complex; Biological process=transcription from Pol I promoter
ttcatttttcaaatgcttttttaacgcaaaacaaaacaaaaacatttatatttttcaaatgcatttttaacgcaaaacaaatacaaaacgccatacaagtagttactccccccctttttggcccttaattttcagccccgccatttcagtcccagtggaaagggacatttcagtaccagatttaaaccttaaaaaacacctataataaatatatccaatcccagaagaggtaaataagtgaaaaaacatctgaaggataaaacccaaggctaaatcctattagagaaggaaagggaggcagaggataggcgtcagctgtcatgccttataaggaagggaagggacgcatgccacctgagcgcccgcgtgtgtgccatttaaacgctcgcgtatgccatttgagccccagagttattttttacagtgcaaccatttgagccccagagttatttttacagtgcagccatttgagtcccagagttattttttaagtttagccatttcactcccagtgcccacgggacacttcagtcccgagacccaaagcctattgagtagccaaagtctacggagggtcattaacattccttttaagtgcattttgaccaacgcagggccgacggagggtcattaatcattcttttgagtgcatttttgccgaagcctaagcctacggagggtcattaatcattcctttgagtgcatttctaactaatgcctccgaaagtgtcataaatatccccttaggaaatgtggagtctgttgtactaaaagccaactgagcgccattaaccattcttttgtgaacatgtctgtccaatcgaagctagtggtcattaattatcccttgggaattctttttgtgcatttctgaccgagtcaaaaccaatggaatggtcattaataaccccttggacgcattttgactgtataatgcccacggaagtgtcggtaatataccactggaaatagaggtcaagctgtgagtcaatgattaattgtgacagttgtgcctatgcaaaacccaacatcagatattctgtgcttgagacagctgctcaattgccggttgactttcagctgtgagtcaatgattaaataaagaatttaaaattaaaaatgaattataataaagttaaagttaaaatataactaaattcaatttattttagtataaatacctaaaaattttctcccattattcatttaaaatgttttttccaacgattaaaaattgcgttgctgttgtagacctcaaaataccccttgatattgaaaaaatttatttaatagcgccatccacaaaatataatccacgtaaaattcatgctgtaattatgaaagtgtataatccaaatgctaccgccataattttctcaactggaaaattcgtatgtacaggagcagctaatgagaaagaatgtaggcaagctgcggagcaagtcaccgaacgaataaggcaatgtgggtactacgaggcacgaatccacgaatttgcggtgaagaatttgattgcgacagcagacgttggttttcatatacgcttaggacctctgtccgactttctaggcgccaaatattgttccttcactcctgaactattccccggtctcgtgtacagaaaccaaaaccctaaaatatcgatcatagtgttctctagtggaaagcttaatctaacaggctctagatcaaaagaagaaattgattttgtatttaatcaattttatcaaattatctgcaatttcaaatattca

SEQ ID NO: 74587 - DNA, 965 bp, Heterodera glycines
  Genomic contig location: Contig_ID=SeqID_1577; Location=3013..3977; Strand=-
  SCN-specific regions: Sequence locations=1-409,431-453,476-799,821 -913,943-965
atggacacaacgacgataaatcggattctagcgggaaacacaaagaccagagaacactacttgggatgcttcccttgcgacaaactcccaaataaaatcaacaagtacccttcagcattggtggcgaacaatgacccatccaataaagagggaacgcattggatagcaatgttcatcgttgatgacaagaccgtctactattttgatagttttggtaggaaaccgaacagatgtatcagccagtttttacggaattatgaaagcgtgatctcgaataagccagctattcagtcagtctttagtgagaattgcggctactattgcatttattttgttcattgtatgtgctcattaggaggaagaaattatgagagtaattttgaaaaaatgacaaaaaagttgataggagaagataatccagatttgtttgtcgtgaattttgttaagaaactgataaaaagtatttaaaggaatttatcattaactcatttataaaaatggatcgattagacacagtaattgcttctcttctgaactgtcccgcacgtaacttgtgcgactgcttaaatcacccggatgagattcaaaaagttgaaaaatacctcaaaggaaaaactctacagacaacatacaaaaatcaactagatgaatacaaagattttgagtacggtggaattacaagagaaagtgcccgtaagcaaatggcttacaatggtttcaagaatgtgaccgtcgaccagcatttttatgtacggcaccgcatttgtcttcgctattcaagcaatccttgcgtgatcgaaaaacacaagaatggcaatgaacgtttctacccacttgaacttgtgaaagtgaaggacaatgatataatttatttagggcaaaatttcccaaagtcaatacctttacttgacgaaaataattcaaaatataatgacaattattatgattcttatcgcttatggtga

SEQ ID NO: 74588 - DNA, 1033 bp, Heterodera glycines
  Genomic contig location: Contig_ID=SeqID_1577; Location=6161..7193; Strand=-
  SCN-specific regions: Sequence locations=1-65,87-363,411-1033
atgtctccaaatgaatgttctgaccgtccctttcaacaacccgacaatgttcaaactgttcaactgccgcatcaacaaccagatgaagacgccgagttgcgcgcacaaattgaagacgcggaggaggatttgctcttgaactggtggcgtgaagacccgacaatcgtaagcttgtttttcaatttatcattttttaaaatttcatcacattttttcagattcgttttctttttggacaccgtcgagcacctaccatcgaagccgcgcttcttcaacgcgccgaacgtgaggcagaaattttgcgccaatatgccgagaaccatcaatgaaaagggaggaccaatcagttatcattttcgtatgttatttttcttatttttttttattatgatgataaaaaattttaaaatgcagaactgcggaggagaatggaaatggatgatggggggggggactaaaactcgcgcacccttgaccgattgacttcaaattttacgagccgtcaactcacacccccttaagctgaacggcgaaagaatttcgcctctagcacaattttgagcagtatttcccgacgccccgcccctcccccatcccgagacttgcgcagcaaaactgtggtggtaagaggaagttcacgccgttgaagaggaggtccgcggcgatggcgagagggggtccacgccgacggactgcaaaatgatgggggaggggtccgcggcagtggaaagagggggtccgcgccgacggacgacggaatggtggggaggggtccgtgccttttgcgagagaggctcggcggcaacggggggggggggagacgtgattgagaagatttataacacaccaatgtacattaaggtggtagtaaaggaaattactgagattgaaattgaaattaggactagggagggaaggcttattccattccaatggggtacaacattacttgtattagcatttaaaaaatctattgtattttagtatttaaatattcattttcacatatagtatatattaataattgaataaa

SEQ ID NO: 74589 - DNA, 119 bp, Heterodera glycines
  Genomic contig location: Contig_ID=SeqID_1577; Location =12252..12370; Strand=+
  SCN-specific regions: Sequence locations=1-119
ttctttttgtccacacttcgctgtctctgaaaattccttgcgattcgttcggaccaatggacggccaatggcccttttcattggtcgcaaaattggggtgactaaataaaaagaaattg

SEQ ID NO: 74590 - DNA, 63 bp, Heterodera glycines
  Genomic contig location: Contig_ID=SeqID_1577; Location =12453..12515; Strand=-
  SCN-specific regions: Sequence locations=1-63
tcccggttggtcccgggttttttcgcggtcccggtcgaaaaacttggtcccggtcccgacttt

SEQ ID NO: 74591 - DNA, 398 bp, Heterodera glycines
  Genomic contig location: Contig_ID=SeqID_11226; Location=299..696; Strand=-
  SCN-specific regions: Sequence locations=1-398
atggcagaaaaaagaattgccaagcgtcgagaaggacaagcgcaggtcggtgggggcacggcgccttttgccaggcaatggcactctccgtttggcccatccctcgcccacccatttgacctctcactttatctctgtctctaattccgttttgactgctcattgctcggcttcatttggccaattattgctctgctactcctcccccccccccatattaattcgtcttttgctcctttccccccccccccctaatcccacaaatttgcttctccagctgtgctcttcctctgttgcttctcctttcttttgattgatcggttgggtcaatcggaaagatggccaaagcgatggacaatggtcgtaagaaaataattactcaatgggtcaaaaataaa

SEQ ID NO: 74592 - DNA, 320 bp, Heterodera glycines
  Genomic contig location: Contig_ID=SeqID_11228; Location=821..1140; Strand=+
  SCN-specific regions: Sequence locations=1-75,126-320
atgatcagtttagctcaccctcaccacgaagtgcgaaacctgacaagttggagtaatacgagagagataaagaagaaggaaaagaagaaaaaagaaagaaaagaagcgaagagaaaagaagagaatggagtcagtggaggatgggacgaactttcacttcagttgacccctcccaaactcacaaatcagccgattaattaatcgttttcactcgaggggaaacaattgccattgttgagaatagtgcaattgcttctgcttgccattgatcaaagctttggaatgaatcagttcaaaaagattaatgaaaacgaagagaa

SEQ ID NO: 74593 - DNA, 267 bp, Heterodera glycines
  Genomic contig location: Contig_ID=SeqID_11232; Location=732..998; Strand=+
  SCN-specific regions: Sequence locations=1-160,192-267
atgcgcggcgagttggtcgcgcgcaactcggtcgccgagcgagcggagaaggcgtccagcgtttatgagaatgtggcgaccggcgagcgtcgtgaagctgctgaaccagcagctccacgagaagctaattatgatgctaatgatggtgctaatgaccataattatgagcagcagcagcagcaacatggcccgccacaaaatggccagggcggtgaacggagggaaggcccaaagggggagatttggtacgaatttggatgcgtctga

SEQ ID NO: 74594 - DNA, 101 bp, Heterodera glycines
  Genomic contig location: Contig_ID=SeqID_11235; Location=1198..1298; Strand=+
  SCN-specific regions: Sequence locations=1-101
atggcaaagttaccaccatttttcgctgacccacaaaatgtccagcccacgaaatgtccaagtctcgaatttgagttttttattattcagatgggcctaag

SEQ ID NO: 74595 - DNA, 589 bp, Heterodera glycines
  Genomic contig location: Contig_ID=SeqID_11236; Location=303..891; Strand=-
  SCN-specific regions: Sequence locations=1-133,155-434,456-589
atgaataattttctgtcaacaattattcatttgatggttttttgactaacgcccattttgatggtttttgactaacgtcccagcaccgttttttaataatctaacttctttttttattcggtatatattctttattctatttgtgtaaatattcttaacaagttgcacctaaaatttgcaaaaattttcccctaggcaccgtcggacgacttaatccccatttaaaaaaaaattttgctgccgcaggaacaactcggcaaccgctgaatgtattgaagtattaagtattcagttacattattactagagttttcacgaccgtttattaaccgatacccccggtttcggtttttggtccaaaaaagccgccggtctttggtttcagttcggttaaacgaccgtgaacaaccccaattattaccgtatttactgaacttacatttttattatacatttcatatttttcggtacgccagaatttttttcagcttccaaattacccagtagaaattggtcaataaatttaataatagcatcccaacataaagaacatatatcaaaaccacatttaatttaataaggaaataaa

SEQ ID NO: 74596 - DNA, 585 bp, Heterodera glycines
  Genomic contig location: Contig_ID=SeqID_11238; Location=1030..1614; Strand=-
  SCN-specific regions: Sequence locations=1-585
agtgccagccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctctccatcgtcaggagtcgcgagcgcctacatgggatccggccccgccgagcctgcaccgtcgtccggcgccgcggaagcctctccatcgtcaggagtcgcgagcgcctacatgggagcctcgcccgcgtacgagccaccagcggttggtttaagggggacacgggagcaaacgcatcactaatcttttgtttttgcagcaggagaagtccccggatcagagcgcctacatgtgagaagatgcaacaacgaccggcggatggatggacgaaacctgaagagcgagcgacctgtcagaagatgcaaagataaagaagatgtctcataatcgtgatctgtatttattgatgtattgtacatttgtatgcatatatcatttgctgtgtattatcactttatttccatctgtgttccgaaataaa

SEQ ID NO: 74597 - DNA, 831 bp, Heterodera glycines
  Genomic contig location: Contig_ID=SeqID_11239; Location=900..1730; Strand=+
  SCN-specific regions: Sequence locations=1-394,514-723,745-831
atgtctgcttttattaccggagacttattttattccggatatcatttttgcgaattggtgaccaattttagtttgacggcggctatttattgtccattagaggagctaatgtcggaccaccaaaatttaataaaagttttgcctcatttcagagaatgcccttccaactggccggaacaacggcacggactgttcggtgtggcacagcgaatttgaggcggacgatgcgaacattgcgctgccgctgagttcgttggacggtggtgccaaacagaaaacgcagcccaaccatttggcacgccgaaggcggacgaagaaagcgacggcaccgtcgtcaacgaaaggacttttggcactcggaagggaacgaatggccgcaatcagtccggtggcagaagaggatgaggaggaagaagaagaaactgatcgggaagacgaggacgaagacaccgatcagcgggaggaggacgaccggcgggagaaggggcgacggaaggagacgaagcggaggagagagtcgagccggggcgtgacggagctttgactggagcggggactccgatggcaccgaacaaagggtgccatgcttttcgacattaagctaattcgcttttctctcactcacttcgttggcattccaattcttttttgttttacattttcattttcacatttaaatttgtctttttgtcgctctttatgtttttgtttggttgggtcacagttgagaagcaaaggctcaaaaattgtgatttttttttttttgaaaaaattgctttgctcacttcccaattaaatattttgatcataaattacagaatgttgttccaa

SEQ ID NO: 74598 - DNA, 75 bp, Heterodera glycines; identical to SEQ ID NO: 54636
  Genomic contig location: Contig_ID=SeqID_11239; Location=83..157; Strand=-
  SCN-specific regions: Sequence locations=1-75

SEQ ID NO: 74599 - DNA, 1038 bp, Heterodera glycines
  Genomic contig location: Contig_ID=SeqID_11239; Location=1941..2978; Strand=-
  SCN-specific regions: Sequence locations=1-319,341-825,944-959,983 -1038
atggtcaccaaaaagggacgaattgtcatcaaagtgggacaaatggccaccaaattgggtcgaattgtcatcaaagtgggacaaatggtcaccaaaaagggacgaatggtcatcaaaatgggactaatggtcaccaaattgggacgaattgtcatcaaagtgggacaaatggtcaccaaaaagggacgaatggtcatcaaaatgggactaatggtcaccaaattgggacgaattgtcatcaaaatgggattaatggtcaccaaaaaagagagaaaatgactgtttgagaaaggggagacgagcaatgccaaaagggacgagaaacagcaaccgcaactgttttgaagctgttcgagatgaattttgtgcatctaatcgacctaaattcgatcgttttaacatgtctacagtcttagtcatactgtattcgctgaattataagcccccgcccctctgtattagaagcccctccccctaacataagaacttttcacacaaatggaccaagttgtatttttttctaagcttttccgtttggtagtggcccattccaatttttgcaggcggtggccttttgaatgtgctgctgtactgctccaaaatgatgcacatctccgagcccaagcatttggtgattttcggcaattcgaatttgctggggggagaaaatggcggggcttttgctgaacagcggaaaaagacgacggccgttgtcgagctgggcaacttggacgaactgcagcagtgttggaatgccgtgttcatttacgtggagcgtggcgagacggacggaggcgcaaaagcgaaaaaggcaaataaatgggcaaaaaaattaatattaaaaatgaatttgaattaaataaataatatttaagatatatttttaaattaaacaattaaatacattttaatattaattattaaaaatgtattttaaattaaacaattatcatttttcaggtgacaaaacaactccaattgagcatcttgacgcgggggaaatcattgttcgtatttgaggaactgaacaaaacataa

SEQ ID NO: 74600 - DNA, 319 bp, Heterodera glycines
  Genomic contig location: Contig_ID=SeqID_11240; Location=39..357; Strand=-
  SCN-specific regions: Sequence locations=1-319
atggcgcttcggcaaatgtttttcatccccggaaatcagcaggaggtggcgatggaaaacaggaattacgatgaatttcgtgtcggaattgaggtccgtcccatttcaaatctcttcgttttctctaatacattttcaggcgaccgaagagaatgtgagccgattttacgaagagaaggagaaattttcaaatttgcctacacttacactcgaattacatgccgaaacgcgggtcaaagctgagaatcttaacaccgaagtaaaaacgaaatggcaagcattgattggactggtggacttgcggaaaaaactgctctag

SEQ ID NO: 74601 - DNA, 848 bp, Heterodera glycines
  Genomic contig location: Contig_ID=SeqID_11240; Location=536..1383; Strand=-
  SCN-specific regions: Sequence locations=1-515,537-692,714-731,753-848
atgaattggtattttcgcatggaaaataggtaatttggaaacaaaatcggatagaaaaacacttttttcagaattgatttcatccaaaaggtgcccgaatcagtggagctttgcgagcagaacaaagagaaatttcagtcggaaaatgacgggacagtgcaagcatacgaacgcgtgatggtcgagtcgcagcaactgctacagtcactcaaacagcagagggaactgctcgaagttgataactcagaggcagcttgccatgttcataggctgaccagagacatcggtgagttggacggcacacaatttgaattgcttttcaatctttaatgtgaccatttcccaataattaatgcctttgcaccctttcctaaagaaatgcgccatcagcaagagaaggaacgatggcacaagcaacgattttaccttaacgcagcactgaacatttcagtgtttctgcgcgactgtgaagttattagcattcaattggaggttatacattctttgagataatttaaatggaatgagaaatatttaaattcagaactggcggcaggacctcgaaggattgcgacactccgtggccagggatgtcgaagtgttcaagcagtttcacaccgacaacactgtcagggtgcaacagaccgtgtccgatgcaatgaaaaaacaaagagaactgttacaggtaaacgcacaaaaccaacacaaaaaacgtggaattataacaggtgataaatatttttaaataatttgttttgcagtccattcgcggaaagaatttgcaacttgtctttaaatctgcgccaaaaacgccgttgaacgacatagtcaacgcagcagcaaataaa

SEQ ID NO: 74602 - DNA, 78 bp, Heterodera glycines
  Genomic contig location: Contig_ID=SeqID_11242; Location=307..384; Strand=-
  SCN-specific regions: Sequence locations=1-78
tacgcgtcccatgacattttacgcgtcccatgacattttacgcgtcccaacaacactttacgcgtcccatggcatttt

SEQ ID NO: 74603 - DNA, 917 bp, Heterodera glycines
  Genomic contig location: Contig_ID=SeqID_11243; Location=1619..2535; Strand=+
  SCN-specific regions: Sequence locations=1-107,136-140,162-225,251 -523,545-769,791-917
atgatgctgcacaaattatcctttccatttttgcctataattatgatggattttgcgatcggacgcattgctttaaacgacgagtgccaaaaaggtgtgaacacagtttgttttaaaaatgttaataaactctcaaaacattttaaagacttttttggaacggctgatcaattggaagaaatggcattggaaatttttgcagcggcggacaaacaaacggaaaatggaaaattttttgaaaagggatttgacattttctgttgtattgcatttgaaattgaaaaagatgctttaaacaaagatgagttggcattaattgatgaatttgaagcaaatcagcgcaatttttgccaccaattgaaaaagggccaaaatatttgggaagcggtggaaagtccggcagggaatgccattgtaacagcggcgagaaatgcgaaagttaactctctaatacatgaagaaggacttcgaaaattggagaaaatgcaaaattcgagccctgaaaatcaagcagaaattggaatgtttgccaaacattgcattgccgcgttgaaattgtttcaacaattcatcaccggtatttctttaatgcaaaataattaagtttcagtcagaagcaaaaatattcatcaaaattgctaaaaacgcttattctgggctctattgcactttatgaatataaagttacaaaagaaattactcaacaattacttaattaatctaatcttttttggcaattgcctaacactgagattttatatatatttgcttcttaaggcttttactttgaatgataccaaaaagataggggtttgttcgaataggacattacggtggataatcgatcaaatgatgttagaccgcggcaaaagtatgcattcaaaactgctaaaaagtagaatcagaatcccgcggca

SEQ ID NO: 74604 - DNA, 1447 bp, Heterodera glycines
  Genomic contig location: Contig_ID=SeqID_11244; Location=53..1499; Strand=+
  SCN-specific regions: Sequence locations=1-349,381-493,516-765,787 -1276,1299-1447
atgatgctgcacaaattatcctttccatttttgcctataattatgatggattttgcgatcggacgcatagctttaaacgacgagtgccaaaaaggtgggaacacagttttaaaaatctttaaactctcaaaaatttttcaggcttttttggaacggctgatcaattgcaagaaatggcatcggaaatttttgctgtggcggacaaacaaacggaaaatggaaaatttatggaaaaagcatttgttggcattttgtgttgtattacaattaaagctgaaaatgattccatgaaaaaggaagagttggcaatgattgaagattttgaagcaaatcagcgcaatttttgccaccaaatgaaaaagggccaaaacatttgggaagcggtggaaagtccggcagggaatgccattgtaacagcggcgagaaatgcgaaagttaacctccaaacatacgaagaaggacttcgaaaattggagaaaatgcaaaatttgagccctgaaaatcaaacagaaattgaaacatttgccaaacattgctttgccgcgttgaaattgtttcaacaattcatcaccggtatttctttaatgcaaaataattaagtttcagtcagaagcaaaaatattcatcaaaattgcaaaaaacgcttattctgggctctattgcactttatgaatataaagttacaaaagaaattactcaacaattacttaattaatctaatcttttttggcaattgcctaacactgagattttatatatatttgcttcttaaggcttttactttgaatgataccaaaaagataggggtttgttcgaataggacattacggtggataatcgatcaaatgatgttagaccgcggcaaaaatatgcattcaaaactgctaaaaagtagaatcagaatcccgcggcattaaatttcccgccccggggtccctctcgaccgttttcccaaaacctagggattgaccgggatcggtaatccggctgggatccaatttgtttgcttattaattgctacagtagctgagtgttttatacaacgacaaattaagatgagcgattggctcagactttgctcgctggtggaggacagactgtgtctgatcaaagttcagccttatcagctcaaccggcgcccactcgatctgatcagctgcagaaggagaagtcgtcacggcgaaggaaaagatcgagtaaatggccaaaatgccttggtgcttttgcattggccggcttttccggctatgtgtgcagtatatttgctaggctcttgaaaatcaatcatgttaacattttcacatctcatcatcctgttgttcagccccatcctcgtatatcgttagtaatggaggtgttagtttcaatgtacatgttctttgttctttctttggtcagcatctttttaggcatttatcattgctttgtcaagcgtgattactattga

SEQ ID NO: 74605 - DNA, 764 bp, Heterodera glycines
  Genomic contig location: Contig_ID=SeqID_11245; Location=243..1006; Strand=+
  SCN-specific regions: Sequence locations=1-479,501-764
atgatagtaattgtgattccttttttagtaattccgcaacaattgtcggccttcgatgggtcaaatcgttcgttttttcctccgttgtccatcggaattcaaacgccaaatcaatgccaaaaaggggaggagggcccattggcaaagccaacggcgaattgccaaaatggtgaagaaagcgaatggtcgacaaaatcagcgccaacaccaaacgaaatgagcggaaacaaaagagcaaaaaagcggaagagagagaaagttgccaaaaatggacaaaatggggagggagagggggagcaacggaacgccaagaaatgcaacaccaacgccaaagacaacaacaacccaattgtgcaaatggtgatgagtgccgtcgccgaaggcaccgccgcaacgacagccatcaatttgaacacgtgcggtcagttcagaggagagggagggagggatacggtgctgtggggatgaccaatgaaaagcccactttctttgtttgtccgttggacccatcccccgagggaattccgtcatgaaattgcccttttagccatttgcggggaccaattccgcctcatcagtgaccttgtccaacatgcgcgaacgaatcaccgccaaacgagcagatacgatcggaatgggccgagggcatcgattgcggaagaagtgcagagactaagcaaagagtgaagcggagagaaagagagacaaagagagattggaggggttagagaaggagagactgtcagactcacaacaagacaaaa

SEQ ID NO: 74606 - DNA, 2881 bp, Heterodera glycines
  Genomic contig location: Contig_ID=SeqID_11245; Location=1278..4158; Strand=-
  SCN-specific regions: Sequence locations=1-289,312-374,398-650,672 -929,951-1242,1264-1676,1698-1701,1723-2097,2182-2704,2726-2834,2856 -2881
ttttttgtgtttgcacttttcgctttgtgcgtttgctgtgcgattatttgtgcggctgttaaacgaaaggttcagcacgaacatcagaacggtgagcaaagcaatgaatgagcgatggtcggacaaacaaatacaaattaatgaccgattaattaattatcgttaattgacacctaattaacaacacttaaaatgggacggtcccttcggttgcctttcccccgccccatgaaatatttgtttattcaatcgatccctttccaaccgtaaaaagcaaagcattcaaatgaaaaagcggggggcccataaaattaagcggaggcccacggaaaagagcggcggaaaaccaacggacgaaggtaaggaaacagaaaacggaaggagagggaggagaggacattttgccgaaaagggcgtccgtcgacggaaagggactgaatttgcccgtgtccaattggccatgactcatttcaatttaatatcccgaaatgtctgaccccctccgtcttagatggccactttctcagcttccaacgcatttacttggctgtttactgtttagccgtggcgggcgattggcttcaggtccttcatccccccctccccctctttgcctaattaagcacatttttgccactgctaatctcggcttttccccagggcccccatgtgtacgcactttacgagtcctattggatgaccaaacatcagatcggtcggtctttgggtggcgttccccggggcgtttattcgttcgttttccacaattcgcagaacttctgttcatcgccggcttcggctccagtctcttttttggcactttcattgggtccatcgccgacaaattgtgagtcgctttttcagagtccctaaagccccttaggcgcggtaaataggcaatttgaacaaattggagcgggtaaaatgtctcttcctcctttcccccgcttcgctcgtccctttccccgatgggttacggtaattctgttaagtggccgcaaggccaattgtctactgtacgccctgttgtacggtgtcagctgtgtgaccaaacattttgcggactttaacattttactgatcggccgattgatgggcggcatcgccaccagcattttgttcagtgcctttgagtcttggcttgtgtttgagcatcggaaggtcactcactcactttttgggatgtcatcaaagtgccctttttccagcgcggcttcagcgatcagtcgctgaagcaaatctttgcaaatgccactttggccaactctctgatcgccattttggccggcatcacggcacaggcggcggccaacgcattcggatttgtgtgggttaaaaccgcggcattttcaaaactcaattggatcactgtttcgatgtcagtgccccattcgattgcgcctttgtggtactcattgtgatggcactgctaatggcattcacttggactgaaaattacggcgacgaaagggcgaatttggcacaaacgtttggcgaagcttttaacacaattcgaaatggtcagaaaaggcgacgaaaaatgaaatgtgtatgaaacactttgcagaccaacgcattttgtgcctcggattggcccaaagtcttttcgaagggtaaattcggataaatatttaaattcggataaatatttaaattcggataaatattccctccgtccaattatcctccccttccccctcatttgctcttttgtcagttccatgtacgttttcgtcttggaatggacacccgcgttgagccgcgcctcggagaccggcacaatccctcacggctttatttttgtgcgtaataaacattcaaaagaaaatggaaaacgcagtaaacgttgcccttctttttttccataggcctccttcatgttgtcagtgatgatgggctcggccgtgttcaatttgctcagtcagtacaaccgacccgagtcatttatgcggtaagaaaacaaagccaaaacaacggcaaaccaaagctaatcataattgcaaatcaaaactaattaggctagttaaactgagaccagatcaatcggctgatcgttcttacctttctctgattatttgttaattgcacctccccgcgtctctctatctttctctctctcccctctctttttctctctccctctctctctttgtctctctctctctctttttctctctctcttggtcttttcatttcaacactaattagtgctaattaagcttcgtcttcctcgtcgcctcccttttgatgtgtgccccggtgcttttcccttcatcttccaccattattttcatctcatttgctctcttcgaagtttgcgttggcattttttggcctgccatgggtttcctgcgctcccagtacattcccgaaaaggtcggacattggcaaattgcgacaaacgaaaatcattttcaattgaaaattgtcctcctcagactcgttcaacgacaatgaatttcttccgtgtgccattgaatttgcttgtcattggcatcctttggaacaatttccacttggacaccattttcaaggtgggtatttgctcttattatgattaataattgcctctcggcattcgctaattgttgctaattgcctgactaattaataataattagctgtgccattaagttctgcttctgtttcctcctttcggctgctttcatccaacatgccattgctcggagactttgcattttgtggataaaaatggccaaaactgacctaatttaggatgacatgttcgcaacctctgttgatagaacatccggtggatgttttggaagagatggaaaaactatgccccgaggggggagtcagagaaaaaatagacaaagagcagagagaggacagtacggaagagactgcggagagacga

SEQ ID NO: 74607 - DNA, 2939 bp, Heterodera glycines
  Genomic contig location: Contig_ID=SeqID_1579; Location=166..3104; Strand=+
  SCN-specific regions: Sequence locations=1-1396,1419-1527,1549 -1697,1719-1746,1769-1874,1966-2304,2326-2558,2581-2624,2646-2939
atgttaacttctgcccctgttttacaatcaccaagatttggcagattatttataattgagtgtgatgcctcgaagaaggcaatcggagcagtactgttacaggaaaagggaccagtggcttttatttcacgagctctgaacagacatgagactaactatccgtccattgagagagaaacgttagctcttgtttatgcagtgaaagaattttcaccatacatagtcggctcagggattacaaaagtgataacggactgtagcgcgcttacctccatgattaaagccaatgaattaaagggaaggctagagaaatatcaaataagcctacaaagctttgacttagaaataatttaccgtccgggaaacaaaaataaagcggcagattttttatcccgctacaatatcccaaaaattgatataattgaggagtcggacaataatcctaaagagtcaaaagaagaaaaggtgaaaatacttagtgcacagagtttggaaaattcaagtgaaaaaagtggaaaagaaattttttgtgaaaaaggacaaataactttggaagaaattattaaagcacagaggcaagtaaaagaaggggcacaaatattttacattttaaagacagggaaaatcccagaaaaaacatcaaaatggtcacaaataaatcatgattactgtcttataaatggagccatttactataagaaaggaaaatcaaacgcagaaagaccaaaattattaattccttatttatacaggaaagaaatttttcatttaattcatgatgagggacattttgggttcgacaaaacttggccagaaatcaaaaatcgattttattgggttggaatgaaggatgacgtaaatatgttaattgatagttgtgtggggtgccaaaaaagaaaagttcaaccaggccaagctaaggcatcaccaggtgtacccataatacctacagattatcctttccagagggttcactgtgatataatgggaccgctgaaaaaaacggagaagggaaatgtgtacgtattccttgcaattgacagcttttcgaaatgggtaatggctgtaggaataccggaccaaaaagcagaaacggtttctgaatcatttgtggaaatggtaattcaccaacatggggtacccgaaacagttgtgactgaccaaggcagacagtttatgtcacaaatttttgagaatctgtcaaagtgtacggatttatacataatacatcaacgccctatcaccaacagtcaaacggagcagcagagggtgcgatcagaattttagcaaacattatttcccaaatcattaacgaagaagggaataattgggatcaaattttgtcaaaatcagtgtttgcatacaatgtttcgatccattcatctacaaaaaatacaccattttttgttaattttttacgaaacccgcgtctgccaactgatcagttacttaagctaccaaaaacagatgagttaacatcagatatttcggtttataccagaaaacatggtgaaaaagcagcaaaagcgtgggagtttgttagagatgaaattttaaaagcacaacaaaggactaaagaggaaaatgatttgtgtaggaaagcgaaagaaagagaatttgaggtcggggacttagtacttctaaaaaaggaagtattgaaacataaattcgataaaaaatggagtggtcctttccgatgtgttggaattgaaaaggataagatgaatgtactcttacaatccttagaaggaaaagggaaattaagaaaagtacaccaagaaaaggtaaaaattttctatggacccgcagttttaccattgagaccttgtgatgaacccctttgctgggaaaagtatgttaatgacccaaatttggaacaagaagaagcagaagatgaaagtgagactagcgaaatagaatatgatgaattgaaagtggaagaaaaaaataaagaagagaaggaaggtggaaatccgacaaaaacggggaaacaaatgtcaaagtacggctttgaaagcagtgatgaggaaactcattcaaaaattattgctttcatacgagaaaaccaaaattttgaagaagatgaggaaaatgagggtccaggaattttaatgggcgatagaaatcccgaaatcgaagccataccgacctttactgagcttgaaattttgctcgagggctcatttacgagagtatacacagggtggataaatcccgtaacaatcgcattaatttcaagtatacccgaaaatttagtcagagaaaattgggaaatttacataaatgaacatggctcaagatttgtattgggttggatttttggtgaaagttttgaaatttatattattaatgaatttgatgaaataatgctaggaatcgatgcgcaaatgttattaggtgaaagatggaggctaaaaaacgaagaactaaccgaatcatactgggaaatttatgttgacgaaagtggggaagaagttgaaataccgagaatcccggaaattctgatttctgaaaaagaccatgtggaaaatgaggaaaacggaataatcagaataagcataaatttggttaaaaatgaaattgagagagatttatacgactttacactaaatacaaatccaaaagaatttatagaaatggaaaagaaaaaaattcaggataattcgaccatggattctcttacaggtatggaatcgacgtccaatttatttgattcactcacaaccgacgaggaggaatcattgaaacgactcaaaagaagtctaatggctcaattggaaagagtcaataaaacgctgaccaattcggaacaaatgagcgaaaagcctgaagaaatggccgacaaaggaatgccagatgaagggataaaaggtcatgcggtggaggataaaatgggcgaaaaggccaaaagaagtggccgaagttacaaagccatttga

SEQ ID NO: 74608 - DNA, 1191 bp, Heterodera glycines
  Genomic contig location: Contig_ID=SeqID_1580; Location=164..1354; Strand=+
  SCN-specific regions: Sequence locations=1-2,24-301,323-388,410 -839,889-1191
atggaaaaggaaaaaattcaggataattcgaccatggactctcttacaggtatggaatcgacgtccaatttatttgattcactcacaaccgacgaggaggaatcattgaaacgacttaaaagaagtctaatggctcaattggaaagagtcaataaaacgctgaccaattcggaacaaatgagcgaaaagcctgaagaaatggccgacaaaggaatgccagatgaagggataaaaggtcatgcggtggaggataaaatgggcgaaaggccaaaagaagtgccgaagttacaaagccatttgaagagacggaagcgaaaaacgaaagctcattacctgtcaaaaaagcagaaggaaaggtcataccagaggattgcatttcgttggatctcgaggaggaagagagaattctcgaatttccaaagactttcgagaccggagcattgggattttacgaatcatgcgtcaacaaaagcaaatcaaagtcggaatacgaagcaaccttaaaaaaagtggagaaaaagccaacgaatccatggaaaattgcttatcacgaaataaaggcggctgagacaaacattttgtcaaaaaaggatgaagcaattccgcccgaaggaaaaaagaagaatccttttgcagagagtacactggataaaaaggaatgtgaaaacaatagtcgaaaaagattcgctgttggagacccatggcttgcacctcccaattcaatttggcgtgaaatgaagacgaacgagccgaaggaagtgcaaaatgtgatggcaatgcttctgagcatacggaacaaagcattggacgtccacgatgaagcacagaatgcttggaacgaattaatgaaaatgaaaggaaaaggggagaagaaagaggaggaaggcatggattccggacttccagggttttcaactgctgattggcaatccgatcatgaccgttggcgtggacaaaatcgttggcgcggcgaaagaggagcaagacgttggggacaaccatggcgagggcgtgaatggaaccaaccaaatcaaggagcgggcccatcgacatcagcggcatcacaagaaggacaatggaatttctcaaagatggcgggatatggatagaaaattggattttgagttggaattggttgcattttagattttttttttgggccaaaatacaacaaaaacaaacaaaaaaaca

SEQ ID NO: 74609 - DNA, 2016 bp, Heterodera glycines
  misc_feature (1753)..(1753): n is a, c, g, or t
  Genomic contig location: Contig_ID=SeqID_1580; Location=4165..6180; Strand=-
  SCN-specific regions: Sequence locations=1-70,95-126,157-787,810 -1106,1128-1252,1274-1294,1317-1417,1439-1899,1922-2016
  Gene Ontology: Biological process=positive regulation of growth rate
atgtccattgggatgagcgtcgattttacggcacatacggcttactctttccaagtgagcagcaaaatgctattttttaaaatttatttaaaaacataaatcgcattcgagagtcttagtgtcagaagtttcaaattttcctcttttcacattttattcctccttgtttcagctgtcccaccgacgcgaaacgcgcgacggtcgcgttgtgctcgtgccgttgcgaacaccgcgcgacaagttgcagcacgcgttacgctccatcgcgtggccaatgagtcaggcggggctcagcacggtgatctgcgtgctgccgcttgtcttcctgcaagtgattgcttgactgattgatgagcttacattatacatattcgagatccaaatctcggccagtttgggagtctctcgagtgattgttattcgatttcaacggtccctgtttcgcaaatttatctcgactctcgaaaaaagcatttctcgtgcaacgctaggccatacgaatttctaatttccaatttctggcatcttaaacaaatagggtacattacgtagtgattgaatttggcacaaaatcccacaaaaacgaaaattgctttgttcccaaaatcagaggttgcttgtttcgataaatctcgaaaagcggaaatttgcttcagaattacatcccgctcgtgttcgtcaaaaccatctcactggttgccatctggggactcttccacggcctggtaaggaccatcagccctcattttcagaattttcggttttctttggggaaattaattgaatttttcaaaattttgcgcccttcacaggtgctgatgccggcctttctcgcctcgctgccgccacggtggttggaggtgaactgttaccggatggccgttcagaggattcaggtagataaatagagtaggaggaacagttatcattgaatttaatgtatcaacatttttccaaaaaattctggacttgaataataacggctgcggcttttcaaagacctctctaattaggaaccaattacggattggccctaattggaatccccaattccgtcttgtcctggttctcgtgctactttttgtttgtttgagtagtccattcaacaaagcaagcagaaagaaaattcatcactgttacgacatttttttggacgagctactgtaatatgtgggattggtagaggggggggggggaatacagtaagtatacagtatgcttacccattccgcttttcaaagtttgatcccgatttttccaaattttaagcaaatgagcgaccagcaacagcaacaaaattgtgttggtggtggcgatgatccaaacaatgattgggactgtgtggtgatcagcggcggtggttgctccaaaatgttgctatcatcagcagcggacaactgccatcaaaagcagaaaattggcgaaaatcaaaatgatgaagcaaaacggagggggcaaaggtgagggaaaaacaacgtcgtttatttaaaaaaaaaattcaattccgatactgtgagatgaatgatcggaaaattacgaatcggatcactggccaactcatacaaataacaaataaatagaaaatttcagaaataaaaataatgtggaaaaattttccgagacccgaggcaaaaaaaaatgtttaaattccaactcaagacttaaaaattgagaagtttctcaagtcgaggctaactttaaggggggagatggggtcaaaaaaaaactaaagcctcttattttgtggagaggngtttaaaattagagcaacgaaagcttggttttttggatcactctcactatgttccccgtcgtttagccgcggattatttcttaaagaagagttcattactaacgcttttttttcctaaatacttattaaacttttaaaattgtgtgttaatttttaaaatatttatttgctgttaaatttgaatgcctttcagtcgattggaaccgttccgactcagccatttgctgaggagcactgaacgccacacaaaagcagaagcatga

SEQ ID NO: 74610 - DNA, 3131 bp, Heterodera glycines
  Genomic contig location: Contig_ID=SeqID_11246; Location=53..3183; Strand=-
  SCN-specific regions: Sequence locations=1-130,160-200,222-372,396 -1156,1181-1424,1446-1539,1561-1581,1604-1638,1660-1680,1717 -2139,2161-3131
  Gene Ontology: Mol. function=protein binding; Cellular component=DNA -directed RNA polymerase II, core complex; Biological process =regulation of transcription, DNA-dependent
atgccggacgcagaccaaattttgcagcaattggagcaccattttgtcaacaattggctcctcgacacgggcaaaattgatgaaatgaagcaggtctgtatgtttggagggggtgattgcgttaaacttgttttattttaaaatttatatataataattcagagacaaagtgatcggagggaagagcatgatgagttcgatcaatctgaagaggaaactgacgaaatttcgcttatcaatgtcatttattgatggtgatttagaaaaagaaattggtgatcgacgggagacggacgaagaaaacaatggagaagagcaattcgattttgaatagacacagttcgataaaaggttcttcttcgtttttacaggaaataaaatttttttaaatttttgagcttcattaaaaactgtgttatcatttcacttgtattatttgctttaaaaacctcaaaatacagttacagcatgcatgggattcgaacctgagacccccccttttggtgactaactcacagaccactaagacgaaaaatccaacttaattgtacttggagcccaaaattgggccgctgtgtgcaagaaatgatgacaaaacgatgtcacacaaatattttcacgttttagttgaatctaatatctaaggctggtaattatatgcgtgccaggtgatttcgacagtggttgatttcgacagtgagtgaattcgacgatgattgatttcgacagtatcagaaaaattgtgaattcgacagagattgatttcgacagtaccggtaaattttaaaaaaatacgagtatatgaaaaattggaacctaaaatgaagtgatatagtggtggaaaaaagttgacttaagatgaaaaaccatctcatagttcatataaaaatctgagataattcatgcttgcttatcttttggtcttcatcaaaaaattcttttaccccaacttgatcagatcattccttcatggtgatcgggacaccacaaaatacgttgaaaatcgctgaaatttaaaaaaaaaatcatagggagttgggaaaatttccaggtaaatttttaataagctccttttaaagaacacaaaatttactaccgaattttcttttgaatggtagagctacgacttgtatataaaaagttatacttggtattgaaataattgtgaaaaattataaatgaatggtgacatggagagcaaaatcacgatccacaagccccttcgaagattttgaaaatcgtaatcctaaattttctttgaacgtgctcataccactttattttaggttccaatttttcatatactcgtttttttttaaatttaccggtactgtcgaaatcactcactgtcgaaatcacatagcaccagcacatgcatatttttttcctagactgtgggaggcctgaaacgcacgaaaaacatgtttttagcttcttttgaagcttctagactgtatttccatatgcatattttgcatatttgtgcatatttcgcgatttatgtgcatattttggaatttcgtgcatattttatgtgcatattttggcatttttccaaaaaacctctaataaaacggccccaaaagtttgaaaaggattggtagcattaaaaaaaagatattagcatcagattaatttctcttttttacataattaaaatgaagagatagtatgccaaagtaagagaaattacaaagaaaaagagaaacgacgagatagtactaggcttttctctgcacagtggagttgacccatagtgaagttattgtgtcgatttggaagagaaaatgtgtatataaagaggggaattttcgtttacagtcattcattcacattatttgttattatgtccgccgacagagcgcccgacaacgcgcgacaacgccaacgccaaaatgaggcgcgttcaactaactctccatttcattatttgtttcttaccttattaatttcagcgtcgtctgacagtttcgccttcagttcgctcggatgtggagtcgaatgatcatcatattgttggggcttcaacccgtcatacgccgtctcaaacgcatcgtccgccggcttcaacccgtcgtcgggcgacttcagcgaatggtgtggtacttttcaaatgctgactttaccaaaacactcattcccttttccttcagtgaaacatcgggctcagcgtcgtacgtggtctcaatcgcgtcgtccatcggattatccttcctttttgcgagtgccgacatcgaccgaaccaccgcgatgcacatcgaccgaaccaccgcaaagcccaaggaatgttcatgtgccacaactcccttcaaacggaccaccgcaaaacccatggaatgttcatgtgccgcaattcccttcaaacggaccaccgcaaagcccatggaatgttcatgtgccgcaattcccttcaaacggaccaccgcaaagcccatggaatgttcatgtgccacaactcccttcaaacggaccaccgcaaagcccatggaatgttcatgtgccgcaattcccttcaaccggaccaccgcaaagcccaaggaatgttcatgtgccacaactcccttcaaacggaccaccgcaaaacccatggaatgttcatgtgccgcaattcccttcaaccggaccaccgcaaagcccaaggaatgttcatgtgccacaactcccttcaaacggaccaccgcaaaacccatggaatgttcatgtgccgcaattcccttcaaccggaccaccgcaaagcccaaggaatgttcatgtgccacaactcccttcaaacggaccaccgcaaagcccatggaatgttcatgtgccgcaattcccttcaaacggaccaccgcaaagcccaaggaatgttcatgtgccacaactcccttcaaacggaccaccgcaaagcccatggaatgttcatgtgccacaactcccttcaaacggaccaccgcaaagcccatggaatgttcatgtgccgcaattcccttcaaacggaccaccgcaaagcccaaggaatgttcatgtgccgcgacgctcatcaaccggaccaccgcaaagcccatggactgtgtctcgtcctgaccatttgattgaacatgcgcatcaactaaatgtggtgccttcagcgtctcttccgtcagatcaag

SEQ ID NO: 74611 - DNA, 419 bp, Heterodera glycines
  Genomic contig location: Contig_ID=SeqID_11246; Location=1806..2224; Strand=+
  SCN-specific regions: Sequence locations=1-198,223-419
atgcatgtgctggtgctatgtgatttcgacagtgagtgatttcgacagtaccggtaaatttaaaaaaaaacgagtatatgaaaaattggaacctaaaataaagtggtatgagcacgttcaaagaaaatttaggattacgattttcaaaatcttcgaaggggcttgtggatcgtgattttgctctccatgtcaccattcatttataatttttcacaattatttcaataccaagtataactttttatatacaagtcgtagctctaccattcaaaagaaaattcggtagtaaattttgtgttctttaaaaggagcttattaaaaatttacctggaaattttcccaactccctatgattttttttttaaatttcagcgattttcaacgtattttgtggtgtcccgatcaccatgaaggaatga

SEQ ID NO: 74612 - DNA, 181 bp, Heterodera glycines
  Genomic contig location: Contig_ID=SeqID_11246; Location=3601..3781; Strand=+
  SCN-specific regions: Sequence locations=1-136,158-181
atgaatctgtgcgatatcgtttgccatcatttcttgcataataccaaacatttcacactgtttttttcagtactggaaaacctcccgtgccggtgacaatgaggcggtcaacgaagtgcggacggcacttgatgcgggaatggaatgtcatgcagtggttgggcacccgtacctcaacgcg

SEQ ID NO: 74613 - DNA, 865 bp, Heterodera glycines
  Genomic contig location: Contig_ID=SeqID_11249; Location=42..906; Strand=-
  SCN-specific regions: Sequence locations=1-865
atggtcccgaacaagggaaagagatcattggcaaaattggctgtgaataatttatgtatgttttttcgttgtcctatgaaaatattataaacaaaaaatttaggggggccgattttcacttcgaaattatggtctttcgcagacgctcatcacagatgacccatctgagcttggaaattacctggacaacaaaaagattgaaatcagcagccttgacatgctgacgccggaaagaattctgatcagttatcaattgaaaaaagactggatcaaagagcatccttgttcaaatgttgtgatttcactgttcacaacatcagcagcccgactacatttactgaaatcaatgcagaaagtggtcagaagtcccggctgcactcttttatacacgggtaaacatacaataattttctttattattctaaattttagacaccgattcattgtttcttgtacacccggaagactcaaacctccttcagacgggggtgcacttgggacaactcactgacgagttcccaaaggtaaaagaccaatataaatcgcgctgcatttttttaaatttagcacgatattttggaattcgtaagcggcggcgcaaagcagtacgggctgaagctgcgaaagaagggagccgcagacgactttgagtacgtcctcaaactccgagggattacgctcaattatgacgtgacagaaaatcaaggacttcgttatgacacattcaaacagcgtgtcctggaatttgcccgctccggaaagacagacccaattaaagtgttgtacccaaatttcctccgtcccaccgtaattcaaggcaatgtcacctccgctcccctccaaaaaatttataaaccttacgttg

SEQ ID NO: 74614 - DNA, 136 bp, Heterodera glycines
  Genomic contig location: Contig_ID=SeqID_11249; Location=1616..1751; Strand=-
  SCN-specific regions: Sequence locations=1-136
tcgtaatcggaatcgcaattaatcggattttgggccataatcgtaatcggttttaaaaccgtatcggatttttggccataatcggaatcggcgatttaatcggaatcggattttgtctggctcggcacatccctgg

SEQ ID NO: 74615 - DNA, 364 bp, Heterodera glycines
  Genomic contig location: Contig_ID=SeqID_11250; Location=1..364; Strand=+
  SCN-specific regions: Sequence locations=1-86,116-251,281-364
gctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttgttaagccaaaaaaaatccaaacatttaaaaatctataaaaaatttaaaaatgagaattcatgcgagattttctggaaataagcttaattgggcctagttaagctgtaaaaaaaatttggggcgatttgaaagaga

SEQ ID NO: 74616 - DNA, 151 bp, Heterodera glycines; identical to SEQ ID NO: 59122
  Genomic contig location: Contig_ID=SeqID_11250; Location=519..669; Strand=-
  SCN-specific regions: Sequence locations=1-151

SEQ ID NO: 74617 - DNA, 284 bp, Heterodera glycines; identical to SEQ ID NO: 62736
  Genomic contig location: Contig_ID=SeqID_11251; Location=893..1176; Strand=-
  SCN-specific regions: Sequence locations=1-153,196-284

SEQ ID NO: 74618 - DNA, 347 bp, Heterodera glycines
  Genomic contig location: Contig_ID=SeqID_11251; Location=1..347; Strand=+
  SCN-specific regions: Sequence locations=1-95,125-257,291-347
agttaagcttgtaaaaaaaatttgggggcgatttgaaagagaatagaaagaaccaggttcgatgaagttttgttaagccaaaaaaaaatccaaacatttaaaaatctataaaaaatttaaaaatgagaattcatgcgagattttctggaaataagcttaattgggcctagttaagctgtaaaaaaaatttggagcgatttgaatgagaatagaaagagccaggttcgatgaagttttggtaagccaaaaaaatatccaaatatttaaaaatctataaaaaatttaaaaatgacaattcatgcgagattttctggaaataagcttaattgggcctagttaagctgtaa

SEQ ID NO: 74619 - DNA, 364 bp, Heterodera glycines; identical to SEQ ID NO: 62360
  Genomic contig location: Contig_ID=SeqID_11251; Location=1089..1452; Strand=+
  SCN-specific regions: Sequence locations=1-86,116-247,281-364

SEQ ID NO: 74620 - DNA, 1656 bp, Heterodera glycines
  Genomic contig location: Contig_ID=SeqID_11255; Location=32..1687; Strand=-
  SCN-specific regions: Sequence locations=1-125,156-166,205-367,389 -560,629-649,678-745,767-797,884-970,992-1274,1296-1656
atgtgttttacccaaggtgcgtatcaaaaattattcaaattcaggacatcgggcccaaaaattcagattttggggtcgaaaatcaggacattttggaaaatagctaaaaattgtttgtttatcaatttaatagattaaatatagaatcatatttcgtattccctccaatgactatttttaacttttttagggaggaaataagcaaatattacattaaattgttatcgttctcaaaaaaacagatttttaagaatatttttgcggcgcatttttcaatgacttttgaggaacaagcggggcggaaccgccgggaaaatttttgaaaatttgggtataattgttaacagattttgtccaaaaattgtccaaattttgtgattttgagccaatttttaataaaacaaaggattcttagggtcaggcgttgccgttaagcaccgccgttgaaaaattttgaactctgagtgacttacgccataaaattacaaattttctgaagaattttaagaaatcaggacaaattttgatcgttccctccatatcaggacaaatcttctatgtttaatataataattaatggatataatcattatctttatataaattatgaaaatataatataaaatttcataacaaatcagaatagctgatatgaaagaaataataaaattaaaatttcgaaattactgaattatggacattcaaaaatttagtaaataaatctattaattcgaaagaaactaccaaagaaaaaagtttgaattaacaatcaaaaaattttattgtcatattatgtctttatatatgattaaaaattaaagaaaaaaattaataaattgttcgtaattgatgttaaatatagtaataattaaaataaaaaatagagaaaagttataaatatattgtagcgaataaatttgaataaacaagtcccaaaactattaccgataacataaaacaaaattaaacaaatcaatacaaaatttattttccacatctaaagggctaatgttggcttaattatatttgggtggacgagcacgcgtgctcaaacatcggcaagagatcaatcgaaaccatgagatgtgtataaaatttcaatttttagacaccgatagcctgatccttgtccatcccgatggtcggtgtcatcttaaaactggcccgcacctgggacagtttacggacgagtacccggaccacaaaatcatcgaattttgcagtggaggagcaaaacaagtaaaaatcatttgttttgttttttttcaatgttgcatttaaagtatggtttgtgtctgcaacgcaaaggggctgagcccggtgcccaaatggagcatgtgctcaaagtgaggggaatgacgctgaaccacgatgtgttaaacaatcagggtctccgatacgagacgttcaagaacgaagtgatcaattacgcaacgaccggggactatgagccgataaatgtcatttatcccaattttctaaggcaaaacattagggaggggggacgtctgacttcaatgccaatgcagaaatgctaccgtccctttgttggtaagggaattgttggtcagggttttcaattgatgaattttggtcacacattgtaaattttacgcaacacatttaaaaatgattaatgcaaaaaaaaagaataaa

SEQ ID NO: 74621 - DNA, 957 bp, Heterodera glycines
  Genomic contig location: Contig_ID=SeqID_11255; Location=3277..4233; Strand=+
  SCN-specific regions: Sequence locations=1-26,48-378,481-615,652 -691,713-746,793-890,940-957
atgactttatgtgaagtgtttgttgagtgagttacaaagtgacaaaacattagtattcttaattctttctcattaaaacattgctttgaggagtttttcggttttgaggcagaaattcctcatgaaatattgcatgattgtctttaatattaagatgttagttttttttttatagcattaagcgaaacattaattttttgtttaatttgcttatcatgaagaaattcggtaaaaaaactatttcgttttgtgttttctgtacatgatatttataccttttcataaacaagaccgagtattaaaatacttaatgaataattatcatttgaaaatattttaattcattatcaggtttgattggtttataacttttttaaattaattttatttattttttattttcaagagatattaggttttctttttcttttaaattttgatttttattttacttgaaaattttttattttttatttatctcattaaaaaattctattatgaagtttcattattgcatgcattatttttggtagaaccatataaatgacagaatagtaataattatttttgattcattaattgaccaagtcaatggtggttatataccttcaaagcaaaaaattatttatgcaatttaaattttttaaatttgatttgctataattttgagaaagaattaagaatactaatgttttgtcactttgtaactcactcaacaaacacttcacataaagtcatatcacaagtaaaataaagataaaaattttactaaaaaaaattaactaaaaaattcaaacaaacatctaaaatattttcagagatttctcttacgaaatttatttaattaaagtaaaaaaagtgttaaaaaggtgcagatggtaaatacaaactataatataaaaaacataaaaaccaaaatatacaaaattttaattatatgcagaaaaagcattatta

SEQ ID NO: 74622 - DNA, 641 bp, Heterodera glycines
  Genomic contig location: Contig_ID=SeqID_11258; Location=2911..3551; Strand=+
  SCN-specific regions: Sequence locations=1-117,139-147,169-203,260-641
atgtggatggatgtggaggtaaagcgttggcatagtgttggtgtgttgggtgagtgagtggtgggatgatgatgatgggggattgccatcaaaaatgcgcctttttggcaaattttgtaaaacaaaataaatgaaatttgaaatatgtaaaatcatttttgggattttaaattaaaataaaatcattctagcgctatttttccattttttgaaaaaaattattattaaaaatgcaaaaagtaaataaataaaataaaatgcagcaatgagggatcatcagagagctctcctctctctatccaccgatataaaaatgctcatttattaatctagttttcttttttgggttctattgcactttacgagtttatgagtccaatcggaatttatgagtccgatcaaatattataattgcattttttgaatccaatcaggtttatgagttatttaattaattaaatcaaattttgagtccaattattttttattgtcgtaaaccatttttaagcgtaaaaatgaaaatgaaaaattcttcaaaaagtgtcagttaatcgtaaaaatttattgactcataaatatttgatcggtggattcaaaatatttgattggactcataaaattaataggactcgtaaagtgca

SEQ ID NO: 74623 - DNA, 2712 bp, Heterodera glycines
  Genomic contig location: Contig_ID=SeqID_11260; Location=1861..4572; Strand=+
  SCN-specific regions: Sequence locations=1-543,565-1148,1188 -1289,1311-1422,1456-1506,1528-1564,1586-1662,1684-1901,1923 -2097,2123-2159,2181-2214,2236-2380,2402-2605,2628-2712
atggaaagacgccgctctgtggtcatcaccggacttccagaaaaccaatcggagaccccatcagttcgtgccatttctgacaacaatgccgtcacaggttttcttgaccagctcggggttgagactcattctatagtcagctacagaatgggatggtacaacaaagaccgagcaagaaatggtgcctgccgtcccataaaagtcgtgctccccgcctcttcttttcagcgcacatgccttcaccaatggaacaaaaaatcattggaaattcgccgacagttggacaacaaaaggctgaacatcagggaatctctcactcaagaacaactgaaagcgagacgtgaacttcaagcgcagtgtgccgaaaagcgaaaagaaacatccgctgactggatcatctataacggcatgcttgtgctccgaagtgaaatcaaaggaaggaggatgaacggagagaacttgaacgggccttttcctcacattgactctctgctgacacgcaatcaaaaaaactaattcatgccagcaatgttctgaggtttgggggtagacaaaatttccaaaaaatatattctcaaaacagaaaatcccctaaacctcatcctaaattttctcatgctaatgtaaatacaaatatgaatttgtccatctctggttgtttagttaatgcacgttccataaaaaataaactaaatgaattaagtgcattactgacagtaaataaaattgacataatggggattacggaaacttggctttctgaatctgatgaaataacttttcttgaacaatcactcaatgacaaatatgttgtttttaatgcgaaaagattaaaaggcaaagggggcggaacctctcttattataaataaaactattcagccttattttagtaacacggttacaaaatttggttgtgaaatctgtttttgtaaattaaaaaatgctaaaaatttatctattttatctttatatcgcccccctaataccaaacttaaagcaacaaaatcactttttaattaccttgaaaaatttattacagcttccaccttaattataggagaccttaacataggcaacagagacataacttggtctaataattgtcccatacctcatacctgtcttggcataacttttgttgattttttcaataaattttctttaaatacaaaaattataggtcctacaagaggaaattctgttctagacctttgcttatgtacaaacccgaacctaattcattttgttgaaattaaggacagccttatacattctgatcattcagccttattttttcaaattaatttgtcattacagaaatctcctccaccaagaataactattagaaactttaaccctaacaatattaaaaccttaaattcgtatttactttctaatgttacatcaaatttaaccaatgtttttacattagaaaataaatacaaagttttttctgaaacaatttcgagtgctttagagcattttgttcctcaaacttcctttcttaaaaaaccaccaccaaaataccctcttcatataagagaatcgatcagacataaggctctcctttggcagaaaatgaaaatagacccaataaaatataagaaattctatgattctataacattacatatcagaatacaaacaaaaaaattctatgaaaacagacagaaaaaatttctctctgttaatccaatgaatctttataaacttatcagaaaaagttttgtaacaaacaatagtattccacctttagaaactgaaaatgggtttatttttgatgacaaggataaggcacaatattttgccaagtatttctcagaaaccttttcaaataatttggattcaacaccttgtttgtctcagacagacagcctcggctattctatctcggatttaaattttgatgtctctgatgtttttgataaacttaatcgtttaacaaatagaaataatacttctcctgattttataaacaataagattcttaaaaattgtttaattcctcttgagacctgtaactgatcttcttaaactttcttttcactctggaaaattgccaaaaatatggaaacattctattattctcccattacataagaaagatagtaaaagccaaattaagaattatagacctatttcacttacatgctctttatgcaagatatttgaaaaaattcttgctgaacatattttaaagttcttgttagataaaaaattaatttctaattttcaatttggctttgttagtagaagatctactattactaacttaattacaacacttgaggactggtatgacggtattagggataagaaaaatattgatgctctttatcttgattttcataaagcctttgataaggttccccataatttacttatatataaattacataaaattggtattaggggcaagatattagcttggatttctaattttctacttaacaggacttttcaagtcaaagtaaacgaacattattccgaaatttttaaaattaactctggagtcccgcagggatcggttcttggaccacttttgtttctgatttatataaatgacttacctttatgtattcctgctgaaattggcatcaaactttttgctgatgatactaaattatatgttatttataaatctgaagctgaaagaaaacacatggaccttgcactttctaatgtactaaattggtcacaaaaatgggga

SEQ ID NO: 74624 - DNA, 1603 bp, Heterodera glycines
  Genomic contig location: Contig_ID=SeqID_1581; Location=177..1779; Strand=+
  SCN-specific regions: Sequence locations=1-241,264-274,402-484,512 -543,597-1225,1261-1450,1480-1603
atgccaaaaaatgatgccaagggaaattgccaaactgacaaagtatcaccatatgaaaagaatgatgataatgatgacaaagcgctgacaaaaaatttggaaggaaaagaaaaggttgacaaaacacaaaataaggaaaaggaaaacaaaattaatgaagaagaaaaaacaaagcataaagattctggtaataatgatgaaggaattgttacagaaaaagaagccgctgttacaaatgccaaaaccaaaaaagcctatagaattgcaggtattttaaatgaaagaatatttataataattaaaaataaacggttacttttattagaaaatatataaaaatatttaaattaaaaaacttatcaatatattaagaaataagtaaaaacaattaaatgaaaaaaaagttgaatcatatttcaaataaaatttcttattttgactttaatctttttcttggaaaagaggggaaaatgttgttattaaacttaaaatttttaaattgaaatttagcaaaatgattttcttagtgtatttcgaaagaagaataaaaatatcaattttatattaaaaaaaataaataatttttcaaaatttatgaccttttagatatcaaagaggatgtttttcttctgggccattttcaaaatattctttcaaattcgaaagagtttagcattgagatgccgcgaaatttgctcgagttaggcatttattcaaatgaaatttggcaccgaattttggcagagagacattttgacaaaattggcatcaaattttggcattcaaaaataaattttgaagagaaatgggcagaaattgaaaataataaaataaataaagaaaatgaacaattattgaaaatggaactgtaccaaatgttgagcaatttttccccagattttgacgaaaattttgaaaaaaattatgtgaataaaaattggcaaaaaatcggtgaaaaattgcacagaaattggttggccaggacccttttgtccaatggtgaaatgtcgaatgacgggccaggacgttttcgtaccgccgttttcgtaccgccattttcgtaccgccgttttcgtaccgctgttttcgtaccggagacgttttcgtaccgccgttttcgtaccggagacgttttcgtaccgccgttttcgtaccgctgttttcgtaccggagacgttttcgtaccgccgttttcgtacgagtgagtatcgaaaaaattgcattcaaataatttgttaattttttttaattacttttaatgttttgacagttaagcttttattaactacaaaatgaaccagcagcaagtaattaaaacaaaacgaaataatgataaattggtgcatgatggtgcactttatgtgttccacaaattcagtaacgatggacttaagaaatttggcggtgtgagtttcatagcccggcagaccaatgcaagggtatgcaatatattattttgaattttgaaaatcttttaaaattcaggacgcttgcacacggatttaaatacgttgtgcagaagttggtcggagttcattcgtgcgacatgaacgctgcgcatgtggaatgtcagcgtcttgtaactggtgacgtgctgctgtga

SEQ ID NO: 74625 - DNA, 1554 bp, Heterodera glycines
  Genomic contig location: Contig_ID=SeqID_1583; Location=495..2048; Strand=+
  SCN-specific regions: Sequence locations=1-95,166-174,196-266,333 -449,491-762,784-787,873-1279,1438-1554
atgtctgaacaaaaaccagctgaatggcgagcacagattgaataccttcaacaaattaattgcgataataacgtagacttgacttatcgtgtaagaaaataaattatatttatatgttaaattacgtttaaactaatttattaaattttgagaaataaataaaatcagagaaggtaattatattttattttgtttcaattaaattaagtattcaaaattatggtcaattggacattggtcagatgattatgcttaataagcaattgataattattttgaattaattaggattataaattatttctaattttttaatcaatttttaaaaaattcaatttgagctggaacaaattttgacaacaaatggtcatggtttacttgacacaaacaagacacaagaaattaatgaaaatttcaacaaaattcggacggtcattaaagaatgggtgaatttttaaaattaaaaattcattgaaaaattttaaatttagttaaaaggccaaagcgatttgttgttaagcggatcaatgatgttggatgcttttacgatgggttctgatgttgacaccatttgtgtgtcgccagaacatattcaagctgaccaattcttcggcaaagtgccgtgccatcaaaaatttgccgaggaatgccgaaatgatgactcactgttttgccgactgtgctttgtaacttatcgtatcaattgcaaattatgattccgcagttgcggaaaatggaccaaaaaacaaggattaggaaatgtccaaaattcaatttttcaaaccccataaaaaatttttttaatttaccattttttcagcactgcttcaaataaatttaaaatcgaaaaaattaatagatttttaatttttcagcacccggaagttcattcactgcaacggatccaatccaattgggtcccgctgatcagactaaaactgatcaattttgatcatgaaattgacattgttttcgcttcaattcctgggcccgtaccaaaagaacgaggtaagggttaacctacccgttacccgtactaaaagagcaaccccgaattgagggtgacttaacccggttaactaaccctcagctgcgggtaacttttcaacccgcacccatgccagggtaacaacatgagcatgttttttgaaaaaatattcgccctttggaacatgaaatacccacaaaaattcacaatgtttaacgtttaataactttcatatctaataaattggcaaccagcaaaaatcatcaaaaatgcacttgatgagggtatttgttttattaattaatttaaataatttataaattttgtaaagaatttatttaattatatatttatttattttaattgcatttaaatattgtcattttatatatttttgtaaattaaaaataaagtattttattttttacataattaaaaatttttaaaaagaattgtcaaattccctgcttttcctattttcagcatttaaattgttttattcttcaaaaagtgcaaatgaaaaattgcctatgctctttgaacaacaaataaaattccacgaaaag

SEQ ID NO: 74626 - DNA, 609 bp, Heterodera glycines
  Genomic contig location: Contig_ID=SeqID_1584; Location=434..1042; Strand=+
  SCN-specific regions: Sequence locations=1-126,148-240,262-324,353 -397,419-542,564-609
atgacattttggaaatggaaaaaagaagtaatgccaaattgtcataaatgtaagcaattattttaattttgagaatttttttattcagttaaatatgtttttagcaccaaataaatattccaatgaggaaaaattaagaaagataaagcaatatttcgaaactaaagaaaagaatccaaaaatttgtgatgaaacaaaagctaagaaattgagaattgcgagtgacactctgagaatatggaaaaaagaaacttactttagttccggaaaagtgattttttaaagaagtttatgtttttttgatattagcttgtttatgttatgataaaaaatttaattgttttatttttttgtgtgactaatagcgaaattttaagctggttacaaaggcctaaattaatttaaatatgtttagaagtgttttagcccattttcatactgctcgagaattttgttcaaaaaattagcatttgcgtcttaaagctataaaatttttagtcaatttaaatctcctaaatttgagaattttatgtcatattttaatttcttaggtcataatcaatataataattatatcaaattttacgcattgaattgagtttcagacta

SEQ ID NO: 74627 - DNA, 808 bp, Heterodera glycines
  Genomic contig location: Contig_ID=SeqID_1584; Location=2835..3642; Strand=-
  SCN-specific regions: Sequence locations=1-293,403-808
atgtataaaaccccgaaatatgtaaaaatatgtaaataaagtcccaacttttgttcgcaaactcaaaaaagaaagtgttttcctactatttagattatggagaatgcatgaaaaaatatgtatttacataaaattggcatccctagtcatcaagtcacaacattaataattaaaaacgccaaggatttataaaaattgaagatatttaatcccgaaatttttgaagcataagtttctcccattctacaggacttcatccttctgtttttcataagtataatttattttccatgattttattataataattttgttgaattatatcaacaaatttcattaattattaaattctttaagacttttatatacaaatatgaaaaaattcgattaaattaaaaaaatggttagaatgaataataaactttggccaaactttgattaaatatttggagatggatggatggaaggaaataaaaatgaaaaaagtgaaaaattcacggcaatgtttgatcagagatgccgggatatacgcggtctgctggagtttcgaaaaaatgaattttaagttcttcgggctcctgtcttgaggctttccgaacaacaccattcattgagtgcaatggtgcgagggcattttggtaatatcatagtttttgaaattttaattcaattttttcaaaattaccatctcatttttcagtcactttttcgccaattaattcagcttctgactgactactgtggacgaaaaccaacaaatacggtaaatttacatagaaagatcacatagatgtttcattataataaa

SEQ ID NO: 74628 - DNA, 939 bp, Heterodera glycines
  Genomic contig location: Contig_ID=SeqID_1584; Location=3689..4627; Strand=-
  SCN-specific regions: Sequence locations=1-757,780-852,893-939
atgtcctcgtcccatgccaaagtgactgtgcttcttctgctgttcgtcattgcctttgtggcactggcagtttcggcaccagttgcagaagaagcaaatgccattgttgaagcaaacaatggcaaattagcggcttccattggcacggatgaagcaacaaggtgagatgaaatgcgatacaagacaattaatagtataattaccaaatttctttgattattagacccgggtcttttattgttcaaccccccccccgcccccctaaaaaggggtcatatattcgaggggagtctaaataatcgaacacatacggtactcacttagatctaaacccaatttagtgctgtagaaaactcaaatccggttcgaaatttccttgaaattacgtgtgttttttaagtttgatacgccataaacgatacggatacggctacggtagacgctatggcggctacggtggatggggcggctacggctatggcggctggggtggcggctacggatatcgcagttgttattgtggctatggcggctatggctatggatattatggaaaataaataagatagaattaacaactataattggatataatatatataaccacataacattatgtcaatgttgtataaatatataaaagttatagcttataacaaatttttctaccggttaattactacctaaaaatgatctaatttatattgctgttcgagagtctcggcctcaagtctcggtccatgtcgcaagtctcggctttaacctttttgtttcttaatcaatcgctttaacatttacaattaaatatataagaattgatagaaagatgattatataatttatatctggttcattattttaaaaatttttttgaaatttatttaattttttagcagatttattatcaaattatgaatttacaaggatttttggaataaa

SEQ ID NO: 74629 - DNA, 831 bp, Heterodera glycines
  Genomic contig location: Contig_ID=SeqID_1585; Location=168..998; Strand=+
  SCN-specific regions: Sequence locations=1-464,486-831
atggtctgtggaaatgcgttcaaagattggcacagagacgcgcatccgatcgatggaagaggcggagagggcactgcaacggcaccaggaaagactggccgaaattggggcacgagaggaagagatcagcgtaagtgacaagccaaaggaaaagccgaatggggaggaaaagccgagtcgcgaaaagaagggatgatcaaagcccaggaatcaccacaacagtcaatgtgttatttcagactctgagagaattcggccataaattggtccaggaacagcccgaactgaaaatggacgtgcaaagggcgcaacggcgcattcagacgatggagcaccagacgaaacagtactgggaacaacataacgccaaattggagagggaattgcgcagacagaaaattgaggcgaatttggcccaaatcgaagcatggactgcgacgaaagaggcttttctggatgggttggtggcgggcgacagcacagagtcggtggaagaagcactgaatgagcactgtgagaagaggcgcgggggggacggactacggaggggggtaattagccaatcaaagggaggaggaggctaataagccaatcaaattgcaaatggcaacaattaaaatgttgaatcaattggcatttcagcgcattttgccaaaacactgaatgtccaaatggagcaccgttttgggcaattggatactgcggaaaaggaaataagcgaaatgggagacgccgaagcggaaacggtgcgcgagagagtggcggagacgcgggaaaaatgtcgcggattgaccgaatggacagaagtggaaaaagccgataaatagttta

SEQ ID NO: 74630 - DNA, 804 bp, Heterodera glycines
  Genomic contig location: Contig_ID=SeqID_11261; Location=303..1106; Strand=+
  SCN-specific regions: Sequence locations=1-59,82-163,185-249,272 -314,355-459,524-631,653-804
atgccttttttgctcgaagccgaatatttcacatgtggccattcggatgccgaattggccattgatttggacatttttcaaacacttattagcattgcattggcaatggaactgcgggacaaattagtgcgctatttggccgatgaattgcccaattttcaaaatgacatgcaaaaaccaaattttgcaccatcacccaatgacatcatccaacaataccatgccaaactttgcgcattggcaacaccattttttgggaacaaatttggccagaaagaagaacagcttgtttggccaagcttgacacggtaaaaattgaaatttcaatgaaattttggaattttaaattttctaaaatagatgggctcatttggctgaccaaagtgacattgaaagtgccatgctttttcttcatacaattcagcaacaaaatgtgccaactcgaaggtattaaatggctaattaattttatttttttattttttaaagcggttaaattaataaattaaatattttattttttgcagatttttacctccacttagtgcccaaaatcgaccaaaatggtgctcacttttgttaatggatgcttcatcggaccatgcaataattggtgcttcattaaattgggttggccatttggaagtgtttgttgatgaggagcaaaagttcaaggtgatttaagcaaaaaagattattttacagtactctcaataatcttttacagtactatcaacccacaaaaatattattttacagtactctcaacacattaatactgtgtattcagcttgtaagcactga

SEQ ID NO: 74631 - DNA, 2613 bp, Heterodera glycines
  Genomic contig location: Contig_ID=SeqID_11262; Location=137..2749; Strand=+
  SCN-specific regions: Sequence locations=1-418,440-491,513-525,547 -789,811-945,968-1033,1101-1154,1226-1259,1281-1979,2002-2039,2062 -2214,2236-2268,2293-2297,2319-2319,2341-2399,2433-2581,2604-2613
atggacacaattggacaaagacttgaatggattcggcaacaatttgaacagcggactgttgtgggacaaattgatgaagccgaaatgtcaagctcattggaggaggaaggcaaattaagcaatgaaaatgggaaggatgccgtcatcaaaattccacaaaatgaagacagaaagccgaaattcggagatgaacttgaaaagataagggaattaggaaccatcactgagaagacatgccaagaaaattccaaagtcgaaaagcctgcttctgtaaatgccaaagtcgaaaagcctgcctttgaaaatggcgaagtcgtcgaaaaactaccattcgaaaatgccgaacaacaaaagccacatcgacaaaatgccgagaccataaaaacgactcttgaaacagcgagaatggcaattccggctcttaaaaacggtgaagaaaagccatatttggacagtgccaaagaagtcaacaccaagacaacttccgaacaagctgaatttgaagaaaaaattattgccgagattgaaagtcctcaacaaaatgccgaaattggactaagattattggaccacgaatccgacagatcttttgtacgtcagagcccaccttcatctgctggctatcactcctcacgtccttcgacttcacaaaacaatagtcacgaagaagaagctaatgtcaatgctaaattaaatgccaatcgaagaaatcaaaatgccaaaactggaaatgtgccaacgcctccgattgttgaaccaatggatttccgcggtttgagaagcagcgatgaaggagaagaaatggagcagcaacagcaattgaatgtacagcagaaaaggccaaaagtccgttcatggaaagagatagaggtgaggaaggaggtcttggagggggtacgaacagggaaaaatcaaaaatttcagcaaaaaatgcaaatttcccccaaaaaaaaaatttttttttttacacaaacccatctctgggctaaaaagtacgggaacggaactggtactcgcgacaaaccttaaagtgtaattaataaaaaaaattttaatgttcaattttaaaaaattaacaaataatgatttaaaaataaattgactgtattcagttgaaaagtcgataaatcatttgttaattgctgagctgtttgttttaattttaaagaatatttaaatcataattctaaattatatttaaaattaatttcaaattcaaaattaaggtgttccctcggaacagtccatcaaatgtggaaaagccatcaattttcgttaataaatgcgccaaatcgataccaaaatccaaaaacaatgctaattaccccagcaaaaacatcaaagaagaagccgtccaacaaatgccgaaacggtcaccctggcggcggccccaatggctgcgtttgttgccacctttcgatggcacaattcgtacagaacgccaaacaaccacggcacagattaagcacgggcatccgttgctcgagcttaaactcgacggttcgccaatgttttttaattttctatttttatttttagagcatttttcaacgcctcggtctacggataaagtggcaaatgccggaggtgatgttggcacttttttaacaaatccgggacgatgccgaagaacatttttggagttggctgccaaaaaggagcgtcgtcatcggagccaaaattcgagcctcaacaggccaaaaacgacgatggtcagtttaaaaaaatgcaaataaataaataatctcaaacaaaatgtaaataaaaattgaaatttttgaatcttaatttttctccaaaattctttcgctttgtttgattaaatctaatggacaagatctaattgtaatttatgaattaactcattattgtataatacagggggtttagccccgaccaatcggggaagaaattctcggtgatcggggtaggggagcgcaaaattgtcaggatcggggaccacgatcggggaatgatcatatttttatttgaacaaaaaattcatttttttgccacttactagaaatgggctaaggccgagcccagtacatttgaagaaagggtcataaaggcatgccgtgggaaaaatgaaaaattttgcgcgatttggcgaaaaatttttttttttactccaaatttcaatttaatagatttttgagagccggtgaattctagcttttttcattcaactttccttttttttgacctaattggaccggataattgtcattcctaatggtctatttataattgatcagtttgatgatgaaaaaataataatataaaaaatatcctcaaactactaaattagcaattttgtaattaaaaatatttaaattaggaccaccagcagcagcaaacgcacaacaacggcatttacgacagtggcatcggacttgagcagcagcagcagcagcaacaacagagcaacaatggcacatcaagaaatggcattgtgctgtacacagttgagcttgaagaagcggatgttgcggcaatgcgaaggcgtgccgaaggccgtcagaattgatagttaatgggcaactaaccattttttgaataatttaatttagattttatgttggaaaatatttttattttctcgaaataata

SEQ ID NO: 74632 - DNA, 846 bp, Heterodera glycines
  Genomic contig location: Contig_ID=SeqID_11263; Location=397..1242; Strand=-
  SCN-specific regions: Sequence locations=1-179,330-347,370-383,405 -425,447-846
atgcttccattacaaagtggtttatcgtcagcaaaaagttttgcaatgttctgtgctcgtggcattgcaaaacgcgtttccgtatttgccaaaatcccttttgtcggctctatgattgatgctgtacggaaaattatagcagatatgaagaatagatttttgccactgttggcagaaggtaaaataattttttttttttgtatcaaaaaataaatgcttttttattttaattaattaaaaacattttcaattgcttttaatttatttaaaattcatatgcatttaaatagttatgtatgtttattttataaatataaatatatttaattgctctaatgggttggattaaatagtattcttaaatttaattttctaaaacgatttggcacattaaaattttcagtgaatgttgtacagaactggagaaaaaatgtggtttatttaatcacttatccgcgaatcggcgcatttgatgagaacaggtaggaatatagcacgtaatgggactcgaacccaatcaattttctattttaccactgagccattagaacttttttttagtttgaaaaactaaccgtaaacactcataaaaatttcaagaatttcagatttaatgaatttttgctatataattaacatttgtgcctaacatttgggaattggcacttttacagtgggcacagtaatcttctgtttcattacagtaatgtgccagtgatttcgcccgctgcattgaagctggaggtgtggctgcaatttcgcggtgtggatttttatgtaagcaagttaatcactaatcatccacttttgccgcagttaatttcatattttctcgctcattgttaa

SEQ ID NO: 74633 - DNA, 337 bp, Heterodera glycines
  Genomic contig location: Contig_ID=SeqID_11265; Location=71..407; Strand=+
  SCN-specific regions: Sequence locations=1-337
atgggcaccactgacaacgaagagaagaaaactgagccgatgaagaagttctgcaaaatgttttcatgggttcagcaaatgttttcatgggttcaggtatgtgttctctaaatacctaaaaacggatcacaaattttcatgatttccttattttgaaatccattaaatttagaaggaaaatgtcgaaacaaaaattgacgacgacgaaacattgttgaaacggttggacaatgtgttcatggtaaaacatccgccggaattgctcaatttttggcgacacgcggtcaaactgaaccccaaaaagccattgggtaaatatttttttacaaaaatttaa

SEQ ID NO: 74634 - DNA, 995 bp, Heterodera glycines
  Genomic contig location: Contig_ID=SeqID_11265; Location=1251..2245; Strand=+
  SCN-specific regions: Sequence locations=1-457,479-603,625-995
atgtccaacaatgggccggactatttgaaaatgctgaaaaagcggcgtgacagagaatctctcgaaatgctattccatggcattgtcaacaaattcccactggacgacaaaggcattggctaccaacagctgctgttggacgacgccaaggaaaatggtaatacatttttgttttttcttggtacacccattttcgtaaatttacgggtttttttttaattatctcagttttttaaccaaaatttcagcccaactaaagcggaacatcaaaacaatgggcaccacggacaacgaagagaagaaagctgagccgagtaaaaagttcttccaaatgtctccatgggttcaggtatgtgccctctaaattattcatcattttagctgttgttgttttttttgctcactcaaattaaacaacttttacttgtacgcaacggcattttaagcaaaaagaaacgatttttgtgtcattttacaaataaaaacaaagacactttcaattagcctttcacaaatgattggccggacatattattattccattatcatttccgtaactaaaaggaggtaaattcttttttttaagctgtccttttgcttggttttcttgctcctttcatttttggtgttgtgctgctgtgcctccaaccaaactcaaaccagcacaacaacagacactgttcgtttggttttttggggcggtttttttgggtttatttatttttcaacagatttcttccaacaattcttttgctgtcactaagccacccttttggctgcccactgatcccttttggcgtcccgtattcgatgcaatgatttatgcagccattgctataagtgccatcaccgtcatttttggagttccgtttatgattttcattgcttgtattgcttctagtgcggctagagactcggaaagatgggctgaaatgatcgagcgaagggagcagcagagacgcgaggcggaaagaagagatgaactgctgttttaa

SEQ ID NO: 74635 - DNA, 1017 bp, Heterodera glycines
  Genomic contig location: Contig_ID=SeqID_11266; Location=142..1158; Strand=+
  SCN-specific regions: Sequence locations=1-115,138-318,341-344,376 -522,549-693,715-1017
cccaactaaagcggaacatcaaaacaatgggcaccacggacagcgaagagaagaaagctgagccgagtaagaagttctgcaaaatgttttcattgcctcaggtctgtcgttaatgttttaaaaaaaaatttttttttgtttcaaaataccaaaatactacagagaataagaatgacaagaacgcatactgctccgactcgtactgttttttgtatgatcaaaggaggccggccaaaaaaaatttagttggacggcaaaaaaaaatttttcgaaaaacaatatagatttaggctttgaactttttcccgcaaacaattacctttttaaaaaatcaaatgatcatttaaattttctttcagctttcattttgcttcgttttcctgctcctttcattcttcgtgatatggtacacatccgatcaaactcaaataaacacggtccgtttgcttggcaatcctggagaatgggtgtgcccaatttaacttttttttaattttgtgctcataatcagtttttgagcccaaattaaaataatatattaaaaattagggacacccattcgcgtgtcccggcatttgcggtccgacatttgcgcctttgtccaaaatcgagttagtttaagctatcagggattgaaaaaaaaaaaaatcaactttgagtccgattttggacataggcgcaaatgtcggggctcccccattctccagcaggattgccgtttgctttttttgtttttcgttttatatttatttattttccagaaaatgccgttgaatgattccacgtccgtcacacctaataagcctccgttttggccgtacactgatcccttttggcgctctgttgctcatggagtgttctacgcttgccttgccatttctgctttttctctcatttttggctttgcgtcattcattttcatttttgttctgctttcgcgcactttgacaaacatggagcatattaccatgacctgttatgaaatcgacgagatatttgcgtggatgcgtttgaaaa

SEQ ID NO: 74636 - DNA, 1575 bp, Heterodera glycines
  Genomic contig location: Contig_ID=SeqID_11267; Location=3207..4781; Strand=+
  SCN-specific regions: Sequence locations=1-506,528-984,1006-1370,1393- 1575
atggacgaattttatgtggtactaccatccaattcacctggaccagggaacacgacctcaaaattcactgtcaggcttccacatacgcttgagctggacgcaaactggatggttgcactttcatcaattatctacccctattcattcccatctgtcggaattgatgatgacgacttcatcagcattaaacttgtaaatccaaattttaaatttgcggatgacaaacgttttgtggatattgagctaaaaataccgagtatgcaattctctagtgttgggcatttaaggcaaacattaaatgacataattaatgatgcgtataaacagcggtttgggctctcatcacagaaagccgccaaagttaaacgccaaattgacgttacggagcttttttttcacgatcaccctgtcgattattgggaaaaaattgaagagttggaaaaaaggttggttgaattgagagaggagattgatacgaaggagagggagcatggtgccgaaggtacagagcagaaaagaaaaaatgaacttgaaggtgaattgaaaattttaaggcttcgcctcaagagaaaagatgatgagctggaggagcttaagcgggcagcgaagcgtcgcgatgacgacacccctgagaatcagcagaaaaaaatacgggaattcttccatcaccatccggatgatcatgaaaaaaagctgaacgagtctcgactgatcttcacaaaatatttgtccggtttgcaagaaaaaatgagtgaatatatcggtgaaagagatggagcaaaaattgtgcaacttaatgaacagacagggaagctgagagaaaaaatcaaatacttgctgcgcaatcttaatttgtttgagagcgctgtgctacagcgcgccaacagtgatgacccctcgcgaaaaacgagagaggaatatgaaaagagcagccatgaacagaatagcgtatatgttcaggaattttttcaaagacacccgaccaattattggcaaataattcataacaactacgacggtctccgggaacagttcgacaagatagaagaactccaacaaaaaacggcacagaagcagctaaaggacgacgagcactcatcgttccagcagcaaattgaccgagcaaaacaactgctggaatacagacgcaagagatttgccgcattggaatttgaggcaaagaaacgtgacggacaacagcaacaatcctctccattctcttcaccaatttcatctgcattgaccgccggagaggcgttaaaggagcgattaggtgccgttcaagtgaagcagacagaaaagtcggatcaggataataataattcgatggaaaaaccaaaaacccacgctgaggttctcaaagagaaaatacaacaacaacaacaacaacaagatatagccacgtcgacaccaaatgagttgcaaaatgacggcaaagcagtagcagagccaaaaacccatgccgaggttctaaaagagaagctagaacaaaagaaaggcaccagcgcatcagctgagagggatggtgatcatgacagcgatgccgtcgatttactatcgcgaggtcataaattg

SEQ ID NO: 74637 - DNA, 1586 bp, Heterodera glycines
  Genomic contig location: Contig_ID=SeqID_11268; Location=144..1729; Strand=-
  SCN-specific regions: Sequence locations=1-105,127-239,282-375,427 -472,521-657,687-718,750-755,780-827,850-877,899-1126,1148-1156,1178 -1531,1553-1586
atgcgtgcccttctcttcttgaccatggttagccttgtgttggctgttcttctagaaacaggttggtcaaaaaaataagaaaattatttacaaagtgggccccataaggcattttttgccattatagtttacgagggcggattttccttaaattttgtcccaaattataaatccatagcaaatataaaacataaccaaaattaagattaagatttctttcacaatatagctctcccatgaaaattatatatatatatttaaatattatttattttaatttagcaattcaaaagctgtgaaaaagggctttcttctatatcaaatataaaataaaatcacaattaagatttttttttttcaaaatgtagctctcccattaaaaataaaatcattatatatttaaatattatttatttttttaatttagcaaattcaaaggctgtgaaaaaggataataaaaggggtaaaaagcaaataatttaattacttattattttatttaaacgtttttaatttataaggagcagtggcagcgcacggaaaaggcaaagatgcccataagggaggagcaagtccagcaaaaggtaaactactgaattacagtatacagaaacagtattgctatagtaaaattaagtattggacttaagacaacacttaatatttatgttattttaaattaaaatcgaaggaaataggaataaataagaataattcgttaattattataatttacattttatttttaactctccatattttaggtaataaaaaagcagcaaaatcgccgggtaaaaaggatgccaaaggaaaaaaaggtttttaagtattggaaatttttctgcaaaatgttcttcaaattttagacaaaaaagataagccagcaaagaaaggcaaatcaaaaggtgtaaattattgaagcaaattccaaacataaattaattattttagacaaaaaatcaaaaaccgccaaatcatcgaaatccaaggacaaaaagacaccaagtaaatcctgaccatgtattgaccacgattgtttcaacttttctaatgagatttttcgtaattttaagaatttttctgacagtacgaattggcacagctatttaaatagtttttacaaaacttaaaatggatatttttgatagaaaaatcattaaaataaagaataaattaagccaagcctagcaaagctgtgaaggccgcttcaccaaaggctgagccggcactgaacaacgaaccatccagcgcaccagcaactgaagttgaacaggaagaacaggacgtcatggaggctgatgaagaattaggagaggcgaatagtgccgaatcttacgatttggcagagggcgaactgcttgaagatgatgccaatggtgatggtgaagttgatgccattgatgctgatgaggaaccgatggaataggaaatgtctagtatattgttgtggacagattgcaaaaacggaacaaacggggaaaatgtgatgaaatgtcacaacaaatttacattttctgttatatattcgtagttatattaaatttttatatttcaatactaaaatatgagtataaggataaaataaa

SEQ ID NO: 74638 - DNA, 1003 bp, Heterodera glycines
  Genomic contig location: Contig_ID=SeqID_11268; Location=2236..3238; Strand=+
  SCN-specific regions: Sequence locations=1-62,111-241,263-270,318 -479,520-880,902-903,925-950,972-1003
atgcgtgccgttctcttcctggctatggtttgtctggtgatggctgttattttggagactggtaataaacattatttaaaaataaacaataataaaatatatctattttagcgaactcaaaagcagtgaaaaacgacggtaaaaaaggtgaatataattgttgaaaataacaatatattaaaatttaaggagctgttgcatcgcctgccaaaggaaaagcttcgccaaaaggtgccagcccagcaaaaggaaaaactgcaaagggtaacgaatttaatatgtttttaattatattaaataataatttaaattaataaggtggcaaaaaagatgcaaaaaaagcgggcaaaaaggacggaaaagtgaaaaagggttagttggtatttgaaaaagattttttgaaaatgtttttgaaatttagaaaagaaagaaaagccggcaaagaaggcaggcaaagggaaagatgcagctaagaaaggtaatattttaagaataatttaatttaaaaaatgaaatttagacaaaacaaaggacaaaaaggcaccagcagcaggtaaactcattaaattctaacttaatgaatggcattgtgccaatttggcgatttaagccaagccaaaggctgagcctgtcgagactgaagagccgtccagtgcacaagttgtagctgaacaggacggaggcgaagagtcggccaacaaccaagaaatggatgccggtgaagagatgacggaggaggaacagacggatttggcacaggatgaacagcttgaagatgatgccatcgacggtgaagaaggcgatggaatggcggaggaagaacaaccggagatgaactaataaacttattttttgaaaatatataggaaaatatttacacgggtcaaacggggccaaacctattgtaaacattattttgtataatatttaatttatcaataagaatcagaagataaatttgtaaacctatttatttgagattttgatttactaaaaaaaaaaa

SEQ ID NO: 74639 - DNA, 1158 bp, Heterodera glycines
  Genomic contig location: Contig_ID=SeqID_11270; Location=623..1780; Strand=+
  SCN-specific regions: Sequence locations=1-86,108-261,284-410,432 -440,462-532,554-1082,1105-1158
atgcttaagccttcaatggatcagaaacattttgcttcgggggttgtcaaagaaacgaatgtagagtcaatgagatccttagggagaccaaaatttattttgtggattgcggtgaaagtgacacaagtgcaagaaagaaaaaatagggatgttcatgaagagttggagagagctgaggaaggaggtagctttgtagcacatccgatgattccgcagggtttggagttgagaagggcatgttttgcgtcaaatcttccatctcgagttgccaagctggacacaaatcaaggaaagctgatgagggcagtaatgggtcgtccacgagaacagctggttggtgaacagggagagattttgggtcatgcgtcggcagttcaagagtttcacccgttgatgagaaagttaaatgagaggcaaaaagtgtcggccaaactgttgttagggaatgagtgttgtttgatctatcaaaatgcgccaccaggagttggtaagacttatgttgcatcaattgtggcggcgattctcttgtcgataaatgaaaatgtcaaaattgccattgtcacatcagcgaatcttcctcttgcaaaattagcccaagaattagacgaagtgttaggtagtgacgaaatggaagagtcgggatcgattgcgttcttctcgggttacgcgaaagaaaaatatagagagatggttgagaagttgaagcgtcacattttggtgtcaaagctaaaaagtgaggaaattcagagcaagtttgaagagagaagtgaagagaatcaagataagagagatgtgagagagtattgccaaaattatgagttcaggcctaggctgacaaaagagagaaaaatggcatcgttgtatgcggaagtggcgaacttgagaattgttttcgcaacggcaacgatggcagagaatgtattgtggacggcgttgactggcacttcggtgcttatatttgatgaagcaacacagggttcctgggtcattctggcacatctggttgctcggttgccgaaattggagaaggtatttgtgaccggcgatcgttaccaacttggtgtccatctgcaggaattgccaaaaattttgagaaagggatttggcttagattcgatggtcgatcagctggttgattctccgaatgttgtgcaataa

SEQ ID NO: 74640 - DNA, 437 bp, Heterodera glycines
  Genomic contig location: Contig_ID=SeqID_11271; Location=274..710; Strand=+
  SCN-specific regions: Sequence locations=1-437
aaaatggtctaagtaaaaatcgtaattacgctcaaaaagcttctcaaacaattttagcgcttccaattccttctataatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcttaattacgctcaaaaagcttctcaaacaattttagcgcttccaattccttctacaatcgcctttatacatcccattatgaggctaaaattatcagagtgccgaaaatcgc

SEQ ID NO: 74641 - DNA, 516 bp, Heterodera glycines
  Genomic contig location: Contig_ID=SeqID_11272; Location=661..1176; Strand=-
  SCN-specific regions: Sequence locations=1-516
atggttttattcaccgctataaatatagcattagtattcctttgctgcaacaaaacgtattttggtaataaaatttacaaattttggcatttagcaaatccatttcccatcgcattttatttacagaatgcaaacacaccgcacttgaagtgttgttcaactgtgattcatgtggccacgaagtgcacagaacttacgaatgcttcagtacggcactgaattttgttactccaattttctgctttatcacctacactttaagtttactttgtctatgtgaactacgtggacaacagaaggcgccaccgttggtatcgttactgtcgcaacaaaacgtacagtccatggggacggtacacggcggaaaatgtcacaagaacggtggagcagaagccgaggccaacgaccaccattgaggcggtggagcgcgaattcaaagagatgagcggtgaagagaaggacgattacacgaccagctgggcatggaccaccgatttgataagtcgccttgattaa

SEQ ID NO: 74642 - DNA, 423 bp, Heterodera glycines
  Genomic contig location: Contig_ID=SeqID_11273; Location=46..468; Strand=+
  SCN-specific regions: Sequence locations=1-336,358-371,393-423
atgacatttcgccaactagacataaaatgtttaaaatcatttttcattggcctcagtttcttcgccactttcttcgtttccatgaacatcattaagcccctacaaagccttgtatgtatcacaagtccgaacaactgcaaagaatttgtcaatccttcttccgatccaaatttgacctcgtcaaagatcgcaccaattttttacttgatgatataccgttggggacttaatgctttactggaggtgttctgctcgtccgatttccagcttgcggtgccttttggcttttgtatttcgcgaacagttggcaattcttattataattttatgtttacaggacattttgaaaaatttatgttatcattttcgggtttttaatgaaaatttctgatccaacaactgtctggggtaatccgttgacaa

SEQ ID NO: 74643 - DNA, 439 bp, Heterodera glycines
  misc_feature (296)..(296): n is a, c, g, or t
  misc_feature (368)..(368): n is a, c, g, or t
  Genomic contig location: Contig_ID=SeqID_11273; Location=1001..1439; Strand=+
  SCN-specific regions: Sequence locations=1-70,168-293,325-439
atgaatttttttctattcattactattatttttacattcgtaaaaagtgggtaaaatccattaaatatgcatttaaattaaataaataattattgatcacaattatttttattaaattattttatttttcatattttaatttgtaaatattaaaataataatatttaggcaacgcggtactaaattatgtggaagaagcatttagtagcagagacgaagttcaaaagttggccaattatgcaattgattgggcttttaacaacggaatgattcttcgttatgacatcagacagtanaataaataaataattataaaaattaaatggttatttttgccttatttagcaatttcatagcccaattctcanccgtttcgcttcttcccgtcccatttccgagagaagcatttgagaaaagcatcgctggtcaggaggttaaa

SEQ ID NO: 74644 - DNA, 2353 bp, Heterodera glycines
  Genomic contig location: Contig_ID=SeqID_11274; Location=915..3267; Strand=-
  SCN-specific regions: Sequence locations=1-82,104-370,393-495,517 -679,703-740,762-924,946-1377,1399-1757,1779-1951,1974-2353
atgaaagaggaagaagccgtaaaattggaaaaatggtataacgagaattatcaaacggaatttgaactaggtagacagaaaaatatgggtttttaaattatattggatttaggggaacagctgaagatatattgcgaaaacgacgtggaaattctgttgcaatcagttttgaagtttcgacaattgtttttggaaataacaggggattttgatgtgatgaaagacagtgtgacaatcgcaggagttgtgatgaagatcttcagggcaaaatttttgaaggagaggcacattccgatcatgcctgagggagggtatgagagagctgaaaatcagagtaaaatagcggtgaaatattttgagtggcttgcccaaagaaaaggagtaaaagtgcggcatgcgtgtaacggaggagaagtggaatttggtgggctgaaagtggactgtgtgataggggcagagaaaaaaataattgagtttcaggtaaaaggaaaaatattttctttttaaacaatacttaaggggtgtgcatttcacgggtgtccgagatgttttttaccttgtactatagcgccaaacggacggactatggaagagaatcaaagtagaaccgaaattcgcatggaaattttgagggaaaagtgcaaaaatttttcaatcggagaagtttgggtagaataaaacatttagaaatatttattaattgttagttttaggagtgtgatgtcagagaggaattgaagaaaaataaggagatgaaaaagttctttgaaagtgtgccggacaagggaccgatcaatccgagggatgcttatgccgggggaagaacgatgccattttgtttgtacgcaaaggctaccgaagaaattgagatatcaatgttcgacatcattagtttgtacccgtttgttaattatggtaaaaatctgcttaatttttgttagtttcctttcgcttaagacaccccataccccgttggagtcccgaaaattgtagtgagcaggaattttaatgtgaattggacagcacccgacgacgtaccctatgatggacttttgaaagtaaaagtgatcccaccgaaaaatcttttgtaccccctcctccacgtgcacatcgatgaaatgctcctcttccctaattgttggtcttgtgcgagaagggccaagaatgaatttgtgatgacaaaagatgtgaaaaaatgtaaccatcgtcccacgcagagagcatttttggggacattcacatcaattgagttgcggaaggctttagagctaggatatagaattatgggattctatcgagcgtatcattttgaacagtttgacagtcaactgttcaaaggatatgtgcggatgtttttgaagataaaggtggaagcgtcggggtggccggcggaggtgaaaagtgaagatgaaaaaagagcattcatcgaaatgtacaaggcaaagtatgacatcggtttggattatgataagattgggtttaatcccggactaagaatgattgcaaaattggtgagaaattataaaaaatctctaaaaaatgttcgaatttaagggattaaacagtttgtggggaaaattttcgatgcgcaacaccctttcaagtacggaaattgtgggcagcatggaacgttggatggaattggggagagacaatacaattgagtttgggcgcccagtaaaaataagcgaagagatatcaagagtcgtgtaccggaaaaaggaggagttcatcagggagcataaagtgtcgaatattgttttgtcattgtggaccacgagtgctgcgaggctaaagctgtacgagtacatggagcaggtctacaagaaggaggggtgtaaactgctctattgtgacacaggtgaaaaggaataaaaagaaaataaacacaaaaatttagattctctagcttttgctcatcggaaggggcgctgtccgttggtggaggggaaatttttggggtaaaacataaattttgaaacgcatttaaattgtggttttaagggagatgactcgagagtatgcggacagcgaaattttggagtttgtgtccgcgggtccgaagcagtacgccttgaagctcagaaggaagaagggtggtgtgatttggcacaaaaccaaaatcagagggatgacactggatagacgaaacgaatttaaatatgaattgttcaaagagatggtgctggattacaagaaaggggtcaaaaaagtttttcactacccggagaagatcgggccgacaaacgacttccgggttctctcaaaagacgtacaaaaagaatatacaccggtgcagaaaaaaggaattattgacgatcactttaatgttttgccctttggatattattaa

SEQ ID NO: 74645 - DNA, 2622 bp, Heterodera glycines
  Genomic contig location: Contig_ID=SeqID_11275; Location=132..2753; Strand=-
  SCN-specific regions: Sequence locations=1-867,894-971,993-996,1018 -1432,1454-2024,2046-2224,2246-2455,2477-2622
atgattggccaagaatgtagagaatttcaaaaaaaatatggcgggccacatgcccatcgtgtctatcataccgatctgctcgcaatccctgaaaatgttgacggattgatttgggcacatattccacctgaaccgaaccaaaatgaaaaatctgattgggctatttttattcgcaaagtgcgcgagttattgccaaagtatcaatttcatgactgcggacgccattgctttaatcataaagggaaatgtaaaaaaggttttccgaagccatttagtaaatttacgatcttgcatgatgaccggccagcaatctatttccgtccgtgccaagaagatggcggacaaacgttaactgtaaaaagaggcaaaacacaaattacatatgacaattcacgagtatcggcatacaacccatatattttagttcactttgagactcaccataatttggaatatgcctatgggcaaagcaccaacttgaaatatttgtataagtatccgttcaaaggccccagtttttcgtacataaagactattgaagaaaatggaaaaacaagtattgacgagcctgcttattatgccagaatgttatatcgctcatctcctgaggcatattgtaggatcatgtcgctaaaatatgctaaattatctcatacggttattgctttgtcgcttcatttgccaggccagcaaaagatttattataaatcaagtgaaaaggagtctgtcgcacaacaagtacaggcaggcattttgcctgaaactcctttaacagcttattggaaaatgtgtgaaacggatcctgatgttaggaaaattctttttgagcatatgcccgaccagtattcattcaacaaatctggaaaattttggaaaaaacgtattttttctacacgtccacataatatacacaacagaaaaccaattattggacgaattttcccggtctcaccacgaaatccggagttatttgccttatatttgttgacaaaacattttccaggaaacccgcagcaattaaaaatggtaaacccaacgcatatctgtgaaacatttctggagacagcccgactcagggggcttattgatgacaacgacgtgtgggttcggaccatggaggagggtgctgcctcgctcaccccagcacaaatgcgacaattgcttgctaacatattaatttttgggtcaactgaaaattgtctcattgatggagccctgctctggaaaaaatttattaaacacatgtttgacacacgctgcacagaagctgagcgtcctgctcgtattgaccatgctcttgctcttttagaaaaattattagttgcacaaaacaaacaatgtaaagattatggactaccaaccccagcgatttcaattatgaatgatcaacaacgtgggattaacgagtttttcttcccccagctcgtaaaggatgatgatgctgacgacacagttgacacaacagcatttgaacatgggaatttgaatgcggaacaacaaaaattttttgatatggtaaaaactgcttttttaaatacaacgaattctcgactattttatttatgtggtgatggcggaacaggaaagacatttttgcttaattacattttatatcagttgcgaaaaataggtgccaaaattattcccactgcatctacaggaatggcttccacccgttattatgtaggtggtaccactgtccattcggcgtttaaatttggaattaatgttgaacctgggaaattacctgcgattccctttgatagtttctttggtaggcgaataatagaaagtgacattataataattgatgaaatgacaatgttggagaggacagtttttgaaaatattgatttactctgtcgtcaattgtgctcacaaaaagctcacttaccttttggtggaaaatgtgttataatttccggtgactggaaacagtcacttccagttgtgatcaattcttatggaagtgcagcacaagttgcggcatgcatccagtcctccccgctttaccctatattttcaaaatacaaattgacccaaagcatgcgagttaatccaaacgaaatagagtttcttaaatggtttgatgatattggaagaggagtaaatggagacacggtcgcaatcccaaaagacatgctcgtcgattcacgtgaagatctgattgcatgggtatttgatcaagggcttaatatgccaagtagcgaaatgctgaaacgacttcttttgtctactacaaatagaattgttgacataaataattcccaaatttctcattccatgcttggaaattttattgaatatttctcggtcgacaaggcaacagatgaaaacccgttttcggtaaatgcagctgactttgatgtagcccagctaaaccagctgaatccaatgggaatgcctacccatttgttacgccttaaaattggatcaattgtcgtcttacttgtaaatttaaacacttcaaaagggctttgtaatggcaccagacttcttattaaaaaactaactgacaatttaattgaatgtgaaaccattggtagcggatcctctggaaatggcataattattgggattcctcgaaaccgacatacatataaagacaagcgtcctgacggt

SEQ ID NO: 74646 - DNA, 995 bp, Heterodera glycines
  Genomic contig location: Contig_ID=SeqID_11277; Location=1213..2207; Strand=-
  SCN-specific regions: Sequence locations=1-98,120-459,490-592,615 -890,921-995
atggaaacaaacaaacagttcacaaccagtgttacggtatgatttctaccgtatacacaatgggcaacagttcgccaagaaactgcctcatcacgcggaagaacagcttctcattccgctcctttccaaatcaatttgggcaattaaataattagtttcgttaattaatttgctaatggtcggtcacccgaaggttccgccatcgaatgggcaagtcccttcaaatttgatatttacaatttgttaatttctctttcgctgttcatttgattcggatttcggtattagaaagattctcgactttttctatgactcatcgaggattgccttgttcgtctgcttgttcttcagtatcgaaagtccctttcccgcggtccatgggaatgtttcgggctgtacaattccctcaacatcatttgctgctgcttctattgtttcggatcacttcggtccattttgaattaattataaaataataataatttttatgttttacaaaactgagaattgaataattaaaattaaaaaacatttctttgagagtatttgtaaagttaagggaagaaaatgtgagaatgaaattggcgtttgttgtttgttgccctttttcttttatgatccattaaaaaagagaccagcagtgagtaaacaaaaacataagaaaaattaaaaatgaaaaaaaagaatttgcattcggcattttcaggcgccatcaaaaatgattgaagaatgtctgtgtacatatcatgaaattttcggttaattcgaaagaaaattcaccataaacgacaaatatactgtaaaatttggtaattctgtggacgataaaaaaatcttttatcaataatttaaaaaagcaaaaaactagaaaaaaatgtcggaacgaagcgaattttttcaattaattttttaaatttaatgaattaacttgaaacattttagtgagttgtggtacgataaaaaattcgaaagactttctcgggtttgagaataaa

SEQ ID NO: 74647 - DNA, 266 bp, Heterodera glycines
  Genomic contig location: Contig_ID=SeqID_11277; Location=2280..2545; Strand=-
  SCN-specific regions: Sequence locations=1-141,163-266
atgacacggaaagagcattttgtatcagctcctcatagtctgtgctgtaaacttgggaacggacaaacagttctttgtccgccggctcggggtaaagccgggccaatccatccttaattggataataattaattatgattgaaaagaaaattcaaacaaatgtcacttcagatttcactgacagaattatgccaattgatgttgaggaaaagggccctttaattgggattaattgggcaaatgagtcgcaaatgggggacaattaa

SEQ ID NO: 74648 - DNA, 1535 bp, Heterodera glycines
  Genomic contig location: Contig_ID=SeqID_1586; Location=1..1535; Strand=-
  SCN-specific regions: Sequence locations=1-7,34-123,145-148,202 -679,703-1260,1282-1345,1367-1535
tttgaactttttaataaaaaaatattattatttccgattttctttcacacagtgacagccggagttggtcaagtggtcattaagcgattctccaaggagcaatgcaaatttagttggttaaattgaatcattggaaatgccattcaattacctaatgaataattaatgaaaaatgaattattttacttttgtgtttaaaaagtgttctcgatctgtcagacccttgtctcaatggtggcaaatgcattcccggaaaaacttcgtgcgattgtccgtcgggatggatgggcaaatactgtcaccgtatgccgacttattacccatttcaattcacaaacaaaccctacaactgaaggtcgttgtcgcaatatttaccaaagttgcgaccggtgggccatggaggagaaatgcgaactcgtccgaactcaggtgggcttactgtacattccgtaactgtagcgcattcgattgacaaaaaaaccataagatgccattttaaataagtcgtaattattggctaccaaaattcacaaatatttttccgtccactcatttttcaaaatgacaattgccattctattaagaccaatttcttcgacattaattgcgccgtttcgtgcaaattgtgctcacccgacccttcaatcagtgagtgatcagtgacagtgactccccccctctttcccccattcccctttttagaactcactccgattccattggccccggcactcgaaccgctacaatttatgatgggcaaatggtattctcaggtagacgataggccacacatttggaaaaaacaatgcggaacaggcgagcaaagggctgcgctacccgacggacatggtggcgggagagtacgaggaaatgctggacatttcgccagcccaggcactccccccaggcgtagtttaaatgctggcaattcttctcccttttaggtgccaatgtttggccctccgtctttgaatttgacgttcgtttcgctaaaatttaattgatgcaaaatattattctcctccaatttaggagcacgtgttggcatcaaaatggtaatgggagaagaaccaatcagtcaaattgcttagtgtttgctatcccttcagacatgcgagtgacgcacggatttatcactttaaagcccaattcggtgggttttttatcaattatcactgattagtgctgatagtggtgaaatgatttaactaatgttgtgattagagatgggatttttagtgcagaaaagtattaaaataggttttcaaaatgttaatttttcgaagagtaaaaaatgttcattttttgtcacaaaattttgtaatttttcaatcttacaaatactgaattgatgatatttataatttatgcacctttgccaccggcagaatccgcccgaagttgccattctgagcacgggcaacgagggactgaacatgatcgaacttggcacgctgcagaaccacgcggtgacactgaacatcagttacatgtatgtggaatgttatgacataacgcaaaaggccatcaaaata

SEQ ID NO: 74649 - DNA, 793 bp, Heterodera glycines
  Genomic contig location: Contig_ID=SeqID_1588; Location=498..1290; Strand=-
  SCN-specific regions: Sequence locations=1-134,156-484,506-534,556 -660,682-793
atgaccaacacctcgttcagcaaaatttgtgcaaaatcgcaattgctcaacatcattctgtccgacattttctatttcgaagacaatttggacaatttggtcgcagaatgcctccaggggatgccaatgagtgacggctttgataaagcccgggtcaccgccaacaggacggaaactgagcaacggcacagaatcagagcaaacggtggccgaaagacgcctgtccatggcgtattgtgtggacatccgctacaaatggaaaagaaaagcgtgagtgcttcttcttttgtgccacctgttctttggttttgaaaagcctttttccgcgcacggaaagaggaaaaaatgccgaaactgaggcaatttcagcggaatgatcaatctcatcggctgatccattaaaatgcactggcgaacagagatcgaatttaatccctgaattattccaattcaaacaaacaaatcaatcacagcagatggccaacaaaagaccattgacggagaactgttccaactcgggccctggcaaaacgtgcaaatcaacaaaatgttttttcagcactttctctgtcggtcgttcgtccaaagccaacggagaaaataccaattcggaaacgatggaacagcgaaatttgtcggaaaaaggcggagaacagccgggacgaagcttcagctgagaaacagcataagacaaatcggaaaacgacgacttttgataaggcactcacttggtcaagggaaagacacaaattacgaaggaccaattgaaaagggaagggattttgaaatctga

SEQ ID NO: 74650 - DNA, 612 bp, Heterodera glycines
  Genomic contig location: Contig_ID=SeqID_1588; Location=216..827; Strand=+
  SCN-specific regions: Sequence locations=1-118,145-269,291-394,416 -520,542-570,592-612
atgacagaagggcggcaggcggaagaacagtctctgccgctggcggacgatggtacccacgcggtgttcccttcgaagccgtgccatgttcttgtctgggacgagttgcggcaaatactcaccgatgtgctcagcaaagaaagtgccaattactcccagttcggccttttctccaaccaatttactgacaatgccaagccttctccgctgcctcccctcgagcctttcttcgttcggcttgggttcgctgcttcccttcccttccgttttgccattgtcttttcagatttcaaaatcccttcccttttcaattggtccttcgtaatttgtgtctttcccttgaccaagtgagtgccttatcaaaagtcgtcgttttccgatttgtcttatgctgtttctcagctgaagcttcgtcccggctgttctccgcctttttccgacaaatttcgctgttccatcgtttccgaattggtattttctccgttggctttggacgaacgaccgacagagaaagtgctgaaaaaacattttgttgatttgcacgttttgccagggcccgagttggaacagttctccgtcaatggtcttttgttggccatctgctgtgattga

SEQ ID NO: 74651 - DNA, 217 bp, Heterodera glycines
  Genomic contig location: Contig_ID=SeqID_1588; Location=1063..1279; Strand=+
  SCN-specific regions: Sequence locations=1-73,95-217
atggacaggcgtctttcggccaccgtttgctctgattctgtgccgttgctcagtttccgtcctgttggcggtgacccgggctttatcaaagccgtcactcattggcatcccctggaggcattctgcgaccaaattgtccaaattgtcttcgaaatagaaaatgtcggacagaatgatgttgagcaattgcgattttgcacaaattttgctgaacgag

SEQ ID NO: 74652 - DNA, 1066 bp, Heterodera glycines
  Genomic contig location: Contig_ID=SeqID_1589; Location=4429..5494; Strand=-
  SCN-specific regions: Sequence locations=1-214,236-258,282-537,559 -1066
atgatcatcgcttgtgtcattacgttggaatcgcgtgacagacacgcgcaggtaattaattaatgacgaatttaattggccaattttaatttttcaggtcattcaagaagaatcggccgaattgcgacgttcgcgtcgttacgcgtcgcagcagaaaaaaggcgaaatcacaagaacagaaacggggcaaatgcgggagaacggcttgaaagtgatgtgcacgagaaggtgcgtgcggcaattaaggagtgaacggcgcaattaattaattaattaatgcccgattagtgaacaatttaaaaaagttgttttcgttaggatagcgttttaatgggttgaatttgtctgctgctgatatcataaactgccccttcccttctcagaaatacgcattcagcaggcgataagctaatgcgacgaagggacccccgacaaaagtaagcattgctttggcaggcaccacagaatgtgcggataatgctgccctttcagagaactgatttcagtggcgcacgacgaggaaattgcggcacaacagcaggagaaaccaatggaaacggacgaagtgcagcaaatagcaagaaagtgccattccaccgccaattgcccgaccattggcccatccctccgcgggtgactttgacaacgagcgacatgtccaccacggatccgatgaacgaatatgcactggaagaaatgccgaagagggaaaaagcggacagaaaaatgatgagaagcaattgggaagatcgaagggggaaagggggcgacgaagcgaatttgggaggggagggggcggcggaagaagcggacgaaaagtgccgggggacggagacaacgccgaggcgaaagtccgcctcagccgtacaaacggtaaacagagtgaggccgacgcggggaatggcgcctttggtacgggtcgaatcggtggtcgaattgtcactgtcctcgccacggtcagcggaagaacaaatggaaagataagcaaaaggcaaatgatgaagtgcagaaaaggacgggtacaaataatatattgcatattaaattatcaattattttgaataaa

SEQ ID NO: 74653 - DNA, 610 bp, Heterodera glycines
  Genomic contig location: Contig_ID=SeqID_1589; Location=1..610; Strand=+
  SCN-specific regions: Sequence locations=1-610
tggcgctgaaacagtcggccggtggacgcaatgtccgtccaagggaatgccaaccgccttcacggatgacgcatctgtggccggtgaatttggcatggaagcggcaaatgttggccaatttgggaagatctccagagaatgtccgctgagtgttggcgaaaagattgggcacgtctttgcctccctaattaaagtcattatccttaggtttcgcttttcagcttacgagtagcgatcagagtgcagcagaagccgcagactttttactttctcttcctttacttcgatcagaacggtgccttccttcgccaattcgaaaggcttttcactgtttttgccgtccccacaggccgttcccgtcagtttcgcttttccgcccgagtccgtcccctctcgcgcattttcgatgccgaccattgcgtacttagcgggtccatcggcttgtcaatgctcacacttcgctgtttgccgttcaattctcacgaaagcgatgcaacagcaaaggcaacgacagcggtgacattgaccaaattggacttgctcagactttccgtcaaagtgacggatggaaatgcgcggacaaatgtgcgacgagtggaaaacgaaccaa

SEQ ID NO: 74654 - DNA, 569 bp, Heterodera glycines
  Genomic contig location: Contig_ID=SeqID_1589; Location=1262..1830; Strand=-
  SCN-specific regions: Sequence locations=1-67,89-153,180-219,241 -389,412-413,562-569
cctcgttttcttcaattttacactcgacctgtaattttcaattttgaaatgttcacgaagcttttcttcgctgttctgcttcttctttccgtgctcctctcatttgaggtcctttccttcgtcatttttaaaatgattatttaatctccatcctttttatttaattatttataattaatcgtccatcttttagcatccttcccaaattgccgtggccaatgcttttccttcggaagtcaacggccgaatgaatgagcacaggcgaatcaaacgcctcagctgcaccaacgacaaatgtttcaagaattgtgcaacggaaccgggctcgcagaaggaatgcgcgagtatttgcgaatgcaattttagcagcgggtcgattaaggcaaaacaaaatgagtgaaacaaatgatggagaaagaaaagtgaaatggggagaaaaaggagcgaaaagtggtaggaaaaggaacgaaaagagggaagaaaaggagcgaaaagaggtagaaaagggagcggaatgatggagaaaaaggagcggaatgagggagaaaaaggagcgaaaagcgaatgag

SEQ ID NO: 74655 - DNA, 499 bp, Heterodera glycines
  Genomic contig location: Contig_ID=SeqID_1589; Location=3744..4242; Strand=-
  SCN-specific regions: Sequence locations=1-32,60-82,107-429,451-499
ttttctgtgtcaaattttcttaaaatgccatctttttcgtctgtttttgtcctttttgccatcgtcggtaaattggggagacattaattaaaacattttttaaattgttcgttttcgcagttatttcgctgggaaaggaacagcaaaagggggacgaactgagggcgaaacgacaaatttgccaaggcttttccgcccaatacggcgcatgcattgcacagaaatactcacagtgtgtttggtgtaacgatgcggtaagaaaagaacaaaacttggggatggaaaggcaaaagagtgctgctgggctttaggattacagagggccacaccgatgcgatgagaaatcatcgatgaaaggctgtgttcaaattgtgcagtgaaatcggcacaattaatgacggaacggaggaaatggaacaattaattagcgaaaggaaaaacacaaaagcatcatttattgtttctcgacacgtattggcataaaattattgtctgtcct

SEQ ID NO: 74656 - DNA, 1289 bp, Heterodera glycines
  Genomic contig location: Contig_ID=SeqID_11279; Location=511..1799; Strand=-
  SCN-specific regions: Sequence locations=1-693,715-1072,1109 -1163,1185-1289
atgaaggatatgtgctgcatttgtggcaaaaatcttcgaccgtatgggaggatgaaaataattaaaatagtaaagttgaatttacgaatttagggaaggcggcttctccggtgaacgtattgaaccgacgacggccaatgtttcaatgattcaccatgttcccgaattggttgtctctaaggaggtgaccaatccaacaaaaaaattcatagcattgcattttcctattatgactaattttggcaattagatagcggacgaattgggtgcacgtgaccatcagaacattgtccgtcaaaggaaactcatccttctgctcgaccttgaccaaacactcgttcacactgcgaaccgacctttaagggccgaggaaatgggagcttcggtcgcatttattatagtaaatactaaaaaaaactattcattttaggatttattcgtttatcggctgaatggttacacattttgcaccaaaattcgtccaaatacaagaagattcctcgaccatttgaacaatttgttcgaaatgcacatcgttacattcggttttattccaaaacctataaaaaatattatctttaaaaggtcagcgaatgtatgcccataaaatagctgaattgttggatcccaaaaagaaatatttcgattatcgcattctttcgagagatgaattgttgagcaggcaaaaccactaatagtcacaaagttttcaaaagtttcctcttttttagtatgcataaaaccggcaatttgaaggccctttttccatgcagtgaacaactgattttgatgctggacgacagacccgacgtttggatgcattccgacgctctcatccgcgtccgtatttatctcaatttttttttcatttagcgttttccaggtcaacccatatcgtttttttgtggaaattggcgatatcaatgctccaccacaggaactgctcgactcagtgcaagcgtcggaagaaatggaaaatacgcaagctgataaatgggtaaaatattgttcacctttagttttttgcacgttaatttaattttgttaagactttaaagcaaaaagtgaaatcgaaaacagaagaggacaaaaaggagggggaaaagagtcttttaacgacgaaaaacggagaagaaaatgcccaaaagaaaggcgaaacggaggaaaaagagagaggagacggaggggggaacggggaagaacggactgaaaatgccttagccgagccaattgcggccattgtggacgatgacaacgcattggaacacgtcgaacgtgtgctggctgag

SEQ ID NO: 74657 - DNA, 721 bp, Heterodera glycines
  Genomic contig location: Contig_ID=SeqID_11281; Location=46..766; Strand=+
  SCN-specific regions: Sequence locations=1-162,184-477,499-721
cgaaccaacgcaacaaacatcactccgcctcgcgccaaacgtttaatggtagctacactggacctggacccaaacactgttgcactcgcagatcaagaacgccaacgcactttggtgttcattggcctcccggaaagcaatgcgctcgcccatcggagcgtgttcaggaagacagggaagcgaccaccaaaatcttggaccatcttgaagttgaggccgaaccaacggccgtctttcgactcggccagtacgacccgcagcgaactactccacgcccgctcaaggtggtcttgccaacacccacacaccaacacgtggcactcggaggatggaagcgcgagcgtgctcgactccgttctcaacagaacctgacccgtctgttcgtccgtccggcgctgtccaaagaacaactcaaagaggaatacgaagcgcgtctccgaaaacgccaacaaaacccagctccattggcacctccaacacagctctcacaaacgaaaaatgaccaaactcccgttgttgcaaagggtccaaaccagaacgaggacagtgaagacatttccaaacatccggaagtttttgacgaaacaatcctcgtatgttatgaagcattaaagccattgccaccaaccgacaaaattgttcaccaaattcaatcgctcgaaaaacaataccctcatcttttcaataaatagttctaccagacctcgaacaatttcttcaa

SEQ ID NO: 74658 - DNA, 1398 bp, Heterodera glycines
  Genomic contig location: Contig_ID=SeqID_11284; Location=75..1472; Strand=+
  SCN-specific regions: Sequence locations=1-256,304-403,431-456,491 -595,646-689,752-768,790-893,923-1055,1087-1152,1179-1205,1262 -1333,1375-1398
agagtgaaaaattcagttgaaaaattaattgctcaaattgaggctggcaatgaagctggagcccaactcaatcaaaggggtgacggacaaggccagctccacgttccagcagatgagcaacttggagctgtttatcgaattctgccgcaagcagggagtcatcacgcaggagttgttccgcgccgtggacctggtcgaggcgcgggacctctactcggtgtgcatgacgctcaactcgttgggccgaattgtgagcataaattaataattaaaatattattcttttatatgtaaaaatttaaagacgggaaatttttgaattttaattgctagatttcttggcattttttaattatggggaggggattcaaataaccaatgattgcttgtagtgttaagcgtgaattattttatttatttatttatttttgtctcatcatttccaaacagtctaagtataatttatcataaattatttaataaattaatagatggaaaagcacggcaaaacaggtcctcggcgtgtttctgtacatgaaattgtcaatattccgctggccgatcagctgcgtatccatgatataaaaacgttttgatcattttcactgctgatttttcttttattaaattaactaaataaaaacataagctcttcgatttttgtatgaaaatagacaaatttagcttacaattttaaaatgatataaaattattaaaatgatttcgttataaataaattcattttttaattgattgaaaattatccattttcctttttattactgaatttaaattttcggtaaaaaattttgtttccatttgtaatagattttaaagaaaaaaattgccaatttgaaagagttcaagaaaatttttggagagctgactatcaatttgtaatattctgtatttttcttctacctgtatttttctgtacatttatactgggagtatgggtacaggccattcttggaatacaggtacaggtacaagataaactcgaaaaacctcgatttcctggacaaagttttcgaatttattatttaagtgaccgatttttcttcaaaaaatttaaatagaattaaaacacattattattgtaaaattgttatttttagatatcataagcaattaattcaaacgtttttttgctttttaaaacaaatttcaaaaaatccaggcatggatccaggtctcgaagagccttatttttcctttatgtgaatttttctgtacttttagacagaaagtacaggaacaggcctttcttggaatacagatacagctacaggttttacctaaatgtcgatctctagtttggaccccaaataataaaagtttagcactttaattttcatttctttattttttgttcattttaaaaaaagtttcatagaa

SEQ ID NO: 74659 - DNA, 578 bp, Heterodera glycines
  Genomic contig location: Contig_ID=SeqID_11285; Location=1955..2532; Strand=-
  SCN-specific regions: Sequence locations=1-219,256-257,279-407,452-578
  Gene Ontology: Biological process=growth
gctggcactgaagctggaaccaaactcgatcaaaggggtgacggacaaggccagctccacgttccagcagatgagcaacttggagctgtttatcgaattctgtcgcaagcagggagtcatcacgcaggagttgttccgcgccgtggacctggtcgaggcgcgggacctctactcggtgtgcatgacgctcaactcgttgggccgaattgtgagcaacagaaaatattaattaattttgaaaattattttatttatgcaatgaaatatttacaggtttataaggatgagaaaacgaattttaagctaataattatgtgtttcttgaatggctcataaaaataaccaaatttcaattttttaacaaaagaatttcgttatatagttaaatattttggcaataaaaaaccaaaatattataatatatattttttttcaattaaaacattaatttccttataaatacaaccagatgattttttttcaaaatttagatgcaaaagaagggcaaatcccacccgaagcacgtgtcggcatccgaaattgtgaacatcccctccacggatgcgcttcgtctttga

SEQ ID NO: 74660 - DNA, 305 bp, Heterodera glycines
  Genomic contig location: Contig_ID=SeqID_11286; Location=208..512; Strand=-
  SCN-specific regions: Sequence locations=1-119,154-305
atgggatctcgcaggtaattattaaaatggatttaacaaaaattatgaattttaattttaagtgtcgctggtggtgttggtgcttcgattatgaacaaagtgaactaagaaaaagggggaaaatttaaaaaaaaaaataaaattaaaattttagcaagccagcaaatacaacgagagtgagggtgagctgttgctcaactggatcaagcaggtcaccggtgccacaatgacggtgaacggaacgcgcgaaaacttccaagcacaactgaaggacggcacattgttgtgcaagtaaagaaaataaa

SEQ ID NO: 74661 - DNA, 732 bp, Heterodera glycines
  Genomic contig location: Contig_ID=SeqID_11286; Location=1367..2098; Strand=+
  SCN-specific regions: Sequence locations=1-475,497-598,620-676,698-732
atgggagttcaggaaaacgattttgaagaaaggtaatacaattagtatacattttactataatagcctttgttcaggacttgctgattaaaattttcaaaagactcatttagctcaaaaaggataatttaagcaaaaaaaaaaaaatcattttagaaaatttattcaaagagcaaaaaactgcgataatgatcaaatattattggcatttttcattaccaaatgatcattggtctggtcaaagaccactgtcatcaatagggatgcgatttttaggttttaaatatttttttttttgctcaattgttttgaagataggagctcaaaaaacgcatttctgcgttgaaatttttcgattctggtgtcactcactatcgatcggtcactagaaatcactattttggcgttttgtcactaaaatagttaaaattcactattttggcgttttatcactagtttttcactatttcgacattttttgtaaaatttattagtaaaaatggaaaatacaccccctaagaatcgaccccaaaaatttcagaaaaatacacccctaagaatcgaccaaaaaatgtttttaagaaatacaccactaagaattgtaaaattttctcaaaattcttcccccccaatttttttttcttgacaaaatttttgatttaaaaaacctcaatatttgctaagagaattttataaagaaaagtgtacctccatttgcaactgcaaccagtga

SEQ ID NO: 74662 - DNA, 60 bp, Heterodera glycines
  Genomic contig location: Contig_ID=SeqID_11287; Location=246..305; Strand=+
  SCN-specific regions: Sequence locations=1-11,33-60
gagaaggagaaggaaaatacacaattattcgccctaacggaagtacgcttatggttcacg

SEQ ID NO: 74663 - DNA, 1860 bp, Heterodera glycines
  Genomic contig location: Contig_ID=SeqID_11290; Location=674..2533; Strand=+
  SCN-specific regions: Sequence locations=1-49,71-173,195-900,922 -1195,1217-1703,1725-1860
atgaacgccgaacaaattcagcaacttttgaccgctttgctccaaggaaatgccgcttcaagcataagccaagcgaatttggccagctcaatcgacagtagaatttcaaagtttgtttatgaccccgagaatggtcaaacatttgaacagtggcacaaacgcttcggcatattgattgaagaggatggcaaagacttaaccgagcaagccaaagtccgactattgttgggaaagctcggagacgaagagtacacgaagtacagggacacaatcagcccggagttgcccgacaaaccttcgtgggctgaatcaatcaacagattaaaggagttgttcgctgaaacgcgctctcttttcgtccgccgatatgaatgctttcgaatcagacagcatccaaaccaagacatcagttctttggttgctcaaatcaacgcagcgtgtgagcatgccaatttgagccttaccaaggaacagctcaaatgcatgattttggtgatttcactgagggatgaacatcacgatttgaggcagaaatgtcttaaaatgatggaagaagccgagaaaagtggcaccacagtcacactcaaaaagttggaagaggagttaaaagcgatccaaattgtcaaagatagtgctttgtcactcctttccacgccagcttcgacaaatgccatccgaactcgccctcaacagtggagagaatcaaaaaccaaggccaaatcagcaaatgccgtgcaacaaaaccacccggcacagcaaaaaccggccacaggaggaaaagcaattcgtggacaaccgacccagccgtgcggctcatgtggtggtactgatcactggagatcagattgtcgcttccgagaagcgacatgccacaagtgccaaaaacaaggccacattgctaatgtttgccgaaagggagcattcacgacaaagaaccaacgccgttcatttcacacggtccaagtcaaagcaacatgcctacaaattggcacgactcaaggacggtggtggacaattttggtcgaaattaacggcacaaaaatcgaaatgaatgtcgacacaggagctcaggcgacagtccttaccattgaaacatggaccaaattaggacaacctaaattgttgccaaccgacattgagactcgcaactgcaacgacgtcacatttaaaacaattggcaaatttatatgtcttgtcagcattgtgggacaaccagccaaaaagctaacagcttatgtgactgaagagctcaattacgatttgtttggtttgccatggattgaggcaacggaactgattcccaaagaaatcatgtttccggagacgcacacatcggttggaatccgcgcatcatctgccgcacctttccaagaaatcgccgatgttaagtcactcacgacggctcttaaagaaaattttccggatgtttttggtaaagagctaggacagtgcaccaagattaaggcacacttgattcttaaatccgacgctcgaccggttttctgtaaagcccgacccgttcctcatggctcactggaagcagtcaacacggagctggaccgcctcttacagatcggtgccattaatccgatagaatttagccattgggcagcacccattttggccgtcaaaaagaaaaatggcaaaatcagagtgtgcattgatttctcaactggcttaaacaatgcacttgaactcaaccgccacccactccctcggcctgatgacatttatgcagccataagcggcgctgcatttttcacaaatttggacttaaaagacgcatacctacaaatggaattggatgacgaatccaaacagctctgcgttttgaacacgcatcgtggcctttttcagtga

SEQ ID NO: 74664 - DNA, 1030 bp, Heterodera glycines
  Genomic contig location: Contig_ID=SeqID_11292; Location=571..1600; Strand=+
  SCN-specific regions: Sequence locations=1-501,531-548,571-1030
atgccaaagcatggactaaaaacggaccaaaaaatggcattcgaagtccgacaatgccaaagccgtcccggttgtagtgcatcatattgtacaggtaaatgcgatggttgagcgacgttttgccggcaaacattccgcgacaataccgctgcaccgcattgttcatcatcaggtcactgtgcatctgttaatgtatttttacaattaccgtatttgctaaaatacagtacccacacgcctaaattaagtgatacacccccttgaaataaaggaattcgagttaaataaattaattattccctattcgtcgcccaagaaaaaatatgaaaaatctgggcgctgatcggtgatcacaaatagaaatttttcaaataaatttttgtttcaaaactttgatgaaactactaaatttaaaaaaaaatcgctgaaaaattttcaaaaatttctttcttgaaatttcttataaaaaaattttctagatttttttttgaaaaatttctaggtttgaaaaaaaaatttttttttggggagggggggggggggggtgaagtgcacgctctcctctgctaccttcaaaaaggcacgggccatttgctgttgttgtggttggaggtggtggtggtcctccgcctcctcctcgcctggccccatgccattgctgttgtgtgtgtgcacatacagtgcgatgcactgctcgcgaagctgttccgcccccgcaattgttggcggaatgtaaatttgcaaatatttacgcatcgacacgacattggcctgacgacggccaagcgcagctgttgagacagagagagagagaggagattgcattgatggaattattgggcaaagtaattatgtaattaattggatcggaggctacctacctaccccagggacgggagggaaaattaggactttttcgagttcagcatgttatgggcctggattgacaggataccatcctgctggttggtacacggctgccatgttacagagtgcaagactacgatgcagagggttgtagatgcaaaaa

SEQ ID NO: 74665 - DNA, 265 bp, Heterodera glycines
  Genomic contig location: Contig_ID=SeqID_11293; Location=1132..1396; Strand=+
  SCN-specific regions: Sequence locations=1-265
atgctcggacttgaaaatgctcgaggaaattttcgactacggcgccgtgcagggcaaaatccgggaccaagacctggacggactgttctcgggcgcgcaaatggcgccgatggtttgctgccagcactttgcctgggacttcttcaagaacaatgtcccgctgctgctcaaaaagtatggctccgtcaacaacaccatgttcctgcactgcatacaaagcacggcttccggcttctgttccagtgccatggccgacgaagtgacg

SEQ ID NO: 74666 - DNA, 668 bp, Heterodera glycines
  Genomic contig location: Contig_ID=SeqID_11294; Location=146..813; Strand=+
  SCN-specific regions: Sequence locations=1-476,548-640,665-668
atgctcggacttgaaaatgctcgaggaaattttcgactacggcgccgtgcagggcaaaatccgggaccaagacctggacggactgttctcgggcacgcaaatggcgccgatggtttgctgccagcactttgcctgggacttcttcaagaacaatgtcccgctgctgctcaaaaagtacggctccgtcaacaacaccatgttcctgcactgcatgcaaagcacggcttccggcttctgttccagtgccatggccgacgaagtgacggtgggttggggcgagtttggcctgtgcgcttcattccccccccccgagaaataaaaaaaattctactaacttagaagttgtcaaggaaaagcctagagtttttttataaaaaaatctaagaaaaaatagaaaaatttttcagcgattttttagaattttttgaaaaatcttagtaattccccacaagtttttcgaaatttttttcttctacttttttataaaaaaaactttctaatattttttcttgaaaaatttttaagttagtaattataaagaaaatttctcgggcggggggaaacgacggaggggaaatgagttgctcccgacactgagataattagcaaaatttacgaaggtttcttgatggtcttctccaaaaaaaaaaaaaaattttaatatcaaa

SEQ ID NO: 74667 - DNA, 308 bp, Heterodera glycines
  Genomic contig location: Contig_ID=SeqID_11295; Location=378..685; Strand=-
  SCN-specific regions: Sequence locations=1-75,97-155,177-201,225 -253,278-308
gttatggtcaatggaatcgaattagcatttgtcctatttttgtggatgacatcggcgatgggtcagcgaatattttttcaataaatccaaatttatttatgtttcacttttttaggcttctcgacgaaattcccggcccaagtgatcaacagcagaagtgaatgaatgaatcaattgttgagaactgatcgatctaattgaattgcggagttggagaacgaatttgagcccatattattgtaatgatcaacttttatttgttttgtgttatacaatatttatgtctttaggataaatttgttgagaag

SEQ ID NO: 74668 - DNA, 1351 bp, Heterodera glycines
  Genomic contig location: Contig_ID=SeqID_11296; Location=247..1597; Strand=-
  SCN-specific regions: Sequence locations=1-92,142-294,354-378,441 -723,745-796,819-866,888-957,1038-1200,1236-1239,1261-1351
atgggcaattcatgcttaatttctgattcaacaagagaacaaacaatttcgccgccgtccaatgattttgtcgcaattttgcgtcggccgagtaataaaaataaaataaagaattaattaaaattaattaattattttttagttaatacaacgatcctcgtcaaacgacaattaattaacaaacgaacgctgacaaaaatgctcagcaaaccaaggacagaaactgcaattgttttgcctgaacggaggatggacactaattttttgtcgccaaaagaccgagaattgtacgtcaatttattagtttaacaaataataagaaaaatatatttgattatttattattaattaatcatggcattgaagaatttttggctcattaatttttagaaaaaaatatttacatcaatataatattgtttttttaatttttttttttaccagaatttatttgtgttggcacaataacattgtgacaagtcgaagcgatctgttccacaaggcaatgcattattgcattcatgcgagcccaaagatgaacgaaattatcgcgtgcggccactattgctatagagacctgacaaaatggccaaaacttaacagaatttggttaataaaaatcaatttaaaaaaatgtttcttttgatgtggtgaaagaaggaattggagtgtgggagaaagtcggataaagggcatgggaggaccccttagaggagttgcccttagctcagtcgggtagagcattccacggtatggaagggcgccgtgggttcgagtcccatcggagcgagtaaactttattttatatagtttttcttgcctttttcgatatatatgaccttatacaaaattgttgcgttctaaacatataaaatttaataagttatacccaaagttcataccatattttcttaatgagttaaatttatttattatgaaaatcaaattgaaaatgccaaaaattctaaaatattttaaatgataataatttaaaaatataaaagtttattataaattatctatttatttaatttttagtcaggcaattttcaagtttttcgataaactgatcaatgaatacaaaatggatgaggataaaatgtacgatgcatgtgtacatcttggcgaaatgcatgcaaattatgcccagtatgggcttaagcaacattttatggacctttttcaacaacaattattaggtgggagaattttaaatataaaatatgggtttaaaatgaattagaaaatttaacttgatgtaattttatgcaagtattaattattgtaaaatttaatttacgcctttttaaaatttgacttaaaaagtgaatttgcagaataatccaataaa

SEQ ID NO: 74669 - DNA, 850 bp, Heterodera glycines
  Genomic contig location: Contig_ID=SeqID_11296; Location=2044..2893; Strand=-
  SCN-specific regions: Sequence locations=1-101,197-331,362-488,519 -638,660-796,818-850
atggaagcattaattgaattggcaattattccatgtaattttggatttaaaatagattaaagacaaaatagaaaaagctctcatttatgggctttttgatcaatttaaaaattttttattttatttttactattatttttataaaacattttatttcaaatgaaaaaaattaaatttcttacataatttaaattatgatatcagccattataagtcgagaacggatttttatgttttacatattttttttgcgcttagttatgacgagagaagcccaaaaatagcattttctccgaacaattttcgatttgagttaaaaattccgtttaacaattttatttattttttttaaacaataattcactcatctatacataattgatgcaaatttaggttatttacacaatctttcaagaataattaataatttgatttggtcatctacctttggttccgatgttaacctgcatttatcaaattgaattgtcattattaaaattaattttattttttaatttcggtcactttccccatttatcaaatttcacactgatttcccacatttaaaggcgctattctttaaacaaatgtgacttttcataattttaatttttcgctaacaattatttcccatacataaatgaatgaaataatttactgttaattgcttttcccattaagtacaaaatattgaattcagttttcccatcttctgagtttagccattaaaatgaaaggacaaatttttttttcattttttgggaataaattataattgccaaccctctattttataatttcagattatttaaaacacatgagaattgaagcattaattgaaatgcaatag

SEQ ID NO: 74670 - DNA, 446 bp, Heterodera glycines
  Genomic contig location: Contig_ID=SeqID_11296; Location=3458..3903; Strand=-
  SCN-specific regions: Sequence locations=1-372,395-446
atgggaatagaaaatttatccaatttaaatcagaattcttcatttaagagatatttgtgcctattaatatttcggacattggaagtgattgtgccgacattgtgcactcgtcatttattgttgtgcttggaatcggtgtgatttttttgatgcttttcgtataaaataaacatttatttttagcattgttgtcaatcattggcacttcattttgtggccaagtgctggcttttgagaaggggttgaaagagaactgaaagaaatggcgctcatttagcgggttagagtccaattcgccgccgaccatttcaccgccactaaatcgaactttcaattttacaaccaaattttcaatgtctaattcgaaaatgttttaaaagaatttcaaacaaaaaagttttgacaatgacgaatctttttcattttgtaaacaaatgctaaataaa

SEQ ID NO: 74671 - DNA, 536 bp, Heterodera glycines
  Genomic contig location: Contig_ID=SeqID_11297; Location=1721..2256; Strand=-
  SCN-specific regions: Sequence locations=1-328,350-409,433-453,492-536
atggtataaattagggttaagccccgaccccgagctccccggtccccgaccccgatccccgacatttttgggcctattccccgccccgacacccgacatgtcgtcccccgaggtccacgccccgactttttgccccagagggctcggggcttaaccctatttcaaattatttcaaaaacaaaatgctatttcgaattcccgaatttagacaaatttctagataaacaaattttagggccttctgtttttttatgaaatttctttaaacaccattcagttcattgcttttccttgtgcaagatataacaatcaaatatttttcaggttgtcctttctgttcttggcgttctgtttgtccaaggcatcattgcccttttggtgtttgtgtgcaaatccgtcaaatggcagaaataattggaggaagtgaaaagaaaagtacggcgacgaaatgacgaaagaaaaaacattaagaaatattttgatcaaataccataatcaactttaacatcataccataacaaaaacagagcaataaa

SEQ ID NO: 74672 - DNA, 265 bp, Heterodera glycines
  Genomic contig location: Contig_ID=SeqID_11298; Location=47..311; Strand=-
  SCN-specific regions: Sequence locations=1-101,135-185,212-265
atgccaaattttattctgccgttctcttcattctttctgtgctttatccgttatacacaatctatttgttgtacacaaatctactggcgcaaccaaacgagtaattagctaattaattaatttcttaattaattgacaatattaaatttattttcaactttttaatgcaatattaaaaatcattgattattttatttcatttctttcatttttagtaaaacaatgtgtacgatgggttcttcgttgggccatgacggtgttataa

SEQ ID NO: 74673 - DNA, 253 bp, Heterodera glycines
  Genomic contig location: Contig_ID=SeqID_11298; Location=414..666; Strand=+
  SCN-specific regions: Sequence locations=1-253
atgggaaagaaaacgcaaagcaaacgatcaaagccaatggcaaacatcaaagtgaagatgtttacgagaaaggcaaacagaacggattggaagcaaaaacatgtggaattggagaagaagcttcgctggtcggaggagggccacaaaagcacagagagagggaggaaaagctcaaaaaagccgaaaatgctggacaagcgttgcaaagcgatcagaatgtgacaagcgttgtgcaatgagctaaaaatggaaa

SEQ ID NO: 74674 - DNA, 1006 bp, Heterodera glycines
  Genomic contig location: Contig_ID=SeqID_11299; Location=1143..2148; Strand=-
  SCN-specific regions: Sequence locations=1-237,259-401,424-529,551 -575,622-964,986-1006
  Gene Ontology: Cellular component=cytosol
atgattgcttttgagcagtcacttgtgtttcaggtccacggagttgtgcacgacacaattgcatttgtgaagggtattttggagacggagatcaactcggccaccgacaatccactggtgttttctgagattgaagaagtgatttcgggcggcaatttccacggtgaatatccggcaaaagtaagggttaaattagcattgaaattacaattttaattgtccctaattaattaaaatgccatttttgccttaggtgttggattatttggcaattgccgtgcacgagttggcccagatgagtgagcgtcggctggagcgtctgctgaaccaccaactcagtgggcttccaacttttctgacccgcaacggcggactcaactcgggcttcatgacggtccaattgtgtgccgcaagtttggtgtccgagaacaaagtgttatgccatccatcatcagtaaatttttaaaaaatccaaaaaaaagaaggccaggaacaatagtcataattaatgcttaatagttttcctaaaaactgccaaaaatacaaaaatgctattaaggaatttgtctaatttcattaaaaaaaactttttatacataagttaaataaataataataaatgacctaacaccgtcttatgcttcatgaagttggccctatagcaattaaaaaacaattgttataatgtgaaactgctaaaattaaggcggacagtattccgacaagttgcaaccaggaggaccacgtgtcaatgggcggtttttcggcacgaaaggcactgaaaattgttgaacacaccgaagcaggtgctaacccaaaactatggtgatctgatctgacatcggttttcgaaaatccaaaagaccgaaatttttgcatttgcattttgaagaatcagaaataaaacctaatcaccccatttttagtgcttgcgatggaactgatggcagcttgtcaggtgtctaataataatgaaaaccccacaatgaatttgaatgatatttga

SEQ ID NO: 74675 - DNA, 477 bp, Heterodera glycines
  Genomic contig location: Contig_ID=SeqID_143; Location=2568..3044; Strand=+
  SCN-specific regions: Sequence locations=1-165,188-328,350-376,401-477
tgattaacgtagcctcgctagaatttaatctaaaaaacttttgtaaaaaaagcatttaacaacgtcgcaagcattgtagttttaataggttctaccactatccctttttgaaccttgaaactacgttaatgtccataaaaaaaaaaatccacaaaaaaaaaaagtagtgcaaccttgcttaaaagaggaattacattgctataatttaattttttaccgttgattgataaaaactctcctcatcagaactattatttaaatagttcaagtttctaaaaaaaactgaaaatttttagaaacaataacattttcccttccgggaaaaagttttctctcgtaaaaggctgatcactaggagcttccagaaactctattctataaattaattataaaatatattccaaatctcctatatttcacttatgtgaaaggacctcgggtcttaatctacacgaagcccgtagcgtaccatggcat

SEQ ID NO: 74676 - DNA, 280 bp, Heterodera glycines
  Genomic contig location: Contig_ID=SeqID_143; Location=4775..5054; Strand=+
  SCN-specific regions: Sequence locations=1-126,151-280
attttctaagaaaaaataggaattttgggggcgcggcggtgccgatagtcgccgccggggaaaaaaattggaaattttgatcatttataaacagtttttcactgaaaattagccaatttataggtaaaattttgaaaaattttatgggaatttaatccaattcttaggggtgtaaaagtcgcatttcgcgcaaaaaagcgaaatgcgaaaagcgaaatgcgaaacgccaaaaaatgcgaataatgcgaaatgcgaaaagcgaaacctcggcccatccctg

SEQ ID NO: 74677 - DNA, 1363 bp, Heterodera glycines
  misc_feature (37)..(37): n is a, c, g, or t
  misc_feature (44)..(44): n is a, c, g, or t
  Genomic contig location: Contig_ID=SeqID_1590; Location=783..2145; Strand=-
  SCN-specific regions: Sequence locations=1-105,127-276,298-391,416 -580,608-1363
atgaatgttcagacagttaaattgagtacttaccatntaaggtncgctaaaggtaggttattgtggcccataatttttacacttgtctaaatttggatcaaatttgtaattacagccaaaagtttgtggccctaacatatttacaaaaaatcgtaaaaagctcctgtttttctctatgctaatataccttgtatatccatcatgggattttacaccaatgccttttcgagcgaatgagtcaaggaccgcctcttcaataaagccctgggaatttaaggccaaaaagatgaagaagaagccgatgccaagctggagcacatttcgagtctgctccgtgcaactggaaccatcttattgagtgtggcattttgtgtcgtacatcacaattaacattaattaattgattaattaattacaattttattggaaaaaagaatattataatgataattgcctcagaaggtcagaacattccctccgattgtgagattgattgagtgagtgaccatcaatctcatcgtagttatcatcgaccatttaagaattgaaaaatgagccgtaaaattagttaattgcctaattagaaattaattttttaaaacaatttgccaaaatattataaattgccattataaaatcattcagaaagaataatatttttctaaaatatttaattggggctcccggtcatgcttgagagcatttgtgcgttgaaaaaatgcggtcggggtcgttttcgcgtggccattttcgcgtgagggccattttcgcgtggccgttttcgcgtggttgcacataagcgaattttttacttttttatagtttggaaaattttttcactcacgttttacttctggtgcttaattcaatatatatttaagtgaattttataaactaattaagtctgacaaattattatacagtctaataattttttaacggtctaatgctctgctggtattagtgtaaactcaccatcccaaatgcaatttggtataaaattgttttctctctttctggcaggcttatttatcataatttaaaaaaaaattccaaccactattacagaattttttctatataaaattgagttatttgtgcgtaaaatgtttggggtttttttttcgggaccaatgttctttacctttgccaaaaattgaacaaaacagttaagactttccaatgggttaatctcttggatatgtatgtatgtgaaagaagagtcctccgccccggaaaaagaaaaaaattaaagaaatgtcgtgatgccgatggtcggattctgtgtctcattcacgttgtcaatacttgaagttgttaatctttgcaagcataaaaatgaggacgcttttgagtaaataaa

SEQ ID NO: 74678 - DNA, 5388 bp, Heterodera glycines
  misc_feature (305)..(305): n is a, c, g, or t
  misc_feature (312)..(312): n is a, c, g, or t
  misc_feature (1274)..(1274): n is a, c, g, or t
  Genomic contig location: Contig_ID=SeqID_1590; Location=1798..7185; Strand=+
  SCN-specific regions: Sequence locations=1-51,73-222,244-656,678 -870,892-1037,1068-1142,1171-1399,1425-1746,1768-1866,1897-1904,1926 -2210,2232-2740,2770-2898,2922-2998,3020-3065,3087-3643,3686 -3717,3739-3810,3832-4138,...
  SCN-specific regions: Sequence locations=...4202-4260,4282-4317,4339 -4455,4492-4532,4565-4719,4748-4855,4877-4959,4998-5017,5053 -5076,5100-5112,5134-5388
ggttccagttgcacggagcagactcgaaatgtgctccagcttggcatcggcttcttcttcatctttttggccttaaattcccagggctttattgaagaggcggtccttgactcattcgctcgaaaaggcattggtgtaaaatcccatgatggatatacaaggtatattagcatagagaaaaacaggagctttttacgattttttgtaaatatgttagggccacaaacttttggctgtaattacaaatttgatccaaatttagacaagtgtaaaaattatgggccacaataacctacctttagcgnaccttanatggtaagtactcaatttaactgtctgaacattcattatctcctatggcatattatgatatccttttttacagtttggccatcatttatgcatcattcacaatccataattttgtggccgcaccaattattgcctggttaggcgtccgatgggctttggtttttgctggtctcacatatgccatctttcaggttaactctgacagtattttgcaacaattttgccgaaatgtcataatttatacacggcatttttcataaatgaatcgtactgttgcaattacccccgccgctttaaacattttaatttttgtgaaaatgcatttattttgggctctacatattgcattgcacgtccataaaataattttacaaaatttaatgcaattagatatcatttaatagccccaagaatcctctattagtctacgaaggttgaaaaaatcatccaagtttcaataacttatgtcaaataattcagaaagttatttttgaagttttctggtcattgctaataagtaaattcaattttgtaagataattgcgaacccttatatctatttaatgttacaaggagttatggtgcattaaaattgccaaattttttatggtcgtgtaaacagcaaccgagccctttttgctctaaaatgaccttatttcttaattatttgtagtaatttttgagggctccccggaaattggacaccgaaaattggacaatattggatataaaaataaattattgaaataaataaacaaaaatggtgagttggtcatagattttattttagtttgcacatacctatgttttttataagcttaataaaacggaaataaataatgttattattatttttaacatcagcagaaaaaagcaatcataacattcataaagaaaaaggttttcgtttacatagggttcctattttcgtgcattttttggcacattgaccaatcatcccnccatttttcatgcattttttgcaaattgaccaatgatcgtccctgctgaatgtctgattcattctaagtgccttaattcgttaatccatttaccatactcaaattttatttttaaactaattcctggggttattttttaaaaagaaatttggtgtccacttttccggtgtccaaaattccggcggtgtccacttttccgcttggtgtccaattttctggtgtcaaatttaccggtcccctttttgagtcacgagaaccaaaatttttttgttgcatttaaaaatgaatttcaacgaacaaattcaggctggttttctgtttgtcaaccgttggtacctgttcagctcgtccacattgctgggactcggagctgctggtttctaactatttcatataaccgtatttcctctaacagaaccacataaacagagtcctgtggctcggggaattaaaaatatagacctcttggggctgtattagagcattataggtatatgtagttaaaaaaagtaataaaaataagtattaactgtaaaatttcatattaacatatcttacagaattatagattaaatgatgaaaggacgtaaagaataaaaatattttataatttgaaattttagtgatttggacagctcaaggaaaatacttggcaatgaacagcacagaagaaacagcgggacgacacagtggcctcttttgggccttgtcacaattatggtaatgagtcaaaaaattggcaaatttgaaagaaataattgtaaattactctaattaatcaataaacacccccccccccctaatcctgggtttctaaaaaagaaaatacataccctaaaaatcgaatttttactttccccctcacccgaagacaagggtcctggttgcccccttagtaaatggaagaagagagtaaatttgcaacaactataaaaattcattaaaatacataaaatggattcgatacattaagtcagtcatgcggtggcatctttctccttgtcgttttcctattgatgccaagcccaccgggtggtagcgagcaggaaacatccatttctgtgccaactgtgcgcttcatctacggcacattcaccgctctcactgttctcggcactgccattttggcattgttaccagtgccaacagccacaacaccggcacgacaaacaaatacagtcgacggcacttcctctgctgccgctgttcgtgacccctcaacagtgtcaacagaattggcacattcgatcgatgaaggggcagaagggagcggtgaagcagtggcagttgctgaacagccttcccatctggccatcttgagtatgaagaaaattgtttttgggagtatgacactttttaaatttcgtctggaaacccaatgtccagccagcaccagcggatgcattcaaattcatggattgcctattccagctcattcttccgttcttgtctttgtttgggtgcccaaaattaatagtttttttaaaattattttccaagtaaaaattggattttttctcaaaataaatacaaaatctttcttaaaatttttgctacatatcggctaatttcttaacaacactttcttccaatgtaccggggccggccatgcctggtctctattaattaataaaaaattgatttttgagttcaaatatggtgtcattccccgatcggggtccctgatccccgacaattttcggcttcccaaacctcggtcccattttctaaaaattttcttttttatcaataggttcaactgttaaactgatgggcacccgtcggatggtcttcttttcgttgccttttatgtacacgggcatcagccaaagcttttggagttccatttatccgacaacagtggcaaacacagaaatgttccagctgaaccagggagtcaatcccaagctgttgttggcactgaccgctattgtccaaggcgtgggccaagcaacatgtgtgtggtgtaaattagcaattggggttcaaaaaattggcaccaaaattattaagaaaaattcatcataccagatatttgactgccgtaaataagaaaaaattgacaaaagtttgtgaaattaatgcagtaaaaagggctttatttgcttgtttgcatgttgccactattctagtcttaaaatgcttttgtacattgacattttctgctaagctggcttcgttttcggcattttggacagtcggacacggcgttttggccgcactaaaattgtcagcttcggtgccgcgttgcaactgtgctcctttttgttggcctacctgaatttacctgcgcacgcaccgctggaaaaaacatttgagcatggcattctgaactcgccaaggcaagcaaaatttttaggaaattttcgttttaactatttatttgaaatattcataactattaacagtttaggcgatagattattcataacctgtggtttgaaatatatataaaatcgcaaacatggccatagaacatagactaaaaattatgaaaatggacatggtttcaaaaatatggacattaatctttccgaacaatttttcattaagaaaatttatagaaaaaattttggcccaaagagcaactaaaaagtcttcgggtttcgccatccaaaaatttttttctggctacgaccagcaggcctctacaaaattcctgaattttttttcttgatgcctctctacaaaaattttcaaaaaaaccttattttttcataacttaagcatcacgctcgcgttggttggtggttttttgctgagttttggcgatgcctgttggaacacgcaggtttttgccacactaattgccaaatatcccatcagagcgtcgcaagcatttgctgtctttaaattctttcaggtatttaaaattgatgatttttttaaatgataaatttttcaacaattacaataatattaattttcgagtgcaggaaaaaattatgatcaaattgcattctctatctttgatcacctatttttacgtttcaaatatcctaaaatttcgttcttaataattaaattaagaaatgatttaggtaatccttaaaaattaaaatatgacctctttacatctattcttttgtaatgcttaaatttagaaaattatgtgatttcgaatatcagatttaaattgcctcaaatttagttgattcacagtttcattaagcatataattaacaaacaaaattatttaatttttagtcacttttatgctgtgctgcatttttctacgccacttcaatttctttgccatggcatgtgctcattttggccattggtttgttaatcggcttaattggctttttgcttgccgagcgaatggtcagacaaaatgatgacgattttggagatgttgtgataccaacgcattttgaggaggataattgattagtttatcattttcaaatatgaatgtaaatagtttacctgtaaatagaacatttttttaatttaagaaaaaataataagcacctttccgccacccatgcgcgcttcttaaatccaccatggattcgaaaacaaaaaatatgtaacaaataaaagttcattcataactttgctcaaattcaaccaaattaatcaatcataaatagtcttaatttgaattctaaactactatattcaacaagattatggccaaaaaattatggcttaagatttttttaattttacaacacccttttttatattatttgaaaaaattttgaaaattatattctgatagagacagttaaagcttttaaataataacgtaaaatattaatttaattaagtttgagctaggtttatgaattttcatgtttcatcttttgttttcaatcccattggcggatcagcatgttctccaggtacaaacttatataaattgcttcctttttgaactaaatttctattttcttccctcgcgacgagcatttgtaatcaatttcattgaagaaatgtggcattcatattattaaaaattgacaatttttaaacaaatttcgtttaattagtataaaatttaaattcaaaaatctccttcgcagcgctgtcagctccgcaatggagaaattgatgtcaaatgttgaccaaaggtcacaaaactcgaccaataaaaaattcaaaa

SEQ ID NO: 74679 - DNA, 4830 bp, Heterodera glycines
  Genomic contig location: Contig_ID=SeqID_11300; Location=29..4858; Strand=+
  SCN-specific regions: Sequence locations=1-324,346-348,405-435,475 -1349,1371-1382,1404-1578,1601-1619,1659-1778,1801-2008,2030 -2108,2130-2254,2290-2379,2402-2676,2698-2825,2847-2882,2904 -3420,3462-3519,3541-3563,...
  SCN-specific regions: Sequence locations=...3597-3611,3635-3673,3701 -3758,3790-4403,4426-4426,4448-4830
  Gene Ontology: Mol. function=ATPase activity; Cellular component =nucleus; Biological process=protein complex assembly
tgaattgccaccctatgttgctgcacaatttggtgttgacattcaacctcttccaaatattggaggactacatgtttttgactcgtcccaattgttcgccattgtcaaaaagttggtcgacacgcttacgtcgttgacgccaccacaacaactgatggacccaccagcatttacacagcttcaatgcaattattggcgcgaacggcttaaacaagtggcggtctatgtgaacgcgctgcaaatgttcctccagttgacggtcagtttttgtgttacctattttttgaagccgcaaacttggcatccgaaatcactgtgaagttttcccccgtttcgttttcccccgcgtaatttttttgaaatttttaaatagaatttttcaaaaaaaaatttaaaaattttttcatatgaaaaatacggaaaaaaaatttttagcggttttttgggaaaattttcaaaggtttttcttatcaaattacagaatgccaagtcgtatgacactgatcaacttgtcgctgttatttgttgtgcatcctttccgttgtcgccatgttcatcaacatcaattctgcgccaaatctgtgccgttcaccgtgacatttccaattctttgcttcaattggagcccgaaaagactgcagcgagcaatgatgatgatgaacttcccaaatcgactgtgttccggtgttggctgcctaatcttgacgtaagagacctgccaaacctagtcggttccaggccaaacccctcatatccataaaaaaaaaatttcgtgtattgcaccaaccggcaaaaccaacttttttttttggcctcaaaatatttttccggtacaatttccaaaatttcagtgacgcgggagaatagaatacattttagcaggccttttttatttcgaaatttttaaattttgagaaatgcctgtcggtgtcgatagccactaaaatttgcaaaatgtttcaaaaagattatatattttttttgggggggggggaggagttatgccaccatgccccttccccacatggattaagctaatttagcatagaattttgagtaactttttgctttcctttttgctgcagcaatttcaacacaattttgttgaccggttgcgtgaagccagcgctcatttgtcccaagcaattggaaatgttgccgaggatgctttgtgtttgttgcggtggacgaacaccaccaccacatcacgcgcatatcgtttagatgttgtccaaggaaacattcacaacattttgaccaccatttcaaccctcaaaacattgcttattacaacaaatgagcgagaaaattcttgtaagaaaatgcaattgctcagcaatttttgagacaaaatttgccaaaatttttcataaaactaagagattttttcctcccttttcagcatttgattccacgctgtcagaagtgccatttctgtttgtttaccccgacctggtggccccatatttgcatgtgctcaatttgctttcaattgcactgtccgaacttggtcgacaaattgccagtgcacagaacattgagcgtgttggtctcaattatggcttttcacatgtaatgttttttaaattttctgtttatccccctaggggttggcacccttaaaaaaatttttgattactttttttttttaaaaattactatcaaattgagtacatttgccgccaagaggtgtccacccaaatttttcgggaagctttcctttttggattttgaaaaactgctatttttcgggatttttttgagtcttaattttttttatttcagtctgaattttacggcttgaatcaattgcttcattgctcatctcaatctgctggcgtcaatgccgccaacaatgactttgccattgacgtccaaccattcatccgttggctgatcactgatcaacaaactccgctgaccgcttccgatcgcctgccaatttgtctatggtcaattgctgcgccgttccgtcgtccattttcccagtgccgtgccgatgtgttgggatggattttgcatttgtgggagcgatggcatgagcaaaatgcaaaaatcaaagccaaggagaaattggtggtgaaacggaagaggaaaaggaggaagcaaaatgatgaagaggagccgggaatgatggacgagggaggagatgagtgtgttcacatggaatcagatgaccaaaaggtagattctaattgctttttttgagtgtgattaatggtgcagaactgtaatgggtgcgttaagttctttcctccataaattaagaaaagttttctaacttgaaaatttttactaaatttttttttgtgtcaaaattggatgtgagagaggtgtacgtacgttcccaagaaaattcctgcgatgtattctccccatcttggtttggttttgttgtaactcgaaaaaattcattcctaattaaatatggattcgtgatttttaagtctcatttgtcagcacacatttcgccgttattttgcctaaaaaaattctttaaccatttcagctgcgcgatgcgtaccttcccgatttctcaaattccgcctctgataataatcacccgacgtcgtcccatttggatgccgccgccgatgttgttgttgaccaattttcggtgtccaaagatgaagtccatgatgcgttgtgcaacctcttcaaaacgctgtcgtcaaatgaagatgatgaagcatttgccaattcttcttttcatcctccgccttttatgcctcttttgtgtgtcatcggcaaattggagctgttcagctcggcaacaaaccaaacggagcatgatgaggatttggcatgtaagttatcaaggaaaattgagaattttttgaaaatttgtatcaatttttaaaacaatcgttaataatttgcaaaaacaaaacataattccctggcgcctgtcattttcgtcggtttacaaaatttcctttttttaaatttccaaaaacgcacaaaattggccattttgcgtaaaataaagtttttggtgtgctaaaatatgtatcctggttattaaattttccagctttttagaaattccaatttttttttcggttgtcaaattcgcttttcagattcccagctgctttcacttgacaaactgcgtgaacagcttcaactctgtgcaccttctagcactaaatttccttctctctcctcctcaaaatcagcgccggaagtgccaaaagcggcgctaaatgtgtaccgtgacagtgagccgtccgcggtggtcaaatgtgtggaatgtttggcaccgcttcatcagcgtgtccaactgttgttgaacgagtttcccgaaaatggacaactggcctcactctcttcaaccattgacgcatttgtcaacaaagcgtcggccggtgttccgttgatgaaacatgcggcacagttggagagcattttaggtacagaaaaacaacaacattgcctaactttttcttttcatatttcgtaattcgtacggggatccgaggcaattttataaagttttttgcgaaaatcgaaaaatacttgtaaagttgggaaaattttacaaaatatgaaaaaatcaagggttttgtttcaaaaataagaaaattttattcttttgaattgcatttcgttaaaaatttttacaaaatgtgtttcgtttttcaatttcgtaattgtacgaagttgaatttcgtaaatttaaaaaaataataataatattgtagtaaagtgatggtgcttttgatattaaaagaactattccagtggcaccaaatagcatttaattaattgttaaattaaaaatatatacatttagtacgagctgaagaatgggagtcaattgcggaccgagcgcattcaattcgggaacaaatggtgccactgcaggcactgctcgtggaatggcgtcgtcgtgaggtgcactgttgggccgagttggtcaacatggtccgtgctgactgtacacaactcgctgtgttggcgggctggccgttgttcaaatgcgcactggacacactgcaaagtgaggcattgggcaacaacaactaaaaaattatattgggcaaattatttgggcgtttaaattcgtttaacaaattaattttcgttttttgtaaatttccctaacaaaaatttttgtctttaaatctgtattggtacagacaaaacaaacaaacattttctatttcaagttttttaaattgacaaaaatacttttttatattttttgttttctaaaaaaaagaaataatgccatggacgtgaggaggactcgaacccccaccatttttttctgttgtctatctcaccaaccacaaacaaaaaaatatttcgcaaattgagccgctatttctacatcattaccaggaatgtgtcggtaattccgattcccgacatttttgtggctcagaatttctgctaattccttttattataataataatagatgaagaacaacaacaaaatggtgctaccgtcgctgatgaaaatagcaacaaaaacacgttgattttggcctttgttgattggatgcacaatgcgaccgttggcgattttggcgcgcgtctttggactggccaattgctcaccaaatgccttcctgttttggcgccaccaaattgtgccattgttgttggaacattgtgccgtcatatgcgctcaacatgtgcccattttgcgcaattcaaccgaacgctacgggcccatttcgacgaccgttttgcatccgttcagcgctcgttgcacgacttttgccgtgcggtgcgctacaccgacctgaacgtgtggagtgtgcaggacagtgcaaggcgtgcgcacacgcaccttgtccgcattttgcgctcattcaag

SEQ ID NO: 74680 - DNA, 3066 bp, Heterodera glycines
  Genomic contig location: Contig_ID=SeqID_11301; Location=206..3271; Strand=+
  SCN-specific regions: Sequence locations=1-132,155-173,195-197,271 -299,321-613,635-648,671-1054,1240-1369,1391-1826,1848-1879,1907 -2036,2058-2136,2158-2160,2188-2306,2330-2482,2504-3028,3059-3066
atgccggcacaaaatgagcagaccaaacaaaatgccgtgccgacaatggcaaatttgggtgaaccggtcaatgtgaagcagggcgggacactgaagcagatcaaagacagcatccaaatggcacagcaacagtactgggcactcagtggccaacacgcgcacatgggcaccgtggaatggggtggcacaaaaaatcgtaaaattttaatttaattaaaattatttaaaataaaaatatgttctattttaactatttaaattgaataaaatgatttgattcagaagagaagcagcaaaacacgaaaaagaaacagcagcaaccgtacaacaacagtgaggacatttcgccaaaagcgttgagcagtaagtgaaaaaaagaagcaaaaataaaaattgacaattaattttcggtccgattagtgctaaaaaaactttatggcccctcggggcctgagtccagagacctggacctgcttttgataactttaaataaaacatggtcactcaaaagaacaaattcgaaaatattatacagaaatttcaggttttttaattgtctgagtttcaacgatcagcataattttcaaaaaaaaacagaaaataattttcataaaatttcttagaaaaatgtaatcgatttttaagggctattaaaattttaaattttattcatatgtgtatgtttcatttaaaatctatttcccttaattggccaaaattttttttagcaaaaattgaacgtctgacgccaatggaaagggacaatttggccaagcaattggtgaacattgaggaccgattgcagaagacggaacgcaaattgcaacaaaaagagcaaaaagtaagcaataacctcacagcgatcaatcagccttaatgatcaatctgtgcatttttcttgtcaatctgtttctgatcgttaataattgacccatccattggtccatccgtttccgatcactgtcacttttctacagatcattgcatttttctatgtatctctgcccatttttctttttttctttcttcccataaatcactttccctccccacatctctctttctctctctctatttgtcactctctctttctctctctcgctcccctctctctctttctatctctcccctcacaaataagtctcttccctttctctctctttctctctctctctttctatctctcccctcacaaataagtctcttccctccctctctcctctctttctctctctctctaatataacacatacacacgcactctttctctctcatataacaatgttgatattttattgtgctaacagcaattgtctgagcactttgtagttacctacaccgaccacccttgctaattccatcgccactgctaccgtatcaactgcaccaccaagcccctttactactgtagttacaaaagcgcaaaaaacagtggaagacatcacgagggaatggtggaaggaaaataaggagaaaaagcacggggcagaacagcaaaggaagccgggacgacaaccattgcattctgacggtggacaaaaagcggttgtcgaagagcttaccgagtcggcagaatttgtcgcatcatcggccgaggaaatgccatcgaatggggtatgtttagggaaaatttggcatgaacttatggcggaagaacaatgggtctcggcataaatcgggacatatgtacatgaattgggacgccctcgctcgcaaagggggactggcgggagggattttaaacggtgctgggacgttagtcaaaaaccatcaaatgaataattgttaaaagaaaattattcataatttcgtctaaaatggatcaaattttataatatagatatttttcgatagccctaagtgttttctattatcctgcaaaatttttaaaaaattctttaagtttaaaaaaagttatgacctgaaaagctcaaaaagccaagtttttttgaacatttttagtcataacttttttgatacttaacgaaactttttggaattttgtaggctaatagaaaacacttagtgctatttaatgatatcaagaattaaaaatttagatgcttttgaacaaagttatatcaaaaaatattttcatttgatggtttttgactaacgtcatagcaccttttaaactaacaaattctttttaacaaaatgtattaaaaattaataaaaaaaaattttctccagtgtccatcgccggcccaaatcttatttctcttaaaaaatagacgcaaaatctggtcacaaaaagatctgggttttattcgagttgcaggaaatgtcaagccgaacatcattgtcaaactcaaatggtggcttcaaaactattgcttcatccgaaattggtggcacacaatcgacggtggttggcacgccggcactaaacagtgccggagccgcctcgcccagcgatggaacaaacagcagcagtgccaaaactgccagcgctagcgcgttgatgatgatgacacaaaaccggaagcggccgtcaccgccgacaatggcaccgcaaatggacaaaattagcaacgcaacgccaacaaaagtgccaccggttgtgccaatgatgccacggtatcagcaggcggtgcgcaatttgaccggccgcccgctggggcggctggacgctcgccaacgcaccattgtggcggtgatggagcagaagcgcaagcagttccgcaaggagggcgacatggcgacggcaaccgctgcggcggaagtgccatccccgcagcagaaaatgccgaaaccgcagcaaaagccgccggaaacgatgccgcagggaaaaaaccgcagcggttcgggacgaccgagcgcggaccagctgagcgtggacacggcccaggcgctcgagtggatgttggccaacatgaccaaatcggtggaggttgtccggcaccaatcgaccaagggaggaagcagcaaaaagttgctggccatggcaaatggtgatgacaatggcgcggagacggaggaggacagagacagggaccagaaccaacacggggcaacggcagcggacgaagtgaattttaaaacaaataaatgatttgtataaaa

SEQ ID NO: 74681 - DNA, 909 bp, Heterodera glycines
  Genomic contig location: Contig_ID=SeqID_11302; Location=437..1345; Strand=+
  SCN-specific regions: Sequence locations=1-207,277-525,547-830,852 -870,893-909
gaattggcacgtgcacaaagtgttgtcggaaagcagcagacgagcggcgagaagcagcaaaaggaaaagcacgcatcgccaatttcaatggaactcgaaattgggcggctccgtgccgaactgagcacgatggagcaacaaatgggacaaatgcgaggccgagaccgaggaggacaacggcaccaaaacgtaccaggcgaacaaccacagcgacaacagaacaaacagaaaaaggaggaggaggagcgtgaagaaatgggaagcaaaagcaccagtggaacgatggaaacttcaacaaaattgaggagtacagcagcaggaattgctcacaaccagcaacaggtgaaatgattaaatgataagagaaacatttagggggtgggccatcagtttggccgcccgaatccagtgtccgaaaccccgcatttttctcatcctaatctcgaaaaccaacccgcaaaactttttttttcatctacgagtcccaacccaaaaattttggcttccctcccgagtctcgacgtttttctcatcccgaaccttggacagcaacccgaaaaattttggccgcctctcgacccgaatcccggtattttttctcatcctaatctcgaatccgacccgaaaagtttggcctcccgacccggaactcgattatttttctcgtccttcggccacattagtggccatttgcctgagtgattagggggcgggagcgcaatgtctggaatatcaaccgtgcagcagaaaatgattgcgtctggtttcgggttgagaaagagaaaataacctctgtgaagcccctccattcataaccctgaaaagaaaagattctttcagggaaccctgaccgttttggtgtatttgtttccgttcccgaagccattccgagcgatcaaaatcagttga

SEQ ID NO: 74682 - DNA, 439 bp, Heterodera glycines
  Genomic contig location: Contig_ID=SeqID_11304; Location=1894..2332; Strand=-
  SCN-specific regions: Sequence locations=1-439
  Gene Ontology: Mol. function=structural constituent of bone; Cellular component=collagen type I; Biological process=cell proliferation
atgattgttgttgggactaagcctggtcccggtcaaatggctaagcctggtcccggtcaaatggcaaagcctggtcccgatcaaatggctaagcctggtcccggtcaaatggctaagcctggtcccggtcaaatggcaaagcctggtcccggtcaaatggcaaagcctggtcccgatcaaatggcaaagcctggtcccgatcaaatggctaagcctggtaccggtcaaatggctaagcctggtcccgatcaaatggctaagcctggtcccggtcaaatggctaagcctggtcccggtcaaatggcaaagcctggtcccgatcaaatggcaaagcctggtcccgatcaaatggctaagcctggtcccggtcaaatggctaagcctggtcccggtcaaatggcaaagcctggtcccggtcaaatggctaagcccggtcccg

SEQ ID NO: 74683 - DNA, 847 bp, Heterodera glycines
  Genomic contig location: Contig_ID=SeqID_11305; Location=757..1603; Strand=-
  SCN-specific regions: Sequence locations=1-472,494-647,669-847
atgctgtcaaaatggttgcacactccgcgaaaagatggacaactgaagcgattgttttgctatttgaaaccaccaaatatcgaatgggacaacatcaacactttgaaaaaggtgtggccatatcttcgttaatcatctgattttgttgattgcatttaatggccgttttccccattgttagaaatttctcaatgccaccacttccgttagctacaaaattcaatttattgttgatccaccgtcaccgcaaattgtgccatttgaattagctaacgaacggaccatggagaagctgacactgatcaaagcaagcgaacatcatcaggagaaccgatgggtaatgaaacggtgccaaaatggggagacggcgactgcggttcaatgggaatttgttaatttggccgatttgaacactgtcgcctttatgtttttccctgccaatgaatgcattgggtgagcaacaaaaaaaaaatcattttattttgtttaaaaattgtgccaatttttaggcgtttgtctccacgtcgaaaatggtgtccgattatgtgaaagtgatttatgcatttgagaaatggtcgatcattttggattataatgatgaataggagtgatatgatcatttttaatgttcatttttactattttcgtttaaatatattttattttatctcgtctcgacgcatccattggatatgtgccaattaaaactctaaaaatattatggaataatccattaacatttgaccgccgatctctctccaaaatatattaaattttgatgatttagtcaaaaaaattgaatttttaatttcaactaaaggaaaattgggttaaataagtcaataaa

SEQ ID NO: 74684 - DNA, 2664 bp, Heterodera glycines
  Genomic contig location: Contig_ID=SeqID_11306; Location=283..2946; Strand=+
  SCN-specific regions: Sequence locations=1-5,27-201,224-376,445 -567,614-1136,1158-1291,1321-1321,1425-1953,1975-2088,2110-2279,2301 -2664
  Gene Ontology: Mol. function=voltage-gated potassium channel activity; Cellular component=mitochondrion; Biological process =potassium ion transport
caccgcgacacacaggagacactggcggtgttggacaaattggacacggacgaactgaaggacgaggacccgcagacgcaggagcagcaccggatgaagaagttcggctgggaggacgccttttgggagggccggctcaactggtggatgcgcacaaagcgtaaggaccgatgggaagaaaaacagcgggggattttggacaaaaaataaaataaatttaattccaaattcaaaaagaaccatttaaaaactttaatttgggacaatcaaataaaatttgccgattctttgttcttcggttcagcacggatttgggccctcttcgacgagccctattcatccacagctgccaaagtaaaaaatagggggaaattggaaaataaattagaaaaaaagaattaaaaattgaaaattaaattcattatttatttttttgttttttttcctttttttcccctttaggtggtggcttccattagtgtctgtttcatctgcatttccatcttttccttctgcttcaaaacccatccgagctttcgcattccaatccttcaaatttcgtaaaacattttaaataaattattttttataatttatttaaaattttttttttcctttagcaatttgtccgatttctcttcctccccgtcggtgcctcaacattcgcatattcatcagcagcaacagttccattcccacttcaatcagcccattaatgtgcaacgggtcgccactgagccacacaaaatatttgcccaagtaaacctttgaatttaagccgtttaaacaatcattatttatttttattaataccttttaatccattttattttgtttttcagattgaatttgtctgcaacatttggttcaccttcgaaatcctcgtgcgctttgtctgctgtcccaataagctcaactttttcaaatatccgctcaatctgatcgatttggtggccactttaaggtccgtccgtccgtttatccctcaattttctctcttaattaaacactttcaaattgtgccaaattgcctcatttcagcttctacaccgatgccgtgctcgttcggctgttcagggaccaggccccgaaggatttggtggagtttctgtcgatgattcgcattcttcgcctgttcaaactcacccagcaccaccgcggccttcagattctcattcacacattccgcgcatctgccaaagagctgatgcttttggtgagtcattcattaaataggttaattaattgcgcgtaattagtggtaaagcaatgggttttataaggaacattgaaacatataaataaataaaaaatactgcagaaattttttgaaaaaatgataattatcattaatgaaataataatttatgataattttcattttaataattaaatatttttacaataacaatcaatttaattttccaggtgttttttctgattttgggcgtcgtcattttcgccactttggtttattacgcggaaaagacggagaacaatccgaacaatcaattcactgcaagcaatttttttaaacaattattctaagaattattcaatttatagtcaatccccgtgggtctgtggttctcactgatcacaatgactacggtaatgtttcgatgtccgcaaaataatttaaaattcactcatttaattcaggtgggatacggtgacatgacgccacaggtaattaaaaaggaaaagcatataattgagaaacagagacagagttgtattgttattaaaattcatcagtcattggggtgtggaaatttttgggtcacctatttaggctttatagcatttttctttatgtattcccccccccccccctcatctcactccgcgcacccaaatttttgaagctaaaaatattcaccattggtacccctccaagccaaaatcctatgaccgttggaccgtccctggggtatgttctccaattgtaccctttccctctcccctggggccttccttattcaaaccatcattgttccttgtgcccgtcccattcagacttacctcggccgcctcgtgggcagtctctgtgccgtgatgggtgtgctgaccatcgctctgccggtgcccgtcatcgtgtccaacttcgccatgttttactcccattcgcaggcgcgtgaaaaattgccgcggaaacggcgacgcgttttgcccgtggaacaggtgaaaagggaaggaaccgcacacaactgacaacgcataggcactaggaaaaacgcatatttaattaactgactaattagttgctaattggtgggttgcattgcattgcttttgcttaggttcgccttcaatttcggcgacacgcgcaatcgtccattttggagtcgaacactttgagccgtgttacatctacacgaagaagcgcaatgtcaaacgcagctgcgaattcgggtaacaaattaaccaaaactttgactcccgaaattgcccactaattgtttttctctcaattttttgactgatcgctgctttttgctcacatttaggattattaactaaccccaaaggcatggttttgtcccgtggcatttttgcgataaaattttcaacaattttttcagaaatggcaatggaccccaaaagtgcctcgttgatgaagaacaatgtcggaccgcagctatcctcagacagcgcagctga

SEQ ID NO: 74685 - DNA, 408 bp, Heterodera glycines
  Genomic contig location: Contig_ID=SeqID_11306; Location=3116..3523; Strand=-
  SCN-specific regions: Sequence locations=28-137,159-167,198-354
tatctatttattattcatttattaatttctgtatctaattgggcttaggaacaattttactgcgctttggcctccgttatgtatttgataggctcagtgttcgccgttttgaacatgctcaaggcaatattcgcccctctgtggttttttcatttggtaactttttgaattattattttttgatatttttattttaagtttgtaacttttgccggttttggcctctacgcattcgacttttggacacgttggaaacgggacagtcagttgaggaaggagcaccagcagaaccaatccgtctatatcacttgaccaatcaaacgcacactttgcatacattcgcaattttcccacattttttaaatttttgtttagaaaatatttttgaataaattattatttttttaa

SEQ ID NO: 74686 - DNA, 125 bp, Heterodera glycines
  Genomic contig location: Contig_ID=SeqID_11306; Location=3662..3786; Strand=-
  SCN-specific regions: Sequence locations=1-125
gaattttgtcaaaatgtcaatttatcttcagctgtgcggtctggtcgcccttctgctgacagtccaatgctggccaaatccgcttttccccttctgtttgggccgtgtcgtcgacttctttcagt

SEQ ID NO: 74687 - DNA, 569 bp, Heterodera glycines
  Genomic contig location: Contig_ID=SeqID_11308; Location=423..991; Strand=+
  SCN-specific regions: Sequence locations=1-369,391-523,545-569
atgccgataaaatgtccgccaacagaacgacgagaatcctgtgtcgaagtcaggacgaaagttgctgaaattaatcggaaaacaagaaatatattatttcctatcaaaatgccaaatactaaaaaaataccaatggaaaaacaaatggttgcgatgacaatgcccgcactgatcccatgcgtttttgttgaggacgaagcttcgatccaaagccaagacaatgtgacaccgatgccaaacattgtgatgggagaccaacgcgcaattgccataactaatggagagaacggaacaatgatcaaccacgcccaaaatgacggaaataacggagaggacaaacgaacctgggtctgcgacatgctgaaaatgcaaaataaatcatgaaatttagaggattatttgggggaaggaaaaacataattaattcactataaaatgccatggaaaatcacctgaaaagcgatattatccgcataaaagtcaatgacaacaacgaaagcggcagcgaacagaaggagcaaagggaattccaagaaggaatggataaacgactgaagggaggcgaatta

SEQ ID NO: 74688 - DNA, 1560 bp, Heterodera glycines
  Genomic contig location: Contig_ID=SeqID_11308; Location=363..1922; Strand=-
  SCN-specific regions: Sequence locations=1-956,978-1110,1132-1560
atgtttttggctttgcgtttgactgctaaatctctgattgcttttcagatcactcggagtacttttgcctgctcaaaagcctttttcttcggggaaaccaatccgaaagtcactggtgggtttttaagttataattttatgaatagccacgaatattgttaagcatatccgaatcgctcaactgtctctgttcaaatgtctcatcgaaatcctctggttttatggaattgtgcgcctttctttttctttcattttccaatttattttttcagactttttgtggcccacttcgcagcattttaatgttcgagcagagcccaacgtattaaaaaatttgtaattttaagaattttcaaaaattttctttttagcgtgattttgattgctctaatgtcaatcgtcaatggcagcggaagtgcggccaaaacgaggggattggtctgtctgttggtgggatgggttgtgcttttcattatggactccgactctccactgactaatcattgtgcgtctgtgttactagaatttgtattgaattgtctctttgtttcagccgaatcccaccgacaccaaagtgggctgaaccacgtgttttaccatttcgtcggatggttcggtctctccgatcacagcgtttgtcttcaaaactcttttgcccaaagtctgcccttttaggggggtgtgcttctgctgctctttgctgtgtttcttcgcatgatttacgagtccaattatcgagtatttccatttcttattttcggttttatttacaattcatttttagcatttggccgttgaaattggtggtccaaagcgtctttacgctttgtcttctttggtcgcctctttgctgctcactccgttcgctgtccttgtgctcgtcttcagtccggttggtctttccttttccaatttaaattattacttttattaattcgcctcccttcagtcgtttatccattccttcttggaattccctttgctccttctgttcgctgccgctttcgttgttgtcattgacttttatgcggataatatcgcttttcaggtgattttccatggcattttatagtgaattaattatgtttttccttcccccaaataatcctctaaatttcatgatttattttgcattttcagcatgtcgcagacccaggttcgtttgtcctctccgttatttccgtcattttgggcgtggttgatcattgttccgttctctccattagttatggcaattgcgcgttggtctcccatcacaatgtttggcatcggtgtcacattgtcttggctttggatcgaagcttcgtcctcaacaaaaacgcatgggatcagtgcgggcattgtcatcgcaaccatttgtttttccattggtatttttttagtatttggcattttgataggaaataatatatttcttgttttccgattaatttcagcaactttcgtcctgacttcgacacaggattctcgtcgttctgttggcggacattttatcggcatttccgaggatggcatgcctttgttcactcatggcgaagcatttctcgagaagacatcgcg

SEQ ID NO: 74689 - DNA, 911 bp, Heterodera glycines
  Genomic contig location: Contig_ID=SeqID_11309; Location=862..1772; Strand=-
  SCN-specific regions: Sequence locations=1-180,231-468,495-632,654 -677,699-911
atggctgtgtctgaaagaattagaaagtgtgtaattgtcaccaaacttgccgatggaacgtttgaagaatgccgcaggctggcctatatccctctgaacaaatggcatgtcactgttgcaaaacgcaaaaattaccccttttacatttacgaagaagtcagtttttcatttttcaaaagataatctaaataatattttaattccttttaagagaaaaagtgatggaatgatttgtcaaacgcatcagaaatttattatgaacgcaccgaaatttaacgaacagacatataagctaaacataacgaattatcaagtggatgagcgcaaggacattcaggaatttgtggatgcttttttacgggccagcgaagatgagcaaacagaggcgaatgaaacgttgcgtgagaaagcattcgatcatcttttctctacccaatatgaaaatctctatgagcgctaccgaacctttcaggtgctttattttttaattttctaccgttaccataaattaggaccgatatgaacacacaacggattgtgaggaaaattggtcaaacttatggaatggtttcaataaaaccgttaaggtgagacaaatttaattcaattttttttcattgaaacgaaccattcagataagatttgatgagctttctgcgacaacacttcgtcgctataagaaatttttcaatttgcctaatcggtcgggtgccaactcgaaagcacaggtaattaatatttcatgacctaaatgcctttataaacgattgcagctcctagagggtatcaacgatcattttgaatcaatccccgtggatttagccgaaacagcagctcattttctagacacaatttataagaagcgcaatagactcgattatccaaataatatagagaattccgctggttag

SEQ ID NO: 74690 - DNA, 310 bp, Heterodera glycines
  Genomic contig location: Contig_ID=SeqID_11310; Location=553..862; Strand=+
  SCN-specific regions: Sequence locations=1-63,85-310
atggttgtgctctcaaaacttggctcgccgcttcgtccgttttccaatgactatctcctttgccgcttccaggcattccgtaattatgcaatcaaaaaagaaaggccgccaccagcgaagattcaagtgccgccacccgcaaacgaaactggccattggaaatgtaagtttagtggacgggccttatgcttcggcaatttttaatatttttgcgttttttctttcgcatcatttcgaattcagatgagcgtgactactcctatgacctgcgttattcaaacccgatcaacaaatactccagttttaccag

SEQ ID NO: 74691 - DNA, 100 bp, Heterodera glycines
  Genomic contig location: Contig_ID=SeqID_11310; Location=862..961; Strand=-
  SCN-specific regions: Sequence locations=1-100
acatgaacaaagttattgtataaaaaccaggtattgtcaattgattggactcataaaactcgattggactcattaagtgcactagagccaaaattttacc

SEQ ID NO: 74692 - DNA, 954 bp, Heterodera glycines
  Genomic contig location: Contig_ID=SeqID_11314; Location=181..1134; Strand=-
  SCN-specific regions: Sequence locations=1-189,228-250,273-366,388 -428,460-476,505-836,858-877,921-954
atgcacaaaatcgtaaaatatgcacaaaaatctcgaaatatgcaaaaaaatgcaaataaaagtaccgacttttatacgcaaataccaaaaagaagaagatgtttttcgtaatatttagagcatagagaagccaggaaaaaatatgcatatttttttgcagccctgatacaatataaagaaaagttttgagaatatttataattgtatttttagcttttcaattttttaacaaagttatttcaaagatttgagaaaaatcatttgacaaaattataggtttctgaaatcattctgtaaactgattcggaaaaagtatgagtccaatttatgggttaacatctcatagaaataagtttttgtagggtttttattccaataattaaaaaatactaatatacaataatgattcgatactctaaaaataagttaaaattacaattttttaaaatcttaaatgctcatatcacaaatatgaaattttgtctttcatttttcttaaaacaatttttttttacagaatttggccacggagcagacgagcttgaacaatttgtgggaagaacgtcgcatattgtacgaacagtgcatggacctgcagttgttctacagggacatggagcaggccgagtcgtggatgaccaagcaggaggcaagtgtcaggattaagttgatttaaaatcctgaccctgtcgtcgcgatcgcatattttctgaagccagccacattttcttttttttaaatcaatgattttctcctaccttaggttaaaaatttacattttttacgactgatcacatatgctaattttaatggtgctatgacgttactcaaaaaaccatcaaaataatatttgatgtgattttgcttaaaagcaaccaaatttttaattcaaaatttcaaaaagtttatttaaatttaaagaaagttatgactagggcacgtttcgcaaataaa

SEQ ID NO: 74693 - DNA, 213 bp, Heterodera glycines
  Genomic contig location: Contig_ID=SeqID_11315; Location=297..509; Strand=-
  SCN-specific regions: Sequence locations=1-213
atggctcgccatggagttttgggcggcaacataagaacagttgacgtgagagtagttgacggacacggcaattgcatctacactccgccacctgcagcgcatgtgccgcaactgttggagcaattcatccaagacgtgaatagtgcgattgggcaagcttcgacaggactgatggaggcacgcgttgttgccgcgtgggcgcattataaatcg

SEQ ID NO: 74694 - DNA, 591 bp, Heterodera glycines
  Genomic contig location: Contig_ID=SeqID_11315; Location=580..1170; Strand=+
  SCN-specific regions: Sequence locations=1-69,91-153,189-200,224 -244,268-415,458-523,545-591
atggctcccggacaatccatcagtggacaatccgtcagtggacaatccgtcagtaagtaattcataagctaattatttttaaaccacagagatttatttaaaaccatgtgataattaatttaagtcgctaaaaatgttgattaatattttgtgatattttataataattatgaaataatctttttaaagaatttagtcaattaattgaagtataaagtaactagaaatgataagaatctataaaaattatatttattacatttaacaatcattttcgcaagaatttttgaacattgctcaaaaaaattttctgacgaatttccactgacgaattgacttattttttgaacaaggtatgaaaaatttgacgtatcaaaaaattattttgtggatgcattatttttttcattttccgaaaataatatttatgtagaaaaatttcatttttttaattttagattcatttttaggaaacttgcgtgcgtttgatcattaagattggaataattctttttttcaattaattttcaaaaggccaaaaagtgggaaaatagggtaaaacaatcaaaaatttcaaagcgaaaaccccaa

SEQ ID NO: 74695 - DNA, 495 bp, Heterodera glycines
  Genomic contig location: Contig_ID=SeqID_11316; Location=920..1414; Strand=-
  SCN-specific regions: Sequence locations=1-21,55-174,197-402,427 -448,471-495
atggtaaatagatagattttgtaaaaatgaattaattaatattaaataaaatatgcaattaaatttgcaggtcgggatttttggttgggatcccggctcgagaaattccaaatctgaagcatggcctccgatgtgaccaccagcgactaaaaaatgttttaatacttttgttaccaatttgaaaaatttgcccatcggctcaaacgggggttaaattcgagtttttagcttcacttcaaacattgaacattagcatttcggaggattttggaaatattttgacgttttatttattcgggacttacagaaaattgggactggaaaaacgaaaaacataccctaagaatcgacccaaaaaatattagaaaaatacacccctattaaaaatttctcaaaaattcatctacacaatttatttatttactttctttgacaagaattttgattgtaaaaattatttatctgaatagtgattagtttacttttttgaataaa

SEQ ID NO: 74696 - DNA, 1823 bp, Heterodera glycines
  misc_feature (86)..(86): n is a, c, g, or t
  Genomic contig location: Contig_ID=SeqID_11316; Location=4517..6339; Strand=-
  SCN-specific regions: Sequence locations=1-164,187-1823
agattcaggcgatttctgagatgcctgttccgacaaacgtgtccgaggttcgatcatttttgggaatgatcaccatttaccacaanttcgtgaagaccatgaggttcatccgacagccgttggacgaattgttgaaacaggacaaagtgtggcaatggtcagaagattgtcaaaatgcctttgagaaggtaatcaaaattttgaaatctgatcaattgctgacacactacgatccagcacaagagatcattgtatcggctgatgcttctgagcatggaataggagccgtgatctctcaccgcttttcggatggaagtctaaaagccatcgcacatgcatcatcgtccctgtcagcagcagaaaagaattattctcaaatcgagaaagaaggcttaacgattgtctttgccgttcaaaaattccacaagtatctcttcgggagacacttcgttctgcagacggaccacaagctgttgttgtccatttttggcaacaaaaagggaattaaggcttgcacagcgaatcgattgcagagatgggcaatcacattgcttggctacgacttagaaatcgaataccaaaacactgctgatttcggtcaagcggatgttttgtcgcgcctaatcgcgaagacaccagtgccggacaacgaagtgatcattgcaaacattcgtgaaagcaatgaaacgggagtgttgaattttgtttcgaaaactctcccgctggatcacagtgatttggctaacgccgcgaaaaacgatcaggtgatgcagaaagtgaagaaatttgtctgctcttattgaccaacaaagaacaaaatggccgcagacattgttccgttccatcgacgacgagaccctttgaccatcgaggatgaatgtctgctttatgcggacagagttgtgattccggcatcgcttcaaaaggatgtcctacaacttctgcacagaggccatccagggatgaagcgaatgaaagctctcgccaggcagtacgtttactggcctggcatggacgaacaaattgaaaattttgtcaaaatgtgcaacgaatgcacaatggaggcaaaaatgccggtgaatactgagcttcactcgtggccgaaagctgacggaccatggaaacgcgttcatttggattacgccggaccgtttatgggaaaaatgtttctcataattgttgacgcgtactcgaagtggcccgaggtcttcgaaatgcgttcatcgaattccgcggctacaatcgacaaattgcggtcactttgtgccagttatggccttcccgaaattttgttcacggacaacggcacacaattcgcttaaaaggaatttaaggaatttgtgaccgaaaacggcatcaattatgtgttctccgctccgtacaatcccatgtcgaacggtcaagccgagcgttttgtcgatacgttcaagaggacatgtcggaagatcaagggagaaggagcatcggaaatgttgaccacattcttggcaacataccggaccacgccttgtgaggctttgccggagtgcaaatgtccggccgaaatgtttctaagaaggaaaccgcgcacgactttggacttgttgaggtcaaagccaaaggcaccgataattcgagacgaggccatggagaagcaatttaataggcgccatggagccaaaccgagatcttttgccttgggcgataaggttctcgctcggcatcgtctttctcagccttggcgtccaggaaaagtcaccaaatgtaaaggtgtcatttacgacgtcgaattttttgacggaaaattcggacggttccataccaatcagttgcttgtgagaagc

SEQ ID NO: 74697 - DNA, 1931 bp, Heterodera glycines
  misc_feature (1752)..(1752): n is a, c, g, or t
  Genomic contig location: Contig_ID=SeqID_11316; Location=1569..3499; Strand=+
  SCN-specific regions: Sequence locations=1-448,470-522,553-576,629 -1084,1106-1162,1200-1398,1420-1538,1560-1656,1683-1771,1899-1931
atgatggcacgcgcttcgtttgctttgcctcttcttctgctactgcttccactcttttgtgtggcaatgaatgaaaacgatggcactgttgccggagagggaagtgccaacagcgaaacatggatagaaaaattagccaatttgctatccgaaatcggcaaaatttgtgatgtgtacactattttaccgcgcagtcactacaaaattttgtttatttttggaaagtttggtaggtttttttggtgtttatttggcgcccggaaaatgcgtcagttgtaaaagcgtcagtagaaaatgcgtcagtggaaattttgttgtcctaaaaacaagttcctttcgttttcgagatcactgaccactaatccagtatccatttcggtcaattccgatccccggacccgtagcgatcaagggttacatgacattgtgccccggacatttgtcgtcttttgacattttaaaatttttaggtgtaggcccaaagcggaaaagtatttttacttctatattacaatactaatgccacagagctttatttcaaaatatttatatcactgacgcattttccggtcatagtttatttatatttaaaaattattaaaaaaaagaatcgaaataaaattacttagaatggaaaaaaattaaatcagccaatgtattttttaaagataatatcaacgataaaaaagtgcagaaaatagaaattgagacggatgacaaaggcgactttcggtggaattttgatgaaatgatagtccaaaacaaaaccgtagcagctggagacggtccagaggttacggtacttctgtgccgtacaagcaaaaagcattgccacgtgttccgggtgtacgaaagttttgccgaaatgagagaggaaatgaccaaaaatgagggtcgattttatggagctttccaggtgatgtatgaacattatgggcattgtataagcatggaaagtggcgcttattttggcgaaacggagcaatgccaaaagagtgaaatgtcccaatcggatgaaaactcgggaatggcatactcaccagcatcatacagccacatctgtgatacgtacaccattttgccgcacacatattacaaaattctgttgctttttggcgaattgagtaagtttaaagaagaaaaatttgatttttgctaaggctaaattaatattaaaattccataaataaattaattttcaaagaaaatgcccacggagaaaaagtagaagtgcccaaaattgaaatttcaactgatgaaaatggcacctttcggtggaattttgatgaaatgatcgtaaaaaacaaatctgtagcatcaaaagatggtaaagttacagtgctattgtgcaacttggtaaaaaaggaatgccgcatatttcgcgtgtacgacaattttggcaaaatgaaaatggaaatggcacaaaatgagtgccgattttatgagcatttccaggttatgtatgaacattgcgaccactgtactagcatggaaaacattgggaagagaaacgaagaaggcaattaccttggcgaagtgtcacaatgccaagaacaaaaagagaaagatggcacgggggaacagaaacatcccaaattgccaatctcaacatttccgtcatttcacaccttagcatcaccggaaaatgaggcggaaaaagaggaggaggatgtagaggaggatgtgccacttctgctggaaagaggtgggcacgaaaagcatggacgaacccaccaccgatcattgagacancggcgggtgggccaaagccaagcggagaaagaggaggcaaattgaaaaaacggaagagagggaggggggaaatggagaaacagtgacgaaatgagagaaacgggaagcgaagcaaagaaaaaaggaaaaaacggagggaaggggaaacgatacaagcatttgttgataaggggattgta

SEQ ID NO: 74698 - DNA, 553 bp, Heterodera glycines
  Genomic contig location: Contig_ID=SeqID_11317; Location=346..898; Strand=+
  SCN-specific regions: Sequence locations=1-44,75-134,171-553
  Gene Ontology: Mol. function=ATP dependent RNA helicase activity; Biological process=nucleobase, nucleoside, nucleotide and nucleic acid metabolism
atggccgagtgttgttcatctgtttctgcttctgacaatggcactgctccttcttcctcctcctcttcttgggctgagttgggtctttctgatgcgactcttaacgctcttggcacaatgaagtcacttctcaacaatttcttaaattgttttattttcttcatttagtttcccttttccaactccaattcaaaatgctgtgattcctatcgctgttaaattgaaaaaagacataattggtgcagccgaaacggtttgatatccaattaatgctatttaattgggtctaatttttcaacatttagggcagtgggaagactctcgcatttgccattccgattctcgagcattggctgaccaatgcaattgccacaaatgtccaacattttccggtcaaaggctctctttttgcgcttataatttcgaccacgagggaattggatgttcagcagggatgtgcctaggtttcgcctttcgcattattcgcattttttggcgtttcgcatttcgctttttggcgcgaaaagcgacttttacacccctaagaattgga

SEQ ID NO: 74699 - DNA, 2615 bp, Heterodera glycines
  Genomic contig location: Contig_ID=SeqID_11318; Location=1..2615; Strand=+
  SCN-specific regions: Sequence locations=1-55,77-246,270-458,481 -535,558-590,714-730,760-800,822-1083,1105-1122,1145-1159,1181 -1203,1234-1358,1380-1593,1624-2180,2202-2615
tggcccattttaaccctttcccccgttgaagagaaagacttggaattgctggccgtgaacgagcccaaactgatggagtcgtgtcgctctttggtcaaatggcagcggaagcattggaacattcgctaaaaaagtgaacaaatggaaagggccatgggttgtcgaatgatcacagcgaaacatttgtgcagagaaagtcgcgtgagcaatggttcgaacggatagcgcgggaagcggatttggtgtgggaagagggggaggaaaaagggcgaaagatggcacgacggactgacacggacgaaggaccgacaaaagagtgggtcaattgaacaacaatcggacaaacggtcgacttggcactgacaaaaacccatttcagggaattaatgagacagcggaaaagggccgttgagaaagaaagcattgaaaggaaagctgaagggaaatcaacaaaattgagaacagagagaacggaggattaaccaaagtgcagagggaaggaaggtgaaaattgggaagaggaaagtgagactggagaagggactgaagaaatgggtaaaacgggcgaagatggacagcggacgatgacgagggaacgcaggggaagagaggaagggaagtgaaagaggatgagagagtatgggaagtgaaagaggaggagaggaagggaagtgaaagagggagtgaagagcataaaatggaagaagagggaaaagctttgctagtgaaccattttctgtttgtttgtttgtcttgtttaatcttaagtttaaacggattgaacttttcttcgcattcatttgcttctccctttgcattatttgcataatggtggctcatttccttccgtcattggcaattgtcgaacttcattctctccccatttgtccctttcccaccccatccatccgtccgcactttgtgccatccaacgcttcgtcctccggcagcccttttctttcaattggccaagcctatctatcgacatctcttacgtatattgtcccgaacgagaatgaatgagggggacacaatttctctgaatgccttcccccgagggtattcttttgctttctcttcgtgctctgttccatttgccctttcctccgtttttccgccttttggttttggaagaaaaataacccttgaatttttcataggaaaaacggaggcaaaaaatgccatcggtcgatgagagagaaatgggggaaaaaactaaaattatatgacaaaatcattggtttcatgggtttttatcacaaatttttttttcaaaactaaaggatccccccttttgtttttgatagaattcaaaatcggtactttccatatagcgccaaatcatttttggaatttataattggctgtttctaaaaatgatgaagtctttccccccttaattttatctttttttttgctcatttcgccgcgtttagtccaaatttgccctttcattctttcgtccttttcatctttcaaattgttcaacaattcgtccaacaattgccattccgacatctcttcccgagcacagtaccttttccaataatcacaattcaacggaatgcctttgcgctgaaatggaaaagggccaaaatgcccccgggggaaaaaagacaaaagtttattttgcggtacggacaaattgtgcgaggccatgggagcgaatgttcatctgcggaggaagccgactgctgggaaattggaggcccgaaaaggcattggaaatggcacgagaagcggaggacggcgaagagaattccttcactgaataacgatttaagctcaaacaataagtcaaaaacaggttcatcactacaaagaagcggagaatataagtgagcttgggcagcagcagaaccgcggccaccgattgaccggagaagcggacgaaagagacgaattgcgatcatttcccactttggtcgaggcattgcaaagatatttttagactgtccgtcaaacagaacaagtacccggtgcttttcctttgtgtgggccaaaccgacaggcaattaacgattaattgactgaattactttaaaattccatgtttaattaaactctgttttaatacatatgtgccatttttggatgaacggagcaaagtgacccgagtgggctccaactttgccgcctgctccaaccttttggcaaggctaaaatgccattctttgaaattgctccgcctcccaccgcccattagggcatcaatttgcacagcgaagaattgctctccgatccgtcatccctgaaaagggccgttgcaatgaaactgatcactttcgtctgggtagaggacttggacaaattggaatacgttgcttatttcagacggcaaaatgtggacgcgattatctacgacaggtgaaatgcgcaactttatttttgagtaacagcccaatattttattttttgtcgtcgcaattaataacaattttaaaacaaattaaccccaagaaaatattctaagaatcggcgaattggaaacacgtcaaaatgtgttcgtcgtggaaagggaagtgaagagcgccctgttcaagtcgccccgcacttcaccttctctgtcgcgagcaaattcactgtttcgcaacagtcaaagcccgacgatgccg

SEQ ID NO: 74700 - DNA, 1766 bp, Heterodera glycines
  misc_feature (1708)..(1708): n is a, c, g, or t
  Genomic contig location: Contig_ID=SeqID_11320; Location=50..1815; Strand=-
  SCN-specific regions: Sequence locations=1-268,300-1049,1072 -1088,1110-1624,1648-1724,1746-1766
atgtctaacacattctttgtgcatttatccagtaatagcccagactacgctgagaatacaccaaataagtttagagttcgtttaccaaaacctatctatttcaatggctcttgggtatgcggattacacagcattaattatgcctattcttggccatcaacaattggaaccttagatgatcagtggatcaacatacattttacggatggtttagataatgaaaggcttaggattgttcgagtacccgccccgaaagcttcaaacacaacaattgaaaatttaagaaattttcttatttcaaccctaaagaaccatgctgagtctcttgaaaagattataaaagatagttcacagaggtcaataaaaagaaaacgggccgcttctcagccaaaatcacctcctagtgcaattgtaccaaagtcacaacctaatgttagtcccaatgtaacgctaaatgttaaagtaccaacatctccaccacgagttggacagcagccacaaactaaatccgaggacatttctgattcgattttaaatgtaacaaaaccatctgaaaagcaaccgaaaattgaaaaagagtcagaaattgtaaagcacgaaacagaaaaaataaaccagaagcccacacaaaatatttcactacctacaaatcagacgaaaaatgtgaatagtgaaggtgtttcacaaaatatcattcctccaccacctgttacaagtccgtcgatacatgcgaataagcaaaatcaagaacccaaaaagaacgacgaatcaccatctcaagtcgggaagactaagcatcaattaccagtgttgaaccaagctatagtgtcacaagctcagaaaaaaataactgctacccctactcagaggagcaaaaaaagtacaattgaaatagtcccaccaccacatcgatctacacccacttcaccaatacgcccaaatgttactgagaaaaaaaccacgtccccaccaaagacaatttcaattgataccattggaccaccacccaaacagagaaatgaaaaaagtctaaatattaatcagggtcaaactcagttagtcactgaaataacacctgaaaatagtaaaaagacaacaataacaacaactactaccacgacaattaccgaaccgccgaaagaaacaatcgatgatttggtagggcaaattgaagaaccaacggaaagaaaccgggtggaggagttgatttccgtcttgtttggagatgagaaatggaaacaaataaacttacggatggttagacaaatcattgaaggagtggagttacaatatcacccaaatcttgatcggtttaaagcggtttttacacacccgagaattgaatttatctctttttctcctcaacttggttatgtattaggttttgaaaacgcgcagcacgtaagaaacaatgagattgccaaatatggaagtgatttacgtggtttttgcaagctttgccgtctacgccaaagggttgactgaaaacatgattgttggaaattcactgagttctcttctccgtgttgtctcagtgtcaggagcaacgccgggagaatacactgaaaaaatttacgactcccccctatacgcacgtgttttaccaaaagaagtgtcagaaattcaaattgaattaagaacaatgaccgacggaagattagtaccattttcctattgaacagtgctgatcgtactgatatttaagaangtgataaatttttgaattcactcattattgtataatttgacataatcgattgaataaa

SEQ ID NO: 74701 - DNA, 1257 bp, Heterodera glycines
  Genomic contig location: Contig_ID=SeqID_11320; Location=559..1815; Strand=-
  SCN-specific regions: Sequence locations=1-268,300-1049,1072 -1088,1110-1257
atgtctaacacattctttgtgcatttatccagtaatagcccagactacgctgagaatacaccaaataagtttagagttcgtttaccaaaacctatctatttcaatggctcttgggtatgcggattacacagcattaattatgcctattcttggccatcaacaattggaaccttagatgatcagtggatcaacatacattttacggatggtttagataatgaaaggcttaggattgttcgagtacccgccccgaaagcttcaaacacaacaattgaaaatttaagaaattttcttatttcaaccctaaagaaccatgctgagtctcttgaaaagattataaaagatagttcacagaggtcaataaaaagaaaacgggccgcttctcagccaaaatcacctcctagtgcaattgtaccaaagtcacaacctaatgttagtcccaatgtaacgctaaatgttaaagtaccaacatctccaccacgagttggacagcagccacaaactaaatccgaggacatttctgattcgattttaaatgtaacaaaaccatctgaaaagcaaccgaaaattgaaaaagagtcagaaattgtaaagcacgaaacagaaaaaataaaccagaagcccacacaaaatatttcactacctacaaatcagacgaaaaatgtgaatagtgaaggtgtttcacaaaatatcattcctccaccacctgttacaagtccgtcgatacatgcgaataagcaaaatcaagaacccaaaaagaacgacgaatcaccatctcaagtcgggaagactaagcatcaattaccagtgttgaaccaagctatagtgtcacaagctcagaaaaaaataactgctacccctactcagaggagcaaaaaaagtacaattgaaatagtcccaccaccacatcgatctacacccacttcaccaatacgcccaaatgttactgagaaaaaaaccacgtccccaccaaagacaatttcaattgataccattggaccaccacccaaacagagaaatgaaaaaagtctaaatattaatcagggtcaaactcagttagtcactgaaataacacctgaaaatagtaaaaagacaacaataacaacaactactaccacgacaattaccgaaccgccgaaagaaacaatcgatgatttggtagggcaaattgaagaaccaacggaaagaaaccgggtggaggagttgatttccgtcttgtttggagatgagaaatggaaacaaataaacttacggatg

SEQ ID NO: 74702 - DNA, 6748 bp, Heterodera glycines
  Genomic contig location: Contig_ID=SeqID_1593; Location=6..6753; Strand=+
  SCN-specific regions: Sequence locations=1-438,460-485,507-593,615 -632,654-682,836-1033,1056-1060,1082-1290,1317-1347,1376-1760,1806 -1885,1907-2096,2119-2368,2390-2672,2694-2734,2759-3064,3091 -3094,3116-3282,3304-3359,...
  SCN-specific regions: Sequence locations=...3381-3386,3408-3451,3475 -3528,3556-3796,3818-3963,4036-4090,4112-4131,4153-4181,4216 -4667,4689-5257,5304-5329,5399-5517,5539-5551,5579-5667,5690 -5778,5806-5807,5837-5849,...
  SCN-specific regions: Sequence locations=...5871-5873,5895-6007,6040 -6067,6157-6168,6190-6228,6274-6289,6323-6400,6422-6505,6527-6748
gtccatgctgttcaaactgtcactatcctccacagcaatccatcgcattcggcgattgctgttcgctgagctgctgctcaacctcatcgcgttgatgatcaccatcaccaactgcagcagcactacggttgtgaagaagtacaacaagcatcaccaacagcggaggatggcacaaaaaatgccaatggcggtgccgacggcggggatgaccaattactgttactgtccgcattgctcggctcgtcctcgttgttgtcgtcgccggcgtcttcggcacggcatggcgcccagcgctggcggcgtggcaccattggggagcaaagcattgcggaagagtgtagcagcggcacaactgtcagtgccggtgccgttgatggacgtgaaaatgagggagacgatgacgaaaatggcacagattgtggcgagcatggagacgataaggaggataagtgtgttattacacagctgatggcatttgaaatggaaaatcaaatctattttataccgatcattgatcaatgattgggttttattttgatcaattcgattttgaaagttttattttaatctgttagattatcggactgatttattttgagtttttataattagttgaccacaaaattaaacacaaatttaattgaatctgttttctgactggcatcaaaattatttttcttccttaataaataaatttttattttttataaatttttaattgataatttttataaaatacttttattttattaaaatatgattttatcaatttattaaaataattgttagtaatattaatttgaattatttatttaaatttttaaattattttattccaatttgcaccattatttcatttcagaaagagtcaaccgcccctttcggcattattgtcagccgacaaaacgccaacaaagagccaatttgccaatgtcaatgccaaagttcaacaggaacaccagcaacagagaactccggtggcaaagacgacgtcatgttcaacttcgtcctccggcgtttcttcctccccgaatattaatggtcaggatcaatttttcgaaaattaaaaatgccaaatttagttaatttatgggctgaaaatatccctggaatcgaaaccaatgtgccaagaaatcatctttttttacaaaatacgaaccacagacctcattaaaatcttttttagccttttaaaaattttcgaatgcggaaattcggaccaataaaatccggaatcgtatttcagaattttcaatcgaatttgttattataatttgaaaaaaaagttattgactaaaatattgaaaatttgaaatatgtttaattttcaataagtagttaagaatcaaaaaaaaattaatatttttcataatttcatttagaatttttcaatttactgtccaaaaaatttaataatcccaaatttttttggcaaatgtagaaaagccatgattgaccagtttagccccagcctttctgatcaattgcactaattatgttttccccgttttttaagctggaatcagcggctgcagtaatagcagcaaaatttcgcgcttgatcgtccgtcggcattccgcttttcagctgccgcaacgcttcacggcagccgcctcggtggccattggcaaactgtcaggcgcttcaccgccgcccccagcccttctggcaacggcaacgacggcacaaatgcttcatctatacaatgccaacattggaaacaaaagtgctacccaaatgatcactgctgctgctggtgccgtcgacgacgacgatgataatgacgaagatgaggacgccacgactgatcgaccgactgatcaaagtgatgccaacggtagtagtaccgtaccgccgtcgccggcactgtcccaccagctgaccatggcagccgcgaagcagcaactgttgaagcacacggcgcccaaaagtggcagcggtcagttgtttgctcgagaatttgaattttgaaagcatttatgaaaaacgagacttgataaatttcaagcaccgaaaattgcttgctaaaattatactcgttttggggcccgggtaccggattttttttagaaacccgtgaactctggaattttacctgccaaaattaaatatttttatcccgattgccttagattttttttaactcgtcgaatatctaaattttctgcggcggtgcatacatatctcgcgattgccaattagcaccgactgacaataaaatcttattaaatttcaattaaattccggcataaaaaagctcttaaattatgaagcataggaatccggctgagctcatttcaaaggataagggaacaaaaaatcttatgaattctaaggttaacaaatgtgattaaaaaaagaggtgcatttacaattttcccattttccatggtcatcttggaaataaggacgcgtttagtttttccatgttttgaggcccagattcaagaacgtccctaaatccgaggaaaaatctatgtaatccctgttatcagcatcttttttcctgccaattaatccccacttttgctttgattaacttaatcagtcgccgctttttgtgccctgtttggcgatataaaaaggcatttccgatcaccgcttttcctttgacaacatttcgcggcccctttgtctctttctctgatcaccaccacaaaatcacatatttccttttttgttgtctgtcccttatttcggatcattcttttgtcggcatcattcattgatcacttttttcattcgtttatttgatcaatgccgcctttgtcactgctgatcagctactgcttgcgctttcctttctcactgatcgatagattgtcgttatttcgcttcactggtcaccactgttttctctttttgtttgaaccgtacaaaacactgatcggctaccattggatcacttactgttgttgattgatctgtatgtatccccatacgttgtctttcaatcgcagttgttatccgctatcattgttttgtatttcgctgattctgctatttgatcggctttctgtctaatttttgttgcatgctcttttcacagatcacttccccactcttatcaacatcattttcattcgtttatcagttttaattattattattcattctgtttttttcattgaatttgctgattcatttatattgcactccttttgattacattgtcatcctgatcaccccactgcttctgaacattttgtcactctgatcacccccactgcttctgatcaccttttctgccctgtcagttgatcactttggtcattcccattgttactactgatcatttttctcgcattaatcaccactatcatacctactctgatcagctctctcattctgatcatccaattttgcttttctgcttctgctgatcacttttctgtcaccattttgtcgtcgttttgctccttcgcttatcgactgctaaaacggcggcgtcgaacgaaacaaaaaatggatctaccggccgctgatccttctgctgaagatgatcgggatggggtaaaaagcaggaaaagaaacagagagagcgagaaagttgacaaacaaaatgtgatgtatgcattgtttttttttgtgtcgtcacaatcccttcgagcgcgggacggatcagtcccaaccaaaaaatccgtaacatacactccatcatcacgcattaacagatttatggctgtgatctgctaattctgatcagcagagcagatattaaagcggcatttatttttcgggatcagtccgatcattgattgattgataactggttgattcaaatcggattaaaaacaaggcttccatttttggcttggtccaattcaaggtcagtccgcagcttttgtctgcctccaatactgattagacttgattggacatcgttgattcgattcaaatcactttaaccaatcgattgaattctcataggcacctcagtttttttattgtacttctaatcactaattaaattttagtcaattttaatattaagcaatttaatttaaaatatttttacttacttttttattttttgtgtccaattttcttcaccaatttttttaatccatttttctttatttttttcctgttaaaataaatttatttcctcctcttctcatttcgaaggactgattcatccaaaattgcaatgctttaacccattgttattacttcttgacaaatttttttgttaaattttaaatttaattaaaagcggaagaaaaattttgatttttttttcaaaaattacatttttaccgatttgaagtggcaagaaaaagagaagtgataatttgaagtggacaaaaataaacaatttttttacaaatttcgctggttcattccttcttgtgttagttacttcctccttaatcttcaaaattttaaaaaagctaattatcgaaatgacagtcaaaaaactgaattcagcaaaatcgtgtccacgcggaaaccgggatagtaccgtagaatatgttccatccctcccaaattgcgcatccccctgatactgtcccttaattaatttatgtgctccctgatactgtataacagtagtcccatgcctcctgatacctaccgttcccggtctcttaatccttgtcaattggtctccctgagattgtaatggcataaattatgtcattataccctccaattttgtctcccccatggcaccgtccatggtcaatattttgtgtccgtggtgctgtctgagtgtcacatgccccctcacaccattcctagtctaaacccttgtactatttgtgagcctccttggtatcattctcggccctaagttgtgcagcgtcgactttccgaccgtcccatgtacctaccactaccgtacctggtctaaactgtgccgtcctgctaccatccccgcccggtctaaaagccgtgtgcttccccctttccggctaatgggatagtgtaccaccactctttccccgttttgttgtgctgacaaatcggttggagcgtttcaccgttttcatggttcatcagtcagtcggtcggtcgctggtcggtggttgatgtgcacgcccattacgcaatcaatcatcattagccgccgccctccggcagattttgtgggctgtgctttttctgctccattttagcagcttttcattttgcttactgcttgcttttgtttttgatgatgtgttgtgcttttttgtaggtgcgcgctttttaaccccttttttccttttttgatgggtgagaaatttaattaaacgaaatttatggggggtaaataaattaaaaagtgtgaaattaaaaaataaataaataagtaatttcacacaatgggagggagataaagttttaaaaaaaatgttttaaaaaatacatttttattaaaaaaataaatgccattttaataaaaatttatgtgggtaagaaaaaaaagaaattcaatttttgaaatttgcagaaaactattaggagataaactattagagatttaaatgataccagaatttttattataacctttttatccctttgcataaataaattattactttaaagaaatattgacgtgtaatttaaaaaaataaaaataaattttctttgtttttctaataaacgattttgtccttaagcaattccctagaaggaaattaaaaattgaattagaccttgaatagaaatattgttaatttatcatttattaaatgacattgatccacttctaagttgatttcatgcaatatttttttgttaatttggtatttaaatgccaaatttgtttttgattattatttatatataaaataaaaataaaataaaataaaacttcttttgatatttttaaaaaagacttttatttttttttttgttatatatatatatatatatattaattctttttcagctgacaaaattgttgacgacaaagctaatgtgcacgtcagcatgcaacaattgctggcaatgcgcgacgacggcatggaattggcatttgagcgttgcaaaggttggcagggcatttttggaactaaatttcaattttaaaaattaaacaaaattgaattgaatttcttttttcgattattgcataaaattttttttatttaaattttatgtttttcttattttaaccatttaaaattagtttacaaaaaaatgaaaataaagattttttatcattcaatcttttggtcaattttaaattttatcatcatgctttaaactttttgtttcttttaccaatttgccaaaaatatattttttcttaatgtaatgtaatttaatatattttttgattgccaactaaaactaattaattatattttttataaataaaatttttccgccgatgacaatttttgcttgtcggttggcacttttatctttccgccacgctttaaaaatttgtaaaaattatcgctaaaaacatgataaattcaaaaatttttatctaaaactaatagaccatttcttagtcaaataaggtgtggcaactttcaattaaaattccgtaattaaatgtcaatgttttgtttttgctcagcttggtccaaatacgtgtcccaactgttgcaaattgtcaaattgcgcctgagcacggaggaggactatgtgaacaaattgaggcgccaatctgagcaggccaaggcgctgctcgctgtcggcacggcacaaacagtggcagcgaatgttggcaaaatgccattggccggtgttttcgaacggatgctggacggcacaatgcaacagactgtgcacgcggaatgtg

SEQ ID NO: 74703 - DNA, 916 bp, Heterodera glycines
  Genomic contig location: Contig_ID=SeqID_11321; Location=91..1006; Strand=-
  SCN-specific regions: Sequence locations=1-388,410-507,552-615,639 -714,769-772,794-916
atggcagcggttgatcaacaccagcaacaactcgttgaacgcattaaacagcttgacaccctttcaacaacggcggatgaacaatttgacaattctttaaatgtgccaattggcgatttgtgtcgtttgctgttggccgcgctggcgggcgacgaattggccgcgggggaggcaaaaagttgaaatttgaaggcctcaaaatttttttggcaaaattttactaaaccaattttttggcaatttgggaatcaaaatttttggcagaaatctgtcctccctcgtccccttttgccaatgccatcggttcgcttgccgttggctgtctccgggacggcattggcccggacggattggccatggaaattcagcaattaaattccgcctcgactgggaaaggcaatgaaatgcgcaatgcatttttggaggcttatagggtaaaaaaaaaaaaaatttaacccggcaaaatttcccatactctcacgagagagggctttaacgaattttctgaaaatttaactaatttattttacagaaaaatattattaatttaactgaaattaatttgtttgagagagagagaatttttaattttaattgatcacaaacagttgaaaaaattaattaatttacatatttatcgtaaataaaaaaaggtcatcagcagcagaaaggcgaaactttttgttaattcctatttttttcttggaaaaaaccaaatttaaattaaatattaatgaatttttaatcgaaaaaaagaaatttaaatttccactttcagtccaattttgatcaattgaaaatggcattggccaaatcgaccggtacatttgcctccggtggcagtgcttatccaaaagtggttggcatggactggagcattttgagcgtcattgaagtgctgcgatatttcaattaa

SEQ ID NO: 74704 - DNA, 616 bp, Heterodera glycines
  Genomic contig location: Contig_ID=SeqID_11322; Location=848..1463; Strand=-
  SCN-specific regions: Sequence locations=1-84,114-333,362-418,440 -450,472-616
atggtctggaaagaattggccaaggtggctgctgccggcgccgtggcggtcagccgggcacttgcgcgagcggttcgagaggagtttaattgttattttttaaatatttttgtcgattttatgccggaattaattgtaagctgccaaaaatccggtgaaaattttgcgtgcacatttttttggaaaatttataaaattcgtctaaaatatggggattaaaccttacactagtactcacaaattatgatatgtttcatacactctattgtcaaaaatattatacactttcagatggtgggtgatttattgggggaacaaagggtccatgccttgaaaataaaaattaaaaaacaaaatttttgtccccattggtaaactacttttgggttggggaatgaatatggagattcttgacggcaaattttttaaatttttttttctagcttcacgtgaagcggcccggcgacaagcgtccgccgcgaccgcgtcagatagtgccggcggcgccaacaacacggcctcaacttcctctgccacgtcctctacggcgtcggcacggcgtgccactgaacgggaggcgttgcagaccaacaccaggctgggcatcacagttcag

SEQ ID NO: 74705 - DNA, 2443 bp, Heterodera glycines
  Genomic contig location: Contig_ID=SeqID_11323; Location=25..2467; Strand=-
  SCN-specific regions: Sequence locations=1-201,223-245,267-318,355 -456,496-608,630-636,674-681,705-1058,1080-1144,1166-1195,1218 -1381,1403-1423,1445-1491,1513-1701,1726-1736,1758-1870,1918 -1928,1950-1984,2006-2408,2430-2443
atggacataaaatggcaaaaatctcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcagtcaacattcggaaattggtctcgaattttttcggcaattacgtgcaatcattttaaaagaaaaaaaaacataaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctggggactttagcttggtttgaagcttttaagatggatttctatattcatatttttccatattttgcgatttatgtccatatttaggcattttccaaaaaaacccctattagaacggcccccatcagctaaattggccgttttaacctcaaagaccagaaaatgctccgaaaaagacattttttagcaaaattttgtcaaaaaaaattgattaaatttaaattttcttaaaaattggttaatttatgtgaaagataagcaaaaaatggaaaatttcggttttttggtcgggtttttttgaaaatttacccctcaatttagaaaaatttatgtccatatttttgccattttatgtccatattttgagatttttaccattttatgtccatatttcgcgatttttagtccatatttttaccatccctagttatgataaaagtcaaactatctaaacgattaaaatggaaaatcatacataactcgtgctatgccaactcgtaaggctccctgatgtttcgtcactgggtactaattgggtttgtatccacatttttggtcaaatttttcagaagcgtagccagacagtcagacagtgcactatttccttcttttcttccgcttagtcactggagaaaggaagaaatagtgcactgtctgactgtctgtcaacgtggggctgcggcgggtggaagggtagacagtaagcagccgtgtggtgtgctggctggcagcattgtgtgtgggaaaagggaagaggtgagaaaaataaagaaggaaatagtgcactgtctgactgtctggctacgcttctgaaaaatttgacccaaaaggcggatacaaacccaactagtacctcaatcactacccgggggtcttcgagggagctgatgataacctgaccatagatttgtatacacggcgattcaattttgggctccaagtacaaataagtttattatttatttagtaatcagaacgccaaaactttgcaaaacttaaactttattggggattttcccttgtaaaaatggaagagccgatctcgagttagaaaagaaactttcagaaaacaaaagagaattcgatagagggggtcaaaatatgggcctatgcaaaatttgaagaaaatctgacccaaggaaaaattttttgacccaggacaaagttttttctttttctctcattttagtgtactatttccatgtctctaacatataaaataacacatgaaacatttatttgccaataaacaatttttttaaacttttgactaattaagaaatattcttcagaattttcccttcaaaataagtataaaatggttttatttggtctattattgacaaagttataagctaaaaaaatttaataaaatcaagggtaaaatataatgtctaccttccactatttgtatttgttcttttggcgttctgtttttattaatattttatttatttgctttaaaaaattgaaatttatacacaaacacaaggaggatttgaacctgagaccccctttttgatgactaactcacagaccactaagacgaaaaaaccaacttaattgtacttggagcccaaaattgactcgccgtgtatatttccaaaattttcataaattttggattaaatttggtgaaaaatggttttttatttaatggaatttattttgaaaattatttcagaaaatatttggcattctgtcttaatttttaaaaaaatgcaatgctcggatcccgctggatcccggacaaaaaatcaaatttgcgctcccgctgcaggattggaactcaaaattttgttgcgggacgggatcccgcggtttaatcccacaattttcaaaaaatgcgggattgcggactgggaccccgtaaaatcccgccgggaccccgtcgcgcgccggtatctaatgcagatacgcgggatctctcacaaatccaaatttgcgcattccaaattttaaatcttaagttttttagttagttttgcacttattttggtaataaa

SEQ ID NO: 74706 - DNA, 85 bp, Heterodera glycines
  Genomic contig location: Contig_ID=SeqID_11323; Location=435..519; Strand=+
  SCN-specific regions: Sequence locations=1-28,50-85
acacggcgagtcaattttgggctccaagtacaattaagttggttttttcgtcttagtggtctgtgagttagtcatcaaaaagggg

SEQ ID NO: 74707 - DNA, 854 bp, Heterodera glycines
  Genomic contig location: Contig_ID=SeqID_11323; Location=3607..4460; Strand=+
  SCN-specific regions: Sequence locations=1-19,41-231,253-854
atgaaccgacggtaaaaggattttaaaagtcacacaaattcgtcatttatttgactaaactgttttcccatttcagttggatttgcaacgacgtttggatggacattttcccatcctttgaccgtcctcaactcggcctcaaattggcacttctttcgccacgtttcgatgcgttggtggacaaacatttcaatggcaaaagcgaattgacaatttggagaacgatcgaaattcacaagggcaaaggaccagaaccgaaactatctgtgtggatggatgacaaatttgtgccatttccattgcccgaccgtccgttgcccagcaaaattcgctttaagaaccttcggattgagtaattaaaaatcaaaagctattgcaataaaagcattctttccatttttaggtacattgatcactccgtcatcgcttttcttcgttccaatcaccaaattttcgacaaaagaggcaccaatttacatttgtggcttccattatcaaacaccacggatggccagccaatttgggatgtttttgttcgtgaaatttggccaattttttcggcaaacattcgccacttacgctttccccatggtgatgatttggacaatttgcgtcgtcgcacttcgccgacaattttcactgatctcaaccaattgaattcaatctattctggtgatttgttgcccgctgcgattgatgctgattttgatgtgccaaatgcaacaatttctgctggccaagcattgtccaaatggttgcactctccgagaaacgatggccaacccaagcgatttcgttgtggcagaaatttgaacgcacaagaggacttcgattgggtcaacagtttcaaggag

SEQ ID NO: 74708 - DNA, 153 bp, Heterodera glycines
  Genomic contig location: Contig_ID=SeqID_11323; Location=2251..2403; Strand=+
  SCN-specific regions: Sequence locations=1-153
gattgcacgtaattgccgaaaaaattcgagaccaatttccgaatgttgactgactaattgcaaaacgaaagccgtctttgtcaaagcgccttaccgagtcaaaaaatttggaaatgtatctcatatgcaatttcaaccaataaatttgaagaa

SEQ ID NO: 74709 - DNA, 1270 bp, Heterodera glycines
  Genomic contig location: Contig_ID=SeqID_11324; Location=2929..4198; Strand=-
  SCN-specific regions: Sequence locations=1-126,148-235,263-331,366 -862,885-1072,1094-1105,1165-1270
atggtccaattctcgacgaaaatgctaaccaccttcagtctcttcatcatcaaaattttgctgttggatagtgttgaagcagcaggacacaaagtcacaattaaagcttattttaaagattttgaaagtaaagttccattatatgacaaagcaaaagaacacttaagaaaatgcaggcgactcaactacgaacgaaaaggcaaaaaccgaacattgtttcaaaaatatcaaattttttcactttttaagatgagaaacaattaaaaggcggtattttttgggaattgacatttgaaaacaaagaaaagttgaagccagatgaaaaatgttcaaactatgaagatgaagaagactcggaattggaggcactcttgagcaccttacatgcagcgaaattcccagcggaaaaagcaaatgacaaaacgccaagcagaaaaaaataatattgccaaagcagagaaagctttggatgagtacattaagaaaaaagataaaaaaggtggagaaaaaggtctcatgacaactggtaaaaaggcactcgtatataggtctaggtttactaggcttaggcttacttgggcctaggcttcggcttaatttgcaaaattattattatgagttgaccatttgtacacgttgtaattgactcggggaaaaatggattagaaaaagacgaataggaacaaaatctgcaggcatgggactggtgggtggttccaggaaaaattctcagcagaaggtaggaattccggaaatttttttggatttctggtcaagaacaagacgtaagaggtacatatgtatattataaaaaagttatattttttggggaaaactaaaaatctcaaaaaatttggttaagaaaaatcttccttttatgtggttttcatactcttaaacctaccacctagaaaattgtgttaaaatttttggttaccttttcaaattgtcaaaaaaatcaaattcatgaacctgttttggaaaatggtcaaaacggtttttcagttttaaaccggtttattgtccagaaagtactaattttatgaagctatttaacagctaacttattattttatttttagcttatttcacccataatgcaaaagatttaatccgaatttgttaactctacaactttaataatattttgaaattttgttgaaaacagcttcaaaagtttatctctttttatcctgtaattttggcatttttctgtaaattttgcttaaaaatcgaaaaaaattacactcaaaaaatcataaaaaataaa

SEQ ID NO: 74710 - DNA, 1132 bp, Heterodera glycines
  Genomic contig location: Contig_ID=SeqID_11326; Location=157..1288; Strand=-
  SCN-specific regions: Sequence locations=1-285,307-1021,1043-1132
atgagtatggtggactttttccgcgtcaaaaaggacattcgaatcaatggccaattgcccgccgtccgtcagcagaaagaccgcgaggttcttaccttcccggagagtgaaaaaagtgatcggaattcccccaactgagttcagacgctgttcccgctgtcctgcattgtgattctgcccagccaacggcttccactggacaaaatggccgattatgtgtcccgggagctgcttaacgtatactttttttggggggggggacttggccgattaagcgaaagcgatccaaaataaaaaattttaacccaccagcagtagtcatagatcttctgattactgacttttagtctatgcttaatttgttagctcaattatttcgggtgcaccccaaaatttcgccgaaatttttttttatacggaaccgtttttgggaaaggccggcgaaatttcggcggcgaaattatgtcccgccgcattacttccgcccgctcactctatgctctttctcattgtttattcgttttttttctacactgattagattcatacaaaacaaaagttaaaaaggggagggtcggccgtgccgaattaaagggaattgttagtccaaattttgatcagagcgttgatccgtcagaaatggattattttattctgatcattttgctgtttatgagggacagtccgcttttctttgcacataattgcttccatttcaaatttttgtaaggcgaacaccacgcacccgagcaaacgctacgcggacattgaggcggaggttcggaagatcggcaccggcgcttcgaacgaatttatggtcaaattcggcgtcaaacttgtcggaggaaagaacgacatcaaaataggcattcacgaaatgccaaaggtgttttgtgtttggacatttcaattcgaaattaaattttgaatttcacagatcaaatttggagacggtggacagttgaccttcaaagaccgggtgattcccgggcactaattattggcacaactggcaaaaaaactccttcctcccatttcagatcaatcccggcgtgcgtttcctcgagaccagtgaccgcgtcaagaattgggtggtcggatatccccgtcaaattaacgaccaggaagttcg

SEQ ID NO: 74711 - DNA, 283 bp, Heterodera glycines
  Genomic contig location: Contig_ID=SeqID_11326; Location=2391..2673; Strand=-
  SCN-specific regions: Sequence locations=22-113,136-158,191-283
aaatttttaaaaagtttccagcaaataatggaaaattttttcgaattccccccccccaaacgaaaataaaaaaatttaataggcaattttcgtaacaaatagcactcaaatttccaaaattttttcccggcggcgcctatcggcaccgccggacctacattttccactatttttacaagttttttgccttaaaacggccaaaattgggtcatttttagtgaaaaagtgcagttgttacccagcagtggaaaaaaagttattggttaaatagcaaaaaaaaaaa

SEQ ID NO: 74712 - DNA, 397 bp, Heterodera glycines
  Genomic contig location: Contig_ID=SeqID_11327; Location=358..754; Strand=+
  SCN-specific regions: Sequence locations=1-254,276-371,394-397
atgccatttgtggtcattcattttgccttacacgtaaacactgccaactccatcgacgtgtttgttgagcgtggccggcgggggaacggactgaaattacggtacggtattagttacggtacgaatacaaaaatattttgctaactcacagcagcaattttaatctttttcacttcttcaataaggttttccattgcaatatatttttatgctaaagttacaatattccatagttatttttacaatattttctctaattccattaaatgtaaatgggggacattaaacggagaatatttctttcaatttttatgtctttattttgaaatttttcgttcaaaaataatttttgttaacaaagaattattttcaggaaaatttgaaattttacatttaa

SEQ ID NO: 74713 - DNA, 2684 bp, Heterodera glycines
  Genomic contig location: Contig_ID=SeqID_11328; Location=745..3428; Strand=-
  SCN-specific regions: Sequence locations=1-154,201-298,322-740,771 -951,1020-1070,1092-1225,1274-1532,1557-1626,1648-1817,1849-2633,2674- 2684
tgaatttgtgaagagctggtatcccatattgaaaatcaaggacattggcaatgcttcttcaaagctgccaaatgcggcactgccattggcacaaattgtccgttgggattgggaccaaaatggggcacaacagatcaatggagtattaaagaaatgaatgataaatcttaaaaaatatgattatcaattattattttagacccaaatactcaaaaagggcagtgcaattagtttcaacatttgtgccaatgattctgcttcatttgttattcgaattcttaaaaagcgggagaaaaagtaaatattataattaataataatcccggcggcgccttttggcacggccgggcccacattttaccctatttttttttgtcaaattttggcctaaaaatggcatgatttttttttgctctccgcgcttaaattttttaggtcttctgatttccccttccgaaatgggcttattgttagtcaaaattagagatcggacacgggccgggcccgtgcacgggttttcacgggcccgtagcccgtaacccgtgtttttttgggctgacacgggtttcacgggcacacgggttttccgggtttttagcccgtaacccgtgtcaatgccaagcccgtagcccgtgcccgtgtaaaaagtgacacgggctacacgggctttttttttctccagtaaaattgagattttttgaatttttctaatacattacgccaaaataatcattttttgcataaaatttgattaaatattaaaatttaaagtgaatttgggttagagatcggaattttgagaaaatacggataagggtaagggttacgggcttgacatctatacgggttacgggcttatgggctaaaacctctaacccgtaaaaacccgtattcagaaataatacgggtccgtatacgggtaagggtttttttctttttgataaaaataggtttaataaatacaattttgaatatttaaagctaaaagatattataataatttttattataaattttaagcaacaaaattcaaaaaacacaacaattggcactgcggtggccattgggcgcctccgggaaattttttaaaatttgattgcaatttgttaatagatttaatagaaaaattgaccaaatttgcgatttttaactgatttcatgaattttgctgacagtttttcactaaaatgatttataattttgaagaatttacaaatccaattcgtaaaaaaaaagaattaagaaaaataaaaaaaaatttcaaaaaaatttacgtgctggtgcgtttcgtaaaaactgccacaaaatttaaatgcaattttatgtcacaatcataacgtttttgttttttattaatgtagcacacatcatagttatagcaacaacggtcaactttattgaataatattaagccaattaattttttatttttacctttttgaaaattgcaaaaccatattacaggtgctattatacaagaatcaaaaaatgatgttccacaatacgtgccacaatattttttagcaatttacaaataaaaattaataaataaaattgcgtagttttacgaaacgcactagcaccaaaaatttaaacaaaatgctattcaataacttaaaaattttttggtacagaaataattgatttcttttcaaattacattaattttccaatatttaccaatgctttttcgattttcaccgaaaattttacgaaattgaccgcccaattacggggcccgtaaaaacccgtatacgggtccggcccgtatccgatctctaatttggcttgtttatgttcattatgtaggtgtattgtattttttattatcaatttttataaaaatatcaaagtccaaaattatgacatcaattaaaaaaagatttctgattgtaagcaaagaatctcgaacgactcgaaaaattgcttgaggggtcagggaatcctgcccttaactcaattatccaacggctcgaaaagttggaaaatttggtgcagcaacttgttgagggcgagaatcggtgtggaaatcgatttgctgacccccagcacgcctcccactcttcgtccgttcccatctccaacaacggcacagtccaatggggtcaaccgccgccttttgctggcaccggcctcgtatcgcggatgatcaccgaggcgatcatcaactctgagcagctgaaggagaaggcgaaccgagcagtcatcgaaaaattgccggaggcaatggacgaacgggcattggtggagcaaattgctgatgaatgcggcgtaaaagacaaactgacaccggacattcatcgccacccgaggacgcagctaacagatggaggggtaaaaaaagaccgaattttgaaagttccattttctgacaaatattcgcgtgacaaatttatttttaatttccgtaacgctttgaaaaaattccccaatttgccacaatttatcaaagtccgcagggacatgacccaaaacgaactcaaaattttatactcccttcggcaacaagcctacaaggccaatattgccgctggtgaatataagtattatgtggtcgatttggagatcaggtccctgaaaaacccccatccgctcagaactcgctagggacacgcgagcaaaccaacgaaacaaattgtaaaaactataaaaaataatccctggatttcctgccttttaataaa

SEQ ID NO: 74714 - DNA, 965 bp, Heterodera glycines
  Genomic contig location: Contig_ID=SeqID_11329; Location=1363..2327; Strand=-
  SCN-specific regions: Sequence locations=1-84,106-165,187-395,418 -559,586-650,672-839,861-888,910-965
atggactatgttatcattttattaacaaaggtacatttcggtcgagcatgtaagcctatttatattattttttacttagaaaatatttgctattatttcataattatgatgttaatgcaattttctgtaatatttttttatttttcattcaacactttgattaattttttgtagtgcttaacttcgttttgcctttttttcatttcgtgcttcttgatcactgaaaaatgcccgaaaaatggtagtgtagtcttggtcttgttctagtttagaaatgatcaggtttttatattattcttattttattttgtcaactttttgagtattaatttttgtttttgacgtatctgactattagaaatctttattgtattttgggtttcggtttaattcactttatttaatttttgttttctaatatgagtagaagtatcttgacacatgtatagcactctgtcgtggaaggtatgatgtttagtgatggctaacaaatcacatttatgataacattttttgttttattaaatgtcatacaaagaagattttttatgccatttagttaaaattatataaaatttattttaaggttaaaggacaatttaactttgataattatatttccaagcaaagtccaaatttttttgatttgggtgctgatggcaacattcaaaaaatacacagtaattttaaatttttgttaattttttcttttcatttaatttccttatagggtttttgaatcgatatccttttttatggccagtgatttttttgagttatattaacaatttattaaatcataatttttgcccatttttctatttcaaaacccaagtaacttttattatttatttagaataatgaattacctataaattaatttatatgtttccaaatttttaaatgtttctctttctaatttacttatttcgtttttttttttcactcaatctatggttaataaa

SEQ ID NO: 74715 - DNA, 547 bp, Heterodera glycines
  misc_feature (405)..(405): n is a, c, g, or t
  Genomic contig location: Contig_ID=SeqID_11332; Location=813..1359; Strand=+
  SCN-specific regions: Sequence locations=1-196,230-288,311-477,529-547
atattattgtcagagaaaattttttaattagagggcaataaagaataattttattaaaagtaacttaaaagttaattgaacaaaatttttggttaatttttttttggggggggtgaaatatttggttaaatgtaaaaaagcatgttcaaaatttaaaaaaataacgattttttccaaaaagtttatgactaggtggatttaaattcaaaaatatttaaataaatatttagaaacaacaccaaaatatttaagaaaatatcgacaaagttgcaacaaatttttccagggttttgaatggatttttaaatttcaaaaaacaaaacaaaaaatagtggaaaatttttgaatttttccattcttagaaggtgtatttaaaaaaaatattcgacaaatccttcggtggtnggatttttggttttgtagaattttgtgatgaattttcgaaaagtgcgaaaaaatgctaaaacttctgatatgtttatataaatattttaaaaagaggcccaaaatattttttattttttaaatcatgccaaaattcttttct

SEQ ID NO: 74716 - DNA, 775 bp, Heterodera glycines
  Genomic contig location: Contig_ID=SeqID_11332; Location=1..775; Strand=-
  SCN-specific regions: Sequence locations=1-215,237-243,290-353,375 -509,550-604,626-748,770-775
  Gene Ontology: Mol. function=glutamate-gated chloride channel activity; Cellular component=integral to membrane; Biological process=cell surface receptor linked signal transduction
gttgcccgacctgtattttgccaatgctcgccaagcaaatttccatgaagttactgtacccaattttaatttatttatctccaccgatggtacggtatcatattcgagccgagtaacactgacggtggcgtgcaatttaaagctgcaagactatcccatggacgagcaacagtgccacattcgcgtgctgtcatgtgaataacaattaacagattacaaaagaaataaataagggcttaaaacaaattattaatttaaaaaaacaacaaaaagaaattaatatttaaaacttccgtatcttaaaatttccgaaaatttaaaattttagctgttttataaatttaagttttttggaaataaaaaatctatggaaaagttcgagcaacaatattttcattaaatcaaaatttgcaaactaataaaactaaattctctatcaaagagacgaaatttcaaaaattatgtcaaaatgtaaccaaattcgcctataaagcgaataatgactttttaaattatatgtatatttaaaagcttttaatatgatttctgtcagatgcttacattgctaaaattgtcaatgtcacatggtttcggcgtcaaccaatcctgtacaaccctgaaattgatctgcccgaatttgacattgatcaaattgttgccgaatattgtgatggcacttaccgttatgcagtcactgaacgggcgtacaaaacaggtacaaattggttagagttagtatttgtatacctaattaataattttttattttcaaagg

SEQ ID NO: 74717 - DNA, 1688 bp, Heterodera glycines
  Genomic contig location: Contig_ID=SeqID_11333; Location=126..1813; Strand=-
  SCN-specific regions: Sequence locations=1-97,119-262,284-538,707 -877,934-1035,1109-1180,1203-1215,1237-1245,1316-1578,1600-1648,1670 -1688
atgcataaaaatcaaataataggttataaaaattcaaaacattggtaaatgtaagtaattttgcgatccatggcacctttttttgtcaaaataacttagaaaaaagacaaatttttctacattaattatagaagaaaataaaaacaaaaatttattaaaccgcatattagttctccttatattttctaaaaaaaactaattaaaattctcattagtttaaactcaaatacataaatttccttttcccgtttataattaaataattctctgtgatttattaaaacgtaactcaaacagcagcagatgtccatgagtgtcaaggctccaaacaattaaataatttgggtcagaagaaaagcagctgttggttgaaaagcttatgtttcggccaaattgattccgttaaaacaatttttcactcaaaatatttttacacgcctcattattggacccaaaatttggccagccaattcaacacactttttcaatttaaagtaattttttcttttcctttaatttgtttcgataattttagggcaaaaaatttttttttatttaattttctatttaaaaaaaaatttgaataatttatcaaatattttttttcaattaataattttttaatttttgtgctaatttacaaatatttcttaatttttttttttcaatttgaataaacaatatttattttatttatcaaatatttcgcaattaaaatttattcttgctaatatagcaaatggaaattgaaaataaaataaaatcatttttagaaaaaaagaaaattttcttcacaatgaacgcagttattgctttaatttttcttaaaatcaatatcagcttttggctacaattatatgcttttcatcaaaatcagtaatattctttttattatattatttatatttattatacaaaaatatattaaaaatacatacatttgagtggtcaaaacattcttggatacacacattctgatgaaccatttgtcgcatatcaccgtgccactgaacatgcacctaatcgattggtgagtaattaaatttaaaaaaaaaatacctaaataataatccttttaaaatagtacataattattactaaaaaatttccgtttggattaacaaataaattaattgactaatgtttattaattagtcgaaagtcgttggtcaagggagggaataaatttataatttaattaagacgaaattagcgattttttaaaagaattatttttgaagcttcaaaaatattattttttgtgtaaaagatattttttaatattttttttaaataagaaatcaatatattataactctaaattttgaaaaacaattcctaatttaatttcgttcattccaaatggacatatactcaccaaaagtgtaagtggcatatgcccttcttttggtatttttatttttgaataaataaatttcaacattttttctcttaaagttagtttgcatttccccataatcaacagaaaaaacttcaacgatttcgtgcaacgaaaacaaagtcagctacaacatttatggccagtgaattgcatcgaaaaattcgtcgacctccatcgaactcaaatggtgaacctttgtcagtacaattgggcttctacctcgagagtcttggcaactttcgagaaactcaaatggtttatgaacggcattaaaaattcaattaaa

SEQ ID NO: 74718 - DNA, 1423 bp, Heterodera glycines
  Genomic contig location: Contig_ID=SeqID_11333; Location=2662..4084; Strand=+
  SCN-specific regions: Sequence locations=1-212,250-384,406-894,928 -937,961-1025,1047-1077,1109-1337,1359-1423
atgccctcttcatctccaattgttggctttagcctgcttctcgtgctgattgcacaaaatgtttttgtccaagggtttggcttattaaattccaaaattgacgctgcaagcaaagcgtcgattaaatgttgtgtgaaggaagcacatctgagtatggaatgcgccaaatcaggtgagtaattattcaattttttgtgcttaaattttttaggtataaataaattttcttttatttacatttattatttactggaattgcgtacattttttgcgcatttctattaaaattccacaaaaacgggcatttcttaaatgtaatattagtgctctaacaaaaaaaaaaacggtactagtatttgggtacggcattttatagcaattttcaatttaaaaaaaaaattaattgttctattcgcttcggaacacacgcaggcgaaatcgaactttgaaccaaaaaaaatgaatttaaccgactggaccattgtttatgttgaaaaaaggacaaaaagggacccaaaatttcatataatagcctaatttgacatttttggcatcgttggatagtcctaaatgattctcaattaatgtgcaaaattaatttgttgcgccttttctttgacagtttgtcgttacttcggcgacaaaaattaccccgacaaatgcaccgtgccgatcatgcacaacttcaaccaaatggtcgcctgttttggcgcacacacggacaaccgaggtaaacaacaaaaaaaaatgcatcattattttgagtgaataaaatttgcttaaaattgggttggcccactccaaatccccggcacggttttacaaatattccaaatgattctctatgaaatttccttgtcatggcatttaaaattttctcttgttttttgcgagttatattaattttcaaatatatttttaaattttgcattcatccccaaaaaatttgtctgagattagcttttcgtccccgatcaatgacaatcctgctctaaaattaaaactgaacaatacctagtttttaacaattttgcaaaagattaattttatctagtaactttgtaatggaggttttggaattttttaaatgaaataattatttaaattagaaaatgccaaaatttcatcatttaagcgtgttgcaagcgtaagggcgtcaaggcaccgtgccttgacctgtgcaacgggaagaacccggactatttgccggacccggcttatgtgccgtgcacattccctggcaaagtggacaatgccatccaaaagtgcaaccacgacgcatggaaaagaggctaaatggaactcggagaataagttcaatcagcagaggaaatattgtattaacaatagaaaaagaattgttgaatcattaaaaatgtaaacgttaagagtttcaaattatttttttttaaagaaagataga

SEQ ID NO: 74719 - DNA, 56 bp, Heterodera glycines; identical to SEQ ID NO: 64087
  Genomic contig location: Contig_ID=SeqID_11336; Location=2094..2149; Strand=+
  SCN-specific regions: Sequence locations=1-56

SEQ ID NO: 74720 - DNA, 703 bp, Heterodera glycines
  Genomic contig location: Contig_ID=SeqID_11336; Location=9..711; Strand=+
  SCN-specific regions: Sequence locations=1-578,600-703
aatttggtgcgctttagagcactttctcttcctaatatttatgaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattaggtctccccataaatctgggcgcatcggttcggggggactgccccgaaaac

SEQ ID NO: 74721 - DNA, 1854 bp, Heterodera glycines
  Genomic contig location: Contig_ID=SeqID_11337; Location=2692..4545; Strand=-
  SCN-specific regions: Sequence locations=1-227,261-359,381-558,585 -704,740-763,791-830,852-1184,1224-1251,1282-1439,1461-1568,1590 -1732,1754-1854
atgattttacaattggcaattgacacagcttatgggtgccaaacaaatgaaagtgtcgacggaatattccggcagaattttaacgaaattttaggggaaatgtttaaaaaagcggaacaacgggcaaaaagggaagataataatttattatatgttaaatatggaatttttgatacgaatgacataattgtccgatcgatttttgatgattattgtttatgggtgagtcttttaaaaacaaattgttttaattaatgccaaaatttaagactaatgatgcaattttcactgaatttgtgaaaggtcaagagacaaattttgagaaattttataggatgcttaaagaatattcaaactttgagaaatcaaaggaattttatttacaaaaatatggggcctattttggtcttgtgtatttaatgagaaaaaattggcaatgtgccaaagttggagaggatttaaaagaaaagtgccaaaaatacaaaaaatatttgcatattttgtatgaatatttcttcagaatatctgccgaaggtttttgctttccatttaatgatcatttaattaattaataaaataattaagcaaaaaacgcaaatatgacaaatcaattgtcagcggtaaagccaatttttaaatggggtaataaatattggcaattcatgcaaataatttctattattcaaaatctgaataatttttcgaaatgtttttggaaaaagggcgaaaaagaatgtgagaacgcctatggaaattatgagatggaattgcaaaatgagaaagaaacaaatcatgcaattgaagaggaagaaaaaaatgggcaaaatttggagagaaaaagcgaaaaacaatcgacggaaattggcaaacttcggacagaatttgaccaaaaaatggaagaaatatatgaaaatacaaaagaaaaagtagcagaagaaaagtcgaaattggtaaaaaaaatggccaaattagcaattaatcgtgaaagaaaaatgatggaagatgaatttgaagaaaaatttggcgctttcaattcgtcaccatttgcataagcaaattctcgtcttattctaatccaaaaaggaatttgaaacttgaaagtgattatttgagctatataattaatttacacaactccttattctaacagaacgcaaacactaagtcgatatttaatttttctcttcaattaaggtttaaattttacggaggtttgttatgggctgctttctgagaataattctagcatgcttaaattattatttaatttgatttaattttgttgctttttgtgggcaaaaagccacaaaaatttgcacttcccggcagaaggggggagtcttttaagcaaagcgaatttctgtccagaagacagaaactcacagagtccaaagggacaaattaaaggaggaaattcctctcctctaccgaagagacaatttggaaggagaaatcctttctccttcctttggtaagccttttttgacccaacgggggtcaatggcttaatggtctgtattaaagggctcctgagtgtcccatttaagaccttttcttaatctttattcaatttatacaattacaatttaatgcaaattgcttggacagaaaactgtccggctgacttaatcaaaaattgatcagtgaaaaaaatggagaatgggccggcttttataccctcacaaatcaataggggcggagccaggcacgtgaaaaatgtgcacaaacagatggacaaaaatccattaaaaatggtgactcatagcgaaaatgaagagagaaaaagagctgagtcataaaaaagaggagcgagcgaatgggaaaattgatcgacgaaaagtatcaaaaaataaa

SEQ ID NO: 74722 - DNA, 1838 bp, Heterodera glycines
  Genomic contig location: Contig_ID=SeqID_1597; Location=189..2026; Strand=-
  SCN-specific regions: Sequence locations=1-159,181-1781,1803-1838
atgcaacaattcgagttcgagaacggaagcgagagcaacatggacccagcgaatgagggccaccatcgcaacggcgcacagcacgacgaaaatgtgcaggacggggatggtcccgtcgcttcaacgaacgaagagcaacaaaaagttgccagagtaaacgaagcaacgagaggaagcaacatggcgacaggcgtggcgacaaatcagcaagggatgctacccttcccatcacgcaatttgcggagtgtatccatcccggtacggacagcgcgggacagaatcgagagagcatccgggactctcgccgctcgaattgcggaggctcgagaagtgatcgaccaagaccttaccgaaggggaggcaggctaccaagcagcgcgacttttggccatggagagaggactcaaggaggcaactcaaatcttccaaggacatttcgagattggaatggcagcagcgggagcagaacccgcaggtcaccaggacttcttctacgacctactgacagcgccactgccggcagcaacgaaagagttgcagttgcgaaaccatccaacaccagctgaactgcttcaaattgcggacgagcacatcggagacttaagaacgatgcgacgagcactcgaggatgaagaagaagcaatcgcgcggtctcgattgagcgggtcattcgggaccaacaacagccatccggtgggggacgaaccacctccactcgaaaatcggaacatagaagaatgtgagagatccttccaagtggcggccaaacgatggcagaacggcggacaaggtgtacagcaacacaaccgaagaccaatgggacgagtcgcgacacccgtcatgtcgaatttggacgggatttttcagcggcgtgccaaagtaccatccgtcgccagcatgagagtgacgaacacagcgcgagaatggatcaatcgaaatcgagacgagatgggggcgtttcccccagcaacagcccatcggccggcactgatgcaaccaaaaatcgaaaagcagcaggctcacgtgaacgacgactatcgggagcgtcagacatacccgattcgacggcatgctcgagacgagggagaacatgatcggaagcacgggagggacgaaatcacgggaatgacaacattcgagactgttcggctgcaaccgccgactttttccggaaagcccgaggattggacgacattttgggcctatttcaagcgagctgtggacgacaaacccattcccgggtttgaaaaacaattgcatcttctgcgctgcttaaaggagggatcgccagcccggcgggctgttgaagtctaccctccctccgacggcaactacccggtggttgtgcacctgttaaaagagcgattcggcgacactgacgatttacagcgggcaattcgggcccggcttcttcacttgccaccgacaaaggacaatgtgaacagcctgacgacgatgatcgacgagtttgagcggtgcgtgtgccaactcgagcagctcggagcgaacgtggacgacgactcatttggcccattgctggaggcaaaattgccggtgcgagtgctcacggaattgcggatcagagaaagtatgatgggatcgaaatgggcagtgcgcgagttcaggagagcggtgacggcgcaagtacggtgcatgcggtcagcagagtcagcattggcagcaatgaaagacccggaagtacgcactgatcacaaaacagaacgtgatcagacgggacgggaagttcaagcaggtcgggaaccgtttcaaagagcatttatggtacgggacagccaaccaacctgtgcacaatccaacggaacacgaagcgaggagcg

SEQ ID NO: 74723 - DNA, 4849 bp, Heterodera glycines
  Genomic contig location: Contig_ID=SeqID_1597; Location=2265..7113; Strand=-
  SCN-specific regions: Sequence locations=1-569,591-2153,2175 -2679,2701-3356,3378-3437,3459-3470,3492-4704,4727-4822,4844-4849
cgagctgtggacgacaaacccattcccgggtttgaaaaacaattgcatcttctgcgctgcttaaaggagggatcgccagcccggcgggctgtcgaagtctaccctccctccgacggcaactacccggtggttgtgcacctgttaaaagagcgattcggcgacactgacgatttacagcgggcaattcgggcccggcttcttcacttgccaccggcaaaggacaatgtgaacagcctgacgacgatgatcgacgaatttgagcggtgcgtgtgccaactcgagcagctcggagcgaacgtggacgacgactcatttggcccattgctggaggcaaaattgccggtgcgagtgctcacggaattgcggatcagagaaagcatgatgggatcgaaatggtcagtgcgcgagttcaggagagcggtggcggcgcaagtaaggtgcatgcggtcagcagagtcagcattggcagcaatgaaagacccggaagtacgcactgatcacaaaacagaacgtgatcagacgggactggaagttcaagcaggtcgggaaccgtttcaaagagcatttatggtacgggacagccaaccaacccgtgcacaatccaacggaacacgaagcgaggagcggtacgggacgaacgcccgtttcgccagacgatcgatcacacatgccaacgagaacgagagctcaggcgggaattggccccgtgtcgcatcaaacggaccaattgccacaacggagatatggaactgttcactatgcctaagaagtggacatcgaccaagcaaatgccaagcctatccgacagcacaggcacggaggaagagactcattgagcagaaacgatgcttgcgctgtatgagctccgatcacttattcaaacaatgccaacgagtaaaccggtgcaacgcatgccgaaaagacgaccatcattggcttctgtgctggaagagcatatcgggtggccaatcccgatccttcactgagcacgaacgaagggcaaagaaccatgcgacgctgatcagtgggatggatcgaccatctcacttcactgcagtacgagacgagcagaacaatcgagacgagttcgatatgaatgccggggaacaacgagcttttaccactttcggaagccgactcccggcccagcaaatgatatgcagagtgatcgcagctgcagaggaaggcgaagacgagtgccaaacaactttgttgcttgacccgggaagccatgtcgacggcgcagatacggagctaattcaacaactcggaccgcaacccatcgacaagcggccgcttacagttcaagtgttcggaggaaagaagcagcggattcggtcagcaacttatcgcctacgactcaaacggaccgacggcaaatgggagagcattgaggtgtccgaagtacctcagatctgtacgccaatcagaacagaactcatcgagtcgggagcaacacccgatagcgacccgcgaaccatcacacagacaacgcaacctcaaataatgatcggcattcgaaagttctgggattacgtggtcggatttcggaaaatcgagagtggcgcgcatgtgattgacaccgtgtttggacaagttttgtgcggcgaaggcacccaagcgagcagcggggcaactcccgcggtatcaatcctaacaaccatgccatgcggaaatatccaccaaactcgaacaaataaacgacaacaaatcggagaagtacgtcgaaattggaagcgaaaacgaaagagtcggaaaaacaattcgcgagggattgttagccgagaccgccacaactcacctgcagagtttggtcccgatcggttgggtgcgaacgaagttattacgtctcgagcggagccaattggggaaatggaccctaaccagcgaaagtggcccatcggatggatagtcgagacaaaaggagcgagcgagcataacagaaatgccataatcagaatggccaacggacgaactcggagacgaccgatcaagaaaatttggccgctgaaagaagcgcggctaaaaacgggcgaaacggacgaccgagctgacgaagcagtacatgaacgacacgaagaagaaacgcgagcagccaagactcagagcgaaacgagggatcggaacaaaccctcggcaacaaggagggaggagagaaacgaaaccaagagtaacgaagaaagtgttgaaaatcgacgacgagaaattgaagccgtaccgcctgacggaaaggcaaatcgagaaattcggagcgacaattctcgggggaagggccccaacgattcggaagagaaatacggcagcgcaacgacgacgaagaagtcagcagttttcggaaaagcagcagaagtgccttcggcggcacaatcaaaagcgggaaattcggcacgcccgcattcggctcagagacatgagaaaaaatatctgggagatagttcgatggccccaagtctcctcaatgttcctaccaagtttcagccgaattcgacgatatctgaaggaggagataggtttggcgcggacgaacctcaagcagttcaggcagacgaaatcgggggcgaatttcccgaagcaccagcggtcgaacagcaacaaaacgaactcgaacgaactcccaacaatccgggggaggaagtacgcggcgaacaaaacatccaaggagttcaagcagtacctgaagttgaacccaggaaatcggcaaggactcggagaaaccgggcaatttggtccccggaacgtcatgtaccacgaaaacgaggcgcaattcaaccaagaactgggatggcactgctgatcatgctcatcagcattgtcggaacgttcggctgccaaccatccattcgagcatcgggaatggacccgaaccttccatttcgagagggcccaagagtcccatgcaccacggagtgtgcagaacgaggagtcacaaatgtgagtgggcgggaatttaacaaaatcgagattcgttgcgatgacggatgctgggcaacaatgccaaagtcgacggatgtgaactacggactgccagcgaaaaagctgatgcatggctatccttgccatggcaaatgctggtgggggagcaatgcccctttcaacacaacgaggcgcaatgccaatcgtaaaacgggttcgaaaacccgttgctacaactcatggacacacgcttcggagcttcaactgtcaaggggcgccgcgggcaatgtcgccaattttttcattggcgacgagaaggcgggtcaatccccgcctattgcacaaatgaacgggacgggactcaatcgaagcaaaaagaatgagggatgttcttggagaagaacggggcgagtcccgattcatcaattcattcaaaattgatcattcctaatttttgccccttttccatccaatttctcatatgcatttctccatttcgtaccattcacattttgcccgttcctttgtcccatttttgccccatcgcatcccttcacaattcaaatctttctcatcggttggctcatcttcggccaactttgtgctcagatttcctttcagaatttctcactttttacatctgccaattcacattcaatttttgtgcgcccatttcccttgttcgcacttcgcttctagaattttctgtccgttttttgtctctctcacaatttgtccacgtgcatggccttttgcccgcccccttcgaaaattgtctatttaagcgccccctgccaaggggtcactctcttctcttccttccactccccttcgcttcatattcggtctgcctgtgaccaattcctccaattcccccgtcccatcgcccaattcgatcaattcgtcgcttttattcattattcgttttgctttaataaattcgtgctgaaacggcttggaggactcggaaaggagggaaaagcaccctccacactccatcacattcggcaaattctcgtgcggggccaaacggaggcgcccattcccgtcttgacccctccctttcccgacagcgccctcgtcgttctcccccaattctcccgatcccagttcctttccctttggcattggagaatccgggagttggcccggagcgtcagcgaatttcaagcagttcagactcccgcagccggagtctcgcggatcggtgtcagtctcccgccagccggagcagccgtagggacggggcgaattcccgtcgtcgacgaaaccaagcagggcagagaaggaaggaagagccgagcggtgccaaaccgtccaccgaagggcaggcccgttcgtcgccgctaatcccaccagccggagaagcgcgcatcgccggagtcagtctcccgccagccggagcatccacaggaggagacgggagtcgaaacccgtgctcatcaagttgagagcgaacgtcacgaagttcgagcagttcagattcccgcagccggagtctcgcggttcggtctcagtctcccgccagccggagcatccgccgcaggaaacgggagtcaaaacccgtttcatcgagtcaagagcgaagagcaactcccgcccgttcggagcagctcaaagggtcggacaagcccccttcacaaccaatcttgtcgagcaactcccgcccgttcggagctgctcaaaggggtccgacaagcccttcaccaaaatcttgtcggtggtgccgttaagcaagcagcgatttgctgcacaattctctcaagcaccaatccaaatttgtcacccctcccccctcccattctcgtccccctttggcgctgatcggatcggtcagcagcatcagacccatcagaacgaacggcaaaaaagggtgcgcttccctttacgacaagcgaacggagtgagcaggaggaaaaagggacgagagcggtga

SEQ ID NO: 74724 - DNA, 765 bp, Heterodera glycines
  Genomic contig location: Contig_ID=SeqID_11339; Location=1245..2009; Strand=-
  SCN-specific regions: Sequence locations=1-14,36-118,141-288,318 -349,373-667,690-765
atgatgcgaatgtatgaaagaatggtctttggtaagtgttttgtacacaaaaatcagcaaataaatcaattacttctcttatccctcacctacacatttgaattcattcacatgtacctgtttttaagcacttttaaaaattttaatgaggacccgacttttgaggacccgacatttgaggatttgacatttgaggacccgacatttgcggatattcccgacatttgaggacccgacttttgaggacccgacatttgaggatatacacaatttcaaaaaaaatgaatgaaaattttatttatatcattataaaaaaagagaaaaagctattcccgagggccggggaagcaaaaaataaattgtaccaaatgctggtaatccctaaagtttcatattcaaaaacaatttaagattaactacttcattaaatagtacttgtgttttggtaattcatgaagatccccttttttctattaacatgtggaatcattgttaggaccacaagtcaaaacaagaatgaatttataatactttttaatatcagagtcattaatgattgttctgaagaaaggagagcggattgaatgagttgaaccaactcaggggatagtattcgagaaagaaaaaaacataaagagacaagatttgtttttagaacagagcccggaattttaaatcatatttttctatgcgttattatggcgagagaagcccaaaatattttctcagaacatttttatttagggctacttataaaaaaataaa

SEQ ID NO: 74725 - DNA, 152 bp, Heterodera glycines
  Genomic contig location: Contig_ID=SeqID_11340; Location=1879..2030; Strand=+
  SCN-specific regions: Sequence locations=1-152
atgagcaactctttctttgtaattttgcccagcaatacgccgggctttgtcggaaataaaacgaataaattcaaagtgcacttgccaaagaaattagtgtttgatgggcccgggtggatggtggacatgtctggcataatatatcccaacag

SEQ ID NO: 74726 - DNA, 2323 bp, Heterodera glycines
  Genomic contig location: Contig_ID=SeqID_11341; Location=317..2639; Strand=+
  SCN-specific regions: Sequence locations=1-35,58-535,557-1009,1032 -1146,1168-1327,1350-1376,1409-1434,1456-1891,1913-2232,2254 -2261,2283-2294,2318-2323
caagataaattagttatgccgttgaccacactttctggccacccggtgcgcatcatttacggcaccgcatggaagaaggagcgcaccgcggagttggtacgcagcgcaataaaagcaggcttccgtgccattgacacggcctgccaacccaagcattatgacgaggtgtgaacagaaacatattcattgcggcactaacttggtcaaaaataaaattttttttttgtggcataagaaattttgagggttgggcacttccatgtatggtccataaatagttagtattcattatatccatttaacgcaataatccccctgaaaaaaaattatgaagtgagtaatccgaagacctttttttgctcttcaggccaaaatttccaaaaaaaaaagtttctccggtgtaattttaaaaaaatttcagccgagcaaaaaaatcagaactttgtagccgtttttcaatgtaaattttgccatttttgggtcaaattttcaaaaaaaaaggtaaaatgtggttccgttagtgctattaggagccgctgggaaaattctggaaagttgaatttttttttgactaaaaaagcgtataacaaacagaaaaatgtctaattccaattaatgaccctatactagtagctttttttgcaaaagttgcgcaaattggaacatgaattagcgctttttaatggaaaaattttgaacacttccacccaattttttaaaaatctatcattacaattaaacggtgtttggctttaaaaatttacacaaaatttgcaataaaaattttttttttttcataggccctagttggcgtgacattggagcagttgctgcgcgaaaaattcatcagccgagaggatatttttgtgcaaacaaaattcacgtcgttggacggccaggacccggcacgggtgccctacgaccgaactgcgtctttgcctgatcaggtgctgcagcaaatggcgtattcagggggggagggaaggacagtggatagcccccgaaatcgaaaaatggaaaattttgaaaaattaaccggttttcttagccgtggtcccactaaaagtggccattcttagggccatcatttagaaaaaaaaggtttttttcccaaggtcgtggcacccatcatcaaccctttcaataaataataataataataataatgaaaaactgtggcgaaaaagaatataaagattttggaagagtaaaaaaaagggtacgggaggcccggaaaaatccactgcccttactcgtaaattttttcaaaaaaacgtcatatctcttttgtcaacttagtatcattttaaagcacttaatgttctctatatatatacatgcaaaataaagaaattttttaccaagttccgtaaaagttattataaaaatagtaattaaaaaaatatttcttttcgtccctaacctttttcattgctcaaatgttttgaaattttgcaaggaaatagaaaaccataagggctattgaatgatcccaagaatgtttaatttggtcgacaagccttgccttgagtaaaatcaaaaactttaaaattttgcacattttaatgcggaaatttttggtgtagataaaacagtcaatggaacgcagtttggcgaatttgcgcctcgattttgttgactctttggtgctgcatgggccaatgcggtaaattttttaaattgaaaaaatggaaaattgtgccaatttactcaaaataaagattttgtttaaattagaaaaatttccgacggtttctccgtatgagcaattttatttgaccctcaaaatggtcacattttaaggagttattggatgcccaaaatttaaaaaaaaacttgaggcctttttttgggcacactatgttcctctccccctcaaattttattcataggaatttttaaaaaatttaaagcgtttatcgaattggtaataaaagttttttacaaatctttttaaaatttcaatataaattttactgatttttttgggcagtacacttgacgaaaaccggttggtgtggcgcacctttgaacaactgcacggtgagggcaaaaccaagcgcattggcctgtccaactgttacgacttgcatttgctgcgcgcgctgtacgaggccgccaccgtgcggcccgccgtgttacagaaccgcttctacgcgcagtctgaccatgaccgggcggtgcgcgcgttctgcaagcagaacggcattgtgtaccagtccttttggacattggtgtgtttgtgtggggtttcacgttacgcaccacccctcccctcgtattgccctcccagaattttttaaaaatttacaaagtaaattta

SEQ ID NO: 74727 - DNA, 423 bp, Heterodera glycines
  Genomic contig location: Contig_ID=SeqID_11343; Location=400..822; Strand=-
  SCN-specific regions: Sequence locations=1-423
atggaaaaaattgaatttttagaaaattggagatgcaaatgttcggcaattcttcgaattgtcacgcaaaagaagggagtgttcgatttcagcagagaattcgaagaccacgagtttgacagtaaatgctcatggcgtggattcacttatttcatcgctttttcggtaagagaatggcaattggacatcctgttaattggcccattatgaaaccatttaggaattgatggacccgagcaaaggcttttacaacagagaagaggacaaagtgacactggccattgacgtcactgtgaaagaagcaaaaacggacaattcgtaaatattgtgggcaatgtttaattgtttagcattttatgttcaattttgacattttttgttgttacaaaaacatttggatttatttatttattctgcaataaa

SEQ ID NO: 74728 - DNA, 874 bp, Heterodera glycines
  Genomic contig location: Contig_ID=SeqID_11344; Location=186..1059; Strand=-
  SCN-specific regions: Sequence locations=1-323,345-403,425-489,525 -791,813-874
atgtccctggcctggtcggtccgtctttgcaaattccaatttcaaaactgcgcaatgtttttttggcttatgttcaggctcgccttttcaattttgaggtgaaaaaggcaattttaaatattgtataatttaacaaatactgaagagaatttattaattctttttgaaaatgatatttaattggttgactataaactcattctttccaatgtgttggtctttttctttgaaattttgtggaacatcgcaaaagcgaattcttgaaatttaggattttaggacttttttccatttctggtacaaaaatatttttattttaggactttgctaactgttgtttgctttacatcgatgataatgcggaaattttgatcaaatcggacgcatttttgcggattaaccaaaaaacattatgtgaaattttggagcgtgatcaattgcaaatcaatggagaaatttcaatttggaaagcagtaaattttatggccgatttaaattaattaaattgtttttcaaataattttcggcacttcgttgggctgacgagaaatgccgtcaacatgacattgagtgctcctctgcaaatcgtcgtgccgtcctcggcccggcactttttaaaattcgttttccgctcatctcaaaggaaaagttttacgaggatattggtacatctcacaatccttttttttgtaaatgaaataattaatctttttacagttccatacggcgttttaacaatgcaagaaatggacagtatttctcatttccttccgaattttcgtggcattttcggtgggcttttgttcccacttcagtttccgagccaaaagcgaatttcatatccgaaaaaagcgacgatttggatggaaattga

SEQ ID NO: 74729 - DNA, 466 bp, Heterodera glycines
  Genomic contig location: Contig_ID=SeqID_11345; Location=1520..1985; Strand=+
  SCN-specific regions: Sequence locations=1-424,447-466
atgcatatttacgtatgcgttctttatttcgggttattaaatcaaaatcttctaggatttggattactttgtacaaaacttatgttagaccgttattggaatatgctcctgaggtttggaatccatctcttctaaaaaatatttaaaaaattgaaaaatgtcaaaaatacttcaccaaaagagttcttttcaaatgcagccttccacccattccataccaacaaagattagattaccttcaactgccaacacttgaaagcaggcgaaagctttctgatctgttcatggctcataaaataatttatggccgaacagatcgaatccctttgaaatattcaaaccttctaaacgctttaacatgcccttttatagacttaactcgaaatataaattaggcaaaaaatttataccttttgcggggcgggtaacaaaaatttggaaccaactcgataaaaagcttattgaa

SEQ ID NO: 74730 - DNA, 843 bp, Heterodera glycines
  Genomic contig location: Contig_ID=SeqID_11346; Location=1880..2722; Strand=-
  SCN-specific regions: Sequence locations=1-332,354-372,394-472,507 -529,600-655,678-758,801-822
atggagacaaaaatttttggcgaaaaacgagaatgtaagtaaaatacatcccctaattcgtgatttcaaaaaacgaaatatacaccccctaaaatcgaatttatgtgatttattactcgattttaacattactttctataattatagcatatctgttgaattagtgagttaaaatatgaatgattattatttaagtagttttatataatatatgaattcgctcaatgataaaaatgaagttaaatttcaatgataaaaatgaagttgttactctcgctatttgatttcctcaattttcgttggtcattcgctaaatattgcttaatttttaggaaaaataataaatttctaaatcgtagcgtaaatattttcaatattttattcttcatgttataatattgatgtattttagaatgatttttccaattagatttatgtaaattatgaaattttataaatccaatcactgatgattatttaaattgtttaaaaaataattaatttttgcctctaattaattttcttatggtattaattaatatttcaatttgaaaataaacatttgtttaatgttcaatagtttattaatataatattttcaagtaattagctctttttctgctcatttcctcccattcctcttcatgtcagtgaattcttttcaatttcttttcaatagtatgataatatgatttttcagtcctttggccataaatttttaaattatcattattccgtataaaagttgcaaatttgtcaatttaaatataaatttgatattcaaataatcatttttaaatgcctgattttattcttttaaaattggtttttgttttaaataaa

SEQ ID NO: 74731 - DNA, 1987 bp, Heterodera glycines
  Genomic contig location: Contig_ID=SeqID_11347; Location=715..2701; Strand=+
  SCN-specific regions: Sequence locations=1-204,227-590,612-1262,1284 -1354,1392-1987
atgccgaaaagtgggggcaatgccaatattggcggcggtgccgccccaacaccgattccatcgcccaaaaatcagaagcaaaaacagcaaaagttggtcaaagtttacgaaagatggaagttttttgagggtttgataccaatgacattcgttttttgggtcagatttttgaattcaaaaattcgaattttgtttaattttaagagctttgtggtcaatgtttcataattcttcgttaaattctttttttattaaatatagacaaccttcaaaagctggacaaaaaaatgcaccaaaagctgatcagaagaaagtggcaccgaaaaatcagcaaaatgggaagccgaaaagtgaccaaaacggtgggccgtcgccgatgtccaaaaaagaaaagaagaagcaacagaaacgtgagaaaaaggagaagatcaaacagaaacatcagcagcagaaacaaacggttgacaaaaggaattgtaaattcatcataataatattgtttatttagggtcaaccgaatgcggaaaatttgaagaaaaacggtatagaaaagttggaggagggggaatttgtaactttttgaattttagaaaagaaaaatcacatgaaatttgcgcgagagtcggcggagcgactggaagaagcggtcaaaatgatacaggcgagaaaggagggcagtgaaaaggcgacgggggaagaaaacgtcaaaaaggacaaagacgcggtgtacaacatggtaaaaaatggggttggacattgcatataccacctatctatttgtctaattgtacagtttatcaagtccaccataaaaggggggaagtccatacaatcggaaccgactttttccgctcacgccaaaactttttcgattacccctataataagtttaaaatatcatctatatagagtaaactttaatgttttggggccctgatttgaaattaaaaaaacagcataaaaacaacgaaaagacataaaaaatgttcgcacaaagttcaattgatttggaatggttaatttgttttaaacagcccaataaacgtaattttatgctataaatagtagtgaacagttccaaatttaacttctttgtcatcttcatttcctttttaacagtttaaatgctattttcccctttttaggtggcttcttccctggaaactttgctgcccgtccgcttcgtttttggccgacttcgctcctccgctcggctggttgccaagcagcacagcagcaacattgtgcaggcagccacactgttggagccaaagaagttcaagcagttcgtccagctgttggacagcagcaatgtcgccaaaaagggtggtgttgccgaagcgacggaggacgacgaagaaaaagcagagcgaaaggaggcgggggaggaggacgaacaacgcgttttggcactgtgagttgtgtaaattgttgcgaaatacaacgaatgatataaatgccaattgggagcaaaaaagaaaaatgttggaaaatagtcgagcgactgtttaagaaattgggcctatttgaattcgacttatcttattgttagacatgacgtgtcgtataacgatttatcagttcgaggtctcattctcgatatgcaaacaagccgagaaattttgattttgaactaaaaacggtttggtatcaaccgataaatctaccatgtatgacacatcatttttgagatataaactgccccggacgaccaattgcacccacatatatttgaatctaaaatttagtcatttttgggccataatcataaaaattctgctcaatgatcaattgataattagtgtaacattgccatttctaaaatttgcatgttcattgtcacagtgccctttgtgtgctctccgctgcgatgtgtttgctgggcaatgcgttgcccgacgacgaggacaccgcccaacgacgtgaggaatatctgaacgagtcgacggaactgcgcaaaatggccaaggcaaacattcattggtga

SEQ ID NO: 74732 - DNA, 849 bp, Heterodera glycines
  Genomic contig location: Contig_ID=SeqID_11348; Location=1317..2165; Strand=+
  SCN-specific regions: Sequence locations=1-20,51-327,382-594,650 -730,838-849
atgaattatgtcttggtatgtaatattaaaattttaaataaaaattttttcattttacagacattttttgctgaaaaaattttgaattttccgatggaaaatccaagccaaatcgatctgtctccgtttttgcttttctttaattattcgccctttctccccgccggcgtcgtctcacaacagtggacaaataaatgcatttttcccattcacattttatctatcgtcatcctccgtccgacctctgcagtgactgtgctgggccaaacagcgctaaggctaacatacccaaaaataaaatgcccacaataaaatgactcatcgatgtaaaaaataattagattttaattttaaatgtatatttttttaatgttttttaatcgacccataactaattgtttattgaaaaagtaattagtagggctgcttaagagtcgaaatttccgagactcgagatcaagacccaacccccgccccaaaaaaaaggccgagaaatttcagtacaagttttttttttgagaatttttagaatgtatataaatattttcccaacaaaacattttttccaccttttcttttattatttttgtgggcaaataattaaataattatcatcattaaatatttcaaaattcataaaaatttaaaaggcctatgctcggcctaacagctaagaccaatccaaagcacccaaaaaaatataaaatattcacaacaaaatgattcatcgatttttaattttaaattaattatttttgaaaatacaagaaaaattttttttttattattattattattattattttcaacttaaatatttataatcaattaaaattagaatagaaaaaa

SEQ ID NO: 74733 - DNA, 854 bp, Heterodera glycines
  Genomic contig location: Contig_ID=SeqID_11348; Location=2433..3286; Strand=+
  SCN-specific regions: Sequence locations=1-500,523-542,603-792,817-854
atgctgcggaatattggcattttgtcattgttggcatttttcttcctctgtggcacaattaatggacaacaaccgccgctggccaatgggttggagccgactcgacaacgaattcgcaacactctcggcggtttctactcgggcaatgtgacactgtacttccgtaactcgccgtacaggtgccatgaaaaaaatgggaaatttattcaaaaaagggcggggcaggggaaataggtaaattggacacaaaatgtaaaattcgggtcgcaggcgagtcgtgatcccacccaaatcccgatcccgaacaatccctaagattttgaaaaaacgatcgggagcgatcccgagtcgtggtcccattcaaattccgataccgaacaatccctaagattttggaaaaacgatcgggagggatcccgagtcgtggtcccattcaaatcccgatcctgaccaatcccgaggcttttatttcggaatcccgccggatcatcgggatttgcttaaaattaaaatttaaattttgtcgcccaggcggtgccgatgggcgccgccggggaaagaaaattttgtaaaattttaactaaattattctgaaatttattgaaaattttttctttctagagttgagcgtgaattaattgtcgaatcgggcgcaacaatcacaattgagacgggcgtacaaatgtattttgacacgggcgttggcatgaaaggtgggtgtaatgtgacaattggcatttttgatcggcatttttaaaaatgccttaacctggattctatgttgtatgtggacctggaattcctggacaaaaatccagcaaattccaggtccaggcttgtcatggcctggataa

SEQ ID NO: 74734 - DNA, 2126 bp, Heterodera glycines
  Genomic contig location: Contig_ID=SeqID_11349; Location=67..2192; Strand=+
  SCN-specific regions: Sequence locations=1-472,512-522,544-722,747 -890,942-954,981-1265,1374-1616,1669-1690,1712-1930,1985-2126
aaaatgctgcggaatattggcattttgtcattgttggcatttttcttcctctgtggcacaattaatggacaacaaccgccgctggccaatgggttggagccgactcgacaacgaattcgcaacactctcggcggtttctactcgggcaatgtgacactgtacttccgtaactctccgtacaggtgccatgaaaaaaatgggaaatttattcaaaaaagggcggggcaggggaaataggtaaattggacacaaaatgtaaaattcgggtcgcaggcgagtcgtgatcccacccaaatcccgatcccgaacaatccctaagattttggaaaaacgatcgggagggatcccgagtcgtggtcccattcaaatcccgatcctgaccaatcccgtggcttttatttcggaatcccgctggatcatcgggatttgcttaaaattaaaatttaaatgttgtcgcccaggcggtgccgatgggcgccgccggggaaagaaaattttgtaaaattttaactaaaatattctgaaatttatagaaaattttttctttctagagttgagcgtgaattaattgtcgaatcgggcgcaacaatcacaattgagacgggcgtacaaatgtattttgacacgggcgttggcatgaaaggtgggtgtaatgtgacaatcggcatttttgatcggcatttttaaaaatgccttaacctggattctatgttgtatgtggacctggaattcctggacaaaaatccagcaaattccaggtccaggcttgtcatggcgtggataacaatgcctggacctggatttttttgaattttcttttaataagcaaacaaatgtttaaaaaaaagtcaatttattgtcttaggaaaatcaaaatgtttctctaattgatataataatattttaaaaatatttatcattttttgataatttgaaataaagcatgatcactgaaaaaattctaaaaatattttggaaatcaagtttttcgtgcctaacctggacatggatttcctgggcaaaattctaggaaaacccatgtccttgtttccaggtcccgggccaagtttctaattggcataatttgtgcacgatttgcgtgtccatcaatttcagtctttggcactctgcaagcagttggcaacgaatttgcgcacattcaaatgctaccgtaccaagagcagctggtgtacgatagcaaattgccagaattacggctaattgacggtcccaccgtcaggcaaggccgtctgcaggcaaatttctttaatattttttttcaaaaaataatttacgaaatttaataaaagttcgttttcaattaaaaatgtttttttttataaaaaaaaacattgaattaaaaataaaaaatacgaggtgtacattttaaagccatttaaaataattgtctaattgagctgaaattttacaaaaaaaagacttttgctcaaaaaataaaaaaagcgtatttttcagaattattttcattgtcatcaagatttgatcaatgttggaattttttgaaattaactatgaatgttacagtctaaaaaactaataaaaaaatttttgtttaccactaaggttgttaaatgattttttcatctttttgttccaaaaaattaaaaattgtaattaagtaacaaaaaaaaattaaatttttaatttcgtaacgcctttttatcatttaaaattaatttgaaaaatgcgtaatacattttttgaaatttttttttttgattagattcgctttcgggaccgttggcgttccgtctgtacccaaatgacaaattggaccagtattgacacgggcaccgcgtgccgtaccatgggctatgatgacggcgcattttggcgcttttttcagcgcaacaacgacacttacccatttgtaatgccggcgcccaaatgtacacaacgccaaagtgggaaaattaaaaaattttaatgccaaatttaattttatttattttttgaaatttaagactctctgtggaactgtccaggctttgaggacaaagaacagattccgttgtccgaaaatttgtgccaaggtgaggacgacattggcatttattgttggggaaggccaactttcactggatgggctcgccattggaaaggta

SEQ ID NO: 74735 - DNA, 307 bp, Heterodera glycines
  Genomic contig location: Contig_ID=SeqID_11349; Location=919..1225; Strand=-
  SCN-specific regions: Sequence locations=1-179,206-218,270-307
atgtgcgcaaattcgttgccaactgcttgcagagtgccaaagactgaaattgatggacacgcaaatcgtgcacaaattatgccaattagaaacttggcccgggacctggaaacaaggacatgggttttcctagaattttgcccaggaaatccatgtccaggttaggcacgaaaaacttgatttccaaaatatttttagaattttttcagtgatcatgctttatttcaaattatcaaaaaatgataaatatttttaaaatattattatatcaattagagaaacattttgattttcctaagacaataaa

SEQ ID NO: 74736 - DNA, 706 bp, Heterodera glycines
  Genomic contig location: Contig_ID=SeqID_11349; Location=2352..3057; Strand=-
  SCN-specific regions: Sequence locations=1-46,78-96,128-157,179 -211,251-530,552-579,609-641,677-706
atggtgaaaaagcaaaaaactgatgatgaaaaaagagaaattgttgaaaaatattttaaaataaaaattaaatttatgaaaaatggaaaacattcgcagaaggaatggaaagaatttagagcaaaaattaaacaaatgtttggtgtgatttttcaggcaattgaaaaatgggcaaagaatttaggaattgaacaaaataattcaaaaggtgaattttaaataatgttttaaaaaatttttgtttttttttcaatttacagagcgaaaaatgttatcaattgctgaaaaaatagaaacgattaaacaatattatcaaatcaaaaaacaaaatccaaaattcaaagaatacgaaattgccgcaaaattgggaattccaatgagctcattagacaaatacaaaaccaaatatggcaatgaatccaaaaacaaattgctataatgaggacaattattattattattatcccaagaagattaaatgaaaaattacaatgaaaaaaatttgaaaatttcaatttttttcttgagaatttgtttaaatttgagtttgtgataaaagtttaatctctttttttcatctgtttacaaaaatattttaatcattaaaagcgtcgaatggtctaatgttttaggtgattaagtttaaaattatattaaatgttcatattattttaatcttgaaaaattggcaaaatatgtaaataaa

SEQ ID NO: 74737 - DNA, 484 bp, Heterodera glycines
  Genomic contig location: Contig_ID=SeqID_11352; Location=313..796; Strand=+
  SCN-specific regions: Sequence locations=1-259,287-484
atgacgcagaaaatgcgcaatttcgtcatgccaatgctccgaatgaatcaaattgccgtcgttgacccattcaccaaagagcaactgctgcttcctgtgaatgtactacaattttcacacaattttgcaattgtactgatttcgttggggacttttttgacaattatttccattggattggccgcgtttttcactgtgaaacgaaatggggtaaatttaaaaaacaaaggatgcttaaattaaaattaatatttcagaagtatgtaaagtgaaaaacacaccaaaagcgaaacgggacgaattattatattatgatttgtatacaattgatttgcccagtttttagcttgctcattttggctgtttatttgcatggcttatttataaatgaacccaaaactctgcctggcaaaaagccattatgataaaaatatatgaaatccccctctcctctcctttgctgttttaaaacggcaacatttta

SEQ ID NO: 74738 - DNA, 316 bp, Heterodera glycines
  Genomic contig location: Contig_ID=SeqID_11353; Location=767..1082; Strand=-
  SCN-specific regions: Sequence locations=1-202,224-288,310-316
ttgagagtgtgacaaatggcggacggacggatgggccaaattgagaaagtgttcgtgcaattttgagaattttattaattttgaagaaatgcttatttatcgtcttcatttttgcattctcccagaaggaaagaatcccttttaatttatattattactcattgtcagttcgcttttctgttcacaatcggttccatccttcatttattatattatcattattcagggttactattacggttcactcattctgccttttctgctgatactctttgttcgtttaacatatgccttatgttgccattttttatgtttg

SEQ ID NO: 74739 - DNA, 1364 bp, Heterodera glycines
  Genomic contig location: Contig_ID=SeqID_11355; Location=757..2120; Strand=+
  SCN-specific regions: Sequence locations=1-235,277-383,410-672,700 -880,902-919,949-1364
gaatttgaatagcatttgctattggctgatcggtgccaactcggcatgcattgccatctattcgtttacttattttgtccaatttggcattgtgtttttctctccgtctggcattcctctctggctttgttgtctgctcgtctctgtcccacttttcttcttatgctgccaatacgtgctttttcctctgatcgctttggaccgattgatcggcgccgttttcccattaaagttgaaattaaaatttaaaagtaaattttaaaactattaatttaagacaaatgggctttctgtataagcgccgttacatgctttttgcattcttcgcttcaacttcgtttggcactgtcattgtggcattagcagtaaacgagtccattgtcaatttttcagagaagtaaattttaaaaactaaaatcaaatgtgtcccagcccattaattggatgcttgctttacatgattcgtcataaactatcgtattttctctaattatatgcccgtcattaatcttacccgtctccaattatctccccccccctttctgaggaggttaaaaaataatataccctagcatataatagagaaaataccgtaaatgaagttacggactaatagagaaaacataaagctgaaggtttaattttggctatttatgcggaaaatgaatgacgtatttttaattttttttaaataaaaatggaattaatccgactaatcatggctcatctgctggataatgaattcgctaattctcatattttttagattggttctttgcatgacttatgatccggtcccagcatattttgccaatttcagttggatgctcaacctgtgttccattgttctttatttggcactttggtttcgtgtgaaaatgatgtcctcatctgcttcaggaggcattattttaattggaaaattaataattaatttttgaatttttagcaatgcgctctaatgagacaattaatcggaaagttcttttttcactgatggccatttttttggttgaaacgttcggctgggtgttcaatttatctgttagacttttgctggttcaattcgggaccactgaaagcacaaaatggttggtattgagctatgccggttatctgacgcaattttcattggcactgaatgggccaattctttacgcgacgaggtaaatatttcaaaatagcctttttgtaattaatttaaattacttaaattatctctccattttagcactgaataccgtaccgcctttcgtaaagtgtttggatttggtcaagtcaatttgcctgcatttaccattcaagtggtcccaatgaatagaagcggaaaaactattggccaaagcggaaaaactattgcctaa

SEQ ID NO: 74740 - DNA, 211 bp, Heterodera glycines
  Genomic contig location: Contig_ID=SeqID_11356; Location=228..438; Strand=+
  SCN-specific regions: Sequence locations=1-102,124-211
aaattttacccaaaacaattaagaaacgaattaaaaatggatattttgaacaaattagttgggtcggtccgggtctttcgttctggcccggaaatccgttccgtacagcggaggccgaacagaccagtgcagtgcctaatttggtgtcaattgttgaacgctccaatttttatgcgttcagataacttttgccatgccaaaattggtccca

SEQ ID NO: 74741 - DNA, 498 bp, Heterodera glycines
  Genomic contig location: Contig_ID=SeqID_11356; Location=930..1427; Strand=+
  SCN-specific regions: Sequence locations=1-18,41-112,150-368,397 -416,494-498
atgtccatccaaaataattttcttctttttgttgtctctgcgctgctgtttttcatcggcatggtttgtgttgttgatgcgcatcatcaccaccattggggtaacaaattgctattattaattaaaataataataatattatttttaaacgttaccctttctttggaaaaaaataataattcccaaaaacacaaaaaatcgcaaaaactttgtacaggaaaattgatgtttagaaatattcgggactcagttcgggtatctatctgtcccgtgatttagcattttatttgaaaaaagattaattaaatctgataaatttaggctatggagggactcaattcgaatatctatctatctcttgatttagcattttattttaaaaaagattaattaaatccgataaaatttaggctatggaggctatggctacggcggatggggcggaggatggggcggcggatggggcgggggatgttgcggctggggctggggcaaaaa

SEQ ID NO: 74742 - DNA, 456 bp, Heterodera glycines
  Genomic contig location: Contig_ID=SeqID_11356; Location=2376..2831; Strand=-
  SCN-specific regions: Sequence locations=1-153,175-230,260-392,414-456
atgacaatgctcaaaacagtgttggtaattttgttgccaattttcgatcaccgaaccccgaaaataatccaatggctccgatgttttggtgagtgacactttctcaagcaaatgcttctcgcaaaattctttgtccctttgagaagtgaaaaagggcatcaaatggtcccacaaaatgagccgataagacgcgggcggatcaatctgagagaaaagggcacaaagccaagataaatttaaataaaaaatgaaaaattttcaacaattttacggtgtgtgggttcgcaaaataaaaatattttctccgataaatgttttcttaataaaccaaaatttaccaaactttggcatcattaaaaaccgaatgaaattttgcagtgcaaggccccctcgcttttgggtactttttaagcgaaacatcggaacacaattttatgtgattttaaattaaataaa

SEQ ID NO: 74743 - DNA, 2288 bp, Heterodera glycines
  Genomic contig location: Contig_ID=SeqID_11358; Location=593..2880; Strand=-
  SCN-specific regions: Sequence locations=1-1186,1208-1401,1469 -1487,1515-1521,1550-1636,1664-2288
  Gene Ontology: Mol. function=extracellular matrix structural constituent; Cellular component=extracellular; Biological process =cell proliferation
agaaaattgtggacaggattaaccgctccccgtcacgtgcccacggaatgcgtccgattgatgtgggctttttcaatgctcagagggtgtggaagctattatatgatggacacggtccgccacaaaaacgacgaccgccacgcttccgcaaagacgattttgtgcgcatgagcagagagaagggacagtttgagaagggctatttgccaaattatggcgacgaaatattggaggttgacgaggtgctgaaagcggtacgccccattcggtataagctacgggatgagcacggagagaaatttaagggcagcttctatgagcaggacctggcgcgtgtaagaaaggatgcagagacaagctatcgtattgaaaaggtgtacagaaagagaaagagggcggatgggtccactgagatgcttgtcaagttcataggataccccgagcgcgaatgtgttgataaaagcacccatcgcccgtattgtattccattcatatttttatgtgaaataaaaatgtcatcgaacagcttctttgtgtttttgcctagcaatgtgacggattacccggacaatcagcctaataaatttcgggtccggctcccaaagccgttgcattttaacggctcttgggtttgtgggctgcatagcataacctacccatactcatggtcaaccattggcacattggatgcacaatggattgacattcacttcacacagcgtagcacaatggatgaggacagaccgagagtgatccgggtgccggtgcccaagatatcacataacagggttgagcagctgaaagacttcattaccgctacactgaggaaccatatcggtgcaaaaatgttgccactccctcatgaagaggaggccgatcggaatcggacaaagccgctgggctctccaccgccacggaagagagacagaagagatgtgaacaacaccactcctccccaatcccccgtgctgtttgatgagcacggaaagcgactcgggtctcccccgttgtacgatccgaatgctggcgaagagcaacacatgagcgatgatgatgatgacatgcgaacacaaaaagggacactaattattgatccaaaaagcccgtctcctatagcgacacccccagttccggcggttaaaccgctaacaacaacaacaccgactcctccagccgtaaaaccggtaacaacaacaacaacaccggccccccagtcgtccgcaaagccatcagcacaacagcaaaagccaacacctgtcccgccaaaaccatctgcccctcagacgtcagaaccaaaaatagcgacgacaacgacacctggccctccaaaaacagcaataacaaaacctacaacgctaccgccaccgccatctcctccaacagttcctctacagcgaaagccaacaacaacaacccctcaaacaccaacaccaacagcaacaccgactcccacacaaccaataacaaccgtccatacaccgaaaaatacaaaaacaacaacaacaacaacaacaccgatccctcaaacaacaacaaaaaccacaacccaggtctctccaacgccaaaaataccatcgcctaagccgcctgctgttaaacttcctcctcccacttctacaacacatccgcctcagccagagccaacaacaacaacaactgctcctaccaaaactttcacttcctctcctacgacgggggctgttattggattaccttcaaaagaaaaacaaattccgaccgtcgacgaacctgtctcggctgcgttaactctagaagagttagatttaccagaaaacagcttcatagttgaaatagactcgctccaatttgtgcccaactcggtgtcaatccaatatcgcgatgatgtggaacggttcaaagtggtgttcaagaatgatattatcagccacttgtccttctcgcctcagttgggctatgttcttggcttcgaaaaccctaagcatgttatgtcaaatgaactgtcaaagtatccggttgatttacggggcggcatctcaagctttgcggtctactcaaaaggattgaccgaaaatatgataatcggcaatacgctgagctcgttgctcagggttgtgtctatcagtggtgccattcctggggattataatgagaagatttatgactcgccaatatttgcgcgagtactgccacgggagatcaatgagattgatattgagctgcgcacaatggacaaaggccgtctggtgccattcgcgtatgggacgacgatggtcgtgttgatatttaagaaagtgataaatttctga

SEQ ID NO: 74744 - DNA, 868 bp, Heterodera glycines
  Genomic contig location: Contig_ID=SeqID_1598; Location=313..1180; Strand=+
  SCN-specific regions: Sequence locations=1-169,197-208,241-314,358 -411,476-504,527-868
atgtacattcccgagagcagttcacgcggtgaggacctcgcttttgctacaattgcttgcaattcgatgcttataacagcgccagcttcaacattttcatggtaaaatgatggttttattgaattacatcatctcattaatcctaaacattcttttggccatctgctatatgtcaaaacattttataaaattaaatgtttgagcaaacaatttttttaaaattattttacatatttttttggaaaattttttgaattttggttggcaaaaatgagaatgtttaggtccattttaacgaatagctgatgcccttttatattgcatttatttgttattaaaatttctgtttttaatttattaccgattttggcatatgtattaagaatttaaaaaattttgcttggcgtactgtatttttattattttttcaagattttttttaaaatttaaatgtaaaaaaaatttagtaaaattaccaacaaaaaaaatttatacaaaacagctataaaattaacaaaatatttaaggtaagtttttttggttttaaggtggatggcctatttgatgccggacaattcgccaatttattatagtgcccacttggaaaagacatatcgtggcaaggacaactttctgaaggaatggatacccttacgactgatcgatggcaaaaagataattcgtgacggttgatccaaatccaaaaattctaacctattttttaattaagaaaaaaaagtgaaattttgattttcatattgttacattatttctgaaaaactatattatattttcatttcatttttttgtgacttctatgttttttacttagggtgtaacataatttttgatacccaaatttttttta

SEQ ID NO: 74745 - DNA, 555 bp, Heterodera glycines
  misc_feature (541)..(541): n is a, c, g, or t
  Genomic contig location: Contig_ID=SeqID_1599; Location=1..555; Strand=-
  SCN-specific regions: Sequence locations=1-191,213-326,348-555
atgaagaaaaatgaaaaaaaagttttttacataaataactttatgaaaaaggcttataaaagaactgaattgacatattttaataaattacaaaatgcctccatcttatattttatttttttagatttattccgccattttttgatgaaaatcaaactcattgctgtgcttgtgctactgggtaattttgaataaaaagaaaaatctatcttctaatttgtcagctaaatttgttttattgtccttgcagaggacaataataaaaaaatggttaaaaattttaaaattcatgcttttggcaaatcagaaaatagttaaaatgatactaaaaatcattaatatttatggtttttagacatatttgggcactttcataaagtcagttgtgaaagtgcaagcaatgagaataaaattacggcatatgaaccatcggagcacagtataacgccactaaaggaccacatcaacagtatcactggtcaaattgatctaagccaattcaatgctacgctagaaaatcttttgtcattccgccaaattntgtgccaacattga

SEQ ID NO: 74746 - DNA, 1565 bp, Heterodera glycines
  Genomic contig location: Contig_ID=SeqID_1599; Location=2048..3612; Strand=-
  SCN-specific regions: Sequence locations=1-215,237-374,400-679,724 -848,1002-1309,1331-1565
atggaagaaagcattggcaaagacggcacgccaaatgccactggcattcttcccaaaccaacgtttgacattctctgcatcgccataaatgcggtggaatgcgctttttgctgtccaaccgttgtattgtgctttttgttttggcgactcgtctaccaaacatcgctgttgcacaataatttgaaattcattcttgtcgcccagtccatttatgcatttctgtatgcatttgttcaaattttttcggtaatttatggcctgttttcgcccatggcactgttcttttttgtgaatgcgttccgttatttcttgctggtgtacggtaactttataggtaggtgaacgcactgtaccgtatgcttaatttaaagctgaataaattaaattttaaatataattgatactaatttacaggacatttgttgattgctgaaaggattgtggccactttctgcatcaaaaaatatgaaactgtcaaaaattggtggaccctttcgttttgtgttgtaattatcgtaagcgatttaaatgttacggtataataaatttgatcatagattttattgtctgttttgaatgcatattattactctacaacatcaatgtttgtcgcgccgaatgtttgtatttatacacaaatttttgcgacagttgcaagtttctcggaaatttttgtaagttttattaattttaaaataaacgaaaaataaaataaaaaattaagatcatcactttgctgctggctttgaataaaagaagatttaatcgcgaaaattcagcttcatttaatatggcaattaaatatcaggtcgaattataattgggaaagacaaataattatactaaggattatatttaagttcaattaaaaatttttaattaataagaaaatcattttatttttaatgactgtaatttaaataatataacatagctaaaaaatttcaaataacaattaattacttgagattttttattttttatttcttgtatttaatattcaactaaaaatctcaagaattattattcattcaatctctcgtaattatgtgataataatttttaaattggccaatttcagttagttgaaaatatccgaacaggacgacaattgagtccggcatttttgttccattttcttggcgttttgctttcattttttatgatcttagttatacgtacacaaaccatcaccgatctttatttgttgctaataattggaaaatttgctctgtttctgcagggaattaacaatttgttgattttgtttacaacaataaagtgagccattttttaaattaaagctgaataaaccattaattaattaattcttagatgccacccaattttgtgccgaaatgcgctgaaatttgtccaaaaatatatgaaatgttcaacaacaacggctgctgttgatccttcaattttggcttcttatgtgaatggaattacgcagcgacaaatccctgtcagtactaacatggataattatttccaattactgcagcggtcatgggaaatttgaacgcattttttttgtataattcttacgaattttgaataaa

SEQ ID NO: 74747 - DNA, 604 bp, Heterodera glycines
  misc_feature (603)..(603): n is a, c, g, or t
  Genomic contig location: Contig_ID=SeqID_1599; Location=4428..5031; Strand=+
  SCN-specific regions: Sequence locations=1-502,524-604
atgaaaaatctcagagtctctcatgaaaatacggtttctgatgagaaaattaatgtactgttcagaggtaccgagcccattgggtgtagtcaatcaaattaatgttttctttcagatgccatgaaaatgtgtgttgattcccacgacgaccttttatttgttgccttgaaggacggacggattgtagcgattgaccgacaaatgaagctggttggggtcaaattggaacgagtttttctattccatttttctttaggttgagaggtttggccattcaataacaaatatgggctgggatgggaaaagccgactcatcggattcgattatttgtacgacgatcagcagttgtgtttacttttggacgatgggaaagtgctgctctacgcaacaaataccaaagaggtaatgagataaaccacttcaaattttgccgttggcatttttctggtttgtttcacaaaattcgccactaattccaaatttcagcttaaatgtgcgatagaactgaaaagaaatgtcctcggctgttcctggagtcccgaccttcagctgctcatcgtcgccaccgactcgcatttgctgatggtttctcgggaattccna

SEQ ID NO: 74748 - DNA, 2228 bp, Heterodera glycines
  Genomic contig location: Contig_ID=SeqID_1601; Location=27..2254; Strand=+
  SCN-specific regions: Sequence locations=1-245,275-437,463-700,723 -1021,1047-1167,1194-1437,1459-1460,1482-1483,1505-1659,1681 -1973,1995-2228
  Gene Ontology: Mol. function=Pol II transcription elongation factor activity; Cellular component=DNA-directed RNA polymerase II, holoenzyme; Biological process=transcription from Pol II promoter
gctttcatcgaaagtattgagcagttcgccgctcaagtcaacgacgtcgagtcgctgtgcgtctttctgtcctcactgaaaacggtggacacaacgcaacaggcgatgttcgccccgttttatcccgaacgccaaccgacaaaccaacagaaacaacagccgaaggcgaacagatggacgacgtcagaaacaccgggcaaagttaacggaatttgcgaaaggatccgcaaccatttgatgagcctcggcgagggggaggaggaggcggggaggggccatttcctgcgactttaccccgtcgtcctttgctgttacgtcatggaaacgccgagccgagtgtccgccgctttggtcaatatgtgcacacaaatagcaaaagctaaaggtgagcgatgaagcaatcactaaacaaaataggggaaaattaatggtaaattcgttttaatttagaaaataaaaatggggacgaacattccgaattgattcgccaatggactcgccatttgttgaatttcctcaaggagagcgacctgtttaggcaagcactgaagacatatgacgtcgaaatcgctctaatggtcgcccaatcgaccaatcttgttagttttatgaaatgtttttgtttaattatttttttaaattcaggatccaaaggaataccttccgattttgaacgatctcaaacagaagacgccctcaacttaccaaaagtaacattttaatagacaatgatttttaactaattgaaaattaacgatgcaaatggattatcaagtgattttcccgcttttcaaccttttacagatttcacattgacatgcatttggaggattggaattcggcactcggacacattgcgactttgtcacaattgcaacagaaagatgttatcgacacaaacgatgaagacaaaagcgaagttacggagggtgaagcagtacaaaatacaccgaattatttggaggaatgccttaagctggtcagtttgtttaaactcaaattaaaataacaatcagccgacaaatatttaaataaaattaaaaaatcttcaaaacccattaatttatttgttaattaaggtccaacaacaaaaactttactcgtccgccttgaaattgttttgcgggagacccaactacaaagtttggaggggaagggggacaaatgaaaaagtaaataaaaacaaaacccaaggacattagcgcaattactgcaaaagaattggaaaagaacggccgtttaagagaggcggcgattttgcatgaaaaagcggaagatttggcgtcagcgatgagatgccatttaaatctgtcgcatttttcggaatattgtcgtttggccaaactgcacgagcaaagcgatgtgaaaacggagagcgaactgcgcaaaatgggcacgcaaatggttttcaaggacgaccatttgggagcagccgaagtgtttttgcaccttgggaaagaggtggtacattggcaaagcccaatcgaacaaattcaaattcaaaatgctttttattcaaattaattacaattaaaatgtataatatgtaaaagacaatttttcccctttcagaaaaatgttgagaagattttggagtgttacgagaaagcaaatgcgtggattaaattgagtgcttttgtgactgaaaatcaatccacgcttcatggtcagtttgattatattgtcaatacaattcagtccgattttgcatttctaaatatttgccaaaaagtttacatttaaaaaaataaccggtgagaaaataaagtgattaaggcattgtcaatcgtgcccaagtgcttatgtccactcgatgtgcgcagataattgaacaaattgacagttggcgggacaccatcacaaaacacacgaaacgattggaagtgctcagagaggaaaagcgggccaaaattgaggcgaagcaaacggcgtccggcggcgacgaccaattggacggattcagcgagtcgtccgtcacttcctcttccttctccgacagttcatccaaagagtcacgctcctttttcgagctttcatccaacgcattgaaaggaggcaaagattggtttaaactgcaaagaatggagcgtcagaaacggaagaagctgatgatcaaagagggcagtcattatgaggacggcgcacttctggtcgccctgaaggacatttatcaacgaattgacacccaacaaggtcatcacaccactcacattccctttgaaggctaa

SEQ ID NO: 74749 - DNA, 460 bp, Heterodera glycines
  Genomic contig location: Contig_ID=SeqID_1601; Location=2452..2911; Strand=+
  SCN-specific regions: Sequence locations=1-175,221-397,419-425,450-460
ttcagacgaactgctcgaacttcttcccgctttgctttccatggaccttgtcgacagggcgtgtcgtctgcagaatgaaatgctcacttttcttgaatttgttgctgaagtccatgcgcaactttggccctctcatttggaggcatttcatttgacgggtcccctcgcattggtgaaaatataacaaataaataaacaaaaatattataaaaattatattgttttttgccagcatttcgattcaaattcatgtgaaccaatgcccaggaaaattcacctgacagatgaacttatgccgccgaaactgcgctcaaagggcacagaatggaaattggaaattgtcaaataataaaaaaaaatttcctttccccagtgaattgttgacttataaaatcaaagttttactatcatcccacactcatttgttgattttgttcaattttataaatccaaattttta

SEQ ID NO: 74750 - DNA, 822 bp, Heterodera glycines
  Genomic contig location: Contig_ID=SeqID_1601; Location=4084..4905; Strand=+
  SCN-specific regions: Sequence locations=1-644,705-822
  Gene Ontology: Biological process=mesoderm development
ataatgccgaaagcgccccccccccatcttttggcgtgttttcttccgcttttcagctgtttgccggagaatgcgtactgtgtcgggaatgcgctctctccgcagtgtttgcgttgcgactttccgcccgtttgtcctttcggtgactccgtcgtcgtcaattgcactccgtccgctgcctttgtcaattgcgctggtgacggcgtcgtcccccgtgccaatgtccccgccgttgttcgccttcaagcaaagtgccgtttctgttggcaacttgaacagagagaaattgtgtgtgaggagcgaaagaactgctcgaccaacgagttgacactgcacaggaccaaatgcagggcgaaaccgaacgcaatctgtgcgggacggaggcatttcttcaaaaatgtccggtgcgtcatcgatcagcctgactgttgataatgatgatgatccttttccgcttttccattgtcagttgccattggacgagtgggcacagctggcggaaggcactttttctgtccgtcactctcggcggattcggcgtggacaggttgagaaaagtggaaaaagagtggtgaatggttgtgccaatttttcgcttaggttttatttgggccattggaaaagtgccatcggaaaactgtgagtattttttatttataaataattatgttttaaaatatttgtcgaaaataaataaaaaatttctcaatgtttgtctgatttcgaaggttctcgttcggtggtcttggcgtgtggacacttctcgacattgtgctcattgccttcggttacattcagcccgctgatgaatcgctttacatt

SEQ ID NO: 74751 - DNA, 961 bp, Heterodera glycines
  Genomic contig location: Contig_ID=SeqID_11359; Location=129..1089; Strand=-
  SCN-specific regions: Sequence locations=1-18,43-242,263-510,532 -680,703-705,727-864,891-961
atgggcaaatactgtaacacttttttaaatttatttgtttatggtaaattcaaaattagtttcctatacaatttaaatatttttacatatgatgctacaaatattttaaaagataaattcagagaatttcttaagtcgctaaataacaattggataagctaagccgaacccaaaaaaatgtaaatgtgtatgatttattattctggaaaaaaactaaaattaataattacaataaatgtaaatattattattattattattaacacttttttaagttcaacccaaaacctcactcagttcgtgaacatgaaaagtatagttctaataaaatacgaattcaataagctattcattttttcaaaattttaaagttaaataaatagcaatgtttatgtatttgttggaataataatctaattgtccagatttgcttaaatacttgacagttgcgccatatggagctgttaaatgtgctatgttgttatttgcaaaaaccatcaatatgatttgatataattattttataattttgcttaaaagcaaccaaatttttaattcttgatattattcgatagccctaaatggtagggccaaagatgctcgaaaaacaaggtttttttttgtgttcctctatctataattttttgaacttaacaaattttttgaaattttgtagactgatagagaacacttagagctatcgaatgatatcaagaattaaaaatttggttgagctaaattataaataattgttcatataatcatattgatgattttttaaataatgactccgccccgataaaatgatttccaatttttgggtccgaaactttaaaaaaaaaaacccaaatacgactattattttcgtataatatatatacattataaaaaatcaccctgcacaatacacaattttgaactaattgtaccaaatagagatggtttgactttttgtaataaa

SEQ ID NO: 74752 - DNA, 1692 bp, Heterodera glycines
  Genomic contig location: Contig_ID=SeqID_11360; Location=692..2383; Strand=+
  SCN-specific regions: Sequence locations=1-69,91-284,310-464,486 -564,588-654,677-736,758-1024,1088-1262,1300-1419,1441-1692
atggatgtcaaatttgtcattcccaaaaaccctcgtggacaagttttcccgacttatgaaaaaaaaatgcaaaacaaagttaccctcttgaatttttcgatggcactaaaccgcaaaaatgccattctttattgggttggttggcacctgatgtcactgactacccattagtaaacaattcaatgttgaaaaactcaacatatccattaaattcgtttttgtttctaggattctcatgttggtatttcaagtaccgctccgacttctttgcacaatgctcatattgttggtggtggtggaggtggttgtgtgagtggcggtgccaaaattggaaaaatcactgccgaccgacggttggggttcaccaagttaccaacggaccaactgcgtgcacatgttcaagaaattttgcacacgctcaacacggtccatcttctttattctcgttcattttaattggtcctcaaactaaaattttaatagatcgacaattttaggcctaaaatttcaattatttatcggtcggtactagcaaaaaaccgcatccgaatccatcaactctccaattttttataattttttaaaatgaagagttgatggattcggatgcggttttgcattcagtttctcataagcttgtgcattagatgggggtataaaaccaagaagttcaaaatgttaaccttgttgatcttttttttaattttgaggtgtaggcccaaaaccgaaaatatccaaaattttatttttatataaagcaaatctaaagcatttaaaatgtttcttttttttctcagttcacgcttagccaatgccatgacaaagtgtattggttttccactgttgtgttgcagcaactgcttgaccttgagctgtacaccgcgtgcagcaccgcagttgaacaatgcgtccacgggcaacagaagcgaatgcaacagcgtctgctgctgttcagcaccgaaaaacggaagttggagcaggaaaagaagcaattgaccaaccaaagggcacagttgacaaaggcaattaaaaaaaaaatttttgaagattttttatttttttaaatttttttttacataaaaatttaggaaaaaacagaattgaccaagtgcaaagcgcagctggaacagtcagtgaaaacgttggcacctttcgaggccaaatgtcaggtattaccaaccaactcaacgacaattctactttttttatgcaagaaatgattgtgctttaaaaattcagtgacaattctctccctgaaatggaaaaaaaaattaaataaaaattggttattatttttaagttgtttatcaattttacaactttcataactaatctggtcaaaaatagaaaagcatttcccttaattgtttcaaaagttgacttaaaaaatgtacaattgttttatttcgaaaaaattgttaaagagttatttggaaaaagaaaatttaggaccgaagaataataaaaaaaacttcggattttcacccacaaacaaaaaaataaatttgttttctggttacatgccttgttgttaatggaccatgacaatgaaactcggatttcagcagatataaattcccagttttcaatactcctgagaaaattcagaccatgaagcaggaggaggagaaactaatggcggacaaacaaaacatggccaaagaaagtggaggaaatgaagcggctcaatga

SEQ ID NO: 74753 - DNA, 296 bp, Heterodera glycines
  Genomic contig location: Contig_ID=SeqID_11362; Location=95..390; Strand=-
  SCN-specific regions: Sequence locations=1-296
atgcttgaaccattcggtcatttcttccaaacccgttgatccattcattctcttctctcgccttcagctgccttctcaaaaggccatttgtccgttcttttgccctgctttgacaccgctttttgctcgctaagcgcaaaaagtcagggcgatgccgtgagccgtgcaaccattggcaccaagcagcagcgccatcggcatttccgttcggtagcaatcgatggcactgacagcactgaaatgccatcggcaattgtcgcgatggaaatgttggacaatgaggtgaaagcaccggg

SEQ ID NO: 74754 - DNA, 377 bp, Heterodera glycines
  Genomic contig location: Contig_ID=SeqID_11362; Location=800..1176; Strand=-
  SCN-specific regions: Sequence locations=1-230,258-294,316-377
atggctgttaaggtgagggaagcaaggaagaaaattattgaatgccaaagtacggcattgacatacaataacaaatgccggcaccgttttgcttcccattttaggacccccacacaattgccgctgttttatttgtgccaaaatcggacggtgagtgtcgtgccgatctgcgggagattgaaaatgtttgctgtttttttagatttgcggttgcaccgaaagagttttgttgcagaatttgcactggaaagtcctgaacttcagccacaacggtcagaaaacgtgatgttcaagtcaaaaatcaagccaaacagtcggaaccgaaacacatgccaaaaacccaaagaaaattttaatggcattttacaaaaaataaa

SEQ ID NO: 74755 - DNA, 1117 bp, Heterodera glycines
  Genomic contig location: Contig_ID=SeqID_11362; Location=1826..2942; Strand=-
  SCN-specific regions: Sequence locations=1-45,192-196,312-392,414 -510,532-1013,1037-1117
  Gene Ontology: Biological process=N-linked glycosylation
atgtcatccagcgatcgtcgccgaaaattggcagaaaaaccatcgaaaacaaatcaaaaaaacagcagcaaagacaaagaatcgagaaaaatcagtgaaaaggaggacaaacggtcaaaaaaagaaaaaacgacgacagaaaaagaaaaagtggacaaaagaacgaaaaaaacggacaaaaagaaagaaaagtcaaaagaagaaggaggaggagaagaggaaaagaagaagagaagggaggagaaggagcagcaaaatgggaggaaaaggagcaaaaaggaggagcaaaaggaggcgaagaatgaggaggaacagcacatgcaggagcagcagaactacgagcagtacgaggacgacttcgagcagtacgagagcgactttgtgagtagtagtgtcttgggaagggaggagaaggatttttatgggatgaagctcaaagatttgaaagcttaagagaatattttgacatttaaaaggatgaagaagcggacgaagcggacggaaacgacgaggaagagaaggaacagaaaattggcataaatgaagcggaaaaagacggacaagagagcaggaacgacgaagaggaagcggacgattacccggtcaaaagttcacttttgctgcgaaggatcgccgagggcggcaaattgaggaccaaagaattggggaaggatgtgaggacggaagtgcgaagagaggtcaacttcgacgatgaaaggtgaactacattctcattacagaaagaatgatccaggactcagttggctgggcttggattgatcactttccttcggaaaagcatttcggagaatcggaaaggaccggaacgggattctgcaggaaaaagccgggaatactgtttcatgctgttccccttttttggatgaaatccgacccgatcactttcatggaaatagtcggggattggacaaggaaaactgatcaatgccatgtctgatcacagttttgaaggatggcagagaatttgcaagtgcactcgcgcagtggacaaagtgaagccaaaaatggagaaagagcggcaaatttaatggacttttacatggaattgatcggcaaaaaagaaggaaaggcacaggtaaagaaaaaacaaaataaa

SEQ ID NO: 74756 - DNA, 1029 bp, Heterodera glycines
  Genomic contig location: Contig_ID=SeqID_11364; Location=820..1848; Strand=-
  SCN-specific regions: Sequence locations=1-300,323-1029
atggcactaaggaaacaaaaaaacgacgttatttggtcgaacgtatgccgaaaaatgtatttaaaggcattgctgggggattgccagttgcagtgaacaagtccgaagtcgcatttggtccacgaggctgtcgagtcaccttttcgagtaatggccgacttttttttgtttctaattgacttttttaacatttcaggcaaccttttggctgcttggagtgtcgatttaggctctgtttccatgcgccgtttgaaagttgtcccaaccatcaaagtatcgccgcccttctcacaattagtattttatttgctttgatttttcaggacctttttgccaaatacaaacaaaaaacgggcaaaagtgacttgcaactgaatgcgctcccttcgctttccggcggtctcatttcctttgatcctccatcggtgctcctacgtttattggatgctttcgttatgaaatcgtcccgttccgccgaccaagggataaaagccgagggaatcattctgtcgctttgtgacattatttgtgccaaaagtgacaatgccgaaggtcattcatttagcgatcgcatgcttttctttgtttcttacaaatgttcttttccagaaagagttgttcagcgtgttcagatgggcaattggctgaaacaacagctgaacgaccgtccccagcagcgacttggtccgtccgcctccgtcttcgacctcatcttccaccatttggtctgcggcgcatgtgaaaaggccattgccactgcccgccagtcgcgtcattacaatttggctttgcttttgtcactgtttaaatgtccgagccccaaattaacacgggaccaagtcaaaaaacaggtaattctcatttggtcacaaaatacgaatctgattacttacatccgtttttgttcagctttccgtaaccgacaaaaaacccacaacggctattggctatacgaagattttggaattgctttctgacgattggtctgacaaacgaaaacaatgcttggaagggcttgactggcttcag

SEQ ID NO: 74757 - DNA, 1779 bp, Heterodera glycines
  Genomic contig location: Contig_ID=SeqID_11368; Location=251..2029; Strand=+
  SCN-specific regions: Sequence locations=1-807,829-1052,1074 -1223,1246-1313,1335-1402,1424-1500,1526-1699,1721-1779
atggtcagagcaacaacggccaggacaagggcatcagcagcgcgcgcacggagcatcaaaatcaatcgtcgaaatgccaagaaagcgcgtgccgcaattggacgagccggacatgtgagtgacgcgcgagggggggagggggtggcaattagtacaccaattgattcaattcaactccctttttaaatttgccaattttcagacacgcaatgcgatcgcacgggagaagtgcatgatgtgcctgggcaaagtgagctccatgacgcgtgtgaccatgggctgtgtgcacgaatttcaccgcaggtggaggaggggcttaatgaatgtcaatcaatttagaatcccctgagttcgacaagtctaaaagccgagttttcctggccaaaatgccggaagttttgcttttgctgatcaccgaattcgaaatccgttccgatcaatttgaacccatgacctctcgagttagaacaagcataaaagccaagttttcctggcctaaattccgcaaacaagttttcaattgataccgacaacagtagagccaaatcctctaatctacgggtttttatgtgtctatgattttcaaaaaaaatggtgaaaaaaatttatgagtttttttggggcctagaatcccgattttattcatggtgatttcggataaatgcaacgctttttatcccctgaaggtgcctgtaccgctggctcaaatacaacaccaactgtcccgtgtgccgcttcaatttcatgcgcgcaattccccctgaagaaccggcggaggaacagcaacaacgagaagaaatgactatctgatcagatccatcattgaaatctctgtactatcataatgttgtgtattgtgtatatgtctgtgtgttgtgtgtgtactcagtataaagatgatgatactcggaagatggaagtttttaattgcatttccctgtaggtgttatgtatttagcggtaattaatggagtccggattttaagattgttgtcaatttttttttacaaaaaattgattacctttctagctatgtagctattttattttggatcaaaatatgtaaatgacaattatcaggttagctttgatcagtgtcctctcgctgtctctcactctctagctgattagagtcggatctatgtgcctctctctcattaagttcaggctcgcccatccacactgatcggagggcaaaaatgaggaacacagagctattggtatttcaatttttaaaaacatttactagcaaaatttgacgcctccttttttcatatttttggtccattttacaagactttgattagtttatttatatccacacacacatacacgcatatcaccaatacatacaatttaagtgatcagatattgattgatacatgatacacacacatcaacgaaatacatatgtacaattcaaatgatcaatcggataaatggcaatttcttatccttcttctgttgttgtgccatgatgctaatccaacgccacatccgcggttgtcgctgtcgtcggagtagtcgccgcttcagttgttctgtgttggtcgccgccgccccattttgaaataggtacttacttaaagccgacgataataatcgttgtcatttgttagtcgccaccgcccccgcccactgttcacgccgtccgattctgcccggcagggacactgaaaaaacaaaaacaaaattagaatgggcagatgaattaaagtggcaaaacttacaaatcaggtgaattgcccacaagtccacagtactgaaagagaacttgga

SEQ ID NO: 74758 - DNA, 1170 bp, Heterodera glycines
  Genomic contig location: Contig_ID=SeqID_11368; Location=1670..2839; Strand=-
  SCN-specific regions: Sequence locations=1-7,29-46,68-155,177-188,210- 258,283-496,520-587,609-614,636-869,891-1064,1090-1170
ctcagtatcccagcttctctgccttctgtataccaatccgtcagcaacaacagcagaagcaacaacaacagaagcagaagcaaccggtggagtggtgggtttgagggtcgggggaatcgctttgctgctgtattttgagtctcaatgcaaatttgtaatcattccaaaatttctagtttgtccttaaaaaatggacaacatttttcaggattgagctttcaagcaggacaaattcaagactcataaaagcacgaaaaatgaatttttgttttggcttattttcagtatgttttttactttgtgtggaactaaaacgaaatagaactcgaaaattgagtttagaagcatttcagagatgctattaatagggatgggatttttatgtttttacatatttttctgcggcttagttatggcgagagaagcccaaaaataacattttctccgaacaattttcgatttagagcgaattataaaaacataaaaacacatattttggcattttggcacataaaaacatatggcacatatttcggggttttggcacatattttggcatttttgagaaaaatttgcaataaaaatacaagaaaattgaaaaatacacccctaaaaatcaacttttttcattggaaggggccttctaccagagaggggccttcaaatagcggatttacggtattttattacatatttcaggatttttagcacataaaaatcccatccctagctattaacatgaaatacattttgttttgaccaatttcggacacggaaaccccaaatttcgtttggatagtaaaaatttattccaagttctctttcagtactgtggacttgtgggcaattcacctgatttgtaagttttgccactttaattcatctgcccattctaattttgtttttgttttttcagtgtccctgccgggcagaatcggacggcgtgaacagtgggcgggggcggtggcgactaacaaatgacaacgattattatcgtcggctttaagtaagtacctatttcaaaatggggcggcggcgaccaacacagaacaactgaagcggcgactactccgacgacagcgacaaccgcggatgtggcgttggattagcatcatggcacaacaacagaagaaggataagaaattgccatttatccgattgatcatttga

SEQ ID NO: 74759 - DNA, 1737 bp, Heterodera glycines
  Genomic contig location: Contig_ID=SeqID_11369; Location=240..1976; Strand=-
  SCN-specific regions: Sequence locations=1-22,47-115,353-625,647 -707,734-739,923-970,1150-1166,1188-1273,1363-1737
  Gene Ontology: Mol. function=ATP binding; Cellular component=integral to endoplasmic reticulum membrane; Biological process=signal transduction
atgccacctccgtcaaagcatctcaaaagtgaggaaggaagacagacaacgacaacggcatttaacagttcgagggaaacggatggttttggaacatcggaaaatggacaaaaatggagaggaggaaaagaaatgagagaggaaggaagagaaaagggaaaagaaggaggaatgagagaggaagaaggaagtgcaaacggaagaaaagaaatgaggggagagagagaaaggggaaaagaaggagaaatgaggggaaggggagagagaggagaaagtgccaatggaaatgggacaggggaaagagaggacaaaaacagtggaagaagaagcggaatgaggaaagaggaaggaagtgcccgtggaaattatccaatggatacgaaaactgtgccgacaaattcttccgcggcgccatccgatggagccgcgacaattgctccgtttcctcaaccaccaaaaagaccattcgaagaaatgatgataaaaaaggaacgggctgaacttctggtggaaaaggagcccaaaacggacatggaaagagttaaaaaagacggaggaaatggagagaaaaagaagagaatggaagaagaggaggagagaagtgcccataatgagaaagacaatgggggaacagcagcagtgatgggaaacgcacagaatgtgccactcgctggaagattcgcaccaatgagaaacgacaagcgaggcacaggaagacaggaagaacacggcaacagaagagaggaagacgaaggaggagagaataacgcggaagagcggggaaaagcagaggggagacaggcagagcgaaaagagagtaggagaactgagacggagaggggaaaagacaatgggaaggcagaggagacagacagaagcagaggcagttgggagagagaaagttcaagggaatgggagaggggcgcaaaggaacgcggaggtaatggatgggacggagagaacaaacaacagagagaaagagggccgagtgaccgagaggaagaggagggcaagagacggcatgagaaagggcaaagtgagcgagaggaagaggagggcaagagacggcatgagaaagggcaaagtgagcgagaggaagaggagggcaagagacggcatgagaaagggcaaagtgagcgagaggaagaggagggcaagagacggcactggggaaaaggtggaaacggaagagcagcgacagaagagtcactgttattcagcccacttcaggggccatatccaaacgatggacaatcaggaaaaagtggaaacggaggaagaggagagagagtgcgcgaaagaggagggagaggtggagagagagaagacggcggtgaagagagagcgaggggaagagagagatgggaaatggcagaacagcagcgaagtcgcaatgcgcagcagtccccatcagaagcggaccgttcgcaacattcgcccggcattggacgtgccgtttcgcggcatcagaattcgcgaacttcgccctcctcctcctctactgaagaaaatgtttctcgtgaatccgtaaatcctcgtcaacatgctcgaactgtacagcaacgtccaacttccgttcattcgcgggaatcgccccctcccgtcgccctcggctttcagcgcgctattcccgacccgaacaaattctttcccgacacaattcgagaagcttttccaccacttccaaaaccatttgaaggattggaggagaagcatgggaaagagaatggaggatga

SEQ ID NO: 74760 - DNA, 88 bp, Heterodera glycines
  Genomic contig location: Contig_ID=SeqID_11369; Location=2752..2839; Strand=+
  SCN-specific regions: Sequence locations=1-88
tgccaccgtttccgcgtccaattcgtcctcctcgttgcagataatgtaaatttgttgtcggatttcagttccgtgcaccgaaaaaacc

SEQ ID NO: 74761 - DNA, 349 bp, Heterodera glycines
  Genomic contig location: Contig_ID=SeqID_11370; Location=83..431; Strand=-
  SCN-specific regions: Sequence locations=1-212,241-349
  Gene Ontology: Biological process=embryogenesis and morphogenesis
atggaatttgttggagaaaagctaatcgaatgttcaatttgcagccaaagttttcccgtgacacctccgttcaacatttgtagagccatcagacacatcaaactaaagcatccggaagtgatgccggaacacagaggaggacagagtgcccgggtgggtgggaaaggtgcaatacgtttccatccctcttcatcgtattcaaactccgcccgaaaaaattaaaaattttttaaatttaatgagattttctagtaacaattataaatttttgttttttaggatggatttcaatgccaagagaagcagcagaacggtaatggaacagaagggccatcgaatggagaagaaa

SEQ ID NO: 74762 - DNA, 1532 bp, Heterodera glycines
  Genomic contig location: Contig_ID=SeqID_11373; Location=855..2386; Strand=-
  SCN-specific regions: Sequence locations=1-62,84-384,410-619,642 -705,728-833,862-1045,1085-1109,1151-1266,1320-1332,1354-1425,1447 -1532
atgcttttcggcattcagaatgatctggtttacgccctgttgctgcttttctctgcactgatcgccgctgctttacggctgccaaattcgaatgccatccgtctccaattggacggtctgatcggtctgtcaatcgcttacattgtcggcggttggatggcactctgttcgctgatcattgtctttgcgcatttggctctgatcacttttgtcagatgtccgaggtgggttttgacattgaaaataggaagatatacaattttcttccgatcaatgcttattttttttatttcgatcattttttcccattttcatgcaaattttggataatagtggagaaatgtgaaaaacttcagcgtttttttggaaaaaattagtaatttcagataaaattttgaaaaaagattttcttgagactttctttaaataatatctgattttttgaatttctagcatttcgaaaaaattttaattggttttttttactcatgggtccgaggttcagagttggtcaaaatgggtgtcatattcgagctcagtggttactaaaaagcctggtccgagatctgatcgtattcatgatcagctcattttcttacttactccaaatacaattcacaaattttttaaattttttttttcatcaagacatgattctctcacgtattatcaattttttgttcactttcagtcgtctcaccaacttttccttttttggcactttcatcttcttggcactgctccggtgccaacattttgtgggtctgccccgcctggaatttgtcaccaatgccatccaactgatcatgacattgcgggtcggcaaacagtcgatttaaattaaaaaatatttaaaataatcaggccattggattggcttatgaaattgcggacattcgacgaaaaaaggatggcacagatggtggaaaaaatggcaacaatgacactgctgaacgttatgaacacgagccaaatgcactggaggcgttcaattacctgtacagcttcactgggctgttcacgggtcagtgaaaatggcacttagaaattaatttgaaattttcataaaaaaataaataaataacccttctaggagtgattgaaattccatatttttaattattttttaaattaatttttatctttttatgcgatttttccccatacctcttgtaaaagtgatctgaagtgcatcaaaatttaaaggataatggaatataatgaccagacaaaagcaaaaggattacatggcaataagaattttggtttttttatttttggaatatttttacaaaaaaatatattaaaaaataattaatggattatattaggtgtaatttgtttttctatttcaaggcccttactacacctacaaaacatatgcggatgccattgttcgtcctacaccgattcaatggaccaaattggcaccattaatatggcaaaaaatgcaaacactttgctggacattgccagcacttgttttgatgacttggcttgacccattgaatgtacggagaaaccaaaaatga

SEQ ID NO: 74763 - DNA, 385 bp, Heterodera glycines
  Genomic contig location: Contig_ID=SeqID_11374; Location=324..708; Strand=-
  SCN-specific regions: Sequence locations=1-219,242-385
atgaatgacgatgagacggagaaaagaatatttatgattttttatgttaataattcagggctcggatcgtaccaagtcactttccaagtacaggcattccaatttccaagtacataacggtggaaaatttgtgaaatccaagtacacataaaaattgaacaaaaaaataattaaaaaaggttaattttcctcaaatagttagtatttttccagggaatgattttattcaaaaattaattatttccgctaagcattttacaaaaccattttttgcggcgttttttcaaaaaaaactttttgggaacttgaggagagggggggaggtcctgctgtgcctataggcatcgccgggaaaattattgttttgatagtattaaataataaa

SEQ ID NO: 74764 - DNA, 105 bp, Heterodera glycines
  Genomic contig location: Contig_ID=SeqID_11374; Location=1926..2030; Strand=-
  SCN-specific regions: Sequence locations=1-105
caaaagcgaggcaaagtgactttggccatcgatgttacagtgaatgaagcaaaaacggaggacaaatcataaacaattaaggagattgaagaaagaaaaactcta

SEQ ID NO: 74765 - DNA, 627 bp, Heterodera glycines
  misc_feature (609)..(609): n is a, c, g, or t
  Genomic contig location: Contig_ID=SeqID_11374; Location=2150..2776; Strand=-
  SCN-specific regions: Sequence locations=1-627
atggggttgacaatttggacaattcgactgggacattttgtgaccatgtcattaacaagaaaaagagctggttctgtttcaacaatttcattaccattgcggtaagttggccatttcatttctattccttaattgctctaattatggttaattaagaaattgatggaccaaaacaatggtttttacaaccaaaatgaggacaaagtgacactggccatcgatttaaccgagacagataaaaaattgagaaattcgtttctgatcccaacaaatccaacaggacaatttcgatggacattaaaaaagtgtcggaatttgcgcgagaaatcattttgagtgaccgtataagtgaaactgtgtacatcggaggatttccatggaaaattgtggcagaaataaatccgaaaaaaggaagcactgacaatgagaaatggttgggcattttccttttgtgcaatgctccaaaagaaggtgcaaattaaatgttattagcaataattatgataattaaagtcattagatgaatattggggttgcaaatgtttgtcatcctttcgaattgtctcgcaaaagagcggcgttgcggatttcagagaaaaactcgatgancatgtttctaacaataaa

SEQ ID NO: 74766 - DNA, 807 bp, Heterodera glycines
  Genomic contig location: Contig_ID=SeqID_11374; Location=3555..4361; Strand=-
  SCN-specific regions: Sequence locations=1-141,177-262,290-315,337 -593,615-807
atggagagaaaagggagtattcctcccgaaatttacaacaacaaaaaaattcaaaaaatcaaattttattcacaaaatgtaaaaattttagacaaaaagcaaagaacgaactaatggaaaaaggcaacataaaatgaatgagcacagatactttttctgtttttgttcttgtttgtcaattggtcgcctcttccgaatcgatggcattgcaaagacaaaaagccacaattatgccgaacaccttcacaatgcgaagcagaagcaactaaattaaaacaaaaaattcaaattgatgttcgaagaatcgggatataaaaataaaacagatttttatttttgtaccaaaatttcagttcctttcggcttgttgacagcggaagaagtagaccagtactataaccaaatgaatttttatgagatgtccgatggcataaaaaatatggttaatcataattagaactcgaaaataccgtatttacgggtccttgtaattgggttgaattctaaaaatacacctattaatttaattagcacactttttacagttccatcccgcaatttaacggtggaagaagtgattggaatggaagagtaccataaccctccaaattttcgtgggatgtccaacggcatactgtacccactgcaatttccgtgccatgtacgaatttcacctcatgggacaattgtgatggacattgaaaaattttccgaatttgcgggtgaagctgtggggagtcgccgattgagcaaaacagtgcaaataatgggatttggatggagaattatggcacaaaaaagaataaa

SEQ ID NO: 74767 - DNA, 47 bp, Heterodera glycines
  Genomic contig location: Contig_ID=SeqID_11376; Location=1195..1241; Strand=+
  SCN-specific regions: Sequence locations=1-47
atgtcgattatatcaagtaaaccgatgaatatctcgtttagtaattc

SEQ ID NO: 74768 - DNA, 250 bp, Heterodera glycines
  Genomic contig location: Contig_ID=SeqID_11377; Location=81..330; Strand=+
  SCN-specific regions: Sequence locations=1-250
cgcgagaattttgtcgatctgttggagtactgtgaggagcacttgaaggtccgtcgcattttggcttgcttcaacaagtcggacatcaatccatgccagggcattccacgcgccctccggtgaaattttggatgccaaatttccaatttaccgttttttcagttgcattggcttcaccctcctcccgcccgaacgttaccccgctggcattgacaagaacaccatttttgcgatggtttacaaaatctaa

SEQ ID NO: 74769 - DNA, 1449 bp, Heterodera glycines
  Genomic contig location: Contig_ID=SeqID_11377; Location=741..2189; Strand=-
  SCN-specific regions: Sequence locations=1-119,141-564,596-604,627 -797,820-1449
  Gene Ontology: Mol. function=chaperone activity; Cellular component =endoplasmic reticulum; Biological process=signal transduction
gctattttcattcttatttttgcatcaattataaacatcacacaatcaaatgatgcagaaaaaccgaaggggccaaaagtaacggagaaggtcaattaaaaaaaatgagtcacacacataattttgtttaaataattttaggtgtattttgacattaaaatcggcgatgaaagcgttggtcgcattgaaatcggcttattcggaaagactgtcccgaaaactgtggaaaactttgttgaacttgccaagaaaccgaagggggtaaaattttgcagttttttccggtttttgccaattgtctttttaggaaggttacgccggcagcgttttccaccgagtcattaaggtctttggcttctgtgaggcatttttttcttgaaaaaagcaaccaaattaattaaactttcctggtattcggtaactccttacgtttttttaattgtaatgtgcaaagttcgagaagtttttaaatccaaagaatttatggcaaaaaaaaaagtacccaaaaatgttccatcgaatataaaagttttttactaatacaaaaaagattaatttaatttgaaggacttcatgatccaaggcggtgacttcaccaagggcgacggcactggcgggaagtccatttggggcgagaaattcccggatgaaaacttcaaattgaaacattacggcgccggatgggtgacaattttcattttaggcatgtttatttaagatttgttcctggtttagctgagcatggcgaattccggcaaagacacaaacgggtcacaatttttcatgttcgtttaaaatttaaaaatttcttttaaacaaattccgtttttgtagcacctgcaaaaaaacaacttggctcgacggacgacacgttgtttttgggaaagtgagtttttggacaattttaaaacgtaaaaatatgcggagaatgggcataataaaccgcaaaacaatggcacggatttttttcatcggactgcccaaattcttgggatagacccgaggtgcaatgctttaattccaattaaagccgtaaatcactctcccccctctttatggaataatatcccaaatcggcttaaaatgggtacatttttgtgcctgtttacatcgacattattatcctaggtgctttccgggatgtctgttgttcgccgaattgaagccacaaaaacattgggcggtgatcggcccgagaaggaagtgacaattgcagcggcaggtaaccgaaatgagcaaagcgtacaaaaatgggtttgggcatagctaattagagggcaattaacggtgccaaaatttgtgtgtaggattgccgggtccccaccacctgaaaaatcgaggggtgcacaacaattttttttatcactacacttccgtatttttaaagccaatttttaagggcaaattccggtggaaacgcctttttctgtgcacaaagaggacagcaga

SEQ ID NO: 74770 - DNA, 1439 bp, Heterodera glycines
  Genomic contig location: Contig_ID=SeqID_1602; Location=449..1887; Strand=+
  SCN-specific regions: Sequence locations=1-1439
  Gene Ontology: Mol. function=chaperone activity; Cellular component =extracellular space; Biological process=reproduction
attcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagcaaaaatgcgacgattcgtcaactcagccaaatgtcaacgattcgtcaactcaatgattcgtcaactcagccaaaatgcgacgattcgtcaactcagtcaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcagccaaaatgcgacgattcgtcaactcagccaaaatgcgacgattcgtcaactcagccaaatgtcaacgattcgtcaactcaatgattcgtcaactcagccaa

SEQ ID NO: 74771 - DNA, 1083 bp, Heterodera glycines; identical to SEQ ID NO: 1603
  Genomic contig location: Contig_ID=SeqID_1603; Location=1..1083; Strand=+
  SCN-specific regions: Sequence locations=1-1083
  Gene Ontology: Mol. function=chaperone activity; Cellular component =extracellular space; Biological process=reproduction

SEQ ID NO: 74772 - DNA, 1322 bp, Heterodera glycines; identical to SEQ ID NO: 1604
  Genomic contig location: Contig_ID=SeqID_1604; Location=1..1322; Strand=+
  SCN-specific regions: Sequence locations=1-1322
  Gene Ontology: Mol. function=chaperone activity; Cellular component =extracellular space; Biological process=protein folding

SEQ ID NO: 74773 - DNA, 3014 bp, Heterodera glycines
  Genomic contig location: Contig_ID=SeqID_1605; Location=623..3636; Strand=+
  SCN-specific regions: Sequence locations=1-167,189-219,319-582,612 -808,831-989,1148-1241,1271-3014
  Gene Ontology: Cellular component=cell wall (sensu Fungi); Biological process=reproduction
tagaattcattttttcatcatcttttgttgttgattttgttttttttcaatttttatatccattgcatttttcatatattttcaattaatccttcaaattcattaaaagtttgacatatttgtttcaatttcttttttcgatcccatttccccacatttctcgttttcgtaattcaagtcttcttcatttaccaaattaatctcccaaataccattgtcatttttaaataaaattaagttagaatgaatgtaaaatttaattaattttagcaattattgatttcttaaaaaaaaattcgttaatttttaaatttttttctattgggaaataaatttctgtcctttttctcaattttcattttctacttaaatttcatatttgtttattttttagttggacaaatttaagtaatttatttttaaggtttcatttaattaacaagtttataatttttctggtattgcgttatgaaatttgaaaggtttgttaaagaaggtgatcaaatttgataatgttcaatccatggatttgaaggctttttaggtcgtaggtagatgataaataatttatcgaactgaatgaataaaaaatttctaaaaaatatattttacaatttacactaaaaagttgaagaaatttttttaaagaaaataaaaaacccaattgcaaaaaaaaaatgggaaaattcaacagaacaattcttaatgaaaatgaattggaattaggaaacgacttgaacaagagcgcggattttgtgggcaatcaaaaaaattatgaaaatggcgaccaattgaaagtgtcaaatttgtcatcatattcatctttcagtgatcttctttctatataatcttttgcttttgtcaatgctttttccaatttctccttttcttcgttggcattttcttttgtcttttcgaaaattttttccattttcttctgaaattcttcccaaagattggcaaattcaatttcatttttgtttgatgatttttgtcctttttccttcacttttctgtccgttggtcctccgtttaaaatttcttttcccttttttacattttttagtataattttttcttttctattttttttccattttctaagccaattttggtctttttcttcattttctttctctttaatttcataatcctctaataaatattggcttcaccaatggtggcaattgttttttcgacaattctgggtttcttgcttaataaaatagaaacaaattaggtttttattttttaattttttatataaatacaaaaacttcagcataaatccgaaacaaatattcatataatatgtctaaatatttgcgatatttttcgcattctctccgtttatcttcttcagattcctccccaattttcacagtgccaattctttctggcgcgccaacgattcgtcaactcgacgattcgtcaactcagcaaaatgcgacgattcgtcaactcagccaaatgtcaacgattcgtcaactcagccaaatgtcaacgattcgtcaactcagcaaaatgcgacgattcgtcaactcagccaaatgtcaacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcatctcaaccaaatgtcaacgaattcgtcaactc

SEQ ID NO: 74774 - DNA, 1035 bp, Heterodera glycines; identical to SEQ ID NO: 1606
  Genomic contig location: Contig_ID=SeqID_1606; Location=1..1035; Strand=+
  SCN-specific regions: Sequence locations=1-1035
  Gene Ontology: Mol. function=chaperone activity; Cellular component =nucleolus; Biological process=protein folding

SEQ ID NO: 74775 - DNA, 3173 bp, Heterodera glycines
  Genomic contig location: Contig_ID=SeqID_11379; Location=549..3721; Strand=-
  SCN-specific regions: Sequence locations=1-23,97-196,251-479,603 -779,809-1075,1097-1109,1131-1576,1603-1703,1751-2279,2301-2558,2585 -2862,2889-3173
  Gene Ontology: Mol. function=calcium-dependent phospholipid binding; Cellular component=integral to synaptic vesicle membrane; Biological process=larval locomotory behavior
gaggaggaagacgaatttgtggtggaagaggaggaagaagaggaaaaggaaagggaagaagagggggagagggaagaggaggaggaggaaaaggagcggaagacggacagagaaaagagcggaaaaagcaaaacaaagggcaaaagcaaaggagagagggaggggacaagccaaaggggcaaagggagcagcgcaaggaaagagcagggccaaaaggaggaggtgccggaggaggagggggcacgggaagagacgcccggggggacgcaacggccgacaccactaattgggtgcgcggcgagatcaaagacaacgcatgccaattaatcagagtccctttagcacttccagtcgcgagccatccgcacgattggtgaccgacgaaaagacattactacggcaaagacatgaccaaattggcagagaaagtctgttgagagaggcgacgggtgggagaggaagattagatttatgaaaatgagagggagagagagagagggaagtagggacaaagagatagggagagagcgggaggagaaaacgagaggagataaaagatagtgaggagtggagggagagagagagagagggaaagagatagaaaaatttaggaaaatgaagggtattaacagtcagtccgttgtgggaatgccatttgcctgtcctttcagcgcccggttgggccgtgatgttcctcggtttggttggccttgctttgcttctcggctgtttgttcgcgctgatccgacgcattttcggcaagaaaaggcacggggagaagaacaaacagcagcagcaacagaagtggggccaaggcggactgaaggcatttttcggcggaaggagcggaagcgcagcggcggacgccgtcggacccatcggcgccgggggagcgatgggcggtgccaacaaagtgagggaggggcaaggaagggacggcattggccacggctgatcagagcaattagaaagacactgatcaacccaattaagtcaattaagtgagtggcaggacaaacattcgctaattaagccattaagggagagaagttcagcattaatttacaaattacttagaaaacaaaaagcgaagaaataaaatggaatggaaaataaaaaataatttttatgtcttaaaaaaggtcaaatattaaatactgtgactaaaaactgttcgtcgtaaatgccttttactttttcaaagtgaataattattaccgattttattagctgaacgatcttggaaagaaaacaaaaagcctgacaaaattcgcaaaaatagacgaggaggacgaggttaataaactcggggaacaaagcatcgcaaaagcattgagaataaagcgaaatgaaccgcttaaatgacaaaagtgggctgatgatgaaaagcatcgcttttggcacttttagtggcaccacaaaatgccattcgttcgttcagttcaccgcggacatggaaaagttgggagatcatatggaacagaacgaaagggcacaagcggaacagaaggaggaggtgaacctgggacgaattcagtacaaattggactacgacttccagcagggacaggtcattgaaaagggaagggaaaggaaaagccattttggacacgaaagcattacagttggcagtcaccgtaatccaagcggagaatttgcccggcatggacatgtccggcacatcggtgggtgtcaaaaagcgaagacagagaaagagagagacaaaaagagagagagaaagagagagagaatggcatgccgaaatcagacagagcagagaattaattcattagacaaaagacaattaattaggacattttatcaattagcgtttatactaatgaattcatttttcttttataccgcaggacccttacgtaaaattataccttttgcctgaaaagaagaagaaagtggagacgaaagtgcacagaaagacactgaacccggtgagaaaggacgaaaaaggacaaatgggcaaaaatggaccaaaagggcgaaaacgggggcaaaatagacagaaagaaaagtgtgattggaatttttgatcgattaaggtattcaacgagacattcatcttcaaggctggtcaaatgccgaaacggcacaatttccgttttaatttaattggtgcctctcttttaggttccgttcaatgaattgccaagcaaagtaagcgcacaaattgcaaaaagcgccaattcgtcccttctctctttcagactctcgtgttctctatttacgacttcgatcgcttcagcaaacacgaccgtaattagtggggggaagggaggggtaattaagtggtaattatcgcttcggcattgacagagatcggacaagtgatacttccgctgggcaaaatcgacttgggccaagtgatcgaagaatggaaagacattcagccgcccccggacgacaaagaagcggtagcgaagaacaaaggaaaggcacggccaattaataccatggcatttgaggagaagaacctgggcgacatttgcttctctttgcgctatgtgccgacggcgggcaaattaacggtggtggtattggaagcgaagaatctgaagaaaatggacgtgggcggactgtcgggtaagaaaatggacctatactgtaaagagagggtacggtcaccgtaccatggacaaagcaacatcccaattcccagcgtaaccagtcaattaattatcaccccaccattcagacccatacgtgaagttggttctgatgcagggcggcaaacggttaaagaaaaagaaaacggtaaacggccggggattacagtataaaaaattactgtaatttttgtgagttgttttggcattctgtccgtttagtccatcaaaaagtgcacgttgaacccctactacaacgagtccttctccttcgaagtgccctttgagcagatacagaaggtatctctgctgattacggtgatggactacgataagctcggctccaacgatgccattggccgcgtccttttgggctgtgccgccacgggcgccgaacttcgccattggatggtccgcactttgtcatgctaaattgggcactttggccaagcgcctctttaggatatgttggcatcgccacgacggcccatcgcccaatggcacactttgcaacccatcgaagaggaggaaaagccgaaggaaaacggaatt

SEQ ID NO: 74776 - DNA, 3503 bp, Heterodera glycines
  Genomic contig location: Contig_ID=SeqID_11382; Location=188..3690; Strand=+
  SCN-specific regions: Sequence locations=1-205,227-239,271-653,676 -884,907-1460,1495-1784,1807-1899,1922-2511,2533-2585,2607-3503
gaatcgatgactgtcgccatggaattgattctgaattccaaccccgcgtccatcgacaccatttttcctgtgcatgttgcggattccaacgggtctgaactcttcttacaaccggcctttgttgggacacttcgcgagattaatgttattgtgagttgggaatcaccgtggcaaattaataaatgctagttaatgcgatttgccatatttttatgttctttgtatattcgaatttttggttttaattttttttgtttatttttaaatttacttgtttagcaatcatatttgaagtctgctgcaatcgaagaaatcagtgattcagcattgcgtaagaatttaaagaacatactgaaacgcttgcctgatgaatttgttgaaaattcttccgatgttttaccttttgcgtcggaacattcgccgacttcgaatcgcttaaaaagtcttgcggacaaagtccaaaatgccgcttctcgaggccatcaacgccttatgcaaacgtcgtccgtctccaatttccgtagcatgggccagcgtagcaacaattttcccgcttcttcctctgtaaattttctcaacgatagtctcgcgaatgcaactggaaaaagtgggcaagaacaaccgacggcgaatgggcgtagcatttgccaggtgaatttatatttctttgttgtttaccattgccaaaaaatcttcaatctaactccgtatttttgagaatgtgctcttcttccacatccccgatcgaaacgaccccattggaatggactccgagggatcgatcatggaactttttcgacgtctccagtcaaaaaggcgaaagttggtgagcggagagaagaaaacacgctttttgacggctacggaaagcattggtcttcgattagtcaattgtattgtttttaaacacatgtttggccaattcagtgtccgacagaacagcgactgacgtggtcagtgacgaggacgaggaggagggaatggacgaagcagcggccggatcttcggtcagctcgtcaaatgacaatgttgttgatgaagtaaacattgaactgtttattttacaccaacagcattaattttttattttgagactgaagacatttccgctttgcccgacaatttttccgatgtcgttccgatcagtgccaacgtttctgggaggggttcgcccagtctcagcgggggacgcatttcggggcgcgaaacaccattttctggaaatgctcctgaacaaaacagcggtaaatggattaattgcgacaaattaaacagagttctttgtcagaagctgccaccatttgctccaccgtccctgccatcgccacgcaaccggtggaaccacgacgaactcttcccaccattccgattagtgtgcggaagcaaaatactgaaggactcgaggaaaaatttggaaaatttggtctcccaccgcaagattcatcaagatatcgtaaacattttgtttttaaaccattttgtatatttatttttgattatgtgcaggtgacgaaacggtgtcacttgtgagcgacagttggtcgacggatgtggtgactttgtctattcgaattcaaaaggttaactcactttttcgcaggtcgcctcagacaacgaagggttcaatgagcttcggtgtactgagtcggtcactttgggccttccgccgcaaaatgtccaagcgacggttggaagttccgtcccttccgccgcttctgtcgccgtcccttccgtccaacaacagcaaaacactccaaaagcgcattctcattatgtgaacaatcggtctgggagcagcagcaacactttgttttccatgcaagagaacaattcgcagcaggggacagcacaacttcaatcgaattcagcccaaattgaggcattttgaaagagtcgccaatattttatttttactcatttttatagacacaaaatgaggaggattttcgctattacgaccccaacaatttgacaagatgcagagcctttttggatgcaaagcgaaaactgagattggtgctcagttggaccacgaatttgccatacgcttctcattgtcaaacgcaaagaaataaaaacgaagaaaatgggaaagatttggccaatggaacgaacaaaaaccagacgaatggagcaaagactgagccgaacagtgaactggttgcactacaacaattcctaaagttgttgcttgccgaggcggtgaacagtcgtgatagaaaacagtcggcccaaatccgcgaggtccaacgctgtctgtccatttttgaaccgaaagggtacaattcgcttgtcgtcgtacaattctgtgttattttcgcagtgttcgcgttttgttgcgtacgttgcgcgaggagcaccgaaagaggacggctttccacctttacctgcaacagtcgcgtctcacgctgcttcaacttgacttttgcctggatcggatgagcagacgcattcgccgtgtcaaatcactcacttccgaatgtcttattgaaatgcttgttcggttcagtcttcaaaagaaggaacaacagttcttgcaacaatttctccaagattttcagcaattgaatgtccaggttaataattaaagtttaaaaagcttttttgtacatatttcagcctcggaatttgacggggtcccgactcgagttccatccgatccaaattgtttggtctctaatattggtatctgttaattaaggacgagaagattgaccttgtcgagtcgcatttgtgccatctctacgagcaactcgtcttggaatcgatgtggcggtcggcatccatcgaagacattgaatatgcacgaaaatgtttggagcgttctttgatgggacaaatttacgtttatgcgctcttcccaaacggtgaagcggattacttcagagatgagtcagttttagaatgctttccaagttcaaaatttaaaatgtttgaagggttctcaacaaatcggtccacaaactctctgagcttatttcggtcggccatcccgaattggcaattccgaaagtaagcatattgcgttgaagcaaaacttttactttcccacttcactcagaatctttatgcggaatgtccgtggccctctgctcaagctgaactgaacataatcaacgcgtacaaatcaccgcgagacaaaatggcatgaaatgatttacttttcaattcgaacaataattgtaattgccaggcatgcatcacccgttgctgtgagaccattgagaatttagttacgctttcctccggccgatcggcagcttcggcggatgacattttgccagttcttgttttcgttatcattaaggtgtgttgggctttatttttgattaattcgctggaaattattctttcaggcgaatccgccagctttgctctccaatttgcaattcatcgatggtttttacggaaaacgaatgcaaggaagtgaggcatattggtggactcaagttacaagtgccgtggaattcctcaaaacccttcttaataagctgtgcaattag

SEQ ID NO: 74777 - DNA, 566 bp, Heterodera glycines
  Genomic contig location: Contig_ID=SeqID_11383; Location=14..579; Strand=-
  SCN-specific regions: Sequence locations=1-11,35-58,96-193,215 -247,270-566
atgaccgtgagttaattcattaattaatttatttgtttgtttaaaaaatttggaattgaattttcattttctaagaaatgtgcaatctcagtgccgagataagcgccttggcacggcacatgagggaacgtttgttcatcgaactgttcgccgtctgcagcagaggcaaaacggcggaaaatggccaaaacagcggagaacgcttctgcacaatcatcaacaaagtgcacttcactcgggtgggttttgaaaagagaaggaaaagcaaatggcataattagcaaaaaaagggggggataaataaggtaatttttaacaaattagcaaaatgttcataaattactttgtttagaaacgtttataattagcacgtcattaacactggtgataagtgtcagtcattatgagttaattgaaaatagtaccactatgtttagaacatttttaaaaaatttgagggaaaatctttcttttttttagaaaatttcgcaggaactttcctcccatttctccctggccaacatgtcgggctccttcgaaatggacccgtttctgcacaattttaa

SEQ ID NO: 74778 - DNA, 526 bp, Heterodera glycines
  Genomic contig location: Contig_ID=SeqID_11383; Location=96..621; Strand=+
  SCN-specific regions: Sequence locations=1-215,238-270,292-389,427 -450,474-487,509-526
ttttctaaaaaaaagaaagattttccctcaaattttttaaaaatgttctaaacatagtggtactattttcaattaactcataatgactgacacttatcaccagtgttaatgacgtgctaattataaacgtttctaaacaaagtaatttatgaacattttgctaatttgttaaaaattaccttatttatccccccctttttttgctaattatgccatttgcttttccttctcttttcaaaacccacccgagtgaagtgcactttgttgatgattgtgcagaagcgttctccgctgttttggccattttccgccgttttgcctctgctgcagacggcgaacagttcgatgaacaaacgttccctcatgtgccgtgccaaggcgcttatctcggcactgagattgcacatttcttagaaaatgaaaattcaattccaaattttttaaacaaacaaataaattaattaatgaattaactcacggtcatcccaaaaaataatgcccattaatccggcaaattcctcatccg

SEQ ID NO: 74779 - DNA, 1469 bp, Heterodera glycines
  Genomic contig location: Contig_ID=SeqID_11384; Location=198..1666; Strand=-
  SCN-specific regions: Sequence locations=1-196,242-545,567-1346,1370 -1441,1463-1469
atgtgccaacgacaggggacgaggccgaataattttatgagagaaactgagcagcagcaaaatatggcaaaattcgaacaaatggaaatgagcaacgaagaagcagggcaaaggtgggcccagggagacgggagacgtgccaaatccgatcccacccatggcattattcactccccccacccaaagtagcaaaaagttaaatcaaattaaattaaaatttttgtactttttgtgggaagtgccggacgatggcaaagaaaagaaaaaatattcaaacagagaaaaagaaaggcgaaaaatagtaaaggcacggcttaaactctctctcttccggcgatttcttttctctttgcttttccgtttgatccaacaatggtcaaacattgacatgactcacactgcacatggttggccacattggcaactgtttaagtttgctcgccatttcgtcggcaatttcgcgcgagattcggaccgaggcgggcaaactgtacgcactgctcggagaagcctctcctgccgcgcagcaatggtctctcttagaatgcgcgctcccttccgcgttcaccgctcctccgcctgcgcagcacaacgcgggtgcggagggtggcgtcggcggaggacccatcgggggcggcgacagcggcaacgcgtccccttcctcttcagtgtatgcgtcgcccacggagcagcagcagaacgtgagcaaaaaaagtaccgcgtaaaaagcgagtgcgccaacctaaacgtggcggcactttctaatcaatttccgctgattacctcgtccccactgtctgatcattttctcgcgagttggcccaccacacattaatgagcaaagggtgtgccaatcagaccccatccgacgcatactttcgatgggcacggggtcgtgtgactgtgccgttaggcgccgccgtggtaacttttgtgaaaatttgatgataaatttgagtgcaatctccaaagttttatggctttttgatgggataggcccaatgttgccatttttaccctctgttggtggttttgcgcccattttgtttccctttttgactcttataataaggccgagggtattttggcacaccccatgttctgctccttttatgtgatttgaccagactggcaattagtgctaattaactcaccgttatatttggcatatcaaattaactttttttggcactttttaggccttttttgtcgcctgctgttcatccgccataattcggcctcagattaatccagcgttctgcgcttttgacaatgaaattccattgatcagtgaaattgtgcgcggctatcgaagggtaagcgaaaatgaaaaaagacaaataaaatgggaatttaagtttaaaattaaagtgtttcagtttcaatcgttgcgaatttcggcatttcgtttgacgggaatttcggatgaaatgaacggcacgacaaatggcaaagaaaatgaggacaaa

SEQ ID NO: 74780 - DNA, 1096 bp, Heterodera glycines
  Genomic contig location: Contig_ID=SeqID_11389; Location=729..1824; Strand=+
  SCN-specific regions: Sequence locations=1-772,806-1096
atggcacgatgtgtcacgtcgctcgcgtttctcccaattggagacttgacccctggaatcattgctctggacatggctcttcccgacgaacttactcccgtccttgactggtaaattgacaatctcacaaattgtttagtatttattgttctttaattatttattaggttcatcatgaactatacgggtcgtcttaagcatgatggaagcagaacacgcccgcgatttgacccaaacatttggagtgtttacactcgaacattgcaaggcgatgaccgaacgaataacattcagaagccgcaaacagacgcctgcaatacgcatttgcctgttcacatccatcgatttggcatttcattgaccttctgcgaaaggatcaaaagttatcggatgatgacttcgcgaagtgttcaactggacaagacccaccgcaaaaggcaaagaaatatcgcgaagcagaccgccgaattctcacgatggttcaaaattatttaccactcaacaatggagaccccaatgtttttccacttgagcagcgctttaatcatctatttatcattacctttttgatcggaatttctcgaaattatgaaatgagaccgtgatttgaaacagataaaatgttatttaattttcttgcttgttttaatcgtactgtttgttaatattcatactttggtagggaaatggcccaaatgccttagtagggaaatggcggtagggaaatggcggtagggaaatggctcgatcccaaaatttagggatttttgggtaattttttttaagaaaaaaaaaatttttttttggggggggggcgtgccgataggggcgaattttaaatttatttctaacagatattcaccaaaaaaattaagactttttcgataaattttcgttttttaactatattaaattatcgtgaaaattttcctattcgcttaaaaatcgtttaaaaattttttttgactctattcttaactaatttttggttttttttttattttgattcaatttggtacaatatttatcatttcaaaaaagcacaaagcaaaaaattagtttgtttttttcgcagtttttgtgtcaatttaaaaaa

SEQ ID NO: 74781 - DNA, 117 bp, Heterodera glycines
  Genomic contig location: Contig_ID=SeqID_11389; Location=238..354; Strand=-
  SCN-specific regions: Sequence locations=1-117
aaattagtcaaaatacatgtcagattcgtgattagcgacctttaaaactccggataaaaaattatcatggttttttatcttaaaaaaattttgcaaaacaaaagggtcccccctttt

SEQ ID NO: 74782 - DNA, 272 bp, Heterodera glycines
  Genomic contig location: Contig_ID=SeqID_11390; Location=144..415; Strand=+
  SCN-specific regions: Sequence locations=1-54,77-144,166-272
atggtaatattcgacaaaagtatgttatgatataaataattttttgacaagtacaaaaaatatatatatttgaaatttctgctccaatatttttgcaccgtaaaaaacatatttttattatcattaacacttttagctacaatcaaaatagttttaataaagtttgaaactaaaaaaaataatttaaacccagaaagagcagagaattcttggttagaggatctgatggttattctaacaaaagttaaataaaaaaatttgatcgatcgaaa

SEQ ID NO: 74783 - DNA, 46 bp, Heterodera glycines
  Genomic contig location: Contig_ID=SeqID_11392; Location=205..250; Strand=-
  SCN-specific regions: Sequence locations=1-46
atgacattctatgcttctcttgttggatacacgggaagaaataata

SEQ ID NO: 74784 - DNA, 300 bp, Heterodera glycines
  Genomic contig location: Contig_ID=SeqID_11392; Location=335..634; Strand=-
  SCN-specific regions: Sequence locations=1-185,207-300
atgacattctatgcttctcttgttggatacacgggaagaaataatagttagtccttttgttgaatttttagaaattctatccgtccaatcggcttttggaattttaatgagtaaatcaggaaccgtaaatgacattctatgcttctcttgtttgatacacgggaagaaataatagttagtccttttgttgaatttttagaaattttatccgtcaaatcggcttttggaattttaatgagtaaatcaggaaccgtaaatgacattctatgcttctcttgttggatacacgggaagaaataa

SEQ ID NO: 74785 - DNA, 1065 bp, Heterodera glycines
  Genomic contig location: Contig_ID=SeqID_11395; Location=97..1161; Strand=-
  SCN-specific regions: Sequence locations=1-153,181-253,282-374,398 -1065
atgaatcgcagatatggcacagttcacaacactgatcgcgtctgtcgctcagcttctctgctagctagatctaagggaaacgctaaaacagtaaataattcggtaagatatattatgtttcaaataatttttacttaagagaaagagaaaatacaaagtgaaaattcaaataaaatataactgattcaaaatccatacaagataatgatgccgaggcaaatgatgaaattacagtagttcacgatcaagacggttttaataataataatcaaaaaattaatgcatatttaaggacccaattctgcaattttatttaatccaatgaatttaaatgaaatggaggaattttgcgataaatgggattataattatggtacttttttaaaaatattgttaaactgaattgaaattaagttgttccaaatttcgaattcgcaaaaaatcttcaaatagatccggatacttatagcccaggtatagttaagaccgaagcaactctggctaaggacatgtaataatatttaggaaagcgcgtgtcaattattggtgatggtaactgtttttatcgagcgctttcgttgctactcactggagacgataattacaatacagcaaaagaaatatgacgagatttaatggaatttttggaagaagaactttatcagcataagcaagggattgaaaaccgaaattggtggcaaatgttttatccccaaatcaatgaactagaagaatatatacaaaatcataatactccggcaatggatgcatctgaaactttcagatgggcatcaaacatagattttttgacagctgctaaactttttaatataaatattgttgtgtgcagtccaaatgttcaaaatgataagaattcaatcaaatatacctgggctagttattctccggacgctatttcagtaattttcattttgttaaaaaaataatattaatctttagattctatcaaagcaaaaacctgatacaaaatcactatttatttattatgataatagcggacattttgaagcaattgttgatccgaaaaaaattgaattcttttaa

SEQ ID NO: 74786 - DNA, 660 bp, Heterodera glycines
  Genomic contig location: Contig_ID=SeqID_1607; Location=3107..3766; Strand=+
  SCN-specific regions: Sequence locations=1-660
atggacgcacaacaacttcagcaaattttggacgcggctctaaaaaaatcagcagaagtttttgccgccgcactcaacattcaaaatcaaaacccaaacccagggtcatccacaacggcatcacttgcggcatcaatcaatgcccgcctcgaaaaattcaattataatccggaggttggacagacatacgatgcttggttgaatcgatacggaaaaatcgttcaacaagacggcgcttcgctcccagagcagtccaaagtccaacttttggtcggaaaattagacgaggaggaatacaaacggtacattgacagcattgcccctaaagccaccgaacaattcaactggctcgaaaccgtggcaaatctgaaaaagatttttggtgagacgaggtcgctcttcctccaccgtttcgactgttttcaaattcgccaaagccaaaaccaagacctttcgagtcttttggcacaaatcaattcatcgtgtgaaaacgccgaattggatttgactaaagaagagctaaagtgcatgattctcatcatctctttacgcgacgaattttcggatttgaaacagcgatatctccagcgaatggaagaagcccgaaccaatgggaaaagcatcaccctacaggaattgggcgaagaatgcaaaaagtag

SEQ ID NO: 74787 - DNA, 4269 bp, Heterodera glycines
  Genomic contig location: Contig_ID=SeqID_1608; Location=577..4845; Strand=+
  SCN-specific regions: Sequence locations=1-1372,1394-1869,1891 -2091,2115-2508,2531-2643,2665-4269
atggacgcacaacaacttcagcaaattttggacgcggctctaaaaaaatcagcagaagtttttgccgccgcactcaacactcaaaatcaaaacccaaacccagggtcatccacaacggcatcacttgcggcatcaatcaatgtccgcctcgaaaaattcaattataatccagaggttggacagacttatgacgcttggctgaatcgatatggcaaaatcgttcaacaagacggcgcttcgctcccagagcagtccaaagtccaacttttggtcggaaaattagacgaggaggaatacaaacggtacgttgacagcattgcccctaaagccaccgaacaattcaactggctcgaaaccgtggcaaatctgaaaaagatttttggtgagacgaggtcgctcttcctccgccgtttcgactgttttcaaattcgccaaagccaaaaccaagacctttcgagtcttttggcacaaatcaattcatcgtgtgaaaacgccgaattggatttgaagaaagaagagctaaagtgcatgattctcatcatctctttacgcgacgaattttcggatttgaaacagcgatgtcttcagcgaatggaagaagcccgaaccaatgggaaaagcatcaccctacaggaattgggcgaagaatgcaaaaagtaccaaattttgaaggaaagcacattggcactcagcacaaaacagtacaatgccaatgccattcgtgccaagccacaacaagtaaaggacaaggcagacgcaacaaagcaatatgccaaaccaaaagcggttccaaaaccgtatgagagcaagcacaaattgccaaaccgtccatgccaatcatgcggaagcacaaatcattggcgctccgattgtgggcacagagatgccaaatgcccaaaatgtggtaaaatcggacatctcggcaaagtttgccgaagcaattcttcaattcgccacatccaaacggtgaatacaactgaaaggcatgcacaaatcaacacagtcatcatcgacttaaattgcatggaaatcaaagcagaccatccaaaatggtggaaaataccaatcaaagtgaatggcgcagattatccaatgcatgtcgattccggcgcacaaatcacattgttcacaatccaaacatggattcaaatgggcaaaccgcctttgacgtcagcaaatattcgcgtcaaaaattgcaatgaccaaacatttgcaattaatggacaattcatgtgcaaagtgcaatacatggatcgtccaccaatgaaattgttggcatatgtgagccccgaaatcagtcataatttattgggcatgccatggatagaagctttggaggtgatcccaaaagagattatgcatccaaatcttcatccaaaaatcaatacaatttcaacgaaaaccaacgaaatcaaagacacggagacattaatttcggcgctcaaatcaacccactccgatgtcttcagcccagaattaggtcattgcaccaaattcaaggccaatctcattctgaaaaacggtgcaaagcctatctattgcaaggcaagaccagttccacatggcgctttggacactgtaaatgccgaaattgatcgtctactgaaaatggaggcaataaaacccatcgaatttagccactgggccgctccaattttggcagtcaaaaagaggaatggcaaaacacgagtgtgtatcgatttttccatcgggattaaacgacgcacttgagctacaccgccacccactgccacgtccagaggacatttacaatgcaatcgcaggctctaaatatttctcacgcctcgatttgcgcgacgcttatctgcaattggaattgtctgatgagtctaaaaagctgtgtacaatcaacacacaccgcggactcttccaatgccagcgtttaccgttcggcgtaaaatcagcgcccgcaatttttcaaagtttgatggacaaaatcattacacccatcaatggcgcattcgtctatctcgatgatgtgatatcgccaacacgactctcgaccaacacgtcaaaacgattaccaaagttttcgacaaaatcaaacaattcggtctccgaattcaactggaaaaatgcagttttcttcaaaaagaaaccgttttccttggttacataatttctgaaaatggcatccgcccggacccatcaagagccgaggctattcgaaaaatgccagcgccgcacgacaagtcaactctacggtctttccttggagcgctcacatactacggcaaattcatcaaacaaatgcgcgaaataagaagcccattagatgaattgcttaaaaaggatgtaccgtggaattgggaagatgaacaacaaaaatccttcgagaaagccaaagaaattatgctttcggatttattgttaacgcatttcgaccccaaattgccaatcattgtggccgctgatgcttcaaaaggaggaattggtgcaacaatcagccatcaatttcccgacaaaagggaacgtgtcattgaacacgcatcatgcactttcacggctgcgcaacaaaattacagccaaatcgaaaaagaggctttaggattggtgtttgcggtacaaaaatttcaccgcatgctctacggcagaaaattcactctgttgaccgatcacaagcccctactggcaatcttcggatcaacaaaaggcattccaatatattcagccagccgacttcagcgctgggcgttaattttgtcaaattacgaatttgatattaaatacgtcaacacaaaggcattcggaaatgccgatgtactttcgaggctcatcgcaaattacccgaggccatcggaagacatactcatcgcaaacatctgcaacgacactgattgctgtgttaattttgtttttgaggcaaaaattgagcaacttccgatcaccgcgaaaataatagcggaggaaacagcaaaagacgaaattttgcaacaaattagcgctttcaccaaacaaggatggccacaaaagctgaacgacattaaattgtctccttttcttccaaaaaagggacaaatatccgaaatcgaaggatgtctcgcctacggtgaacgaattatcatcccttcgtcactccggaacaacatcctcaaatcattgcattttgcacatcccggcattgtgcgaatgaaagccattgccaggaaccacgtttactggcccggaatcgactccgaaatcgaacgagtggtcaagcaatgcgaggaatgtcactcagccgccaaaaatcctacaaaagcgaatcttcagccatggaaagcagcaagcgaagtttttgagcgaattcacattgatttcgccggcccatgtgctgacggccaaacatacctggtattggtcgatgcttactcaaaatggccagaagtatggcaaatggaaaggacttccagccaactcaccatctcaatgctaaaatcattcgtgcatcggctcggaattcccaaagaaattgtctccgacaatggaagccaatttcgatccgccgaatttgcacaattctgcaaagaattcggcataaagcacacctttacgccgccgttccacccaatgtcgaatggggcagctgaacggtttgtcgacatttttaaacgatcaatgaaaaagtgccgtcaagagggaaaagattggcttcaaaaagtgcttttggcgtatcgcacgacaccaaacacggcactcaacggccattcgccagacgaacttttcctaggacgccgcatgcgcacaagaatcgcacttgtccatccggaaaaacaaaaactccagccaccaaacttggaaaattttcaacaattccaagggcagtacatcaaaaagatggaaaaccaattcaacataaaacatggagcaaaatcagccattttccaaaatgaggaaccaatttatttttggaatttgaaatacaataaagccacttggcttccgggaaaaattatcgaaaaattaggcacatctccgacgtatcgcatcttggcaccgacgcttggccgagccattcatcgtcatgccaaccaaatcaggcgacgtttcccaattgaattggaggacaatgatcaagttgaagaaaatgatcagacacaggcacaaaatccgccgcactcgccgatcgcgcataaaccgcagacgaatcgccagcaaacgcccgccgctgagcccgtgcatttgcgccgatcaggaagagccaaacaagcacctcaacgactggacctggacccgtcaaagcctaaatacggcttaatccgatcatga

SEQ ID NO: 74788 - DNA, 742 bp, Heterodera glycines
  Genomic contig location: Contig_ID=SeqID_1609; Location=28..769; Strand=+
  SCN-specific regions: Sequence locations=1-54,76-517,540-651,680 -711,740-742
atggaaaaccattcaaacataaaacatggagcaaaatcagccattttccaaaatgaggaaccaatttattttttggaattgaaatacaataaagccacttggcttccgggaaaaattatcgaaaaattaggcacatctccgacgtatcgcattttggcaccgacgcttggccgagccattcatcgtcatgccaaccaaatcaggcgacgtttcccaattgaattggaggacaatgatcaagttgaagaaaatgatcagacacaggcacaaaatccgccgcactcgccgatcgcgcataaaccgcagacgaatcgccagcaaacgcccgccgctgagcccgtgcatttgcgccgatcaggaagagccaaacaagcacctcaacgactggacctggacccgtcaaagcctaaataccgcttaatccgatcatgaatcccaaatcgagggacattcgacttaaggagggaggtgttggatagggatcaaagatcactttcccatcattgttatcgactattctctctccccctttctctgtccaacactatttccattctctctctctgcctatctcctccacatttctctgaccccacgtctttataagtgcgtccattccctcactcatggctctccgctccattcattggcattggacatttatttattattttattctcctccgtcgctgcactcctccgacctcatcaatttgtgcatttatttttatttgtgtttatta

SEQ ID NO: 74789 - DNA, 2910 bp, Heterodera glycines
  Genomic contig location: Contig_ID=SeqID_11398; Location=528..3437; Strand=-
  SCN-specific regions: Sequence locations=1-708,730-1114,1137 -1212,1234-1793,1815-2348,2371-2910
atgaggacagccgaatcggagatgcgagggttagtgaaaactacacgtgaaaatccgtccacaacacggggatatctgcatcacatatgacatccagaatacagctattgagagaaaaataagacgaagagaaatacaaaaggaacgccgacagcattgcccctaaagccaccgaacaattcaactggctcgaaaccgtggcaaatctgaaaaagatttttggtgagacgaggtcgctcttcctccgccgtttcgactgttttcaaattcgccaaagccaaaaccaagacctttcgagtcttttggcacaaatcaattcatcgtgtgaaaacgccgaattggatttgaagaaagaagagctaaagtgcatgattctcatcatctctttacgcgacgaattttcggatttgaaacagcgatgtattcagcgaatggaagaagcccgaaccaatgggaaaagcatcgccctgcaggaattgggcgaagaatgcaaaaagtaccaaattttgaaggaaagcacattggcactcagcacaaaacagtacaatgccaatgccattcgtgccaagccacaacaagtaaaggacaaggcagacgcaacaaagcaatatgccaaaccaaaagcggttccaaaaccgtatgagagcaagcacaaattgccaaaccgtccatgccaatcatgcggaagcacaaatcattggcgctccgattgtgggcatagagatgccaaatgcccaaaatgtggtaaaatcggacatctcggcaaagtttgccgaagcaattcttcaattcgccacatccaaacggtgaatacaactgaaaggcatgtacaaatcaacacagtcatcatcgacttaaattgcatggaaatcaacgcagaccatccaaaatggtggaaaataccaatcaaagtgaatggctcagattatccaatgcatgttgattccggcgcacaaatctcattattcacaatccaaacatggattcaaatgggcaaaccgcctttgaagtcagcacatattcgtgtcaaaaattgcaacgaccaaacatttgcaattaaaggacaattttggtgcgaagtgcaatacatggatcgtccaccaatgaaattgttggcatatgttagccccgaaatcagtcataatttattgggcatgccatggatagaagccttggaagtgatcccaaaagagattatgcacccaaatcttcatccaaaaatcaatacaatttcaacgaaagttaaccaaatcaaagacacggagacattaatttcggcgctcaaatcaacacattccgatgtcttcagcccagaattaggtcactgcaccaaattcaaggccaatctcattctgaaaaacggtgctaagcctatctactgcaaggcaagaccagttccacatggcgctttgaacgacgtaaatgccgaaatcgatcgtctactgaaaatggaggcaataaagcccatcgaatttagccactgggccgctccaattttggcagtcaaaaagaggaatggcaaaacacgagtgtgtatcgatttttccacgggattaaacgacgcacttgagctacaccaccacccactgccacgtccagaggacatttacaatgcaatcgcaggctcaaagcatttttcacgtctcgatttgcgcgacgcttatctgcaattggaattgtctgaggagtctaaaaagctgtgtacaatcaacacacaccgcggacttttccaatgccagcgtttaccattcggcataaaatcagcgcccgcaatttttcaaagtttgatggacaaaataattacacccatcaatggtgcatttgtctatctcgatgatgtgattatcgccaacacaactctcgaccaacacgtcaaaacaattaccaaagttttcgacaaaatcaaacaattcggtctccgaattcaactggaaaagtgcagttttcttcaaaaagaaaccgttttccttggccacataatttctgaaaatggcatccgcccggacccatcaagagccgaggctattcgaaaaatgccagcgccgcacgacaagtcaactctacggtctttccttggagcgctcacatactacggcaaattcatcaaacaaatgcgcgaaataagaagcccattagatgaattgcttaaaaaggatgtaccgtggaattgggaagatgaacaacaaaaatccttcgagaaagccaaagaaattatgctttcggatttattgttaacgcatttcgaccccaaattgccaatcattgtggccgctgatgcttcaaaaggaggaattggtgcaacaatcagccatcaatttcccgacaaaagtgaacgtgtcattgaacacgcatcatgcactttcacggctgcgcaacaaaattacagccaaatcgaaaaagaggctttaggattggtttttgcggtacaaaaatttcaccgcatgctctacggcagaaaattcactctgttgaccgatcacaagcccctactggccatcttcggatcaaaaaaaggcattccaatatattcagccagccgacttcagcgctgggcgttaattttgtcaaattacgaatttgatattaaatacgtcaacacaaaggcattcggaaatgccgatgtactttcgaggctcatcgcaaattacccgaggccatcggaagacatactcatcgcaaacatctgcaacgacactgattgctgtgttaattttgtttttgaggcaaaaattgagcaacttccgatcaccgcgaaaataatagcggaggaaacagcaaaagacgaaattttgcaacaaattagcgctttcaccaaacaaggatggccgcaaaaattggacgacattaaattgtctccttttcttccaaaaaaggcacaaatatccgaaatcgaaggatgcctcgcctacg

SEQ ID NO: 74790 - DNA, 499 bp, Heterodera glycines
  Genomic contig location: Contig_ID=SeqID_11399; Location=378..876; Strand=+
  SCN-specific regions: Sequence locations=1-15,38-391,421-499
gaaatttgcattgaccaacaagcattttattatgttgagcatttggtgttccaagttgaatggattgcatcggacaaatggtcgacaagtgcacaaatcaatgagcacgaccaaaattttttggcacaaattggccaaattctttccatttcaagggcaaacaaaatagaggacagtgaacccccaattttatcatactttgagttgaacgcccccactctgggccgattgaatgctttatttggacgattgtgccaaaattggcaaatttttgtggcaaaatttaacgacaaaaacactaaatttaacgcatggacgaaactgtgcaaaaagaatgtgtttaaggacttttatcagcagaaatgatggaacaatttgaagagatggcaaaagttattttatttatttgtttattatcttatcaagttgtaggaaaaagaaatataaaagcagacaaatagccaaatgaaagagatgcgaattgtatccccaaatccaa

SEQ ID NO: 74791 - DNA, 1995 bp, Heterodera glycines
  Genomic contig location: Contig_ID=SeqID_11399; Location=1850..3844; Strand=-
  SCN-specific regions: Sequence locations=1-239,261-304,327-739,761 -1133,1155-1359,1382-1756,1778-1907,1937-1995
atgcgtgccattctcagcggatgcgatgcagtcgaattgaagcgtttgctgggagctgagcagaatggcgcgactttgctggacgtagcggcacaaaatgacaaaacggaggtggccaaacttttggtagggcaaacagtaattcaatttttcgttttgttgtttctcgaaaccattgaccagcagtgggacggttttcagaatttggcgtggaggggactccacacccgggcacaacaattttattatgttaataagcaatttttaactagtgttacccctccccccccccccctccgagtttaaaatttcttaaaaaaccgaaatttggctgaccgaagaattcccaacgggtgtaaagagcgcgcgggcggactgatcattttttgttttgtccttctcatgggttgtatttgtttttttttcacttttttagttgtaaaaaggcgcaattcgtccaaccgatggcaccgattccgttacaattcgactcgtcacgatgagtcagtgtgacagatgccgtctcattgattcatttttttatttttccatttcaaattcagacaaactttcgccattttgggctgcgcttctcagggaacagacaaaactggtggaaattatggtaataggcacaacaattagttgttaaatcgctgtattcctgcttttcagttggaaaatggacagaatcccaatgaatttggcacttttattcgcgacaaaaagaagcaaagtgagtcattgtcttcaaaagtgcgtcccccttttttatggttggggtgatgtgtttaccggggtgttttgttttgaaaagcgcgccgcaaaaaacgtttttaaaatcaaaaagaaggtcgtccatttacatggctgaatcctttcgccaaaatttctgtctgccccccccctttttcatatgatttgaacttcctttaagaccttttttcaccactccatttcgctgcccaaaaaggcaatttggcgctgtgcaaattgttggtcgcgaagagtgccaaagtgaatcagaggagtaaggacaaacgtggcattgtgcctttgcacattgcgtgtggcaatggccatttgccagttggtcagtgacccaatatttaatgaaacagcaaaatacccttaatcaaagacaattcatttctattcattcctccagtcaaattgctcgttgaggagggcaacgcggacatcgaaagcactgattcggagggggacacgcctttgcactgggcactgttgaagcacaatttcgaaattgctcgctttttgtctgacaaaggcgcgcgcactgatcggcccaacaaggtgagttaggaaaaagtaacaaaacaaaaatatgtttttcacgctaaaataacttttttgtaattgtggtcaagtgctggcaggataactggtggtttgagtccgcgtggtttagaataatttttttttcggggcgcagaacacaaaactaacctccatttcgaccccgaattcgaacaaataaattttttaacaatatttacgggtacttctaggttttgtcacctcctgaaatttttgatgctgatcacgaatctgacctttatttttagccataacatgttttacgtgaaaaatttaaaaaggtaaacagtgccgatggtgccccacccctttcgaaaaaaaatttcaaaatttttttctcggagcaaagtcttttaggggttttcacggtcggagaatccgattcttacatccatttcgacccaattcgaaccttgaacccgaattcgaacaaaaagtcgaaacttaaaattttttctagtttcgcatttttggttcaaaccggcttaaatgtaaggaaacaaattaaaagccatcaatgatgttttttgattaggttttacgaaatttgttgcctttatgtcgcctaattaaatatttttatttttaaatttttcaccttttcacgtaaaatttcacgtaactcatgtaaaacacgttatggctaaaaataaa

SEQ ID NO: 74792 - DNA, 342 bp, Heterodera glycines
  Genomic contig location: Contig_ID=SeqID_11399; Location=4177..4518; Strand=-
  SCN-specific regions: Sequence locations=1-17,50-321
atgttgcttcttgtcgatttcttcgttttctttctcttcgtcctctgtccgtcctttgtcattttctgcattttttcgactttcgcttctgatgggctcaaaaacggcacggccgacaacagcgaaagtggcagcatcgtcgatggtcagcagcgacagagttccgccattgtcgccgctgtgccctctccgtcctctactgtgtccgtcgccaacctttcgccaatggcggcggcatttaatgaggcgattgttcaaacggagcagcaaccaaaagcgaccggcactcaaaacaaagtgatggccaatgagagcgaaaaagtatggcaaaacaaaatttag

SEQ ID NO: 74793 - DNA, 647 bp, Heterodera glycines
  Genomic contig location: Contig_ID=SeqID_11400; Location=259..905; Strand=+
  SCN-specific regions: Sequence locations=1-59,83-110,132-322,346 -454,484-506,557-622,644-647
atgagatcaatttggagttcattttcatttactatccgtccattagtatgactagcttttaaaaatattttgtattttcatacattatttaattagaataaagctaaaacaatggtttagaaattttagaggccggtttatggtcaaattaaggttcattttatcaaatttttgtgaatgataaaccaaagtcttacattcataacctttgcttggcactttcttttggcgaattcaatttaaactcaagaatttcagacgatcaaaaattgtgtaaaatcatttatgttaaacggcgttcttttggcacacaacgccggcgaggttggcacggtcacactgaatgtcgttccaccagccgcacgggtgccacatttggacacactcttccgcgggctcatcatctgcgaatattttaattagtagggttgcaaattatatttgagaaaaacgcaaaatatatataaaatatgtaaaaaaaaaccaaaaaatgacaaaaactgcacaatatatacaaaaatatgtaaaaaaaaaaatattttttatgattttttaaggcaaaagttcatagaaagggataaataaggacaaaaatggcataataacctaattagctgaaaataatgttttaggtatttttaaaccga

SEQ ID NO: 74794 - DNA, 171 bp, Heterodera glycines
  Genomic contig location: Contig_ID=SeqID_11401; Location=740..910; Strand=-
  SCN-specific regions: Sequence locations=1-29,51-171
gcacaaaagatttgtgccgcgatgggaggccaaattgtgtccattcattcggaggaggagaacactttggtggcacggctgatcgacgaggattacatgctgtgcaacggagtcaatgtgccgttggcggaagcgccgaaaatggacgcaatgcgagtggaaaattattaa

SEQ ID NO: 74795 - DNA, 472 bp, Heterodera glycines
  Genomic contig location: Contig_ID=SeqID_11402; Location=68..539; Strand=-
  SCN-specific regions: Sequence locations=1-53,91-332,376-472
atggaaaagctgaagcaacaaacagttgctccatctgccaatttcgatgacggtattttaaatacattataaattaatataattaaaatagaaaatgacaatcaaattaattaccaaaaaaaaatttgaaaagaacagtaaattaaatacatattaaatttaagccgaaatctgctggatctcttggcttggctatgagccacccagcaatttggaagggggtaagtcatttaagggcatttctgagatatttttatacaaatttaaagctgacaaatgggacaattggcatgctttaaacaacggatggccaacggaggagacggacgaacaaaaggaaagggtgaaaatttgggtttttggaattttaaatttggcatttgtttttcaaaagtcaataaaattcagagtccaagcaaatgggtgctcgaattgttgcaagggatgcgcaattttttgtctgacaaagtga

SEQ ID NO: 74796 - DNA, 214 bp, Heterodera glycines
  Genomic contig location: Contig_ID=SeqID_11403; Location=46..259; Strand=-
  SCN-specific regions: Sequence locations=1-72,164-214
atgcaaatacgacattggcaaatattgcgggaatcagaagggcgacaaagtgctcgactgtttaatggtgggaaaaaaataattaaaattcataaaaaaattgtaattaatatttaatttatatgaaaattatataaaattcaaaatttaatatttttattttccaatttcagaatacaaaaattgttcgactgcttcaaaagcgctgtcttaa

SEQ ID NO: 74797 - DNA, 800 bp, Heterodera glycines
  misc_feature (778)..(778): n is a, c, g, or t
  Genomic contig location: Contig_ID=SeqID_11404; Location=1..800; Strand=-
  SCN-specific regions: Sequence locations=1-110,134-730,752-800
  Gene Ontology: Cellular component=integral to membrane
gtgcaatacttcatgtcccgtgactggtcgttggacccgcaactgtacgaggcgtgccaccaagaggcagtgacgcggtgccatgccacagacaattggcacgaaaataccaacaaattgccaggacaggaccaaaaagtggtggtggacccaggaccacaggtaagccagccagccacctatcgcgactcaatgcgctgagtttgccccataatttacaaatttattcaggtgcttgcctgtctgtaccgttcaggtattcttgtaccgtacacccgtccattcatactgtataattggaaaaaaataaaaattcaaaggttacgatgaggcgaacccattgggcaaggagtgcgcgttgcatgtgcgccgagtgttgcgcgagcgtgcggcacgtgtcaatctgctcccggacattgaggagaactgtagggacgcactttcggaatactgtaagtacatttgccattggcacataaaaagaagcatttttgatttaactaattgatcgccaactgatcaattacggtttttttgggcaaaattgggaattccttggacaattaaacttgtggaatcctcgtcagacctagccaagaaatttagaatttttaacaaaaattgttgcgataatcgttttcctaatattgggaaccaccaatgcaaccgatcactattagctttgatcaaatgccgcctgatttttccgattcaactgccccattaaatatttaaaattaatccttttttccatttttcataggctcccaaaatgtgnaagccgacggaggagatgcact

SEQ ID NO: 74798 - DNA, 3230 bp, Heterodera glycines
  Genomic contig location: Contig_ID=SeqID_11405; Location=1..3230; Strand=-
  SCN-specific regions: Sequence locations=1-173,229-393,416-651,674 -846,871-1261,1285-1354,1397-1433,1459-1516,1545-1588,1616-1670,1692 -2018,2044-2117,2139-2396,2418-2431,2454-2556,2579-2926,2948 -2953,2976-3230
  Gene Ontology: Cellular component=integral to membrane
tttttctattgtcgatagccgacgtttttctctactcacacgaatggcggattttacgaaacgatctagcatcgatctttagtgcaaaatgtgaaaaatgtaattgtttcttgactaaattaaattttaaatagtgtagcttcggctcacaacgtttaattatgtagcgagtgttttaaataatttatatagatattattaattaatttggattaaaataattattttgctttaatttgatcacttgcacttttcgtacttcgtctcagcccatctaattgttttcttcaaattaccattttttaggttgtaagttgtttcgtcggctgtcgtcactttgtctgcgaaaattgtcttttgaattttttggatgacaattgtccaaaatgtgcgcaaaacactggaaataataacaacacaaagtcgtgctttcttccgccaaaatgtttccaatcgtcggcaccgtgacaaaatggcacatttatttatttgatcactgttcgattgataattagggatgggatttctaagtttttacttattttttctgcggctttaactcaacgagaaatacacgaaaaacacattttttgtctgaaaattttgcgttttcacgcccttattcgaccttagaaatccttatttttgatgttcgcccttaaaaatccttattttggatgttcgcccttaaaataagtttttgccctgatttggcgttttgtccaaaatttattaacaaaaatgcaataaaaaacgaaaaatacacccctaagaatcgacccaaaaaaatttcgaaaaaatatacccctatgaatcgacactaaatttttcaaaaatagaccctaagaaatgaaaaaatttttctaaaatatagcttatttgtaactgcaatcagtgaataaaattgtttgccttagtctgaaattatttcatgtaaaaaacagcaattttaaaaattataccctaaatttgactttttcgaccttattttcgcccttatttcgcgaatttttcgcccttatttacggccttattttggactttttcacccttaaaaatcctatccctacttatgaaatttaatgaacttttctaattttgccaaattcaggctccaccttggagtgtttgatcggctacatggtcaatgtgccaaaggatgcgtacaaagccaaaattgtggagggcatttcgcaagagtgccgcaaggaagtgatgcgagtcgcggagctccagtcggacgactggcatttggacagtatgccaaatacaaaagaaaaatttgacaaatttcaaaaatgccgaaagttcagggccgcttttcttcgcttgtcgcattgacagagaggtgaagaatttaaaaataaaaattttaaaatattatttcttaatttttcttacaattttcagagattttgtggcgaaatccccgcgggggagggcaaagtgttccattgtttgatggagcacaagcaggacgagaagatgtcgccacaggtgggccaatttaaaaaggaattaatgtttataaatatttattttaagtgctcaaaaattttgtcggaacgagccggactaatgggtacggtaacacatttttacagaaatatttttcgttacctttcacttactgtaaaaaaatgcgtaatttaaattatctccatttattgggtcacattttctggaaatttgaatttaaatcgtcgtcaaaaatttgctttgggccatggaattgcgcaaattaactgtaagatgctcactaaattttcttttatttttttacaggccgtgactacaaattggctcatccactgctgaaatcttgcgacaaagagttgcaggtcaaatccaattcaattttaattacaaaatatttccaaattattaattaattttccactggtttaggcttatcgctgtgtgccgcagccgggctttgaaaaatcgctgcagttccacctcagctgggtggtgttgtgccttgaggtgtattgtacaaaactcaaaatcattacggcaaattattttttaaatttaattttagaatggactccactatttcaaaacgcaggagcacgagcgcaagaaggcggaggaggacaaaaatgccaaacaacgccaatggcccaaccttttggcattcactgatgagtgagtggggcgggggggggaggaacatgtgaatgggaaatgagtcagtggaaattcgtcatttgtcagaatttcttgaaaaactgagacacattaaatatttcggtatgtacctgttactgtatgcaaattataagcgtgaattcacacaaaatgttaacaacttacaatccagggatatagcggaaagtttttgccggttcttggacggattcggcattttacctgaaactcataaattccaaggaaaaaacccgaaaaagtgcacaaaatttttatagattttcagcatttttggctatccgaattaaattaggattgaacataggggagacaacagcatgcttcatttccgactttttgccgattttgccatttaaagtccgtgtcggcaatcggataccggcattttgtttgtatatcagttcattatagtcagaatttttgaatttttttacaaaatatactcaaagagaaaaatttcattggaaatttattgaattacggattacggaaaattgccgactaagacccaagaattgacaaaaatcccgcattcctgctttcaatgaccaaattaaatgaattgacgaattccaaatttgattgttatgcatttcaatctttcgcactacaatacttaaggttacagaatcttattttaaaagtcattctcactttcaaattttccactgacggatttattttccgggagtcggagaatgacagtataatttcgatagacacaaattatattaattaattagtgcaagtaaatgcattttcttattttgttaattttcatccaaacacaactttacatatggacattttaggggtttaaatgtaagatttttttgacgataaaatcccatccccaccgatcacaggtgtcagcatgagatgatgacacatcgtcaaatgatggtccaagaattccgcatgtcgccagaaattgtgatgggctgtgcccaagaaattgacaagtactgctcgccacagggcgacattgagtcggagggcaaaacggtgcactgtttgatggcacatgcgcaggagagggacgagaaaaaggtggg

SEQ ID NO: 74799 - DNA, 719 bp, Heterodera glycines
  Genomic contig location: Contig_ID=SeqID_11406; Location=436..1154; Strand=-
  SCN-specific regions: Sequence locations=1-113,145-392,415-592,614 -622,645-719
atgtatcgccaatgcaaatttgcatttgaagcggatgaagttcggtccaaccgatgtggctcaagctttcacattactcctgacgaaaaagacttgcagattattgaaattagtaattaattcattttttaaataattaattaagaaaaaacattttctcagattgtgacactgtcaatgggtccgactgtggcaagaaggcaaaaacaaattccgaagcgccaattttgtggccaatttgctgactttaatttcaccatcattgaggtccgattgtgccaaggaccctaattcattatggcacaaaacaaattatttactcatttttagggaaaaaaatcccaaataagtcgtttaaaaattttttttttgcaacaaagaaatttggcataaaaattgtaaattctaactttattaaacttaaatgtacaattatttcggtacttttccgtttggggctaagcccgtaattcagcgcccaagagcaaaaacaggaatttgtactcgctttcgccaaaaaagactacttggcggtgccgatagacgccgccggaaatttttttttttgaaattttagtacattttgttaaggaaaattgattaaaatttcttagaaattgccattttttcacaaaaaagcttattaaaaaccacaaaatgatatatatttaaatcttaatcttcgggccctttgggtaatatgatttttatttaataaa

SEQ ID NO: 74800 - DNA, 342 bp, Heterodera glycines
  Genomic contig location: Contig_ID=SeqID_11406; Location=1..342; Strand=-
  SCN-specific regions: Sequence locations=1-98,156-269,301-342
tgaatataacgttcaccccatttaaacgaatacaaaaaatgcaaccaaattattacgttgctttgtatggaaatggaaaagaaccgcaaaattcagccaaaaattatgtaaaaataatatattattatttttaaattttaatttaaattaatttagcgattattaaacccaacagtggatttaattgacataattggtgaggaaacaaattgtgctgaatttacgacggacaaaagttgtaaagtatgaaaaatagaaaacattcagtcattttaaaaaatatatatattttttatttaagcgtatcaaaaatgataactcaatcatcttggacggattggt

SEQ ID NO: 74801 - DNA, 392 bp, Heterodera glycines
  Genomic contig location: Contig_ID=SeqID_11407; Location=1166..1557; Strand=-
  SCN-specific regions: Sequence locations=1-173,212-392
atgaccccttcatcagcggacacaatttgtgccccaatttccattaaagttgcttcagtaagtgccaagcatgagctaagccaatggtcaaatgcggtccaattggagccggatgggccacaaattgccggaaaaatggacattgtgcacgtcaaattcaatgtgcaaaaagcaattttaaataaattaaattattattttttttaatttagagcaccccatttaattatgatgattatctctcaaatgccacgcttgacattgaattaaggttcagcatgaattcaggctggttgcatgagtttgaaaaaattaaatgaaaaaaacccttctaaagaaacaaatatatattaaaggaaaatgattaattttcaaaaaaatatagaaataaa

SEQ ID NO: 74802 - DNA, 394 bp, Heterodera glycines
  Genomic contig location: Contig_ID=SeqID_11407; Location=1880..2273; Strand=-
  SCN-specific regions: Sequence locations=1-48,71-207,239-369
atgctggaaaaatgcaaagacattggattacccgaagattttggtgacaaaaaaggtcatcatcagaaaatccaagtcccaaaagatgttgaggtaattttttctcatttcatttaaaattcttcccgagaaatttaaaattttagattaaatttttctattacggttttttgaaaaattttttacccaaatttttaagtcattagcattaattaataaatgatttaattaaaatttaggcaatttataatgagaatatgacgattgatttgagttggagccaaacatctgctccgaatggtgaactgaccaaaatttatttgctgcaaatggagactgaatttccgaatcggcaaatttcacaaattgtaattttaaaaaataaataaataaa

SEQ ID NO: 74803 - DNA, 561 bp, Heterodera glycines
  Genomic contig location: Contig_ID=SeqID_11409; Location=670..1230; Strand=+
  SCN-specific regions: Sequence locations=1-160,194-315,347-378,415-561
atgtattctcctttgtttaaaacctctttgcctaaaagctctgtatctgtggaaagtcgtcgaaacaccatctaccttttgaacccaacgggcactgttaaaaaaatgtgtcgtggggaggctgcacagccgcagaaaggggcggatgccacggatgtcaagcagcagcagcaccaccaccagcagcagcagcgaaaacatcaggtttcgagcagcattttttgatggctttttaaaatgtaatcgtgttaaacctgcaggggactgaagccatccgagcggcggagaaaaaaggggcggatgccaccgatgtcaagcagcagcaccaccaccagcagcagcagcaaatgaaaaaaggggcggatgccaccgatgtcaagcagcagcagcaccaccaccagcagcagcagcagcgacaaccaatgaactgggcaaagggaatacggggggaggatggaaagtggtgcggactctgcaaggttgtaaaccattggccacacgaatgcccactttatctgaaccagcgtgaagacggcggggtgggtatatgtttgtaggtga

SEQ ID NO: 74804 - DNA, 526 bp, Heterodera glycines
  Genomic contig location: Contig_ID=SeqID_11411; Location=1188..1713; Strand=-
  SCN-specific regions: Sequence locations=1-54,90-191,214-253,280 -306,328-526
atgaaaagtaaattataaaataattttacttaggtgttacataagttttgcaccaaaatttttttaataaaaatttatttttaaaaattcaacaaaaaaagattcaaaatttgtcctttactatcgataagatgttggcattttcaggcaaaaggtcaatagaaatggaaaagtcaataaggagttagagttgataaagtaaaaatggtcatttttggggtaagtatttttgaaggctgatttaaagaaaatgaaaatatacacataaacatagaaaatgtgaataatgaatctccaaaaacggcatttttcaagaccatcaaataacaaaatgtttgaagtggtgttgggaattcctaaactgggtaaattgaccacgctgagtccaaatatagccttagatttggtctctaggttctcactaaacctgtacagctccaacttcatgaatggagttagagcagtacaagctcaggttgaataaaatgcataattcttgcttgaaataatcatttgtaataataaa

SEQ ID NO: 74805 - DNA, 778 bp, Heterodera glycines
  Genomic contig location: Contig_ID=SeqID_11412; Location=209..986; Strand=+
  SCN-specific regions: Sequence locations=1-477,502-778
atgcatattgataatatgcttctcttccccaattgttatacatgtgcgaaaaaaacgaagaaagagtttgtgttggctaaggatgtcaaaaaatgtaaccatcggccagagcggagagctttgattggtacattcacttcgatagaactgcggaaatccttggcgttgggatatagagtaataggcttctatcgggcctatcactttgagcaatttgacagtcagctgttcaaaggatatgtgcgcatgttcttgaaaataaaggtggaggcgtcgggctggccctcggaggtgagaaatgaggaggaaaaaagagcattcatcgaaatgtacaaggccaagtacaacatttggttggaatatgataaaatggtgtttaaccatgggctacgtatgatcgctaaattggtgagaaaaacaaataaaattcaaaaaacaaataaatattaagggattgaacagtttatgggggaaattttcaatgaggaacacactttctgtgactgagattgttaataatttggaaagatggacggagctcatcaaagatgacacgattgagtttaaaagaccgattgagataaatgagggtgtgatgagagcagtataccagaagaagcaagagtttataaaggagcataaagtttcgaacataattttgtcattgtggaccacgagtgctgccagggtaaagctgtacgagtatatggagcaggtctacaggaaggagggttgtaagcttctatattgtgacacaggtggacagaaataaaagaca

SEQ ID NO: 74806 - DNA, 995 bp, Heterodera glycines
  Genomic contig location: Contig_ID=SeqID_11412; Location=2101..3095; Strand=+
  SCN-specific regions: Sequence locations=1-669,708-804,830-995
atgtactcgttcaaaaaatattttgaaactgctcttgagaaggaagactttttctggcctaagaacagagctgaggttgaagcgatgttgattgaatcatcccaatataaagtggccatacaccgggattatgaaagcccgttttccggctacatagaaatgcacgaacacacgtctgcgttttgttttaccatggttgagcgagatatgcgaattttttatgactcaggggcgggtactcctatgggtagatacacgttggtactacacggcatcgtacaggggaactattgggaaatgattcgggattgggactccctatttttttcttctggttttactgggagggaaggagctagacaaaccgcaacggtttttttaggagtcgtctttttctggcaaaggtccaaatgctaaaggttctggcattagcttggggaaaagaactgttgacttccccaattgaagtactattaaatgttttctttaatcgtatggacaggtctttaatgattaaaaatctatatgtcattattattacagagaattgcttgcctcttggtcattgctctatcgggtccctccaagtctctttgatatttctcgtcgaagtgttgcagaaaatatgatggaagaatttttagaactgccatcacactttcgaattgctttttataataaatattaattgtgtaatttatttttttgccttagttatagtcgaaatttatttttatacagacgttttgggggtgttgcttttttcggcgtgaaaaatgtagaaaagggtgacggaatggtatgaaaattgtttaaacacaaaaatttatttttttaggaaaaggttaaaaacttggttgggaccatttgtactttgaaggttaatgtgagtgtgaaagaatatggtggtaagaagggaatttattatactttgattgatatttatgaaatttgattttttttgtctataaatgaaatgttaattttttatttaa

SEQ ID NO: 74807 - DNA, 657 bp, Heterodera glycines
  Genomic contig location: Contig_ID=SeqID_11413; Location=279..935; Strand=-
  SCN-specific regions: Sequence locations=1-234,259-288,318-657
atgtcaaaacaagctcttaaaaactcgaaaaactacattgctcaacttacaccaatgtattttagcacagtacctgaggatcagcttggcgtgaatgagcttgcaaatcgtgtagtgacggcagtgaacaattttttaaatgcagaattaacggaaagcggacaaagagctggaacctatggtaaaaacaacagtccacgcaagaattgcagaaggtaggagtagtataaggccacaaatgtgggtgtaaattttaccgccacattgtgcccttcacagcgcgcgccggcgatcgcccccctcccttcccattgtgggagagtgttgtgcccttcacagagcgcgccggcgatcgcccccctccctccccattgtaggagagtgttgtgcccttcgtggcgcgcttaaccccttttttttgcacgagttgcgcgcaaatattacacaaaaccatgcgagctataatttaattagtcgcgattatttgattttgtaagattgaatttttattaaatatacttagatttagaataaaatatttctctatttctttctattctaaaaggactaaaaaatatttctttttcaggtttaaacaaatgctttactgcagttattctaattttattgtataacattctcatgttaaaccgataa

SEQ ID NO: 74808 - DNA, 734 bp, Heterodera glycines
  Genomic contig location: Contig_ID=SeqID_11414; Location=290..1023; Strand=-
  SCN-specific regions: Sequence locations=1-364,386-734
atgggtacgttggaggacaacaccggtgccaccagcgcaatctttgggaattctacggggccaaacggtgatgaaactgtgcgaaaattctgcggccgtaaaatttcctctgtaggtgcctttagcaggtgcgaaagttctttttttgttgatttgatttgcatttgaggtgcgtttccttcatgaccattctgagtattcctcccgtttcgtcaccggcacttggtgttcccctgcgggttccggtggaaatgtgacactttggacggtccaacaacagcgcgacgaacagagtcaggaaggcggaagacggattgttcagaatggacggattgagttgcccaattgcgatgtcggcgacatttggtgagcgaaaagggaattggacagcaatcattgccgtactttagcgtggtaaatgctcaacaatttgtcgtctcaacaacagcgggagacgtgcaaattgtggaaagtcctttggcatcaaatggagcgaatttggcggatggaattgcgaaaatatcgtcggtagccaaatatccgcgagtgcataagtcggtgttaacgctgcctatttttgtttaaatttttatttttcagatttgcttcttcaaccgcactttgtctgctggacgaagaaatattttctggcagtgattctggtcaaatcattcgcattcgcccggacagccaatcttcacagtcgactcggccatttgcgcaggatttaaccg

SEQ ID NO: 74809 - DNA, 1110 bp, Heterodera glycines
  Genomic contig location: Contig_ID=SeqID_11414; Location=2626..3735; Strand=-
  SCN-specific regions: Sequence locations=1-281,303-631,656-1110
atgagaactcaaacgaagtgggattggcaaaaccgacacggtccaactctgaatcagtgcgaaagagtgcgtctgctacaacccgcaatcaaaatgatagttttctgactgatcaaaatagtcttcgtccacaatcggagcctccaatttatcaattaatggaagggatttcgtcatgtgctcatacttcgaatattagttccgcttttcagaattcgcctttggtatttttgaatgttctattatattgggattaatttatttaacgatttcaaattgcctattattttatacattataaatatcaagttcattaaattttcaggtttcaacggaaaattgctgtgaagatgaaataatcgatgtttcaagtggagaaaattcaaatgggcagttggacaatttagcagacaattgtaactcacgaaactgccaacattcgcatcagaaagaggaaggcaacgccgaacgatgttcgtttaagtttttgtgaagggcgtagccagcagacccttggcttcggggggggggtcgtttttagggggttgttttcttttttagaaatccctacttgggagtctattttttgaataattaaggtaattagaattattgcttaaaaaattcgttgaattattattttttaaatttttttggatttccctttcctgactacgcccttggttttatcctttaatgttttccatttttcttaggtgcctttgatcccgtgacgaagagagtaagtgcccccattgaaaaggcaagaaccctttgacggtcatttccgtttttagcgattttatgagcctcacatgcgaagcggttgcgatggcatttattgtctgtctcaaataacgcaaattggcgagcgcatttgtaacgtggaaaacaaattggcaaggcttgctgagctgttcattcaactcactgacgctgaagttgagactgtcccaattcaccaaatttttaattatgtagaataatgaaacctgccaaatgccgcaacaaaaaccgcagaaagttggcacttcacgtccaccgtcgcgttaccttctcgcacaaagaccagtccctcaatttcgtacccaatccgccgttaacaataaa

SEQ ID NO: 74810 - DNA, 2838 bp, Heterodera glycines
  Genomic contig location: Contig_ID=SeqID_11415; Location=46..2883; Strand=-
  SCN-specific regions: Sequence locations=1-226,265-476,498-828,850 -1089,1125-1167,1223-1582,1604-1651,1673-1699,1732-1846,1900 -1930,1967-2117,2146-2227,2280-2322,2344-2360,2382-2530,2553 -2607,2634-2651,2673-2838
ctttggattcgccattaaacagcagacagatgaatcgtataaatcagtgcgacataaaaaggacacttatgcatatgaaagtaatggctgtgtttggattaacgaagaattaaaggaagcaaatgtcgaatattcctactgtattggcgatactgtaggaattggtgttaattccatcacgcgacagatcttttttacaaagaatggacttcgtttgggttggcacaaatatataattaaacaaattttaaattaaaattttatgctattgatttttgtttaaattacagaaaatccctttacttttcacagatttttctaattttctctttgctccatcttttgctgatgattcattttatccattcgttactttggccacttttgatgacaaaattgaggcgaaatttatgccctttttcgagttcgatttggaaactcggatgaagaacatacaataattgttgaccaattcgtttcttttttatgcttttcttcttcaattgtaatttgggtttttgaatgtttaaaatataaaagcttatttaaaatcgaaatattattctgcaaaaaattccaccatccataatccagtcggttgtcctcttggttatgttccttaccgaatggtactgaatttgtcaagattcgatcgtttaaaaaaagttatagttccaaatctctcaatttttgagttttgaaccggctcaaaaaccggttttttggcattccgcaactcgaaaatattttttcgtgcttagctcctcgagagtggtatatcatttgaccctttttttcccttggcgttcactacaatttatccaatctttttatatttgtttattttatatcccaatcttttttttttgccgttttctgttgtttgtgccattttttggaacattgtttgccgaacactcaaagatgaatgaacgataattcttttatctttttttgcccatcgctttctccatttttgggtcatcgttttgccgtaaattatttactttttggcgtataaatatgtaagcaaattcagcaattgactttcttaaccttaaattctttttaaaaacaaaattcgattccaatattagattttgaaaataaaatgccatcattaaccaccactttttcgtcagcggacgaattctctccactccaacgtaaaatattttgtttaaaataattaattttttaataaatttatttattttattttcagcaatttttccaaatctgagcacatcggaggaaatgagtgttctgattgccagaattgctgagctgaatcgagctaacacagcggaaccatcaatcgcaagttctgctgatttgtttggacaagacggaaacggtaggaaattggaggaacacagtatcaaaattatactgtcacaaaggggagaggaaggatcacaaattgaaaaccaaaaatcgaatagaaatggatgccaaagtcacgcgatcaaaaaacatgaaaatcattgggaataaatttacgaaccaaaaatatgctaacccaaagggaccctatggttttaaaaaaaattaatgtgaccaatttttaagtagcgcaaaactttgattttttaaatattttaggatcggatgatgatgagtttagtccaacagacgaagaagatgagcaaaagaacgaagaaagggaaacgcaaacaaacgaaggtaagcagaaaactaaataaattttaaattttttttgaattaattcgactttaatttaagctgctgaggaaaagctctcacaactttttacgcttacacgagtcttttttatttagacttatgtagtttctgtcttcagttcgggtggttgtttccagagaaaattttaattttcaaaagaaatattttagaataaaaaatttaatttttttaccagtttttgctttttatttaaaaatgaagcttttttattgtaaatttatctttttaaattttttatcatcgattgctgcttaatagccgatttggtgcttattgttaggttaatctccatccagcatttcggcttgggggagggacgaccctaccctattttagtttttaactaaaatttggaaccaactcgataaaaggcttattgaaataaactcattaaatcaatttaaaaataaatttaaactatctctattcctgtaaaatagactggaaaaattaaagtcgaaattattaattcattaaaattaaaagtgattggtcactattattttattgtatttttattttattttttatttcacattatattttattttggcgatgatctcgttttaattgtttatgcgctttcttgaggacatttttaaataatgtttttgtcctcaatgtaagcggatttttcccttttgtggactttttctttattgacaataaactcatagaccgttcaacccagaacagtgatccgcaaaagtattcttttgttttgtttttatctttattttttgttatttcttcaacagaacatattttatgtaaatttttttggcacttttatagttcagtggcacgagttcggagttcaaaatcagtcattagttggcattaaatattcttaaaaggataaaatatcatttgtcatccatttttattaaataattatattttaagctggtgttgaggaacgattctcacaattacaaaatgatcacaagaaacttttggaaagaatcagtgaaatggaaaagcaacaaaaagaacagacaaaaggtgagggaaaatttcaaaaaataaaatttcgatttttaagctaccgcagatcatttgtcaaaaattcaaaatgatcgagaaaatttttttggaaaaaatcagtga

SEQ ID NO: 74811 - DNA, 322 bp, Heterodera glycines
  Genomic contig location: Contig_ID=SeqID_11417; Location=42..363; Strand=-
  SCN-specific regions: Sequence locations=1-9,58-132,154-322
atggtgacaggacagaccttggcatccccactgttactgctgctgctgctcgttgtatgcttcatcattttgagaagtgatgactaatgaaaagggcgtcaaaagccaataaattaagttttttgtactcaagaacaaatcattaattgcttaaattgtgtaattgaaaaatctccaaatttgtgcgattcggtccgaattggaattattattttattcttgttgaataatttaaaaaaaatttcgtcaaaatccaggactgggtccgggtccgggccgattttttctacaaatgattaactgcttaatgagtaaaattaaa

SEQ ID NO: 74812 - DNA, 566 bp, Heterodera glycines
  Genomic contig location: Contig_ID=SeqID_11418; Location=229..794; Strand=+
  SCN-specific regions: Sequence locations=1-396,418-566
atgtcagtcctccactgctcctgggagaaggaggaggcgcgttcccgccacgtggactttgcctgcccaattgtgaagagcaagtccaacccgagtttggcttccgccgcctccgaccctttgccgcaggtgccattttcagaggagacaattttttttgaaatctgtgccgttttcttacaattttcaaaaaagtgatttatcgcttttaaaagtaaattcaacaaagcatttgagtgctttttaagcctgcgccgttgcaaaacaacatcaacaatgggtgggcggcggagaatggtgccggcgaacattcggccaatttccagcaacggccgacgaatgacaacgacgggagcagcggaaatgagaatgaggccgttcaccacccaccaccgccctcctcctcctcacagcaccaccaccattcccaacaaccgttgttcctcaatgtcggctcggcaccacccaactacggtcacaacggcaacagtaacaacattggcacaacgccgcagcaactaccgtaccatttgatcaataatggggcaggcggcacacagacgacg

SEQ ID NO: 74813 - DNA, 132 bp, Heterodera glycines
  Genomic contig location: Contig_ID=SeqID_11419; Location=297..428; Strand=-
  SCN-specific regions: Sequence locations=1-91,114-132
gaaagtgaaagcgattaaacgaaaaacggagaaaagtgccgatgatcaatcttctgcttaatcttaatttcttaaacatttaacctgtacgtattttactttattattttttcgaaaagaaaattcatttta

SEQ ID NO: 74814 - DNA, 354 bp, Heterodera glycines
  Genomic contig location: Contig_ID=SeqID_11423; Location=738..1091; Strand=+
  SCN-specific regions: Sequence locations=1-354
atgagcggtgatcaattggtgacagacgattgggttgccaaagagacgcaaacgttgggcgtgtgcactgcgcgggtgggtgaaaaaacatttgggcatttttgtaaattccgattttaaatattaccatttcagtcctctgactctgaaaagatcccttctgctgctgaccaacttttatggcccggtcatttgccgtgtccttgtgccaaaaaattcggcggcaaatgcccaaacggcgaccatttttgggggtgtgagcaatgcggacagactttaaaatttgcgaaacagaagaatgacgacatggaacagaaagtgagaaagtgccgtcagcatataagcgccaaatga

SEQ ID NO: 74815 - DNA, 90 bp, Heterodera glycines
  Genomic contig location: Contig_ID=SeqID_11423; Location=1828..1917; Strand=-
  SCN-specific regions: Sequence locations=1-90
ggattattttcaaaaacacctcgtagactgggggataattgagactgcgggattaatagagactgggctataattagagcatatacggta

SEQ ID NO: 74816 - DNA, 952 bp, Heterodera glycines
  Genomic contig location: Contig_ID=SeqID_11424; Location=19..970; Strand=+
  SCN-specific regions: Sequence locations=1-553,575-952
atggacaaccaaaacatggccaacacgttcggctttctccgtggctatgatgcgttgcacggcgtcggcattgtgctgaaagagaacgacaaccgtgccgacgcttccttcaattactgcatcaacggccttctgagcaatctgcacaaaaatgtggcacaggtgtgcttttggcacaaagaccgaaactttaaattttcgagttacgcatttttggttcaaaaccggcttaaatactagtacaaggaacccattgaaagtcatcaatgtttcaataaaaaatttcattttagagcaaaaatttgaaaaatgcctgcttcttagtcgattttgtttaaaatgatcaatttttatgatttatttctcttttgccggcggcaacaatcccaccccttccctcttttttcatgtaccttttctcaattttgcagaacatcgtttttctgatcacccattcgtcgggctcgggaaaaacaattgccctgttgcgcaggctgctgaaaccaattgaagaaaaggccggcgtaagtatttaatgttcttacggctgctgtttttaaatgcccatggagctacggcaagatttttgatggacttttaccaaaaacagtaaaattacactatttttgtcacagcaattactcattatccggcttcatcccttgttatccaggtgaaaattccattgaacgaaagcaacgtgttctcctttgacaatgccccgtttgaagcgctttgtttgatcaaagcgatgggtgtcgaatatgacgtggaggaaatggaagaattatccagaaaatggaccaaatcagtgcagcaattcaaacggttgttgaagcatttggccactgtgaagccccatttgactcgggaaacgttgtcggtgtatgccgcgcgttgtgccattgccgacattatgccaatcattgcatcaaacggggagcaaattcaa

SEQ ID NO: 74817 - DNA, 1133 bp, Heterodera glycines
  Genomic contig location: Contig_ID=SeqID_11425; Location=994..2126; Strand=+
  SCN-specific regions: Sequence locations=1-305,327-405,427-439,461 -522,544-1066,1088-1133
atggtatgaaaaaaaggtcgtcgacctccctcaaaacgtaatcctaggagtatccctgtccaacccccttctataccgaatactttttttaaaatttttcggaaaattatttcagccggccaaatggttctcctttctgaagtcgtcggctatgaaagcatacaacgacaacatggagagatacatcgaattagcaattcaagacgcagagctgagagagacttccaacgaaggccaatcgaactacgaggagcaaaaaaagaggaccgacgggacccgagtcggttcatcagtttagggcagaaaaagcatggacgaacctcacatctggcataaaaaaatagttgcagggttttgttttagggaaaaaaagttttcctgaagagatgatgaaaaaattaaaaattcaaacaatttctttttgaatatcacaccgttttaaacaactttggcatttttcctccggctttaccacattttttgtaggcaaattagtgacgaaatatcaataccatacaattttttcagaaattgttggagttttaccgcaaagagcgcgacatgttcacagagggactggagaaggcttccgtcaacgtggaggagttcaaatttccgaccgaaaatgttgaacaaatttttgacggacttttcgcattggaaatcaccggcaaacaaatgaaggccaattacgaaactacgaaggaggcgcagcgagagcatcagaagcaatccaatgccgaagcaatgcgcgcacaaaatttggtcaaggcaaagccaacgaaatgccaaagtggtgggttggcgtggcgagagtcttgaggccggatttatagttgtgcccgagactgtttgtactttcatttaattctcgaagaagtttgcagtgccgttcaatgaattatttaatttgctattttattttaattgctttcatcatttagcgtacaaccaaaaggcgattcagtgctatttggacgaaatgactgagaaaggccaacaacagttgggccagggttggaaagcggacggaagtgccgagtgggtggataaaataaaatttgcgaaatatttttattgtttttccagggcatcgtccaatgttgacatgactgatggaggggaaagcgaag

SEQ ID NO: 74818 - DNA, 1056 bp, Heterodera glycines
  misc_feature (1011)..(1011): n is a, c, g, or t
  Genomic contig location: Contig_ID=SeqID_11426; Location=162..1217; Strand=-
  SCN-specific regions: Sequence locations=1-259,281-368,410-423,445 -520,543-679,701-730,790-928,951-1019,1041-1056
atgggcttctccaagttgaaccagttcaatggcatgtacaaaacggacgattttgtgccgggagactttggcatcgttccattgaagccgaaaacttggtggatttggatgccggagagtgggcgagacgaaactggggaaatggcactggttgaggaacggataggcatggaacaggtggctgccaattaaaatgtctaaatggtgtaattaattaatgattattatttaggattatatcgtcaaatggagaagcattgtcagtgaatttctgcagaataaccaaaaaatgcaattcaattattcaagatttgctgctgatgaagagaataatgcacctcagaaaaaattgtttgatctgaccaaagtaattttaattaattattcaattatttatttaaattaatttcaccttaaaatactaaaactaactaaaaaattattcgtttgaaagaagaaaaaaaataatgcaaaaatgaaagcagaaaagcataaaaaaatgaactaaaagacattaaaaaatcatttttactttttactcagtgttgaaaaatgagcaaaattgcactccaaatcggtgttggtgtctttaatgagatttaaatttttttaatttcagaattctgttagcttttacttttatgaaaaacaattcatttattgatgaatttaactgcaatttttaaaatttaccatttatgattcccgaaaatttgtaaaaaacatttccatttatttttctaatttttaaaatagtattcaaattaatttacttgataaattaaaaaagaacttttacacgaaaatccctgaattttcacgaatatttaagctgtaccactatgttgtcgatcaaacattcccaaattttccaatgcgtaaacatgccgactcttgaggatttctgtcagcagcagatgacaaatctataaaaaacaaaatctgaaacaaataggaaattttttcaaacagcaaccgtcaagaataataattttcattccctccggctgngcgagttataaataagaaattaattacaacgacgaggaaaataaa

SEQ ID NO: 74819 - DNA, 1298 bp, Heterodera glycines
  Genomic contig location: Contig_ID=SeqID_11426; Location=1616..2913; Strand=+
  SCN-specific regions: Sequence locations=1-199,235-273,295-295,320 -419,455-717,780-953,976-1298
atgccatcaaaaattggctcattagaattctgctgcttttttatggaccaattttgtgaggtcaaaacggcaaaaatcaaattcagtgcaatttttgcgattgttttcgatgacactttgtgataaaagccgtgataagccacaacagcggccaaatattcgttgagagggcatttgaactgtggcgttttgtccacccaattcattttccaaatttatttttggtttaataattttcttttcaattgcttctaccgattttttaggcgctgatttttagaaaaatatttttgagttaaaattattacaaaattctcaacttaaatatgccattttatttgtttgcccttactaattcgtcatggattaagttggatgatgcaaatcttaacaactaattttgcaatttcaaacaattcatttttttatttttaatcattaaaataaaaaaaatgcaaaaaccataagattattttccataagaatgattttcaagataataatgaagaaattcataaaacaccaattaaattacgaatttaattattgtttgggcgctaacataagattattttccattatgatcttattctgcacaattcatgatgatggagtttttttgggtacttttcgttatgcgtacacagggccaaattttaaaaaaatgcaacaaaggagcgacgtttgccttcgcacataaaaagctaaacaatgatgaatataaattaataaacattagtaaataaaataaatttaattaaaaacataattaatttttacatgtttctgttttggtagcaccgcaggtggccggccacgcattgttagagacggaggcgagcattaattaatgttaattgcactctcattagcgataataatggcagttcattacatggcctatttccaaggacatccttggaaatacaaaggactatttcctcccaatcccacaacccaatttaaatacttgaatactgatttaaatcattgatttcacttcaaaggcaatgaagctacttctggatgagcttgtgccaatttgtgctgtaccaaatttgccggaagcagccaaattgcttggcaaaaacaagccaatgatgaaggcgaaatgcttaaacaatgccactaattgggcaaattcggagctaaaacagttttgttgaaatgcataattaggtttttaattaatctatttgattaatttttcaggtggacatttgacgaacagtgatcaaagcacggacattttgttcgaattggatggtgccgaaaacttttttcgcgaaaacatttaa

SEQ ID NO: 74820 - DNA, 389 bp, Heterodera glycines
  Genomic contig location: Contig_ID=SeqID_11427; Location=648..1036; Strand=-
  SCN-specific regions: Sequence locations=1-204,226-238,260-305,335-389
gcatttttccaatgcttcatctcccgtcaatttcatcattgtcattcgatttccgccgtctttcgctgacgccgttgtgccatttgcgctaaccaatgaattgacccgtgaacaattggcattgaaaagaactgctgactatcacgactgttttctgttggtccgttgtccaattgcgcgagacgaaagcaaatggacaaaatgggaagaggaagaggaggcgatttattggcatcattattatcagtggaacagaattgacattgaaatttatagtgatgatcacgtcggtgacgggtcagcgattttcaaaaatttcaaatttattgtatttaactatttttagacttctcgacgaaattcccggcccaagtgatcagcagcagtag

SEQ ID NO: 74821 - DNA, 1646 bp, Heterodera glycines
  Genomic contig location: Contig_ID=SeqID_11428; Location=1312..2957; Strand=-
  SCN-specific regions: Sequence locations=1-1006,1028-1055,1078 -1297,1369-1481,1503-1646
atgatcagccaccgatttgactattatgtggacgaacacttcaaaactcgcaaatggacattggcacttattcgaattcatagcaaaaatggaaaggatggcaccaaggaaatgaatattttcaatcactattggaaacttttgccaattccgcaaattcaaatgccacgcaaagtcatcggattcgaatgcatcgagatcaagtaaatttggcgattccatttcaatgaagtgaatgaaatgaatgttttttgtttgtaaaacgattccttaattttacagatacatcgaccaaaatgtcatcgcttttctccaccgttttgcccaactttttgccacaaattgcccaattaacaccacctttttccgccgtttgcgtcaattcgtcccgtcattgcttaatgaatgtccatcactttgctttgtctccttctattatggcggtttcttcaccgaatttccggccaatgacaatgccaatgcttcgaatggacaagcggtggccaaatggcttttcactccacttcaaaacaatgtgccaaagatgtacaaattctcgttgtacatagattatgatgagaattggacgtcgaaaattgcatcatttaaagcggtgcttgccattttctgctgatccgttgtccaattgcgcgagacgaaagcaaatggacaaaatgggaaaaggaagcgattaactggcaaattgatgatcaatggaacataattgacattcgtatttatactgagaattacatcggcgattggtaagtgaatgaatgcctcctattcaaggtcattgctttttcaatttttaggcttcttgattcaactcccggcccaagtgatcagcagcagaagtgaatgaaatgaattgttgagaagagaccgatcaatttgctgtcccaaccccccgccacaccatttgcgtagtaaaattcatgttttttaaggaaaagtgagtgaatggaagaaaatgggggaggggagagagcgttatataattactaaaaatttagaaaatggaaaaccgtacaaatgaaccaataaattcgtataaaagtggttgctgctcttcctctaccttccattattattcattcgccatttatttgttttcgtctctctctctctccgactttttctccctgaaaatgtcttcaaaaatgattctgtacgtttttcgcatttcttctcaacatttactcttttccatctcattttttagtctcttcggtgtgccaatgtttgtcggcggttgtgccattctttggatttattgggaccgtctcaaaaaaccaaaaaataaaatgtaaaaataaaaaataaatttccaaattgaaaatttaatttaattttttagttttatttctgctgactgttggctttgtgtcttcgatttgcttgagccgtcacaacttggcctcggaattgcactgatcagccaccgttttgactattacatcgatgaacacttcaaaactcgaaaatggacgttgaacttcatggaaattgggcgcaaatttgaagagcatggcgcatcaaatgaaatggaaattttcaattctgattggaaattgatgccaattccgctaaagccgttgccaaagaaagtcgtcggattcgaagccattcgatgcgacgagtga

SEQ ID NO: 74822 - DNA, 1884 bp, Heterodera glycines
  Genomic contig location: Contig_ID=SeqID_11428; Location=3113..4996; Strand=-
  SCN-specific regions: Sequence locations=1-14,39-44,67-453,475 -882,904-1454,1476-1531,1553-1752,1774-1806,1828-1848
atgtcagaccgccgaaaagaagcggaggaaaaactggcaaaagcaatgtaaaatttaaaattaaaatgccaatttcaattttgttttcccttttttcagtttcatctccgccgattgttggctttgtgtcttcgatttgcttaagccttcgcaacttggccttggcatttcaatgatcagccaccgattcgacttttacgtggacgaacatttcaaaacgcgcaaatggacattcggaactgttcaatttggaggcaaaattggagaaaatggcaccaagcaaatggaaattgtcagttccgatggaggaattccattgccaattccgcaaaaaccgttgccaaaaaaaatcatcggattcaaacggatcaacatcttgtaagatatggccaaatgtaaaagtttttaggcaacatctcccattcattttcagtttcatggaccgaaatgtcatcacttttcttcaccattttcgtcctctttttgccgcttgtcaaatcattttgtgcatcaacacggacagtgatcgcaattgcatctcgaaactcattttgcgcaacatttggccagtgctcgggaaaaaaattcatagcattgaaattaccgccacacatttccatcatttgcgacaaatggcgccatcagttcttaacgaatgtccatcacttcgttttgtcattttttatgacggttatctcttcaccgaatttccggccgatgacagtgccgcggcatcggatggacaagcgttggccaaatggcttttcactccgcttcaaaacaatgtgccaaaagtgctcaaatgctatttggacacggatgctgcaattttggtgtcgaggattgaagccttcaaagcggtgattactaataatagatttatttgacattttcacgatttattgggcatccaacggaccatctaaactgtaaaatgccatctttgattttttgtgccgccctccccaaaccgaaaaatgcgtttatttcttcatcaatttttccacctttcagacttttgccaatgcttcatctcctgccaatttcattgtcgtcttttggttttcttttgcttcctctgctgtgccatttgcgctgatcaacgaattgacccgtgaacaattggcattgaaaagaactgctgactatcacgactgttttgtgttggtccgttgtccaattgcgcgagacgaaagcaaatggacaaaatgggagaaggaagcgattgattgggaagattctgatcagtggaacgaaatttacattgaagtttttggcgataaggtcggcgacgggtcagtgaatgaataaattatttaggatttaatgtgtttctatttttaggcttctcgatgaaattcccggcgcaagtgatcagcagcagaagtgaatgaaatgaattgttgagaagagaccgatcaatttgaatgatttaattgttgacgtgctcatgaaaaatgttccttttttgttgttggaatgatcaatcaacctttgtctgtgtaaatcattaggataaatttaacgatttcctgaaagatttccaaaaaatccaaggtactgaagtgtccatttttaatcgggactcagttatccattatcacaaacaaagaagaaaatgaactatagttgaccgggaccaaaatacgaacaactgagtaccaaggtcccggttttgaccgggaccgggaaattcccggtttttcaatccgattaggtcccggttttgcccaaaattcccggtcccgctcaactctaaaattccatgcaaaatatacatttatatgaactaaaaaagccttcaccaaatcaaataatttccctttcttcatcatggcaaatgcgcagaaaattttttaataatatcaaatttattcaaataaa

SEQ ID NO: 74823 - DNA, 226 bp, Heterodera glycines
  misc_feature (200)..(200): n is a, c, g, or t
  Genomic contig location: Contig_ID=SeqID_11430; Location=2887..3112; Strand=+
  SCN-specific regions: Sequence locations=1-226
acagaatgtgaacatgggtactaagcagctgaagcgcgacaacgtttacgagctaattggcgattttgcaaaagcgctgcttccctcctcatttctttacggctattgcaaagaggcgaattgcgcaccttcgtccattttggtcaattatgctgttgaactgtgcaaattgtcctcttcttaaagaaaacgatgcgaantcgttttgaactttgcattgaaacag

SEQ ID NO: 74824 - DNA, 751 bp, Heterodera glycines
  Genomic contig location: Contig_ID=SeqID_11431; Location=604..1354; Strand=+
  SCN-specific regions: Sequence locations=1-590,612-751
atggactcggcagcaaatgctccagtcagcaacagcggctatgaacatgacccattggggttgaacaatgtccaggtagtgtagtaattattcaaatcgccctaatggcttttttgagagacttaaaaatcattcattatctctaaggaattgcatcgttttttaattgattaatcgctccaacaggttggtgatccgctgattgacgatgagcaacagcagcgccacccggaaacgaacattgacgaagatgaggacgtacttcgatttgatggaggcgcttttgacgacaatgactacggagaagaggaaggaatgacggagtttaatgccgatgacaacaataacatgggcaaggaaaataatgcttccaatgcttgtgagttttatggggcgtggcagaggtgtcaaattatttttaatgcgtagttagttttaaacaatccttcatccaagtttcgtcttttttacatttgtaaatatgatgccattttcagcacccgttcattctgatgtgcttcaacaaccgctggcacttcagcaggactttggcactcctccgatgtccggtgtttccaacggaggctttgacaaagctgatgacaatgccagccaacacaggagcggtggtgtttctgcccatcgtcgcactaccggcgacgcgacggaccgtcattttcagcgcgttgtggtgggattcccctccacttatctttaagaaaaatactgctattgtataaaagaaatagca

SEQ ID NO: 74825 - DNA, 280 bp, Heterodera glycines
  Genomic contig location: Contig_ID=SeqID_11431; Location=1108..1387; Strand=-
  SCN-specific regions: Sequence locations=1-5,35-173,195-280
ggctgaaaattttttttaacaattattttttattgctatttcttttatacaatagcagtatttttcttaaagataagtggaggggaatcccaccacaacgcgctgaaaatgacggtccgtcgcgtcgccggtagtgcgacgatgggcagaaacaccaccgctcctgtgttggctggcattgtcatcagctttgtcaaagcctccgttggaaacaccggacatcggaggagtgccaaagtcctgctgaagtgccagcggttgttgaagcacatcagaatga

SEQ ID NO: 74826 - DNA, 606 bp, Heterodera glycines
  Genomic contig location: Contig_ID=SeqID_11432; Location=139..744; Strand=-
  SCN-specific regions: Sequence locations=1-256,285-330,376-499,521-606
aaaattaataaaatttgaagaaatgaattttcaaattatgtgatcaaaataccgacctattaggccatagaattacaccaattatgtcaagaaaagtgcgagaatttatattttttgaaacgacctaataaaaggaatagtcatggtttacgtcttccacgggtccaatggttgctgctgttcgggctcattgaagagatgttgttgcggcatgtcgtgcacttctgacatcgcatccgatgggcgcggcaaaacagtgccagcagcaccgacagagactggtctacttggcatccgttgcggtggcggcgtttgtggcggtcggggctgaaaattttttttaaacaattattttttattgttatttcttttatactatagcagtatttttcttaaagataagtggaggggaatcccaccacaacgcgctgaaaatgacggtccgtcgcgtcgccggtagcgcgacgatggccagaaacaccagcgctcctgtgttggctggcattgtcatcagctttgtcaaagcctccgttggaaacaccggacatcggaggagtgccaaagtcctgctgaagtgccagcggttgttgaagcacatcagaatga

SEQ ID NO: 74827 - DNA, 1339 bp, Heterodera glycines
  Genomic contig location: Contig_ID=SeqID_11432; Location=1000..2338; Strand=+
  SCN-specific regions: Sequence locations=1-169,198-528,552-917,944 -950,973-1022,1054-1111,1139-1339
atgatggcaccatcgtcggaaaacggcagcggtgacggaggaggaggacgtattcatcttatcggactgtcggattcgcgtggtgtttgggaatacgttatgcaactgagggaaagctggaacaaaatggtgtgtctactggtcatcaacagaccggagggtaaatatttctcttccttttaagtttttctaattttaaacagctaatcaattgtgcttttttgtagaggaacaagatttcctcaactacatggactgcttcgcgttctacaaccagggcacgcaggtgggcgtgctggactttgccgaccacccgaccatcaaagacggctatgtgttcacgctgagcccgggcgaaccgttgccatgtgagagttttttttaatagcaacttattactgactatgagaatccccttttccgcaacacattgtttaatggtaaaatgccgtctgtgaatgttatgtctttcagctgtgctgttgccgttggacggtgtcggattgcccgagtggacacagcacaacgggtgcattatgctgatgattgtccgccggatggaccacgaggataagcagtggaagcgccaacggatgggcatgggcgttggggacgaaagttggcgacgtcagcagcagcaacacccccaaatgatgccgatggacattccgctgacgccgattggccgcgggggaggcggcgaacgcatggcacatctgctcagcgaccccaggttggactatgagcttaccactcggatgggctctcggctgtaccgcttctcgcgcctctacaaatccatgccaatgattttcaaccgaatcttttctgaaattaacgtggacaacagtgggaacgatgagaatgcgaaagtgtagtagagggggagagagatgggattataccgaaaagagtgtttttctaaaaaatataaatttttcttggcatattggatgggtggtccctcttttctctctccctcgtcgctctctctttgtgccatattccggtttcttttttttaaactgtctttttcttgctttatattttacacattcagctacaaactctatttttgagaagaattaaaaaattctatcaatttgctttatttgttttcattcatttttctgttggtctctccgattttttgccgatcttctttttttgctgccgttttcatttttaattctgatgcgggatttttgtattgtcttttccatattctaatattattagcaattctttttgctaaatcttaccagtacctcccccccccccctgtgtcttcttttcacacagctcacatttgcctacgcattgttgaatctgcatttta

SEQ ID NO: 74828 - DNA, 267 bp, Heterodera glycines
  Genomic contig location: Contig_ID=SeqID_11433; Location=584..850; Strand=+
  SCN-specific regions: Sequence locations=1-234,256-267
atggaagaaaacaaccatagaaccgcggttcaaatggcatacaaatttcgtttaatcgattatgactctcaaggacaaataacgcctattaaactccaaagagttttaaaaaatggcacgcaacagctttttaatttggagacgtgtcgtttaattgttaatcagttcgatgagcaacgttgcggttacatcggtcttgccaaatttccagcgctatgggatgtatgatataaaaaatgacaaaataagcaaaaatattattttaaa

SEQ ID NO: 74829 - DNA, 508 bp, Heterodera glycines
  Genomic contig location: Contig_ID=SeqID_11434; Location=920..1427; Strand=+
  SCN-specific regions: Sequence locations=1-508
atgtattgtgccagttgtgcccaccatgctaacaaggcaatccgcagtatttacttgagattggagctccgcgactgtgaagatccggagatttgccagactgttactgtcttttccaccgtagcggaacattacctgggcctcaaggttgaacgatttgccaaaatggtagaagagcagcctgaacagctcgaagcgttgcttaaatctaagattgagcgtactgtcaccgccaaacttagtataaaggttcacaaatttactacggatataaatattatctttttgaatttttaaggcaaagggtgagctcaagacgatggactggattgttctgtccatacagcatgagaacggggaaaacgagggagatgatgagacggctcctgatgaacaaaagaaaactgacattaataatgaagatggagaaataatcgagattgagaacactagcgtgcattcgacactcttaggcccaccgcttaagaaacgtgtaaaaaagaactga

SEQ ID NO: 74830 - DNA, 2077 bp, Heterodera glycines
  Genomic contig location: Contig_ID=SeqID_11434; Location=1617..3693; Strand=+
  SCN-specific regions: Sequence locations=1-139,163-1281,1303 -1724,1746-2077
atgaaaaagggacaatccgaaacggctatcattcgttcatcatcatcggcaacagcgcgcaatgacaatacggtggcagcctcaaccttggatggcaatgccaaacggcaacgtcgtaatagttgggacttcaagacgatggcccattttgaggagaagcgccctaaaggggaggaggatggacatagaaaggtgaagcagcctcagcagccagcacccttgtttgagcaaaaacaacactacgtgcaccgagtggagcggttcgcactgcagcgccatgtgaccgagtttgtgctgaacggaaaacacgatgagccggaagaggcgcttctccgcgccttcgagcatatcatcgctcgtgcaatccgaaacgcagaggattcccatcagcaaactgacgatggaagaggcacatcagcgggcgacagtgcacatcgtcaacggcgtgtcacaagacttggagttttacttaatggtagaggtgagatttaccgtcagcgttattcgctcttttgttaatgtaaaagttttctttgcaaaacaccaggtctaaccgacccgattgtgctgcccattcgtcctccggagcaaaacacggcagaagtgttgatggctgagctggacaaacttggccagtcggatggcgatgaggatgtgcatggtggagggatcagcaaacgttctttgttgctcagcgagccaattgaagtggtcgtcacatgtatagcacctccggttggtgcggcgccacgtttttaccaataccagcattggggttatgacgaccggcagctgatccgtgtgatgaatcaggacgacaacttttgttattccatgcacttgttgccactcgtgcgtacacggatcaggaatttttaaaggcaacttcgcgacgacaagcccgaacaggggaggatgatagtcttcaatgggatacggtgccagctgagattgcacaacgggtgataacgagaaaagacttttgtgctggctacgaagcactaaaccgtctggtgtccaaccgggagcggatgaacgcagcagtgacggagctaatgcaagctgcaggaattccagctgaccaagagtcgtatgggatggagcatatcgaccaaattcagcagttttgggttggttgttggtgttagaatgagtgctaaacggtagttttttaaaccaaacaggaccaaaactacgctggcatatacagaattgtgctgtttgaggatcactccgaagagttgcctcgcccaatttggaagggtccaatgggacgccgcctctgtgtgtcactgtttttgtcggatgggcattattatggtatcaaaaagatacattgctttttcaaattgggtcgaaaatattgcgtggactgtgaatgtgtttacacccgtgacactaagcacacaatttcatgcaagagtcgctgcccacaatgtgctaaaggttggtatttgtgtttgttgcgccagcagatggccaatcgttttttttgaattttggttttatgccctttatttccttcttgatccagttggcccccagtatccatgcgttaggcagcaaggcgtgtgccttcattgtacccgatgtaatcgctttttcttctcccgatcatgctttgacggtcaccggggcagtcagacatgcaatttgttgaagcgctgcactatttgcaaccgaaccttccagcaggaccccaagcgtcctcataaatgctacagcactttttgtacacgttgtaaggtattgcattttcgccatatcagattggaaataaacaaatcaaaattaatgtgattaggtgtaccatgagaaggatgctggttgctttatcaagaaggttgtggtaccgaatgaaaagcaacagtaccgcatcgtgtgctatgacacagaaacgagattggacccattggaagaggcagggcagcagcgtcataaagtaaaccaactttcagttcgtgttacttgcactgagtgctgtgattctgaacgtggggtgcggacaaattgccaaatttgtatttcggagtatggaacaatggaacgaataaaggattggtatgctgttcattaa

SEQ ID NO: 74831 - DNA, 1072 bp, Heterodera glycines
  Genomic contig location: Contig_ID=SeqID_11438; Location=986..2057; Strand=+
  SCN-specific regions: Sequence locations=1-521,543-648,670-840,863 -947,970-1046,1070-1072
  Gene Ontology: Mol. function=chaperone activity; Biological process =protein folding
atgctttctccattctcctacgacccgttctatcgccgttcgttgttgcctatggccacggttggcaacgtcctttcgcccttccgccagttggagcgcgaactcgaccacttctttgacgggatgcagcccatggtgggggcttattcgacaatttgccaaaatttcaaattcgtttatcatttttgttttagcttcgtgaccacgccgctcagctgaacgtcacggacaagggcgaactcacttacaaagtgagaaggcacagaaattcaccgcttttcgtggctaattttcaattccatgaaattttcaggtcgatgtcagcggcttccgccccgaggagatcaacgtggaggtgattggtaatgaaatcatcgtcaatggggaacatcgcgagcagaacgacagtgagttttgccattgttcgagtaattttatcggggttttggattttggtgagacaaatttcagggcttgagtgttaatggattcatttaaaatgcttttcggaaccatatttagccaatttaggcttacatttagcgaatcagagaaatatcgagaaacttctttcaatttggaaaatttatgtccgtatttctgccatttatggccttatttttgcaaacccttgattttttacgtcccaaaatacctttgaatggatttttcgaaacgcaaaaatattttttttcgggtcgggcatattccgaagttatgattgatttaaatgcaataaatgtctagtcataatgctgtttttcgatgattcgttgccccctccacctcaggcgaatcggtccaccgtcagttctcgcgccgtgtgctcatcccggagggcatccaaaaggagagcatcaagtgcgagctggacggcggtcgcttgtgcatctgcggaatgaaaacggctggcgaaggcggacgtaccatcccaattgagatgaagaagaaggcggccgtggaacatcagccgcaagtggagaagaaatagagggggacaaatggagacgacggaccgatcgatccattaatatgggtctcctcctttggacattttaaattattttcaaca

SEQ ID NO: 74832 - DNA, 63 bp, Heterodera glycines
  Genomic contig location: Contig_ID=SeqID_11438; Location=3368..3430; Strand=+
  SCN-specific regions: Sequence locations=1-63
atgtccggtcgcggaaaaggaggaaagggacttggaaagggaggcgcgaagcgccataataaa

SEQ ID NO: 74833 - DNA, 985 bp, Heterodera glycines
  Genomic contig location: Contig_ID=SeqID_11440; Location=670..1654; Strand=-
  SCN-specific regions: Sequence locations=1-615,637-682,704-985
aaagcattgaccgtgtccatttttacgccatacctttccgctagttattttatggtccgttttttgcacagggtacaacatgaacatgcttccctgggacctgaagccggtccaagacttcatcggcctttggcaaatggaccgcagcagcggaaacttcaaagaattgccgccaccaaatttaattgacttggccatcaatccaatcccgaaatttggagcacggacaatgaacattacgttggtttatgatttttaaaagccgacaaattcaaaaacccaaggcacacttacttggactcggcccgaaatgtcatccgaagtaagcaaacaattacagcttaataaatgccatttcgcttacacacattagcttaaggtgattacggcttttatgccagtgaaaaatgccacccgaagggacccgcggggtgcacgtggcatatctgacgacgagcagcgaaggtaaatcggggggtgggggggggtgatcattcaacggacaaatggacaaatgattgaaggatggtcgatgatggagcagggcttcttcaaggacggcaaattgattttccacctcaaacagtgagtccaattggatgggaagtgtcccatcacgtcgaagccattcacaacagattcttgaaacgctcattcggtgccgggagcaatttggacatcagagaagtgagtggagaaaaagggacaattggggggggggagaacttacggggactcaatggaagaaggaatatttgtgatgcttttgcccaaactaaggaatggcttttcaatcagcaagtgatctctgccaaatgagtacccttttagcctcaattaaccaaccaaagatgggcaaatttaaagttttgttcagtttgagcgtcaatttgaactgtccggcttccactcgatgacactcaaagtgcgcgccgaaacatcttttcagacggaggcttacacagcttggtacacaaagattctc

SEQ ID NO: 74834 - DNA, 830 bp, Heterodera glycines
  Genomic contig location: Contig_ID=SeqID_11441; Location=514..1343; Strand=+
  SCN-specific regions: Sequence locations=1-210,233-378,400-491,513 -657,682-682,704-716,738-830
atgtcctcctcgacaaatgaccccgtgtcggagtttctcgcccgtgaacaatcggcgctcgccgacctcggcgatgactttgtcgctgctgtgcccccacctcagaccaacaacggtttcatatacattggaattaattgagtctttttgagcaaaacaatgcgaaattaaattgggaagagattttcttgaataaaggcctcccaaatgatttttctgtttaattcattttcagatggaattctgctgaccaatggtggctcagattttggatccattgcaaatttagactcatttgacgcaaatgaacccaaattgccggtcaacggagtaaacggttcgttttgacctatttttttctttttgactatttactatgaaaggaaagggggaaaatggtattaaaataacaaaatacgtaatcatttcgtgaaaagatattttttctcactttatctaaattaagccagtgatttacaataatttgtgaaatttgttccccattttaaggatcgttgcgcggaagtccgtccttttcccattcgcgcagccaaagccaacaactcgaagaggagccggagaaaattcgaaaatggcgcgaagaacaaaaggagaaaattgcggagaaaggcattgtttgaattgccatttttaaggataaataattatttaaataaataagtgcttaaaaaagaaaatttgattcattttaagacaaaattgaggagcagaagaaggaggaattacgagagcaggccaaaaaggagttggagcagttctacgcccagcgaaagaacgaattggaggaacggaaaaagatgaatcggtaa

SEQ ID NO: 74835 - DNA, 464 bp, Heterodera glycines
  Genomic contig location: Contig_ID=SeqID_1612; Location=1513..1976; Strand=+
  SCN-specific regions: Sequence locations=1-195,237-299,322-464
atgaaaaaatatgcatatgcatatactttcgacgtggtgcgacttttggggatatgcaacttggggaccgacatttggggacccgacttttgggacccgacacttagggaatccgacattttgggatggggatcgaacgtcttttggggatcagacatttggggaactcgacatttggggaccccgactttggggattttattaaaataaaaaaatatttaaaattttaattttatgtccaaacttagacaagtttatgtccgctttagtcagagttaattccctttgcaagaaaaaacaaaataatatttttaaaattaactctaattccggactctaagaaacagaaaatatgacctcggcattttgttgctgtacgcaattagacagtaaagtcgcctttaactttttgaatgcccttgatgaatttctgttcccgttggcccttgggaaaggcgttttaa

SEQ ID NO: 74836 - DNA, 1891 bp, Heterodera glycines
  Genomic contig location: Contig_ID=SeqID_1613; Location=16..1906; Strand=-
  SCN-specific regions: Sequence locations=1-220,242-424,447-496,557 -621,644-738,799-801,825-1146,1169-1211,1249-1285,1356-1416,1450 -1495,1517-1534,1556-1643,1674-1857,1880-1891
atgaaattcaaattatttattttttcttattgtttcattttattttatgcacaatcagtgccaaatgacaattttaatgaggtattgcacaaaattgtaaaacatttgaagacaattttagggttctccatctgctgatgagcaaccaaatcaaacaccgttaaattttgaagaaaagaacccattaattgaatccaatgaaacaggaacggcaaattgtaaattgaaataattaaatgcaattttttcagggcattttttagagctattaggattgcaaaggattgggatttttaccggggattattccataaatgttgtattctttttttgtccataatcccggtccttccggtgattcaaaaaatttcttttcatcccgggattggtgttgaaaataagtattggtaagaattggctctaaaaataagtccaaaaattaattgggcgggggggggtagttgagaaaagtaaattctataatcatattcaaaccataattaattaaattaattatttatttatttattaagaagaaagaaattaaataattttagggacaaaaatttattcgaatgaacaaaaacaagaactaattaataaattccatgaaagaaggagtgaaattaagaattgtgacaagaagacatacaataaaatcgaagaagaaattgcgaaggatttggacgtcagtcggcacaacatttacaaatggaaaaaagaattgggactttcaagtaaatttaattttatattatttagatataaaaatttaataaaaaataaaatgaaatttatcgtatttattcaaagaaaacaaaaaatagaattagtgcagggattgggtctgttctgatttctcagaaatgttctgatttttgtgggtccaaatcagtgaaattaaaatgttaagatttaaatttatagttttttttgtccattttgggcaaaaatctgttattaaactagacaaaatttcaaaatttttcggcatgcgtctgttggcaccgcaggacccacaaaagcgttatttctggggccgggccataatttctctgattttttgagccctattgcactcaaatatatgaagtgcttatttcttccccaaaacgccaaaatcttattttttgggcacgatattctgattttgaaaaatttcgatccaattcctgatttaagtggaacaatttcaaaaaatgaatgaattcaaaaatttaaaaaatattagtaaaatcaaaaaaaaaacaacatcaaaagatttgggtattcaaagcccttttcgtttataaattgaaaaaaattatgatttttttggcaattaataatattaaaaaaacagttttattattttaggtagatgcaatatcaattatactaaatttagtttattattattttggcataggaatatacatttttaataaatatgattatataattattttaggtgtacgtaattcccataattattcgaatgaagaaaaactaaaactcgtccatcaatttcataaaatgaagaccgaattcaaaaaggatgaaaaaataaatacatctagtaaagtcgaacatgcaattgcaaaaggattgggcgtcactcggtacagcatttacaaatggaaaaatgaattgggagtttcaagtaaatttagttttttatttaaaataaaattgattttgcaatcattgtaattatttacgtttaggcataggaaaatgaaatataaatatgacataaaactcgaacatagaaatatatatcttttacaaatacgattatacaaatattttagatgaattccgttgttcccataatgattcgaaggaacaaaaactcaaattcgtccattcaagtagatttattattatattaattattcttggcaattaa

SEQ ID NO: 74837 - DNA, 1692 bp, Heterodera glycines
  Genomic contig location: Contig_ID=SeqID_1614; Location=1497..3188; Strand=-
  SCN-specific regions: Sequence locations=1-31,54-325,363-808,854 -1036,1167-1311,1338-1381,1450-1544,1585-1692
atggcaattcggagctttcttggccccgcttgctgttcaccaactggcgccgctgtattgctgctgatttctggcttggctaataccgtatcattggcctccattgccacgggcaacggggcacgccttggcatttttcgtccgacacgcagcatttcatatgacggacaacaggaggaggtactgtaggtgcctagtctgagtacaaatttttgttattcatttaaatagaaaaaacagcgggaggtacagtatgattaaaaagaattagtcattgttctacacaataatataagtcagggtgcagttagtcatgtagatcaagttaaaatggtttatttatttatatacaaataatacataaatccgtatacagtaacttgtcaattatcatattttatttgcaaaaagcaaagaaaaattgtattgtttagacattagtataacatttatttcaatacggtactgtagcttgtcaattcgtatattgtattagttaagaagaccacagaaaaatagagttgtcaaactttagtattcatttttttatatacagttatatatgaatcagggtacagtaacttgccaaatattacattgtatttgcaaataccaaagaaaaatagtgttgccaagcgtttgtataatgtaccgtatactaaaaaaaaagggttctaccttagatttttagggtatacaaatcaaatgcgaccagttatatgattaaaatgctttagacggaatatgaagtggagcccggctttgaaaagcgttcaatgacgcttggccgtctgtcatttcggcctggtaaattttttttttaatttttaaaaaatttaaaaaatgaaaattaggaaaacgttggtcctttcccgtctccggtgcttatgcacacgatcggcaaaacagacgctatgatttgttgctgctcagtgaaaaacagccgtcatatggtttggcaccgtctgaagtggaatacaatgtgccaattcaagccaagcccaatgtcgtccgtcacatcaattttcggtaatggaaataattaattaaccaattaacgaaaaatattcccattaattaattcatttttaattaacgataaaaagtacctttaattaattatataattaattataataataaaattacattacttaattatttaaaaaacaatacaaatatgaaattttttttattaatgctttttaaatctctcagtacgatattgatataacaataaaggaacggtcaaaattaacagtagcaaaaaattaattggaattttgaataaatttcaaaaaacaataatcgaaaattataaataaattaaataaaatgagtgcattttaatatgtacatttttcaaacattaatcattttcattttatcaaattaattatttattaaaaaattttaaacaatttttaaaaattattattattatttttagtcttctgcccgagactggaaatgagcaggaaaatgatcttgccgagattggccttcgagaatctgcaatgggcaaacgaacagccgcattaggcaataaattaaaataaaattttaaaaaaataattttaaaaactttttcaggccgagttggttttcgacccggaaagcgaagcatggctgttggtcggacaggctttcgtccaggaaaacgcagcattgcaactgggtaaaaataataaa

SEQ ID NO: 74838 - DNA, 1818 bp, Heterodera glycines
  misc_feature (1245)..(1245): n is a, c, g, or t
  Genomic contig location: Contig_ID=SeqID_1615; Location=548..2365; Strand=-
  SCN-specific regions: Sequence locations=1-2,24-433,467-526,616 -620,642-642,665-770,797-836,897-978,1000-1076,1109-1142,1164 -1495,1517-1526,1555-1580,1605-1670,1694-1818
atggcggagagagtggaggaagcggcggatgagggcgagggaggcgaacatggcgagggagagggcacgcccgaggcgccattcgttagccgaggcattgaaagcatctgaagagaggggggggggggtgagctctacccccccccccccacttcaaccccatttgattcgaaactccatggaacctagcgaccttcctttgttcgacctcattcttaccaattttgttttcaccaatatcctattgggataatgaaaagtcgggaggatttgttttttaaaaaccgaacacttaaccggactatggctgctagactaattaacctttatttttttctttacaatttgccgctcctgtttcattggattcaattagtggcttcttttcagagtttttcggtgtttgttttgatggcccagcagattgtgaatcctaaaattttgtaaatgtcttcattttctaaaagttgctttcaaacctcattaaaagtttcatctggcactgatagtgcataaaacaaaacgcaaaaatataagaaaaaataaaaattatatttcatcttaaattataaaaattagttttgaatttttttaatatatttttataatattattcatgctcataataatgatattaatgaaaaaataaaaccaattaataaagcaaatcatccgttatttgttggcaaattgaaatacgcctatttctgaatcaataaatccataaccacagaaaatttttatacagctctggcgatgaatacactgctaatgtatatattttttaaaaacaaatttacattaataaccggcccatatattttataattctcaactttatataaaatttagaaaaaaaaattgtaaattaataatgaaagattttatatttaaatgggttttgtatagaatttcaaatttgcaaaaaaatggaaagaaataaatagaagaaataatggtttaaattaataaaaacaaataaatactaagggattaatatgtgtaaaaactattaaaaaaaatgatgcaataaacaaatattatgagggaaagggatggacaggaataattaaagcaaaaattaatatttaaaaattaaaaataaaaacggcaattcggaaaatataaaagtggatttagcccctttgaatttcattttattcatcttaatctcataaaatgaaattgttttttatgcatcaatgcccagaattaacaataattgatcgctttcagttagaattnggaaaaatatttaaaaatgcccgatgcttacagaaaaataccttttcatgatcgctataagttagcttaaatttagttttccaaaagtaatgaccatagacacctaagatgaggggttagcacctattttggcgttttcgcactttttgtacctattttgacctttttcttgaaattccaaagcaaaaaaaaacgaaaaatacacccctaagaatcgatcccaaaaaatttaaaaaaatatacccctaagaaatgaaaaattttcccaaaaattcgtaggcaaaatttatttatttaataaataaaaatgactatggcgctcaattgtccaatttaaaaagcaataattttgattttttaaaggatattaaaatgaagaatttgtcattgtacagcgtcttaatgatgattttgcacattttaattggtatgggcatgcttttcatgatggtggcaaatgggcaatgcatatttaatgagaaggccggtgcttgtgacagtattggttgcccaggcggagcatgtcttcagagtggcaaagaatgcgcttgctttttcggaatgcacaaatga

SEQ ID NO: 74839 - DNA, 241 bp, Heterodera glycines
  Genomic contig location: Contig_ID=SeqID_1615; Location=1806..2046; Strand=+
  SCN-specific regions: Sequence locations=1-3,35-94,128-241
atgaaatataatttttattttttcttatatttttgcgttttgttttatgcactatcagtgccagatgaaacttttaatgaggtttgaaagcaacttttagaaaatgaagacatttacaaaattttaggattcacaatctgctgggccatcaaaacaaacaccgaaaaactctgaaaagaagccactaattgaatccaatgaaacaggagcggcaaattgtaaagaaaaaaataaaggttaa

SEQ ID NO: 74840 - DNA, 658 bp, Heterodera glycines
  misc_feature (135)..(135): n is a, c, g, or t
  misc_feature (160)..(160): n is a, c, g, or t
  misc_feature (212)..(212): n is a, c, g, or t
  misc_feature (242)..(242): n is a, c, g, or t
  misc_feature (248)..(248): n is a, c, g, or t
  Genomic contig location: Contig_ID=SeqID_1615; Location=2705..3362; Strand=-
  SCN-specific regions: Sequence locations=1-74,104-658
atgggcacaattggctggagcaagtgcgcacagtgccgagaacggcgaaatggtccgatccctttgaggtaattggagagaagttggagagagaactctcagccgataactctcgaactgatcgcttcaaccatntaataatgggtttcgatcccataanattccggcgcggcgataccttcttgtccaaatgggcggtgtcctcccgactngagttctgaatttgtaaattcttagaccgntttcgngcacttcgtcaaccgcgttcgtagtcagttgtgttccgatggaatttgcctcaaactttggtttcgcgaccaccaaaaaggtaactcaaataaaattgaaatagttcataagttcactcacattgaatttcattgtttaaggcggagatgggcacgtgtggcgatggtgtgccaaaaacgcggagggacgcctaagggcggactgtacgcacatcaaaagcagcaaaggtgaagcggaaaagctattaattaatcacataattagaatatataaattaggggaattggaggtatgcacgtgcgaaggcaatttgtgcaacggttcggcaaagacagcacaaaacgccgcagcaatgctttttttcccttcggtggctacgattgtttttttcattctatgaattaataaa

SEQ ID NO: 74841 - DNA, 1028 bp, Heterodera glycines
  Genomic contig location: Contig_ID=SeqID_1616; Location=41..1068; Strand=+
  SCN-specific regions: Sequence locations=1-71,95-183,207-229,262 -378,400-502,531-620,642-713,803-867,890-949,982-984
atggcatgtggcataatgggtacgcgtccgactacatttttcctagcctggttcaattccacgctatgcaaattatttttcccgttttatttttgcattttacgcaaataaattgccaaggaatctagcaaatttagttccgaaactccacggacagctactagggaccttcctttgtaagcaaaaaataatgcgggatattgggaaaagtaaaactatttacaatgagaaaatataaaataattaattatatcataataaccagggaacggatttttacgctttcaccttttttctttttgcgaatagcatatggtgagataagcgcataaaacacattttcttcgaacaattttcgatataaagcgactttttaacaactattttaacatttttgcttatgaacaaaaaactttttatcaattaggaaaaatgcattaaaaataaataaaaatgcacccctgagaatcgtttttttttcaaaaatacgcccctaagaatcaaattttcaaaaaaatttattataaatacatccctagcgatcgagttttcaaaaagcaaaaatactggccatgattttggcggacttaaaaatgtttgatttataattattcaaccgaaatggataatgaatgaatgaattttggaaaattcacacatttattgacatgtttttccaatatggttggcaactttttagcaactattttgccattttaaattctataattatattcaaaccataattaattaaattaattatttatttatttattaagaagaaagaaattaaataattttagggacaaaaatttattcgaatgaacaaaaacaagaactaattaataaattccatgaaagaaggagtgaaattaagaattgtgacaagaagacatacaataaaatcgaagaagaaattgcgaaggatttggacgtcagtcggcaaaacatttataaatggaaaaaagaattgggaatttcaagtaaatttaattttatattatttagatataaaaatttaataaaaa

SEQ ID NO: 74842 - DNA, 3007 bp, Heterodera glycines
  misc_feature (1181)..(1181): n is a, c, g, or t
  Genomic contig location: Contig_ID=SeqID_11442; Location=103..3109; Strand=-
  SCN-specific regions: Sequence locations=1-7,30-64,86-388,410-449,471- 680,703-736,759-2274,2297-2405,2428-3007
atggtttgacaaaatggcagatatgggaacccaaattcaaacatctcgaaatgaacttaaatcttttcaagaagtagagaaatctaaaaacacaacattatagcatgtggcaaataatgacatgaaacaagcaaagaaatcagccgacgtcgcaaagggaattgccagacatgcaaaaaccaaatatacatcaattctcgaggaatataatgataaatcagaaaagggttgtagcggaatggtggataggcttaatgaagcactggtgaacattttaaacgtaaggatattgaaaataaagaagtgccggaagctgaaaaaggaccacaaacaaaagagagattagccaatgaggatgctcaatttcaatatgatagcattgaccaaaaatttattgtctatctattctctgccgtctcccacatagatttgtcaaaacaactcgtctatgtgctcgtttttatatttcacgcggaagaggcgatttatatgccagctttgacgggtggtgtaagtcagctatacatttatgcaccaaatttaatagaaaacacaattatcggcaaccagatggctccacttttaagaattattaacgtcgtcaatgacccaagatcgattagtgaagttatatatagcgccgagtactttcatcgtctatttgaacgcgactaagcatctataaaaaaaataaaaatatttgtggccaacaaagtggtattttgctgccacgtgaaaagaaaaatgggtgaaccaccaaagggaccaccgagggaaagcaaaggggccaaaaaaagggggaaaaatggccgagaaaatcaaaggggcacagacgggccaaaaaagggcggacagtggccgacggaaggcaagtcggcacaaaatagccgcaagtgggcaattgccgagggaaaagcaacaaacggcaaatgggctcgaaagggccacaagggacaaatgccgacgaaagccaaggaggcacaagggaacaaacccaaaggcaaagggaaatgcaaatgggcacaagggggcccagggaaaatgcctgaggaaaggcaaactataggcgaataggcacaaaagggccacaagtgggcaaaagcccgcggaaaagcaaatgaataggggaaccgctgcgcggagtcccaaattagcaatggaaaagcacaaaaaaaggggcngaaattcggaaaattcgtttatttttggagcaaaagacacaggaaaagcgatggtttgttgagtcgttggtatcagcaaaaagtgaaaagcagtgctttttgcatcgtccgttcgttcttaagtagtggcgagagttgggcgggcacatcggggcgagtggcgagagttgggcgggcacatcggggtgaaggcactgtagtaggcaaagcagccaatcggaggagagcaaagtgcaacagatgaagaaagggaggaggccaaaaccttgcacgtgccgtgccaatttagttgcgatggtgttcctgtgagattaatgcgagaggggaagatgggacgggcctggcccagattagttgtttatgataacctagagaacgtgacaaaagatgaaccaattaatcccccaagaaatatttttgccaaaattattgcataaattaatccccaaaaatatttgttgctaataccaaaaaattttgccaaacattttgatactgtcgtagacagattccccccgccgcacggctcaagcagatagggacgacgcaactgccccttcattttcttgcgctgttgggggcactggcgggggtggggccactgcttcggggtttggagctggccagcgacggcatttcaaccagaccaaccggaccgatctgcacctgtggtccctgaaaacaagatgggccgggcgccagtgcctgcccttgattagccttagggcgggaggcccccgaaccgcccttagcacccgtaccccccttggtgcggttacgcaaacgttttccccacccttgttagcggcccccttaacttgctgcccgattttgttggcagtcagcaacaccaccatacgctccatcagatttcgctgaacattcgccacacgcagcaactccgagaaggtccaaatgagacggtgatcattttgtggagtcggagcaatgttcggatggcgaggttcaggctggccggtcggtggacatgcggaaggcatcaacggcaccgggtgtggcggcgcgcagcagatcggcagggggccggggacaccaaatcgggggccgggtggcgacgtggccggctggccttggtgcgaaaagggggcacccggaaaggccggtgccattaagaactgtccatttgtgggtggaccagcgatgacgtatccatcggttggatacgaggccaccatgtatggccgcggaacactgggtatcgcattgttgttcatcattttggggagagtattcagaattgtaaaggaaatttgcctatttttaagagaaaagaaaaatcaattaaaaaattaaaagtaactgaaaaagaaagtgaaagaaaaaaggggggggcaaataaggcaattaagctgggtcacatcgtgcgggcccaattacggcctcttgagctgcggaccctttctgtccgatttctcggtggcctatcatcaccttgcctttccacccccgtgccaattcgtggtaaacaacaaacagcggggcagaacatagggcaatagcgaatgactaacaaaaaaatgaagagccaggccaggccaacggtcaccgcgaatgtggcatgtggtaaagaccccactgattggaaaagcgcaaattgtatttgcggaaaagcaatcgactcggcacttagtctctaccttgggatgggaccacgaaagaacaacggagtttgggtgtcctttgggcgtacaccgggtcacccattctgtcccatcggcacattcaacacttgcaaaggactctccccgggaggaagtgcaggtgtaattgaatctccccccggttctacaactatggcaacctaa

SEQ ID NO: 74843 - DNA, 448 bp, Heterodera glycines
  Genomic contig location: Contig_ID=SeqID_11444; Location=38..485; Strand=-
  SCN-specific regions: Sequence locations=1-19,46-118,141-160,217 -231,254-339,379-395,430-448
atggtaatttacatgatacatataattttttattaaattaaaaaagtaaaacgcctttgtgaaaaaagaatgtagacaattatatgtagttagaaatttcatttaaataaataattatgtaaatttacaaattgataatctgatgtgctaatgcttgggcatttaaattaaaaaagtatattaaataatttaaaaaatttttttattttttatatagcattattatatgtatgaaaagaaagataaaataaatgtttggtttgaatgggtaggaaaaagcgaagaaatgagaaaggaggaatcgattgtatgggagcgggaggaggaaatgggaaatgtggagcaagaagaggaggaggagaaggagcaggaggaggataagtgaggaaggaagaacagcagcagaagaaagagcaaccgcccaatgaatgagaatggggaaaataaa

SEQ ID NO: 74844 - DNA, 2846 bp, Heterodera glycines
  Genomic contig location: Contig_ID=SeqID_11444; Location=538..3383; Strand=+
  SCN-specific regions: Sequence locations=1-420,442-551,573-644,668 -847,889-904,1020-1402,1433-1433,1456-1507,1530-1716,1738-1833,1856 -1892,1924-1939,2198-2213,2251-2318,2341-2372,2398-2455,2620 -2642,2772-2846
atgatttctgctaatggtggcagcgccgccaaagtattaaaatgtctgatgtgtggccagtcggagtcacgcagcacgtttatggcacatattgcagaacatttgtaagagcataataattaataatgactaattactgtacccgaaaatacagtaacccattttttaattgaaatttgtaggaattatcgacctcaccaatgtgccgaatgcgatttccgatcagtgactgctgaacaaatggctgaccatgaagcaactactgaacatgttggacagttatacgtacgtttaattggttcaaccattaatactaatatgcaaattgattttccaattaattatgcatcatttgtattaattaggcatcgcgcaatccctacttggaccggctgtgccgttttgtgtacaacgactgcgattttggggacaaaaatgggggtctcgagaaagttttgatgcgcaaattggtcagcacagcggacgaggagcagcagatcatccgccaagcggttggcacaatgatgaaagccgaagaatggtgggatccatttttgtaaatttatatctttataatgtcttggttacggtacctttgcctttaggttactgtatgaaacaaattttaatttttttttttgactgccaattaaattacaattaaatttagcctaggcctagcaaactaagattaggcctaagcctatgcacgagttgccttttgtacgcgttgtcatgacactgaattgggtgctcaattcttatacatttttgtgccggatttagtgccaaagtgaacagtgccattgagtccgcaactgttggcggtgatcaacgcgttggacaaactgtacaacaatggcttcaacaacagcagcaccaccaccattttgatgctgccgaccaccagcaacaacagcaacaacaattctatgtacagtcaacatcatctaccgtaaccggcaacaaccgtaacagcaacaacaacagcagcaaccaatcccagcagcagcagcaacgtgtgtccagtgacgagttgaagctggaacaactgttgatggacactgttggggttggaggcggagcagttctcggtgcggtggccaatgtttcagcggctggcggtggtgccggtgttgtggcacaacaattccaccaggcatggcatggagaagagatattttccttttcttctgaacttggcatagaattgtgccatctaaacctgtttttgtttcttgcaaaaaaaacatttctaagtttttaatttaaacttgtttttaatgtgcaatttcaaaattctcacctaatccgaagctgggctaatagaaaatttcataaaaaatattttaacgatttatttaaacatagaaagtttcagaagaatctgcgttaatttgccatttaaaaaatcaaataaataaatatttttgaattttgtcattaattttgctttaagaaatttttttctaaacctccccttttatgtatatgcaaaaagtaccggaaaaatttttttataaattattgtgcaatttgagaaatcaaattccttaattgccccaattttatcttaaaatagattttgaattttcatcatttgacgcggatttaggcgaactttttgggggatgacattggcgctgcggatgaacaacagcaggacaaatcgccatcagcaaatgcgtgcagttcaatgcttcaacaatttatcacacaacatcaacaaccacaacagcaggcggtgagtgatcggaactgtgccgtggcattggcatttgttgatatcaattgatcattagtgatcaggatttaacaggtggcagtctggtgacagtattttcttgaaataaatttgctggatagacagactataagccagcagtctaatcaaaattttaacaatttttaatttttttttatgaatgattgctttcagtaattttataaaaatttatttttagaattatttaaattttttgttgtgcataaaaattttttcataatattttaatttttaatgaaggctccagtaattttttaaaatttatatttaaaatttatttaatttttgttttaggcgtggaaaagattttcataacttttatttaattaattaaattatcaatttgtttaaatattttatcatttacataatatttttataaaagtttttaaatatttagaaaaaaaatttccacgaaagacatttcttttaaacaaattttttaaaatttaattaataattttcaactgaaaatttgtttaaagttgatgacacaacactttgacggggttgtcgagcagtacatccatggccagcagcagccaccgccgccgacggcgccgcttcaattggccaacggtgaagcacatggagaacaacagccaaagacagtgaaggggcacaagccgtgcaagcaggtgttcgagaatgtgcaggtggggaaaatggaaaaaaaaagttaattaaaaaataaaaagtgaaatattatttaattttaattttaacatttgaaaaaaaatgaaaatattttttcatttcaataattgaaaagaatattaattaaaatggtaaaatttaaaagaatttttaaatcaaaaaaagtatatattaaagcataaaacattttgataactattaagaaaaaataataataagcataatacctaaaatgaaattaaaatagaaaaaaaaaatttgctaaaataattaattaaaatcaaaatatattatagtaaactaaactttttcaataaaacaaaataaatattttacagtgtttgaagtgtcgtcaatgggtgaaaggacgtggcatatgccttttgtatcacatgaatacaag

SEQ ID NO: 74845 - DNA, 476 bp, Heterodera glycines
  Genomic contig location: Contig_ID=SeqID_11448; Location=879..1354; Strand=-
  SCN-specific regions: Sequence locations=1-312,337-476
atgaccagtgggcaaaaagtggttactgaagcaaatgaaattgtacattgtgctccacaaagacccgatttgcatgctgtagcacgtattcgacttcaaacggacgaccgtcggggatttgagggtcggccatcagcagaagcctcaacttgcccagcagagtcagcacttcgacaatcagttctcggtattctggctcagcaatcttcaaaagtcaacaaatggtacccataaattggtcagtattcataaaacatccatcccacctggttcaatacttgttcgacctgacaatgaatattatttttaacagtgttttttcattgttgtgtttacctgtaatgcaaattttatttcgtttcgggtcatttcttgggtcagtccataactgagaacaatcccatcaatcgaaattccatgtggaaacattcggacggtatcccaaaggttctaaagttgttccattgagaaataaa

SEQ ID NO: 74846 - DNA, 2202 bp, Heterodera glycines
  Genomic contig location: Contig_ID=SeqID_11448; Location=744..2945; Strand=+
  SCN-specific regions: Sequence locations=1-275,300-911,935-1126,1150 -1942,1964-2202
tccgtcggacagtgaagattcgttggccggtgaagagtttcagttcggcatttggctcagacaccgacgcatcgacggagcactgaacagagtgccgtccaatttttatgcggttgtcctcgcacagacagcggatttatttctcaatggaacaactttagaacctttgggataccgtccgaatgtttccacatggaatttcgattgatgggattgttctcagttatggactgacccaagaaatgacccgaaacgaaataaaatttgcattacaggtaaacacaacaatgaaaaaacactgttaaaaataatattcattgtcaggtcgaacaagtattgaaccaggtgggatggatgttttatgaatactgaccaatttatgggtaccatttgttgacttttgaagattgctgagccagaataccgagaactgattgtcgaagtgctgactctgctgggcaagttgaggcttctgctgatggccgaccctcaaatccccgacggtcgtccgtttgaagtcgaatacgtgctacagcatgcaaatcgggtctttgtggagcacaatgtacaatttcatttgcttcagtaaccactttttgcccactggtcattttaatgtttagttcaaaaatcaatcactttaggcagaaatgggcacaattgtgttagagtgctgtggcagtgggatcggatgtgacggtgcccgtggaatttgcaggcatttttacgacacagcaccggcaggcgaatttggcaccgttcattatataattcgtgctgcgatggatattttcgccccttcctagtcacactgcttgtttcatagatttattctgttttcgtaaacaaattgcatctttagccgataaacatttactattgagtcaatcaattttcgaactttatttggtaataaaatccacaaaagacaaaagtggttcgtcgttttgtttcacttagcacattcattgatgagtgtttttctgaactccgtcagaaggctgtccgtcatcagctcagccatgaaatttcttaggtttttgttctttggtacaattggcacattgttttgttcagacaacaagaagcgattgacatcgaccgggagctgttcacctcgtgcggtttcagcgtggaccaactgatggaattggctgggttggcctgtgcccaggcaatcggtgaaacgttcgaaaagggtaccttgaccgataaattaaatttacttggtcacctaaaaagtgcctttccttttttcagggaacgttctcattttgtcagggcctgggaataatggcggcgatggactcgtttgtgcgagacacttgaagcattttgttcgtttttatgttatttgttagggcatttcttttttgggcaatggtaatgaaaatgttaatcaaagacggacggagaattaatttcccatttgaaagggttaattttaagaaatttaagggattttcgccttcgattctctgtccaaaaccatcacaaaatgatctgatgcaacgattgatggtcaatgcttttgataaatgacgaatcagggctgcacgaaaacaattttttaagaaaatgaaacgaaaaataataatttttcacgaaaaaaacgaactaaaaatttactaaaacgaaaagatttcgtgcagctctggtgacgacgaactgatgtaaaattatttcagcttcaattggaatgcctcggcattcccttcgtcgaatcattccctgaccccaattctattgagaagttcaacttcctcgttgacgcaatcttcggttttagctttcgtcccccaattcgggagccattcaacaaaattttgaagcaaatggaaagtgtccaaaatcgtgtcccaattgtgtcaattgatattccttcgggtaaatttgaacaaccgacggatttgtttttaataaaaggtcaacccaaaggttgggacgtggagaaagggcccccggatgaaaagagcggtttgcccattctgagccctttggcactcatttcactgactgccccgaaacaatgcgcacaattttttaaaggagaatatcattttttgggaggccgttttgtgccacctgcgtaaacttttaacaattttttcttgtgaaattgaacatttaagcttggtacagaaattcggacttgaaaatatgccaccatatgaaggatcttcccaatttatgcgtcttaat

SEQ ID NO: 74847 - DNA, 401 bp, Heterodera glycines
  Genomic contig location: Contig_ID=SeqID_11450; Location=161..561; Strand=-
  SCN-specific regions: Sequence locations=1-111,146-272,294-401
atggagcggaaccaatttccagaagataatccggcttttgatgcaccggacaagcaatcgcttgccgaatttgtcatcattctgacaattaggtaggtgttaattactccgaaaataattaaatttaaaaattaactaaatttaagaggcaataatcaacaatttaattcggttctgcccccatcaaatcgaacagcgatggcatttgtggaattgtttgagcgaatccaacagatcaccgtttcgcaccagaaactgatttataaggcattttttaaatcttttaatttgattttttacggattacggtacaaaaaaactttaatttgatatttttttatggattacagtacaaacaatctttaatatttgcgtaaaatttttttaaaagttttaataaa

SEQ ID NO: 74848 - DNA, 726 bp, Heterodera glycines
  Genomic contig location: Contig_ID=SeqID_11450; Location=2046..2771; Strand=-
  SCN-specific regions: Sequence locations=1-100,137-169,191-530,565 -638,660-726
atgtattcgcgttcgccaacgccgaaatctgagcgacggcaccaaattagggtttgttatcccatatggaaggacttcattatgatttagattcgaatacttagtccatttttcaataattttaatatttaaactaccgtaataaaatatgataccattgaaaattttgtctaaatttaaaaccattctcaaccccagttgaatagtcgagatgataatgatggcatcaacaacaacatgaatattaatgcttgtggtggaacaaacattagtggagagcaacaacaagctgctgctggtcaatcaaaccgaacatccgtttaccaccaaatttgtaccattaatggtcatgaaatgatgacgtcatcgtcaacaacaaataatgaaccgcaattagtgacaaataataattacccatgggcattagctgaaccaggaacaggtggctgcagtatggcatcagcaaatcagcaaatgatggtggcaacggagcattttggatgtgcatcggcagaatcaggcatttcggcaaaattaaaaaacaagaaaatgctatggatatccctggatttggcggaatgttttttacaaaaaaaaaatctctgaattttgggcgcacaattaagattttaatattttggagaacatttatgcaaatggaactctaacaatttaaaattttcacaaataatttactgaaaactttgtggtggcaatgccaataaa

SEQ ID NO: 74849 - DNA, 1218 bp, Heterodera glycines
  Genomic contig location: Contig_ID=SeqID_11452; Location=272..1489; Strand=+
  SCN-specific regions: Sequence locations=1-234,300-470,507-507,529 -982,1004-1218
atgaccctcagcagttaattaagccggaaatcagttgtattccgcaaaagcgctgcatgaaaatgagagatgttgatgacctattagagaagagaacaagtggttgaaaagcagcttcagccattagcataatgtcacattaatactaattaatgcataaatttgactattcaaatgtttattaaaagtactgataactatggaaaccctaaataaatcgaaatgaggcgaacctaaaaaattataaaagaatttttgcattaaaaaaatattttatcgaaaaaaaaaaatatttttttgggaattcaatcacccataaacctaaagtgaggctcaccaaactcttaagggacgccaaaaagaagagaattataagtcgttacgaaacgagccaaaaattcataatgatggcgatttcgggaggtaataagaaatggaaaaggaagaattgacattgaacgaagcaaaagtattttaaaaaatttaattagttttttcatatttttgcaaaatattaattgcttaaatttgctacgtttttcactttttggcgatggctccttcgattgcattcggtccacaagatgcgcacgttgcggcaaatattgaaaacttttcgaatccgtgcgtatgcggtaccattaggctcagttcggcgagctgagtaaaacggtactgaatacgcgcagaaccgttcactttaagacaaatagcaagtgtcaaaaattttttttgaaaaattcagtggtcaccgaagtttacgctttcggcatttgtcgaagagtgaacggttctgcgcgtataaggcaccgttttactcagctcagcgagctgaatctaatggtaccgcaaacgcacggttttggcgactttaggacaaattttttgttgtctttgtgccaaaaaggggccttcattttcaaatgatttttgcctaaaaccaaattcaggccattttttaggttctttgctttttttttgcaattttatattttaatattttcagcaactgcgcacaatgcttggatggacattcttccctcttttgaccatgctcaactcggcctcaaattggcattactttcgccacgtttcgaacttttggtggacaagtatttcgatgacaaaagcaaaatgacggtggaccagaaatcgcaaaggcaattttgaatgcggtaagtttttaaagttttctcggttccaaaaatggcccgaaaa

SEQ ID NO: 74850 - DNA, 856 bp, Heterodera glycines
  Genomic contig location: Contig_ID=SeqID_11454; Location=400..1255; Strand=-
  SCN-specific regions: Sequence locations=1-38,60-235,265-327,349 -525,547-643,681-702,726-765,800-856
atgtgggcatcgaatttgggcttgaaagacatcgtacagcgattgttgaaggccggggcacgagctgaccaagcggacaaaaagggtaagtaataaatttttcccgcaaccctccattagtgcctcaccctttaataaagccccacaaatcgcgtggggttgaaaatgggaccatcactactattcccctccctttctgtgaaaatttgattttctgaatttttttagatttgactataaaaatttagaaaaaataaataaaatgtttcgttttactaatttttttgagagtggcgccgcagcccataggactgtggaggaatacttaacaatatgcacaatttaaacatatggactggcaacagcaggccgtaaattgaggcgtcaaaaattctccctcttttttttactctcggcaaattatccctacaaatattctcattcaaacacggttttttttgaactgaattccccagcttatgaagtatgcatttaaaaaaatttccatatcaaaaatgttgcaagaatttaaatatttttttttttcactgatttcaaattaaattaaggagacacggcaattgatattgctgcacgaaaaggacacgtcgaagttgtcaaaatccttcgtgatgctgcactgtatatacatagatatatatttatatataaatatatatttttaatatttaaacgattaatttttgtttttgaaagttttcagacacaacgaattgtgaccggcgcgggcgagagacaaacattgaaatagaagagtttttaaaaattgtttatttttgagtttacttttaaattactaatatgactggcaaattttatgtcgcaaaagaataaa

SEQ ID NO: 74851 - DNA, 1095 bp, Heterodera glycines
  Genomic contig location: Contig_ID=SeqID_11455; Location=147..1241; Strand=+
  SCN-specific regions: Sequence locations=1-580,602-998,1076-1095
atgctagctgccgaatctggtagtttggagatgtgccgtctgttgatcgaggaatgggcagctgaagtcaaccagcaagcaatcgatggcacgacacctttgatgggcgcgagcagtgaaggacgcctgaacgttggtgggttgaataaattggaaaatcgataacatactacctgactctcttcattttcagtgatttatctcatcgatcatggcgctgaagtccaacacacagacgccgaaggatacaactcgctgatgcacgcggtgaagaacgggaagactgaagtggcacgacatttgctgaccaatggcgcaagcactgaccaagtgggcaccgatggtgggcacaacttcattcttttgatgaatcattacacaatttcccctccatttctaaggcaaacgggcacgggacttggccgaagaaggaggacttgccgaaatgatggacatttttcgcactaccacggcagccgaacgaacggaggcggaccattgaggggtgaaaatgatttttttaaatttttcactgacataaattaaaaaattcattttcagatagcaaaacgacgaccaacagcagcagcagatgacaatgagagggaattgcggctcacaaacaatcggacggatctgatttatattcgatcattttcatgtatgatgtattgcaaatgtattatcgccatgtatattttgatttgcttgtcacgctcggatatttgctgctctgattgtacatattgtattattgtgcctaacaacattaaatactcgataaataaattgtttgtccatcaattcttggtcattttggttttcttttatcgaagaaattacagcgagttctccagtagagttcattcgcatcctcataatttacaagggttgccagtattgcattcagttgctgaattgcgtccgcaaaatgaaaagatcaaaaaaagggcggcaccatctatagtactaccttaaattcttcaaatattatttggatattataaaaaattatatgaaattttttcgtaaacttttatttattaaaaagaaagttattttatttaaaaattttgaactttctttaagtaatga

SEQ ID NO: 74852 - DNA, 92 bp, Heterodera glycines
  Genomic contig location: Contig_ID=SeqID_11455; Location=3342..3433; Strand=-
  SCN-specific regions: Sequence locations=1-92
atttaacgtttactttgccttacatatgcaaatgaatcgcattcgcccgcaccagttaatctgctgaatgatctcaacattttctcatcagt

SEQ ID NO: 74853 - DNA, 1474 bp, Heterodera glycines
  Genomic contig location: Contig_ID=SeqID_11455; Location=1711..3184; Strand=-
  SCN-specific regions: Sequence locations=1-170,192-251,275-408,430 -537,559-658,680-772,794-1451,1473-1474
atgcaatttctcgcatttcttattgcttttgttggccttcttctcattgttatgcccacgccgactgtttcgcgcaccaacgccacaaccgagtcttttcactttcagcttgatcacactgatcagaatctcaaagtgcaggtaaatgaataatgaatgatttataatgatcagaaattaaaagaaaatgagtgattttacacagaaaatcgaaatggaagcccataatggaacagaagcggatcagaacaatgacagcaggacgaacaccactaacagcagtgcaattgctggacaaaatgtttacgatcagctgcaagcaaaaacggatgctgatttagggtaattaccgggaatgccaatctcgaaagtccaaaacgggagcgccggtcttcaaaaaaggggcataagagggcatgcaatttttggcatgaaatgggccaaaaagacacggttttaaacagaactcctaaatatactgattttgaagcatttttctttcttttaagggtcattaatttctttagtggaatgatgattttctttcgtgaaaatgatcatttttgacaatatttgttaaaaacaagaaaattagaaaaaaattttcagacagcgcttttcgacaacgtcgggcacaaaattccttaaatttcagcctaaaaatccacaataattgtcagtttttcgtgtttatttttgagtgtggttttttctagatttacaaaattctgctaaaaacttacgtgtttggtcaaaatttattagaaataccataatttttaaaaattttctccgctattggcaccactaaaggcccaaaatcaaagtcaaaaacgatgctccaaaattttgcaaaatattattttctaacaaatgattacagcgatcgtggacaataaaaaaagcaaataattgggagccgttttttaaaagttgttggtaatttccgttatgtccgtcccttttttcagtgtcgtcattttgtccgtgttcaaatggctgctttttgcgtgcattgggctcagttcgtcgtccatttgctgctgcgtttttgcagttggcaatcccctgagccgacaattgcctttcccttttctcgtgatgaatgtcgtcagtttgactgtgctcactttgtcaatgtttgcgatggcacttttgatgttccatggctttgtcggcactttgtctctgatcatttgtgcctcacttatcgctttttgtgccctctgttccgctgctgctggctatgtattgattgaacttgcaaagaaaattgttatattttctgatgattgatcgtacttttggcatcatgttttggcttttcgagataacgcatgcttcaattccttttcgcttatcgcattgtttttaagatcttgcatattttgacatattttttcatattatttctgattttgagcacagtcccggctttatcgtcagaacatttatttttcaaaatttaaataaa

SEQ ID NO: 74854 - DNA, 842 bp, Heterodera glycines
  Genomic contig location: Contig_ID=SeqID_11456; Location=100..941; Strand=-
  SCN-specific regions: Sequence locations=1-24,50-842
atgggaacaatcaatcaaattactttctttgtcctcctcctcttctcattggctgtgccggatgaatcggcaaatcacaccaccgcaaccatcgtcaattttactggaacgcaagatggtcagcagattgatcagcaatttgatgtggagaaaaatgatgggactgatcagaagaaggcgaatgacgggactgatcagaagaaggcgaatgacgggactgatcagaagaaggcgaatgacgggactgatcagaagaaggcagatgcaaagcctgctgagaggtaggttatctcatcgtcgacaatttccattaaaatcaccaaatttgccttttcgtgcccattttcccatatttaaatatccctcaccaaattcaatatccttaatgattttaatgatttatgtatgtttcagcctcatttggcccatcattggcggagttttgttcacaattattgcaatttttgtgtcagtcacgtgcttttttgtggcaaaaggcaagaaaattagcatcacgaagtgggtgctgccagcgtttttcattgttggcgttttgtctattattgtgatggcatttttggtgttttccgggtttgtcggtgttttggcattcattggcagttcggctctgatctgttgctgtggttgttgctcttgtgccggccttttgtttcaagaggattaatgcccaattcattatttttcattagaaatcgatcctaatgcaaaaaatttttattttcaaaaatcagcaaaaacaaatgtaattttttttctcttttttattttgacattcctatcgattaccccagattttcgcctatgttgaaaatcagattaaa

SEQ ID NO: 74855 - DNA, 496 bp, Heterodera glycines
  Genomic contig location: Contig_ID=SeqID_11457; Location=587..1082; Strand=-
  SCN-specific regions: Sequence locations=1-189,211-436,469-496
atgccaagattgtttaatttggatgcttctagaaaaagttatggcgctgatcaaaaattgatcatttttatggtgatcaaatattcaaccaagtatatctttttatgtaaaagtcgtagccccattattcaaaattcaaatcagtagagaattttgtgctctttccagtggccttgcccattttctctagaaaaaatttcccaaccccctaggaatttcgaaaatttcccgattttcagtgtattttgggtgtcccggtcactaggaaggagtgatctgattaagttggtgtaagagacttttttgatcagcaccaaaagttgtgcaagcatgaattatttcaagtttttaaatgaactataagatagtttttcaggtttgagtcaagaatttttctggcactgtatttctctcacaaaaatgcaatttgtttgggaaatattaaaataataatcaaattataattatggtcaacaaatctaattaatagattaaa

SEQ ID NO: 74856 - DNA, 155 bp, Heterodera glycines
  Genomic contig location: Contig_ID=SeqID_11457; Location=271..425; Strand=+
  SCN-specific regions: Sequence locations=1-155
atgattgcacgtaattgccgaaaaaattcgagaccaatttccgaatgttgaccgactaattgcaaaacgaaagccgtctttgtcaaagcgccttaccgagtcaaaaaatctggaaatgtatctcatatgcaatttcaaccaataaatttgaagaa

SEQ ID NO: 74857 - DNA, 1553 bp, Heterodera glycines
  Genomic contig location: Contig_ID=SeqID_11458; Location=676..2228; Strand=+
  SCN-specific regions: Sequence locations=1-333,356-360,382-519,546 -744,766-902,925-1101,1125-1130,1152-1528,1550-1553
atgaccaagaaagagatgagcgaagcattggacacatgggcacaagcacagggccaactgttcaatgtgagagaccgcgggggggggagggtgatcagaaaaggtggataattgaaaaggaaaagtgatcagaaaaggtgaagcatttgactgatcagaaataaaagtgatcagaaaaggtgaatcattttgtgatcagcagaaggaaaagcgatcataaatatgaagcattggactgatcagaaataaaagtgatcagaaaaggtgaagcattaactaaaagaaggtgaagcgatcaagtgaaaaattgactgatcagaaggcaaagtgatcagaaaaagatgaagcattgactgatcagaaggaaaagtgatcagaaaaggtgaagcatttgactgatcagaaataaaagtgatcagaaaaggtgaagcattgactataagaaggtgaagcgatcaggtgaagcattgactgatcagaacgaaaagtgatcagaaaaaggtgaaggattgactgatctgaaggaaaatgatcagaaaaagataaagcatcgactgatcaaagcgaaaagtggacagaaaaatgaagcattaactgacagtcatgggaatttgttaaaatgttgaatgaaatccattgcccctcggtgatcagactgtttaccttggcctgaaagcggcttatgagtcggcacggcaacaattggaccaacggcacgcggcacagatgcaaaaccaaacacaggtaatgaatgagttgatcatttaacaaccaaaatgccagattttttgaaacttttcttgtccccgaccggcaatcaccgaaagtctcatccccgaaaggtgtcggggatttaacccaaattaagaaaatcgttgactaatttttgatttggattaaataaagattaatttcattgatcagttacattttttttttggcattttaggcggtgcgcgaggcggacgccaaaattcaaacgattgccaagtgaattaaaaaatagaaaaaacgtaaacttttatgccattttcagcaaccaattcattacattagcggaggagaagcaacaaatggtggtgggttttcggacgaatttttctgagaaatttttcatgaaattttggagattttaaacattttatagggggatgatctagaaattatgatgaaattctgatttttgtcatttggaaagttttgaggagtttatacattttagattttcttgggcttagaagggaaagaggggtgccaaatttcgaattttcacactaaaatttatggcatttcatcggatatgccatttttaaatcagaatgcccaaatttgttgaacatcattcttccaggaacaaatggcaaaattcccagcggatgtgcagcaaacactgctccaatttgcgccctatccgtacaacaaaaagtgatgccgaaaaacgaaatggcacagaaaaagatggcatttttggcattttgtcgaaaaaatatgccaaaacaaaacaaattttgacaccccattttcatacttgattgttttttattggttatgga

SEQ ID NO: 74858 - DNA, 174 bp, Heterodera glycines
  Genomic contig location: Contig_ID=SeqID_11459; Location=1089..1262; Strand=+
  SCN-specific regions: Sequence locations=1-174
atgtcaattgcgttcagaggtcgaatggcggaggaggacagcggggggaagaagaaaaagtcggacgaagtcagtctgatgaggaaaaagtcgtgccaagaacaacaacaattggctgctgctgatcagcaacaacaacaacaacaggacgagaaggagggaccgttccgatcg

SEQ ID NO: 74859 - DNA, 1517 bp, Heterodera glycines
  misc_feature (1277)..(1277): n is a, c, g, or t
  misc_feature (1305)..(1305): n is a, c, g, or t
  misc_feature (1308)..(1308): n is a, c, g, or t
  Genomic contig location: Contig_ID=SeqID_11460; Location=652..2168; Strand=+
  SCN-specific regions: Sequence locations=1-185,207-696,719-789,816 -933,958-1006,1067-1174,1196-1464,1509-1517
atggaagaacagcggcgtccaatctgcgactattttgccataattggatatgatccggccagtggactgaaggttcttcaaaataggggctgggatttctttaattttccattggcattttaaacaaaaagtcaatgagttttttgcccacggaaaatttttaaccgaaaaaaaagaaaatcaaattaaatgtcaattttttattggatttttggataggaaattgacgaaattgttgataaattttgaatttttcaatttattaactatttttttaatgagttggggaagcgttttgttgagaaaaatgattatcaaacagacgctcaagcaaattttctgatgaaatttaccattttatatgtaccaaaaggcccattttaggagggattaaatttaatccgggtaagccgaatgtgggccgggtgcttattttcctctcacagaccgggcccatgtcgggtccggctaatgtaagtcggttgagctgttggcaagccggatttttgttccaaaaaatgccggcccgaacaccggtgcccagtacaatatctccatttaaagaaaaaatggtgggttaacccctatttcattccagcaagagcgcattgccgaatttggcgacccatccttggccacctgcagcaccagcagtgggccgccggtgcgcaagtcgccactggacgccacttatgagccaaaagtgattgcgcatttcccgacggaacgcccggggcgcccatttgcgccagaaatagcatcggtacaaaaatggggggaaacccggctttagaaaaattttaaaaaattccaaagagcctcagccaaggatttacgagtaaaaatgtattttttggatgggacaggtgacaaattaaattttattcgtcctaaatttcttaatggactactccttaacgggatcgcaaatgcatattttaaaataattaaaactctgtccttttagcggcctttgaggcataataatttttgggccaattttgccataatttattttaaaaaaaccaaataaatttgatttttctaaataaaattcatttaatatgtacctaattaaattatagctcgcattgccccagggcattcggcttcgaacagaacggaatgtgccccgggagccttttttccactcatttgtggtcattcgcgaaggtgtgtggccatttgagtgaataaattataccgcaaaatgccattaaaataatgaacaacacaaattttagatggttctcggatttacgggtgctcattgattntctttgaggtttatctaattaattttanaanatgtgaaatttgtttttttttttttttttgcttttttaggagctttcttccatcgaactccgacagcaaatgtatgaaaaaaggaatattgaaatatataatatattcaattaaaaatgtccttacaaattaggcattattggacatttatggctcaatttaaatttttttaaaaattaaaaatacattaacaattttttgggctgaca

SEQ ID NO: 74860 - DNA, 549 bp, Heterodera glycines
  Genomic contig location: Contig_ID=SeqID_11461; Location=1084..1632; Strand=+
  SCN-specific regions: Sequence locations=1-348,373-549
atgccattctttgactatcccattgaaacacttttcgcgcacattggtgttgaccaatttgtcaaactgttgaccagcttcatgttggagcagcagattttgctcatctccaaaagtaagggaggactaatgattattaattttatattttggcccaattttggaagttggccaataatttatgctaattaagccataacacaataatcggttaattgtaagattccaaaatgaaaaagtttttcaagaaaaatgagcaagtttttttggaaatttaaccaattttgccacaaaattcattaatacttcgaatttttcccggcggcgcctaacggcaccgcggacccaccattttacatatttttaaaatttgccactttttagaatttacgaaaaagtatattagtccttgagtgcccttgaaaatcgtgtccttcctttatgtaacagatcccaaattctaaattttgtgcatttgtacagtcaggcccatttctatccttgaatagccaacaatgttcttgaataaccaatgggataaaaatggaa

SEQ ID NO: 74861 - DNA, 1108 bp, Heterodera glycines
  Genomic contig location: Contig_ID=SeqID_11462; Location=265..1372; Strand=+
  SCN-specific regions: Sequence locations=1-185,207-216,238-388,410 -484,530-613,638-794,826-1108
atgaaaaacacaaaaccaatcaataatagtctgatcagggctaatgccactgattgctcaagatattattggtcatttcctttcaaacagtgcaacatttgtttgttggacatcgatgcgcgacgcttggaagtgccggaggatttgccatcctttccacgccaacagcgcatgatcagcgagatcaacgcattgattgcccgatcagcatctgctgctgatcagcaacaacagaagcaggcgggggaggacaaaggcgtgcatacattttatatgcgggtaaattctatattctatatgttatattttgatgcataattggtatacgattttttcaattcgtctatatatacattatattatggacaagtatatgttgttgatggaattttattttatgaatttttagaacatttgcttgtggccaaaaaattcgttcataaaaatgcattaaagacaaaaaaaaatgaatatttcatttgagtaaaaaataaaaagaaaattaaaataatttaaacaattttttttacaaaatgttttaaaggaaacgtgataaattttctgggaaaatagttatctaataattaaaattttcatttgtattacgaatatgtaattttttacaaataaaatatagcaaatacatatttcctggatactaatactcaatcttttattataaatatacaaatttgtatgcacataaatggcgcattcaattatttatcaatttagcagtatattttaaaatgctgtggtgctctagccctgaaaaattgaatctaaggttttctggaataaaaatttccaaattttacagggcctccaattcaatgcggccattcgtcagctgtttctggaccattttgtctcactgttctccacctatgaggcgtatttgcttcatgccggcacggagcatggtggcattgtgtcggtgccgaagagtcggcgcaagaatggccgaatgtttcgagagtcgagcgcaaattttgacaaaatttcatttctggttgatcagccggagtcggtgctctcatttctgagtgcattccttgaaacacaggtgatcatgaacgatcgatcgatcaatagggctcctgattaa

SEQ ID NO: 74862 - DNA, 3255 bp, Heterodera glycines
  Genomic contig location: Contig_ID=SeqID_1617; Location=1235..4489; Strand=+
  SCN-specific regions: Sequence locations=1-201,223-563,585-1245,1269 -1344,1385-2641,2663-3255
atggccggtggcggtggccgtgcagcactttcggcgtacgccattcgtcaagaccaacacggcgcggatgctgctgatctactgaccaatgccggcgtcgccctcaacaaacacacgtacacgcttgatgacgtacgacaacttcaacaatggctaaacaatcagcatggagtggggcaaattcggctcgtggtgttcgagaaagagcaggagtaccggatagtgttcaaaggcgatgggtatgttaattattttttagtggattagtcaatgatatattgaagaattgccgcccgcttcatctctgcattttgttggagcgcgcgcattacaactatattgggcgcagtgagcagctgttcaaagtccccggctactgcattgactgtgagcgacgggcggatgcgcgttaccatgcctcggggtgcaaagttgcgtgtcgcctctgtctccgctttggtgccggatacccgtgcaagtcggaacaagtaagtattaatttgttgtcaatcatgtaattattttttcaaaaaaagttgccaaacggtgaaagcagtgcccgtcgttgtaacgagtgtggcttcgtcttcccctgcgacgactgcttcaactaccaccttgtcaaccaggcaactgacccattggacggccgtggtttgcgacagcgtcgtacgctttgtcagtggcgacgattttgccgagactgtggccgtgttgcctatcttgggcttcaccagtgtccaccacttggccaagccgatgagggagcgcaattcaggcggctgttcttccattcctttgacaacgcagcggcagacccagtggaacaatttttggactacctgacgcgtcatgggccaaaaaatgcgcatacggtgtgcatcgcgcacaacggcggcaagtatgattttaacctcgtgctagaggcccttcaccgtcgaagtatgccgcccaaacgactatgcacaaccggcctgaagatctactcgatgaagctgggcggatacaaccaaaggcggatcaccttcaaggactccgtcaactttttcgtctgtcaattggatgcgctggtgaagagcttcaacctgccacaacacctggcaacggttaagcccttcttcccgtacatgttcatcaagcgacaacatctgcttgagaggctggaaggacttcccgggcttgactactatcaaccggacaccatgaaggcagagaaaagggccaaacttcttcgttggcacggcgaaaacaacaacaacggcaacagatttcagcttcgtgagcagctgatcatgtactgcaccaacgacgttgccattctgcgcgagtcggtcatccgttttcgtcatctgatcgaagagcatgcacaaggccttgacccattcattgtggcatcaacggcggctggtcttgcgcttgccacgcttcgtcggtgcttcctgccggcaaaccatctcgtccactcaccagaaggcggctacctgcgtgggcgccgcgcatcggctgagtctcagcggtacatccgcttcttcgagctggagcaccccggggcgcaagtgcaatgcgcgagctggtccgtgggggaggcgcacattgaagacacgggataccgcgttgatgggctttggcaccgccacccgccccttcgtcctctcgccatcgagtggatgggttgcttttatcatggtaattttttttgtcttgtttcttttctttttcataaccaacaaaaccaaggctgcccaacgtgctttcccgagcgacagcagcaactggcagcggggcggacagcggaagacttgtacgaacggacggagcaacgcctttttgagttgacgaacctgcacggatgtgaactgcacgtggtttggagctgtcagtggatggagcgtcttcgtcacgacccggagctgaagcgcaggtacgatgccgtgttcgtcccctgcccgctggacccgcgcaacgacgcactcaggggaggccgcacagagccgttcaagctccaccacgtgtgcagcgacgacgaagagattctgtgcatcgacattgtcagcctttacccccacgtcatggtgggttttctgtgaaggtgttcatttcttacggataaaaaaaaaattcagaaggccaaccgcttccccgtgggcaacccacgggtcgtgacgcgtgaagtattgctccatccaccaacagcaccacttccgtggacatctccggaaaacaacagcttccgagggctgctgcttgtccgagtgcttgcgccacgcaacatccgtgtgcctctgctcggctaccgcacaaaggatgggcgcttcacctttccattgtgtggctggtgtgccgatcgacgacagcagcggccgtgccgccacggagacgacaggcgctcgtgggtgaccgcctacacgcacgtcgaactcaacaaggcactccagctcggctatgtggtcaccgacctatttgaggtagtcactcatttaaaaaaaaaatgttgtgcacgaaaacacaaattaggtttgggactacgacgagtgggacggcacgctgttcagcagctacgtcaacacgttcgtcggtctcaaagtgcaggcgactggttggcccgaggggtgtgtcacggaagagcagcgtcaagcctttgtggaggactttgagcgcactgaggacatccggttggactcgtccaaagtggagttcaaccccggcctgcgcctcattgccaaaaccttggcaaactccttgtggtaaagatttttggcttttaattttgaaaaaaaaaagagacctacagggggaaacttgcgcaacgtgtgggccagacggagattcgctacacgcggactccggccgagttccataagctgctagacgaccccacgctggacaagttggactttgtccacgtctctgaccacatggaccgctgcgtcgtgcggaagcgacccgtgttcgccaaggcgccactgacgaactgcctcccggtcgctgcattcgtcacatcgtacggccggcttcagctgtacagctatatggagcatgttttggccatcgacggtgcggagctgctctactgcggtatgtttgtcacaaaataaaactttctgtggacattactatgttttagacacggactccatttactacgtcaacaagatgggaggcccgtgcgtagcggaaggagaagcgcttggccaaatgaagcgcatgagcacagcgcccgccgcatcgtcgaattcattgcgggtgggccgatga

SEQ ID NO: 74863 - DNA, 723 bp, Heterodera glycines
  Genomic contig location: Contig_ID=SeqID_1617; Location=5597..6319; Strand=-
  SCN-specific regions: Sequence locations=1-94,116-507,530-643,667-723
atggatttaattcttgcaaccgattggataaacaacgcttatcctgaaatggatttagaggacgccaacaacgagaaaaaagagtcaacgaaaaagcaagaggaggaggcggaggatcccagctggatcagcctcattgacgaggagatgaagcgcgagccgctggcccccattggtgaggagtcgccatcaacaagctgtttggttttaatccgagattaaattttaaatttaggcaccccaaaaaaatgtacgtgtgccgaacgccgtcgccccgtcccgctcgtggaccacctctgcaagcggtcaaatgcagtgcccatgagctgcatgtgctcttcaaaagcattgagaaacgccgggacattgtggagcatttgcgctccgtccaactgcgtaccgcccacctgcggccgtccgtgagcaattttccggtgtgctgtaatgacctgtccatcctggacacccactcggccccagcctaccgaggctacctcggcatcacggttttttattattattattttttgtgagtgcaaaaaaaaatttgaaggtccggatgcactattacataaaacacggcatccgtttgcgccaccccaatttgccgtgcgtcgttgaatttggaggcggagatcacaaaacttttttccctcttgaaattttgtccattgttttgtagatgtattcaatttccaattgtactgttgtttttaaaataaa

SEQ ID NO: 74864 - DNA, 3399 bp, Heterodera glycines
  Genomic contig location: Contig_ID=SeqID_1617; Location=7048..10446; Strand=+
  SCN-specific regions: Sequence locations=1-730,760-1185,1212 -2005,2047-2647,2669-3399
atgagaaggtcacaaatgctagcaagaaacgaattctttttggagacactgtgtagttctaaaaaagcgaatacccttattcgaggcgcatccgatgagcaacttttgtgccttgtcgaaatctgcctaaacattctaaagggacgggtccctttgcgtcctcggcatttgaataagctgaaagctcatacacaggtgcttcgccgtctcgctcgcacacgctgctctcgctcagccaaaaaggttttgctacagcacggagatggcctccccgctattgtggggctcattgcgtcaattgctcttccgcttattgcggatgtcattgaaaattataaataaggtgcaacaaggtaaaaaaaaattagtaataatgcagcatacaaagcgctatttgcttgtccccgaagaaatttatcagagtttggcagcaccgccaccggctgacggaacaccaattgggctggtccgcacccgaattaaacaaatcaaaaacgatgacggcataaatgaggcggaacgggcaatcaaatatgagcaggaacttaagcgtctcaacaagctcacaagggacgaggatgaacgtcccgtgggtgttaaattagaaaatttgagtgacgtggttgacgccatgcccaaaccagtcaacgtcagaagaccaattgttgtcgctacgcggcgccatctcaaggttgggcgtgcgcgaaaagaaaatgttgaacaactagaagatgatgatgatgatcatgatgatcatgaccatgaaactccaaagccatcgagttcaaataaacgacaacccacacaaacggaaatcttaaaattaatttataaaaacgcccaatctcttggagtgtctgaggaaggacaggtcttgagagcgggtgggcgaccgtttataaccagcagtgtttatgacattgttagtcacctgctgaacaaggacaaacgtgctcaaaacaaagagccaactgcattcaaagaatttgttgaaagggcaagacagatcccgctcttgagtaggcatttataaaaacatcacactgaaatttaagccatcattatggatttgaaaaagcttcgcttgctcgagtttttgtacaaggacctaagttcgcctgtcgcattcacgagcgttgaatcgctgctgagagaggcgcagaaaagtcaacgaaaaattagtcgaaaagatgtccaaaattatttagccagccagcgtacatacacactgcatcgtcaggccaagcggcgctaccgtcgattgccaacattggcacctggcttacacactgaatggcaggccgatttggctatatttgaccgacttgctaaacaaaaccgtggctacaagtacttgttagtctgtattgatacccttagtcgacaggtgtttgtggagcccgtaaagaccaagacgagcgctaacatgataatagcatttggtcgtatattcaaaagatcaaaatatatcccgtggaaggtgttgacggatcagggaaaggaattcactgcccgcgcagtacagcatttcttccgagctaaagacgttgaacgcttttgtatgctcacttcaccccaatttcatgccggaatggccgaacgtgcgaatcggagcatcaaagagcggctttatcgctactttacggagcgtaacacgtacaagtggattgatgttgtgcaagacattgttcgtgcaattaaccactcgccaaattcgagcattgaaatgcgcccagcagacgtgaactttaaaaacgcagaagcattgcgacaaaaattacatgatgcagctgaaaatgttgtacgacgccagccaaaataccgtgtgggagatcgcgtgcgcattgaaaagtacaagcacgtgttccaaaagggctatctcccacgcttcaccaatgagctcttcactgtggcagaggtacactctgagcgttcgccagttgtttatcgattgcgtgatgaccataatgaaattattagtggttggttttacgcaaatgatttatgcaaatcactagaagacaaacagcaaaaaatgtatgaaattgaaaagattttggtgaaaaagaggcagaacggtgtggattatgcacttgtgaaatcgaaagggtatagcgctcgctttaatagttggattcctgcaaattcaattaccgagaaagatatataaaaaagcactatttaataaatttaacaaaaatgccttcaaattctttttatgttgttgttccgtcgaacaccaatattgaaggaaataggacaaattctttccgagtgcgtttaccgtgcaaactacaattcaattcggaatgggaggtgggtctggcggtgattgtgtatccccactcttggccttccataggcaccgtggagcaacagtttgttcaggttgagtggcaaacgggaaatacggtgcggattgagcttccatcatcaaatgtcaccaacccccatgagcttggcaaaaatttgtacagactcctgggtgagggcagcgatccgttggcaaaaaaggtacgctcaacgcagaattctttcatgcttacgataaacaaggctcgtcggtggaacagagaagagtacattaagcgaaagaccaaagaaaaacggggcgtccgtgacgaagagctgctcctacaggccctgttgacagatactgggacagtggttgacctcaacatcatgacccacggccttctggcacgggaaaagcgtgcggaaaccagcaatatagcgttgagaatcccagctgacgataatgattcatatcaacaaaaattggatgaatacttttctagattaagtgagaaaaatttgagcattcttgatgaattgggcatgacaaaattgaccgccgaaatcaaaaatttgagcgaagaggaacgtgcgatccttgaagccacaaaggaaatgggaacggaagcatggattcaggcgtatcgtgaaatacgtcttgtctgccaatttaactacgacgtcaataaaaatcgctttgttttaaacactgacccacggtacgttaaaaaggtcaaagtctcgcctcaactcgcgtacattctcggtttcaacaacacggaatttatgcaggccgaaaacgaggcgaggtttatgccggacatgagcgggggtgtgtcatcctttcacgtttacacgccagaccttattgaaccaatgatgattggcgatgtgacggccccagtgttgcgcattgtgaccatacgcggagaccccgaccaagtgattgaagaacaattttttgccatacaatatcacaaaattttattaaaggaagtttctgaaattctgattgaaatccgtacaaatagcggaagtttgatgccattccaatacggaacttgtacattaactttactttttagaaaaatgtcctatttttaa

SEQ ID NO: 74865 - DNA, 349 bp, Heterodera glycines
  Genomic contig location: Contig_ID=SeqID_1618; Location=1304..1652; Strand=+
  SCN-specific regions: Sequence locations=1-349
atgcctccaaatgaaaattctgaccgtccctttcaacaacccgacaatgttcaaccagatcaacaaccgcatcaacaacaaccagatgaagacaccgagttgcgtgcacaaattgaagacgcggaggaggatttgctcttgaattggtggcgtgaagacccaacaattgtaagcttttttttcaatttagcatagtttttttaatttcatcacatttttcagattcgttttctttttggacacagacgcgcccctgccatcgaagctgcgcttcgtcaacgcgctgaacgtgaggccgagatcttgcgccaatatgccgagaatcagcaatgagaagtgaccgatcaaa

SEQ ID NO: 74866 - DNA, 1251 bp, Heterodera glycines
  misc_feature (1110)..(1110): n is a, c, g, or t
  Genomic contig location: Contig_ID=SeqID_11463; Location=17..1267; Strand=-
  SCN-specific regions: Sequence locations=1-207,229-357,379-525,547 -598,628-638,661-796,825-1147,1185-1251
atgaaaaaacaattgtacaaattaagaaatgaaaaagagtcaaaaattatttcacaagggcaaaactcagttaacaaatttattcgaaataaattatcaaaagttaatgaaattcctacgttaattgataatgctggaaatatgttttccagcaatgttcaaaaatgtaagatattagcagaaatatttcaaaagtcttttttaagaaaatcaattgttaatggtccacaaactcaatcaacacagaataagattaaactttctgacattgaattgaatgcgggaataatttggaacatattaagaagacttccccggcgtaattccacttcaccggataatgttccttacattttattaaaaaattgtgcagaaccaattacaaaaatattagcagatatatttaggctaattttggattccggtcaaattccggaaatatggcgaacatcattggtggtaccaattttcaaaaaaggcgaaaaaactgatccattaaattacaggccggtgtcattaaccagcactgtctgtagagtttttgaacgaattttgagtagcaaaattttagaatttctgaacagtacaagattctttgataaagaacaatttgggtttttaaaaaatagatcgactacaacccaaatattaaaaatgatggacgatatatataattctatacaaaagaatcaacaaattgacataatctatattgattttgtcaaggcgtttgattctgttcccattgatttattacttcaaaaaatcaaaaagattggaattgaaggaaaaattcataattttttaactaactttttaaaaaatcggagttttaaggttaaaattggcgaagaattgtcagaaagtttcagaatattttcaggagtgccccagggaagtgtcttagggccattactctttttaatttttataaatgatctgccgtcctttattgcaaatgaagcatcatcagttggcataaaaatgtatgccgatgatgttaaattatattatgcccatgaaaatgatgataaaacaaatcatttagataaagcaattgaagctttggaaaaatggtcaaaaataaatgggttagaaatttcaactggngaaatgttttgttctttatttagggaaaaataatatgaaaaaagattatttaattaactcaaaaaagatttcagaatcggataatgttcgtgacctaggcattataattgactcgaaactgcatttttcaggacatattaa

SEQ ID NO: 74867 - DNA, 1833 bp, Heterodera glycines
  Genomic contig location: Contig_ID=SeqID_11465; Location=2042..3874; Strand=+
  SCN-specific regions: Sequence locations=1-173,195-428,450-545,568 -1090,1112-1158,1180-1234,1257-1461,1483-1833
tgcatttccctgctgtcccttgctgctgctcacctcggcagcgaacttgacaccgccgcggacgaaagtgccaattccaccgacgacggcggcccaaaaaatggcaaccgaatgccaaagagaggggcggacagccacggccaggaggaggacgaccagcaccaaactttgcaaggttttttgtttgcttgcttatcatttaaatcgtcttggtgcgtagtttgagactctaacgaatttttgctttgaattcggtttttttgtttggtgaaaaatattttgcaggcccattccattacttgacagttcggtactcttgcagtttacgggatacttttaacatacattttagtaattttttttaggttttagaaattagtgaaaaataattttcaaggggttttcgaggtcgctgatcatgaatgcagcaatccatttttgccaattccgtacccctgacccgaatttgaacaaattcgaaattttcgaattcagaattagccaaattttctttgaatacagctgaaactgccttttaattgcggaaaaaatgcatgaattataataccactgtgatgaaattggacggactcaaaaaaaaaacttaggtgctcctattcgaagcaatgcaaaaaatgggaaaacatttctctgcttcagacgctgctccactgaacgaattggacgcctccgccgtttatttgccgtcgttggccaagcgcaaaaaatgccacaaaaaggcgaaacaacggcaggagcaaaaatggccaaggaaaacgaattggaatcagcagcaaatggaggacaatgagcagggggaggaggaaaatgaagacggaaacgagtctatggacgaacaaatgaaggcattccgaaagaccacgttggaccatcgcaaacaatgtccgtttttgagggacatgggattttcttggccatccctctaatttcgaccttggcatttttaaattccatccgtttttgaggggcaaggattttcttggccatccctctaatattggaccttggcatttttaaattccaatcggttaatccgccgtcccccctcattttttttggtaaaattaaccatatttttgatcaaagaaaacaactaacgggaatatcggttcttcgttaccgtgggaaattttgtcgatggaattttaaattcattcttatagacttcgattggtttctttttttcgaatttgatagagtctccgattggaatcacaaaaaattgtttggtttttgtaattatttggttcgtctaaaatttgttgcacctggggggtttggttggtgtcaccggttgtaaaaattatgaccatttctgccaaattccttgccaatttgttaccgattttagttttttaattttaaaatttcattttacagaggagcagaaaaaacgtgaggagcagcaaaaggcgaagcaacgacaggggcaccgaaaggacgaagaagaatattttgatgcatcgaaaagtaaattttaattgattttttaaagaaattttatagagaccgtaaaaatttacggttttttattattcttacaattagtaaaatctggcaattcacaaaaaatgcaaattttttgtattttttacgaaaaattctaatttatccccctttcattttccatattttcagtgagtttcaaggcggcccatctacagcaaactgttgctgcagtgcgcaattcgcttgttggcggctgtggcaccgccgcggggagtgtcaatgccatcgatagcgccggcaccgcaaattcatccgccgctgtcgcgtccgccgggggcagcgacgatttgtccacccgagggc

SEQ ID NO: 74868 - DNA, 59 bp, Heterodera glycines
  Genomic contig location: Contig_ID=SeqID_11467; Location=823..881; Strand=-
  SCN-specific regions: Sequence locations=1-59
ggattgctggggtcgtgggttcgagtcccaccgggcgagttaccttttatgttctacaa

SEQ ID NO: 74869 - DNA, 56 bp, Heterodera glycines
  Genomic contig location: Contig_ID=SeqID_11467; Location=1103..1158; Strand=+
  SCN-specific regions: Sequence locations=1-56
tagaacataaaaggtaactcgcccggtgggactcgaacccacgaccccagcaatcc

SEQ ID NO: 74870 - DNA, 509 bp, Heterodera glycines
  Genomic contig location: Contig_ID=SeqID_11468; Location=298..806; Strand=-
  SCN-specific regions: Sequence locations=1-509
ggataagctattgtatgctaccaagattgtgcaatttggttgcgtctgagaaaagttatgagttgttttatcaaaaatttaacaaattttgcactttttgtccttcgactcaccacggtatttgcgtttggaaatttaaatggagtatttcttttaatatatatgtacttacgtaactcgaaacatataaaatggagctgctgagcttaaggggggggacaaagtgacgccgaaaaacggacaaaattatgtagaaaaggacataaagcgttttaagccatttttgagttctcagatcaacatgaaggagtgatctgatcaagttggtgtaaaatttggtcagcatcaaaagttagcctagcaataattttttaaattctgctaatttgaaattgagttagtgtctgttaaagattttgcttcgttacttttgtatcgccaaaaattaggtcaatttggttgtgacactataactttttgagggattaactaatcaggatccttttttc

SEQ ID NO: 74871 - DNA, 1801 bp, Heterodera glycines
  misc_feature (2)..(2): n is a, c, g, or t
  Genomic contig location: Contig_ID=SeqID_11469; Location=833..2633; Strand=-
  SCN-specific regions: Sequence locations=1-259,329-521,544-718,740 -769,791-811,851-957,982-1020,1042-1057,1089-1415,1437-1488,1511 -1571,1620-1713,1735-1801
gntcgagtcgatccgctgagtgcctttgttgcggaactgcgaccgacgcgggtcgaattgtgccggatggcactggacgacccgtggtggggccgaagggcggccaaatgggcggaggaccaatgcggggcggcgtacaacgacatttactcggagaaatgcgtcaactcgcggggccaacgggcgttttactgctgccaattggcgggtaaatgtgaaaacagtcggaaaatactgtccaaaataaaactaaaaagcgattaattaaatttcaaattaaaaataaaaagcgaattaattatattttaaaattaaataaataaaaattcctttaaaatgtttaatcctttcacaatgaatgtttatctgttcagtggaagcgttcaaagcgaccaatcccacagaaaaagatgtgagcccttttttgccgcatgcgctgaattttgccggaaatgacggccaaattctgccgttttggatggaacattataagtaaaaatgggcatacaattgctttaccattttaattggactttctagaaagctttgtccccacaacccaatgcctccccagggtcggcccggatcgcacccaagcgtgactaatgactaattaaattaaaataatacccaaaaaagaaattccaaattaactcaaaattaatttaagaaattgcgcgcttctccgtgtgttttgattattgacagccgaaagattgggaaaaaagaggaaaagaagcgaattctactctgaatacatagttttgacgttatttaatatattgttgctgggtgaaattcatataaatggaaatttttttaaataataataaatctttattaatattttgcaaatatttctaatagtaatttgtgttgtttgtttatgggcaaaaaatccaaaaaaaaccccacaaaaaatgtctcaaagcttcactgtaaaaatcatgcttcatttgccttttaaaaaaccacaaaatgaggccaaagcctcataattgtgagccctgttcataattaacatttgatcattttaaaactatttttgtgtcttctgatttataataattttattcataaatatttttcgctacttttccatgaattttctttgcgttggcattatcgattctatcgattttttgacacgaaatattttattttgtcttcctacgtaaaacatgggggaagatacatttttcttaaagccatgattatggggctttaatgtaaaataataatttttacgaattttacattttttcatttttgtctttttcagtgaatgtcgccattttattggctattatttttgtttttctacactttggcaatatgttgctccatttcaaactctgtccaaacttttaatggtcaaattgtggccgatccatccactcctttcagagtgacagtgaattgtgaaaagtgcgaagaaaaggaaaagcaaatagatgtcgttggaaaaaaagacttccaaattgagatgaaaacaaaggaagaaaaagaacgaattggacgaatcaaactgcaaataaaatcattaacggatttgggcaaacagaaaagagtaattaaaaataattattaattaattaatgttaattgattatttaatttttcgaatttttgggttgggaattcaaaaattcaaacgcaattgaaattattaattaagggtcattgaaaaagaatttaatcaccaccatttcagtcaaatgaatgggtcattgaggagccgagttcagacaaaatttacaagtttttcatcggctattttacaccaaatgccgacccaaag

SEQ ID NO: 74872 - DNA, 570 bp, Heterodera glycines
  misc_feature (521)..(521): n is a, c, g, or t
  Genomic contig location: Contig_ID=SeqID_11469; Location=2112..2681; Strand=+
  SCN-specific regions: Sequence locations=1-194,264-570
atggtaaagcaattgtatgcccatttttacttataatgttccatccaaaacggcagaatttggccgtcatttccggcaaaattcagcgcatgcggcaaaaaagggctcacatctttttctgtgggattggtcgctttgaacgcttccactgaacagataaacattcattgtgaaaggattaaacattttaaaggaatttttatttatttaattttaaaatataattaattcgctttttatttttaatttgaaatttaattaatcgctttttagttttattttggacagtattttccgactgttttcacatttacccgccaattggcagcagtaaaacgcccgttggccccgcgagttgacgcatttctccgagtaaatgtcgttgtacgccgccccgcattggtcctccgcccatttggccgcccttcggccccaccacgggtcgtccagtgccatccggcacaattcgacccgcgtcggtcgcagttccgcaacaaaggcactcagcggatcgactcgancctgcgatcttatgaaaaaacaaagagaaaaacgatgtgtcaagagtga

SEQ ID NO: 74873 - DNA, 1596 bp, Heterodera glycines
  Genomic contig location: Contig_ID=SeqID_11471; Location=18..1613; Strand=-
  SCN-specific regions: Sequence locations=1-87,109-205,227-323,345 -418,440-536,558-654,676-772,794-865,887-960,982-1078,1100-1196,1218 -1314,1336-1405,1427-1500,1522-1596
tcactcatagccaccgcggcccatcattaagctttagcgtgcatcttaaaatctctggagctacgatcagcccacaaaagaggtctctaaatttgtattccaaatgtaattaacaccctcactcatagccaccgcggcccatcattaagctttagcgtgcatcttaaaatctctggagctgcgatcagcccacaaaagaggtctctaaatttgtattccaaatgtaattaacaccctcactcatagccaccgcggcccatcattaagctttagcgtgcatcttaaaatctctggagctgcgatcagcccacaaatgaggtctctaaatttgtattccaaatgtaattaacaccctcactcatagccaccgcggcccatcattaagctggagctgcgatcagcccacaaaagaggtctctaaatttgtattccaaatgtaattaacaccctcactcatagccaccgcggcacatcattaagctttagcgtgcatcttaaaatctctggagctgcgatcagcccacaaaagaggtctctaaatttgtattccaaatgtaattaacaccctcactcatagccaccgcggcccatcattaagctttagcgtgcatcttaaaatctctggagctgcaatcagcccacaaaagaggtctctaaatttgtattccaaatgtaattaacaccctcactcatagccaccgcggcccatcattaagctttagcgtgcatcttaaaatctctggagctgcgatcagcccacaaaagaggtctctaaatttgtattccaaatgtatcattaagctttatcatgaacgggcccatcttataatctctggagctgcgatcagcccacaaaagaggtctctaaatttgtattccaaatgtaattaacaccctcactcatagccaccgcggcccatcattaagctggagctgcgatcagcccacaaaagaggtctctaaatttgtattccaaatgtaattaacaccctcactcatagccaccgcggcacatcattaagctttagcgtgcatcttaaaatctctggagctgcgatcagcccacaaaagaggtctctaaatttgtattccaaatgtaattaacaccctcactcatagccaccgcggcccatcattaagctttagcgtgcatcttaaaatctctggagctgcgatcagctcacaaaagaggtctctaaatttgtattccaaatgtaattaacaccctcactcatagccaccgcggcccatcattaagctttagcgtgcatcttaaaatctctggagctgcgatcagcccacaaaagaggtctctaaatttgtattccaaatgtaattaacaccctcactcatagacaccgcggcccttaagctggagctgcgatcagcccacaaaagaggtctctaaatttgtattccaaatgtaattaacaccctcactcatagacaccgcggcccatcattaagctggagctgcgatcagcccacaaaagaggtctctaaatttgtattccaaatgtaattaacaccctcactcatagccaccgcggcccatcattaagctttagcgtgcatgttaaaatctctggagctgcg

SEQ ID NO: 74874 - DNA, 653 bp, Heterodera glycines
  Genomic contig location: Contig_ID=SeqID_11472; Location=2073..2725; Strand=-
  SCN-specific regions: Sequence locations=1-24,46-313,337-404,430-653
cagacattgtgcccataattcaccggcattttacacgcctttggtctgaagccgacatctgatcacggcaccacaataaaatgtgtctctgttaagcggcaatacgggaactgatcagattaccgtaactgcgggacgaactaatgcaaaacattgataattttggacacgatcacggaaaaaatcaatcctaagtgatcagaaaatgttccgccgatttcggtactttgacgaattctcgtacatcaatgcttttgtggattaccgtaacgcgccgatcagtagtgatcagatgtattcggtgatcagcaacatttcctttttaaaaatgccgtgatcagacgcgcagaccgtgccggaaataccggcaactctatcatcatcagaggggccaaatggccaacaattaaattaaaaatataaaaaaatcgacgaaaaatcacttcaaagctaggaaacaaaattatttctgatcagtgaggaagtgtgttggcgatggacaaactgattaataaaaaaatgtacaacaacttaaacagaagttgaacagaagaagagggggaggtgattagtgattaaaaagggaggaatcgaacaaaattcaaatgttcacagaggaaaattggcgaaatgccatcaattaacaaaaaaaa

SEQ ID NO: 74875 - DNA, 1473 bp, Heterodera glycines
  Genomic contig location: Contig_ID=SeqID_11473; Location=485..1957; Strand=-
  SCN-specific regions: Sequence locations=1-82,115-138,165-679,706 -748,772-802,831-859,881-1011,1058-1264,1314-1365,1412-1473
atgcctttggcaatgccacttctttcgttggcattcgcttcggcactcacaatgctttccagtaaatttacctgtaaaacaatttatttgtttttaaaattttagttaaacaaagtattttaattctaaataatccctaattaattaatttgtttattttacccctaattaattctttaattacccacatttgcctcagctgtccatctctgctcaatatcgcgtcgaattgccaagaatggggcactctatcaattggcacattgcacttgtggccaagcaatggccggtgcggttgcattggcccaactgctggaccaaatggcaatgctcgccacggtgtgccacgtgctatccgaccatattgtaagcatatgtataattagttctttttttgcttagttcaggggtgcgatcgaaaaattttcaaaataagaacatcaaggccaaaaaataagatttttgggtccaaaataaggacattttgcaaaattgctttaaatcgcttgtataacactttattcaattaatatagcatcaacttttgtatttttcgcctccaaccaaggaattttggagaatgggggggggagatggtccggcggtgccgataggcgccgccgaggaaaattttttgtaagttcgttatgatttgttaacaaattttcatcaaaaaggccaatttttgaaattaaaagccaagccgacgacctttttttgccttcgaaaacgctttttttgcggcgaatttttcaaaaatttttgggggttggacaggggcgtccggtggcgccgataggcgccgctgggaaaattttgtgttttttaatgcgatttgttaacagattttgtctaaaaattgccccaattttggttatttttgagctaataacgatagcccgaaataaggacaaatcttataaataaggacatttttattttataagatttggaacctccaaataaggacaaatcttataaataaggacagatcgcacccctggcttagttatacattaattaattaattagttcttaatttgtttgtttcgctttgcttttcagaatttgctcttccacaacgcttttgcgccgttgcgcttctctcctcccccattttggccttctgttgccatttcctcctcttctgctgatagcgttgtgttgcttgacctgctcgccgccgttgtgctgccgttttgcgccgccctggtgatgacgtgcagcgtacgggtgagaaataaaaggaaaagcggcgggagagatttttataaatttaaaattagtaaaaaaaaaagctaaaaataatttatgtgttttttaatttgataaaccagggcttcaactttaaggaaaagctttttctaaataaaaaattattttttatttagaaattatttttaaaaaaattgagaaaaaatttgtttgctttcattttcaggtcccagggagtttaggaaaaaaataaataaa

SEQ ID NO: 74876 - DNA, 2205 bp, Heterodera glycines
  misc_feature (21)..(21): n is a, c, g, or t
  Genomic contig location: Contig_ID=SeqID_11475; Location=79..2283; Strand=+
  SCN-specific regions: Sequence locations=1-197,219-496,519-599,636 -674,697-823,863-999,1039-1045,1079-1092,1119-1267,1289-1390,1413 -1471,1499-1650,1705-1834,1876-2205
atgccgccactccgtccgacncaacggcacagtgcaggtcaattagccaaccaattaaacggcacaaacaaaaaagacagtgataggcacaattacagcactaaagatgaaaataccgtagataggatggagacaccgtacttttggggaagtcaaagactcggaaaattgttgtaatttggttattatgatatatgatcatattgatcagtgatcactttatgatcttttctaataaattaatatcggagagagcgagagagaattaattagtcgaaaatttatttcaaatatcaaattttaatgctttttacacagaagcaattaaaaaaaatttgcaggtcaaatgcaacaaaaagtgaccaatttgcggattggactgattatgagaaacaatgctttgatttggtcgcatttttattattgaaattattttccaattgtgccaacaattcattttaagatgccattgctcaattttggcctttgcacgccgtaatttaccgcttttgaaatttgaaattgccaataaattaattacttttttcagcgacacatgcacagattatgacgtcagaaagctggtccaattcagtaagattttattaaaaatagtaatttaatttaattaaattgcaattttcagtttatgaagcggccgaactttcgatgggccgcaaatttgtttgtaatgtgaggaaaaagcaaattaattaaatcatttgcttaattactttcgcttttttaggtgtccgtccactgcagcaattcaagacccgaaagtcaattgtaccacgacggaaagtcaatggtacgaaaaggcaaaatttaaaaaaaagaaaatttaaataaattttaaaatcgtttctctgctcaaggccgtcctttgccttctgctagccatcggctcccttatgctttttggcactttctacgacatttacgtgcatcggccactcgaacgtgccgttcttgaaagtggccaaactgtaaaaacaaaattaattcattaattaattaaattaatttattaattaaacgaattagggttttattgttttttaaattatttaaatgattttgggctcttttccagaacaacaacaacaagcagcagctgaacattgcacgaagtgttggccaatccaagacaattttgttcattcgattgttttccgtggttcgctttgttcaaaattttacaacaaattaattgccattaatttgtttttggcccgtaatttggactatataatggacacgcggatggaggagggccaaattcggtgtttgcatggtgggagaattaagcaaattttcactaattgcaacaccaatgaattaattaatttttggtaattaggtgcccgttttctcagcatgtgttgggtaattaattaattaatacacagctgttctaatgattttgaattttacagataatctttggccatacggtttgtcccaattgttttttttatttattttttaataatttcccattttcagtattattacattggcacttctttcaccggcggtcttttgactttgccctttgtaaaaaaacattgttaaaaattcagataatttactccaaacgctgcacgaattccccaaatatttctacaatcaattggtacataattgtttaaatttattatttttatttttaaattattacaattttaataaattatttttcggttgtccaagctccgctcgcggtcgactcattctttctgctcagcggccttctcaccgcgtacatttttctgatcaaattgcacaaaaatcagtttcgtatcgacgcggccagcacatggtatcattgtttaatttaaaatttaattaattttcaaattatttttttttgcttttttaggttgccttattatggacgccgatatttgaggcatttcaaattctaaaatgccaatttgattttgtttgttttttcctttttaggctaactccaatttatgttttggttatgataatgaaaggtaatggccagcccatttttttgattatcaatttttgttaattgaactttttcagtcactgtgctcacttatgtctctgagggacctttttggaggccaattgttagaaaatattccacaaaacttaatgatgatggcatttttaattaggacccaaacttttgtcgagactcttggtgggccaatctgttgtacataa

SEQ ID NO: 74877 - DNA, 288 bp, Heterodera glycines
  Genomic contig location: Contig_ID=SeqID_11475; Location=4811..5098; Strand=-
  SCN-specific regions: Sequence locations=1-8,31-205,229-237,259-288
atgccgtgttccctcttttttcccatttttggctttgttgcccaatgctttttcggctttgttccgtccctccgccaacttcgaatgggtcgccgacttcagttggttcgtcggctccgccattggtttctgcgcattcgccgcgatggaacgaataaatccgaaaatgcaaacggaaaaatcggcggatggacaaaacgatgggacaataacagaagaagaaaatggggcaatctgagaagaagaaaaacaaataaatcaattgaacaaaatgatttaaacaattaa

SEQ ID NO: 74878 - DNA, 968 bp, Heterodera glycines
  misc_feature (954)..(954): n is a, c, g, or t
  Genomic contig location: Contig_ID=SeqID_11476; Location=1..968; Strand=-
  SCN-specific regions: Sequence locations=1-314,380-439,461-968
tttcagtccctcctttattgtgccaatgcaaaccctttcgcctcctcccccctgcccgtttcagtccccccttcgttttgccggtctctccccgctcggttggctttcctttgtgcttttttggtctgtccaagtcgcactgttccgtgccggcctttccgccgtccgtttgctcatcgacttggccggacccgccgtttacgtggtaatgatggcactggccgcttatttggtgactaccgccgggatggccaatttgaggatgagtttgaccattgaaggtgaaaaggcaaaaacttgagaatttaaaacggttttaaaaataaatacaattaattaattttaattaaaattgtaaattttataatttattatttatccaaaaaatgttttaatttggccaattcattcactgcagatgaaccgctgtccctttctgagaccgttttgacaatgttttccgcaatggcattaatcgtttcttcgatgggcagcgcaattttcagtttctgcgacttttcgcgcttcgccaagtcgtggaattcggtcaaattgggcaattttttcggtgaacttaattatgaataattatgccaaattagcatccccccatttcaaggtttgcccatcaattatttgctgttcgccactctgaccgtgctgacaatctccgccactaagcccgtgtttggccaaatgaccaccgacccaattgaaatggtcgcgcaaatcgactcgccagtggcagtgaccgttggcgcactcactttgacggtctgatcagtgatcactcactcgctgatcagtggggaatttcattgacttaaatcgcccaaaaaatcatggctaaaaatgaaaaatgggacccaaaataagccaaatttacaatttggcatttcaatttggcatttctgtttgtctgttttaagatggcgtcccatcgcattaacattngccacttcgtttgt

SEQ ID NO: 74879 - DNA, 4803 bp, Heterodera glycines
  misc_feature (3799)..(3799): n is a, c, g, or t
  misc_feature (4753)..(4753): n is a, c, g, or t
  Genomic contig location: Contig_ID=SeqID_11477; Location=108..4910; Strand=-
  SCN-specific regions: Sequence locations=1-310,358-633,655-681,704 -826,866-912,941-956,978-1014,1037-1385,1433-1604,1627-1774,1796 -1798,1826-1973,2017-2162,2193-2293,2338-2365,2390-2495,2518 -2604,2626-2718,2780-3462,...
  SCN-specific regions: Sequence locations=...3484-3644,3666-3704,3772 -4645,4688-4803
cgaatggattaccggatgctcagcgatgatcggagagagcgatttgtaagagcattgattttatataggctttagctcatttattgccactgtacagctgcatggaaactgtttaaactctaaagtaataaataggaaccgagttttatctggatcagagaccggaaaaaatttttatatagaaaaatagatacaggttaaacctgaaaaaatatcagtaaacgttacaggtacaggcaccaatgactaaatttctgtctgatttaaaatttgttcatgaagcgataaaaattgattgtttcaagtaatcaaaaattaaatcatttaaattattattatgtttttaatgtttttaaagagtttctattaattcgaccagagaatgcctttacaggttcaggcatttgccaaaagactttttttgtacaatatgccatgactccaacatcactgcatttgggatgccaaaaaagactaaaattcaaaaaaacaatgaacgggtctcggagattgctgatatattttgtgatggaggccgggttttgcccgattctgcagaaattaggcggttttgccatttagcacaacgcgtggctccaaatgaagaacggttacggttcccacgagtacgaccggctgtccttcttccactgcaatcccagcttaatcccttccgcccacgggggccccacctttcttttgtggcaccgtgaatatttgaaaaggtcagttttcttggtttttggcgcctcggttctttctccattctcggactcattgtcgatctttgttcttgaatttgaaaaagttccgaccctcgaatatctccatgtttttccatataaatcagttgataatttttaatgcaaaattttcgtcttgggttgtttcataaatccgccaagcggttcgaaattttttttcaattataaaaaattatggccataaaagtacaaaaaatctacagtcagaattcaaactttaatggaatttcgatagctctaagaaatgctctattaatatttaatattaaaaactttattgaatttcaaaaaaggtatggacaaaacattctgacccaatttttttttacttttatgataataacttttttctttctacataaatttatatttgaatagagaacacctagtgctattggatgataccaaggaatattaatttggttgaaactgagacaacttatgaatttatacgtgtgacatttttggcggatttaaaaaatgacctatcaaccgaaattttaatgcaaacaaaaaaaaattgttttatgatggaaatcgcaattcgcgcaattgacccatcagtgtgtcttccttattgggacgttacattggaccagcgattgccgaaagcggtaattgtttttttaaaataatttttacgaaaaataaataatactttttttaatgcagacagattcgatcatgtggagcaaattgttcatgggtgctcctgacaacggaaataaattcattgccgacggttttttggccaattggtatactgtaagttcattttttgtagcaatgattttaatttaaccctaattattcgtttcatacatatctcatcaatagattaattcaaatgacttgaatgaaaatatattcagtcgagcggtggcaaaattcgccgtgacctcggcttaaatggtcggctgtttggagaaaaggagtaaaaaagcgcactaatatttttttatccaattaatttagagttctctcaatgctaacgaaaagcaacatggatttcttttttgcctttacaaatgcagtaaaaaaatttaaaaataataatttttgtttttcccaatattttcagactccaaccagcgaatgcactcaatcgataccggacgtagaatctgagaacgcattggaattgatccacaattatgtgcattcatggataggaggacaaatggtaaatttattaattaattccaagtgttttaaaattaataattatattattatttttttaaaattaattgcggtatttttttaacctttttagacacgcttagaaacatcaacagaagacccaattttcttcgtttatcactgcttcctcgattatgtgtgtcaattaagactaatttaagtggaggggtctaagttttagaaatatactgctggtaattttatcaaatatattaattattattactgggcatagatttgggagcagtggcgccaaaagtggcagaatcgtgagcagcgcgaaacgcaatacccacccgatgaccaaattgttccggtgacaattcaaattttaaacatttttaaacaatttttaagaaattatttatttgaaatagaatcgaaaaaattggcattcgtaaaaataattttattttattattgtttttcagtgctcagggtctgaaaattatcgcctcagtgcaacaatgtacccattccaggatccggttctcctaattaaaggtgtcatattgcctttcacaatgctttggttttaaattttaatattctgcaatgtcctggaaaacttagaacaaataactgaaactttttatggcataaaattatgttttactctcggcactattacattctaattatttcataatttattttagctggcctaagcaatgaatacaccgacaatttgtacacatatgccacaagaccatcgtgtacagcaacaaatggatgcggatcaccgtaaaagttttttaaaataaaatttgattaaaaagaaaatttttggaaaaatattttgtaatatttttctccatttaagtattcattataataaagtaatgatgccattaattagccaagcagttaagttatcttttctgtgatttgacaaagcaacaaactcctgagcccttatgttgtgccaaaataaagtccggaggcgattgctcaatttttcaggggaacagttaattgaacccttttaaatattactcttaattagtttctttgttcattagatgaagagccatgttttgattccgtttgtattaatggcatatgtacagcaagcgaaaaaggcacgacaacggaacatggtgaaacaacaacaccacaaaccgagacaagttcaaccacgcttggtaaaaagattgtaactgatttggtgaaacatgtaattaatagacacatgttacaggtacaactcaacttggtgagacaaccgcaacacctacgacagggaccagttcaaccaatattggtaaacgaatgaaacaagattcttgaaataagtacaaaatgtgacagatacaaccctaattggggaaacaacttcaacggcatcggatcacttctctactgtgttttctctgtcaccctctcttttgacgacagaaccaactgatcagatcaccctttccacgataagcagcagcacaaccttaggcacattcacacccaacactaccgtgtcctcatcatacagtaaaccattaaaaatgtataaataaaatgcatcggatcatttttaatatattttgcagctcaaaatccatcatgttgttgtgtgtgtaaggaatgtgatgaagaggaacaatataaaatggtatcgtgcaattttttttaaaacaaaaaaactccggaataaagaatttctggccaaaagctgcaggattttaaaaaattctatatagaaatgaaaaccatgagaaccaatgcaataagagttttttctataattaatcattaaaaaaaaaaattctataaatacaaaaaaagaaaaataaataataaaatttttgttatttccttttattcaatcacatttnaatatttgaatatttatttttctgttagtccttcatcgttcccaatggttgaattggaaaagccaaacgcaagaaacaccgtaagcataagccacgctgcggtggtcgctcttcgcgcaaacatcgccaccacaagtcgagcagtaaaagcagcagcagcagttcgtcgtcctcgtcggaggaggaagacagtaacgagtgcgacggaaagcatactgtagtgagtggacaattcaaaaaaagagtggagtcggtacacttaagtgccgacactcgagcccccagcttcatttaagtgatcattaggcctggatttttagggtcgaaaaaacccaatttttggatcgaaatagggacgaaaaatggtaaaatattggcgaaaattttgaaaaatctgtgctttttttcaatgagaatgaattaaaatcgatgtaaataacttattcagcaatttagttacaaaataattatatttcctcttttttttgtaaaaatgtgtttttcatacatttctcaccgaaacaaagccgcagaaaaaagaactaaaacctaagaatccggcccttgtgatcataataaaacttgttatccgataatagatgataagcttttgattaacttttgttaattacaagtgatttaacaaatcacaaagaattacagttcgatatttttaaatgccaaaattcctttacataatttttcaaattatggcattagtttataagggatttacatacacaaaatcccttatttgttaggccgtcacaaccaccatttcttcatctcagcaaataacaaaatcaaccgacggtcacttgggcacgaccacaccttctccaacagtaaattttaataaaattgaatattttttatgaattttttaatctttttcagcctcctccacccaaaaagcgcgtttgccacgatggccatgagtgttgtgctcattgngccgcgaaaggggcgtgcacatctgcgccctcgcacatgaacacgtggtg

SEQ ID NO: 74880 - DNA, 757 bp, Heterodera glycines
  Genomic contig location: Contig_ID=SeqID_11477; Location=4070..4826; Strand=+
  SCN-specific regions: Sequence locations=1-138,161-187,209-484,532-757
atggaaaaacatggagatattcgagggtcggaactttttcaaattcaagaacaaagatcgacaatgagtccgagaatggagaaagaaccgaggcgccaaaaaccaagaaaactgaccttttcaaatattcacggtgccacaaaagaaaggtggggcccccgtgggcggaagggattaagctgggattgcagtggaagaaggacagccggtcgtactcgtgggaaccgtaaccgttcttcatttggagccacgcgttgtgctaaatggcaaaaccgcctaatttctgcagaatcgggcaaaacccggcctccatcacaaaatatatcagcaatctccgagacccgttcattgtttttttgaattttagtcttttttggcatcccaaatgcagtgatgttggagtcatggcatattgtacaaaaaaagtcttttggcaaatgcctgaacctgtaaaggcattctctggtcgaattaatagaaactctttaaaaacattaaaaacataataataatttaaatgatttaatttttgattacttgaaacaatcaatttttatcgcttcatgaacaaattttaaatcagacagaaatttagtcattggtgcctgtacctgtaacgtttactgatattttttcaggtttaacctgtatctatttttctatataaaaattttttccggtctctgatccagataaaactcggttcctatttattactttagagtttaaacagtttccatgcagctgtacagtggca

SEQ ID NO: 74881 - DNA, 1130 bp, Heterodera glycines
  Genomic contig location: Contig_ID=SeqID_11478; Location=199..1328; Strand=+
  SCN-specific regions: Sequence locations=1-21,43-139,162-424,446 -506,528-634,663-739,761-1130
atgtgggccccgcagggcggttgggtggtggtgatgggggtgaacacgtccagcggaattgtgagcttcatcgacgcgacgggggcagaggcgaacaaagctaaaacgattgagcatacttcactcagtcaggtgggccactgtcaagaaatacaaatgatctttcaagaatatttttgcaatttgtttcccattttcagggttcttgggacccgaccgggcgatactttgccacgtgcactttcgcgggaaagagtcgctatgagacgggctatcgcattcactcgttccaaggacgtgagctgcgacgtaaggcggtagacgccctgctgcgattcaaatggcgtccgcggccacccgtttcattgtccgagcaaaaagtgcgggagactcgcaaatcgttgaagcaattgtcagcgaagtttgaggaggaggacaaaagggaaatgctcaaagtgtcgaaggtaaacacaaaaaaatatattggggaccgattgatggcggaaaattccctttttaggaaataattgaacagcgcaaaaaggcattggaactcttctcgaacattcgcgtcgctgctgctaaaacatacgaagaagaacgggaaaaacggactgagctcagaggcaattcatttaaattctaaataaaataaaaagcaattaaaacaattgtttaggtggcattgaccaggaaattggcgagaaggacctcgttgaagaaacaataacagtggcactaaacacggagaaggagaaaatcagagacgagagcaaatagaggagagaggtgtttttcatgcactttaaattatgttttctgttaattcattgttaaatatgatatgtactcgagtttattataaggtcggcaatttcggttaaaatttattccgaatttcgggactagcagtacgtatgtgggtctaccacaacacaggtacaatcaatagacgtatttaatatgcagcgtaagtgggtcagaacagcaaaattgaaccaatggcgctgctattcgttcggattgtattaatccattttttgtcaactgtttctgacccacagtttccgtaattattatgtgtacaatttggggatattatggatggggtgggccaaatttacaaggta

SEQ ID NO: 74882 - DNA, 2290 bp, Heterodera glycines
  Genomic contig location: Contig_ID=SeqID_11478; Location=1355..3644; Strand=-
  SCN-specific regions: Sequence locations=1-483,506-1534,1556 -2159,2183-2290
  Gene Ontology: Mol. function=protein kinase binding; Cellular component=cytoplasm; Biological process=regulation of JNK cascade
atgtccgtcgactcggaactgtgcacctccggggaatatttgtcgacagtgaatgtcccggcggagctcgtggaggaagtcaaatctttgggatccattgaattcgttgcactccaaaaatgtgaagaggaggaccaaattccaacattttcaccacccaatgagaaattgtcgccaaaaagaaaacgtaagtgctttgaaattgtcttcatttgaaattgttttttagtcagtgttaatcaatccatcggagcgaacggtgaaacgaaaagtaagtgttttcgaattcattcgcaaaaatgtgcctaaaattctcccattatgaattttgagccccaaaatcggttcaagatgttctcagcagcaataagccctcactgcatagaacagaagcaattccctttgaattcggcgaagaaaattcgtcagaaaaaatggaccgagaaaatgcgacaattgtcatgaaaaaattgacggatggtgaggacaaacaaacaaaataaaaggtggaggtgtgccatccttttttttctctgtccacgcttttcggttccatccattttaattaataatcacgctttctgaatttactttttcaatttttcctgtttatttgctccgctgttcttaacacttttactaatgacactataaatacaagcccttttgccttggaatgctattttggtcacttttagggtccctttcggccattgccaatttgcctttgcatgttcgtgacgctttgaactcgtacgaatggtgtgccaatggcgctgagagtgaattgctgagcctcccaaccatgtggattgggctggagaactttttgtgggagttattctccataatattgtgttttattttcatacattcagcattcacatccattcggctgtgcgaaattggagcaaatgtttgcggcgtgtgaaaatgccggatgccgttctctcaattttgtacgtcatcatttgtggcaaatttaaattttcaattagacatttaaacgggcggatgtttgccgcattggccaatggttcagtcgctgtttttcaccggaatacaagtcagtactgtacttacagttccattaattgataatacctaattcgtgttattttgtgtgccatctttgcgttttagtcggggaatggtccgccagtggttactttgtggtcaaattgggttctgccaccagttcggtgtgccatttgtgcactgttggcggaaatgtatgggctgcctgtaggaattgtgtgatggtactcgacccgacaaccctcaaaataaaggttgatgaaaaacagcggaacaattactcacaatcagagaaacccgtatttcagcatgttttcactgcccacccgaggaaagactcccaagttcgacaaatgatttgctgtggaaaaggcgtttggctttccatccgactcgactcgtgcatccgtctcttccacagcgaaactttccaacatcttcaggacgttgacgtggaaccttacatctccaaaatgcttggtcgtcttccgctttgctctctcatttctaaatcctttcgtcaattcaggggctaatcagcttgacagccatttgcgaatcacctctctgagtgagctgaacagaaggatttgggtgggcaccggatcagggataatcgtctcaatccctttaaaaggtaggtcaagcgatttgtgtcaaatatttggattttgttgcgtcagaaaggagcagtgcgactgttgtggctgacctcgaccggggacggacgccaggccaagtgattcgtgtccattcgtcgggcgatgaatccacggcaaattccaccccattctgtgacattacaaacgctcagctcagcttccatggccacaaagatgctgtccgttttctgctaccattgattgctggtgaccatttttacacacacagataaacaatttaaacgaccaaaatttacagagggattttccgaccttacacaaagtgtcgagacgaaaaaagcattgatggtgtccggcggcgatggatatattgattttcgattgggtttgttttatacgttgaaagaaattatttaaggggggggggcaaaagatcgttgggttttaaaaatgtcaaaaacacaataggtgacgaagatgtaatccctcatgacaagaaggagagcaacgaaagaagcgcaatgacagagcaaattcgagcgagggatttggcgcatttgctgatttgggagacggaatgtccggtgaaagagctgaccggactctccagggacgaagaaggacagtga

SEQ ID NO: 74883 - DNA, 1570 bp, Heterodera glycines
  Genomic contig location: Contig_ID=SeqID_11479; Location=60..1629; Strand=-
  SCN-specific regions: Sequence locations=1-372,394-452,474-959,982 -997,1019-1570
  Gene Ontology: Mol. function=protein kinase binding; Cellular component=cytoplasm; Biological process=regulation of JNK cascade
gaatactatggcaatgagtgccatcgacacaaatgtacgctggaatttccgacctgatcagtgcgcatatgtcacagagtacgcatgccgacttgaacttggcaaatcacatcagcaccgaaagtgggctttggtcttcgagataaagaagtaattcacccgttgttttatcaaaggggattggcacgaagaatttggagaagagcaaacggtggccgaaattctcgcgactccacgcgccgacacggagaaggaaaaagaagcggcaacagagaaggaagtgaaggaggagaaagacgggcgacaaagcaccgccggacaaatggaacaattgtacggccgaattttgtgccagcgggggacagtcaatgcccaattaaaagacaaagcattcatcaaagaattctttgggaattttagctggttttaacaaacatcgggaacaatgttttattgatttagcattaggattttcatattttttggggggggggaattctccgcgaaatttcagcccgttaaaagtccgataaaattgagcgagcacggaccgccggtaaaggattttattatatttttttgtaatttaccaaactatgtcgaactgttaaaacctgttggacgcttgagcccgtcctactttagtttacacttgccattttcagggacgttgtcgacgatggcgacggtgtttctttgggtgccgaccttacaggtgagtattgggccaagtcagtttctcggttatatcggctatttgcgcctttgcctcatctcccaaaacctcaggccaattagttgatccggcagagttcgcctcggcgggtaattgccccaaatttatgaatttttcgtaaaactttttcgttttttgcagtcaacgacacatttatcggtatttgctaatttgtgatggtgtttggtccttttttgcttgttttgtgtgataacaacctttcttttttatttaaaattttatttgaaggatttaattgtttaggaatgggcaaagaagtggagaatttgatcagagagaacacggaactgttggagacaaaaaacgcattaaatattgttaaaaacgacctcattgcccaagttgatcagctttccaggcattgcttttattcgaaaattaattttaatttccgattcattcagtgagaaagaagtgttccgcgaggaggtgcgaagtttggagatggtcaaattgaaaatgtctgaacgaatccgcgagttggaaagcgaaatgaaggaattgaaggagaaaatgaacaattcggacaccgtcattgacgaaaaggtcggttttgtgttttacatgaatttgggtcccccccccattcatcaaatgttctaaattgttaatttgtctgactattattagcacttttatcccattttaaggaggaccgttcccaggggaaacgtttcacacgcgtggaaatggcacgaatggtcatggagaagaaccaatacaaagaaaagttcttggagctgcaggagacggtcaaattcacggaacttaaaagggccaaaaaacacgaagaagaattggcacaaaggcgga

SEQ ID NO: 74884 - DNA, 502 bp, Heterodera glycines
  Genomic contig location: Contig_ID=SeqID_1619; Location=90..591; Strand=+
  SCN-specific regions: Sequence locations=1-126,167-242,306-502
tttttcgctcagcgccaacagcgacgaaacaatttcattcagcgtaaaatttggcgatgattggttttggatgattgttgatgagaaaatcggagggaaattgaggacgagtgaccttgacgatggtaattaaaataaagaaaaaataaaataaattgaattttaaggaacaaatacaaaattcaaattaatccctcaaacatctggcaattttgtgattaaggtttggaaactaaattgacaaaaaataaatattgttttaattaataatttaaatttaatatgtttttttattgtatttttaaggcatccaatggaaaatttgtgagctgcagaagtgaaaatcactggttagtggcggacatggaatcaccaaagagtctctatgaagaatttgtgttggatatggtcaccaaaataacagataccgtaaccgctcgcgtacctctaaaaatacaataattctttcaattcttttatcctttgcaccagaataattaaa

SEQ ID NO: 74885 - DNA, 414 bp, Heterodera glycines
  Genomic contig location: Contig_ID=SeqID_1619; Location=709..1122; Strand=-
  SCN-specific regions: Sequence locations=1-80,133-261,284-414
atgaagttgttttcaacatttgttctatgtttgatgctcatcatcggactgatgggcattattgctccagtgaattcgggtaaatttaaaagataatttttaaatattttcaatatatgtaatatttatttagaagaggaacctggccaagaacaaggtaaagaaaaaagaaaataaagaaaataatttgcaaaaagaataactttgataatgtttcaaataccttaacaatatttcagcttctgctaaaaaggaagaagatgaaaagccaaagcccccaaaaggaaagggagcgggaaaattccgttttttgggcggacgacgaatgaaatgagcagagaagttgcagatttgcttagattagaggctattaaacaccaaattaccgatgaataatcatttaacaataataaa

SEQ ID NO: 74886 - DNA, 349 bp, Heterodera glycines
  Genomic contig location: Contig_ID=SeqID_1620; Location=813..1161; Strand=-
  SCN-specific regions: Sequence locations=1-225,258-276,312-349
atgattattgcaatcattgaggctattacgtgtataatttttattgtattcgctttcgtaaatacaaaaggtaatcaatgccatttacgttaatgcattcattgtgtctttgcatattcaattttaatttgtcttatgtcattcatattaaatgtaaattaaagaagcattgacaaaaaaaaagtttgctgagaaaatgctgaaaaagcaaatttttagccgaacttattaagaaattattttttaatttaaaatttgttgcggtttttatgtttgaatattttttcaaaaaaaaaaaaaaagaaaattatgcatttcaagattttcaatttgtattaggaagaataaa

SEQ ID NO: 74887 - DNA, 2406 bp, Heterodera glycines
  Genomic contig location: Contig_ID=SeqID_1620; Location=1216..3621; Strand=+
  SCN-specific regions: Sequence locations=1-21,44-142,178-506,528 -748,770-1153,1175-1218,1240-1294,1316-1363,1386-1507,1537-1634,1657 -2133,2155-2232,2254-2380
gattatagcaatgaaaaaagcattatttaatattattttatatgtgcatctaattatagaaaaaacgtctggaaacgatgtgaatgatgaagcacatttaaatggtaattaatatacataagaaaaaacgaataaaccccggaaatttttgtttaaaatttttatttttatttttttgcacaaccacagaaacagacgcagaagatgaaaagatgataaatcagtacaaaatgtatttgaaatatcacgaaaggttgctgaaattggatgcttatgggttggaggtagaaaataataacatggacgacgacacagaagcatttataaagttcaaaattgaagcagcaaattggcacctaaaagcgttgacattggaattattggaaaaggcatcgcaaattgcaaaaaataaccaaaaaataagcaaaaatgaaaaggacggacaatcacagctaaatgaggcattaaaaaagaatgtggaggaattagcgaaacgcatgtcaatggaaacaattgaaaaattggtgaaaatgcatggggaagttgagacaaaatgcgccaaaatgaaagatgatataatcggcaaaatattcaaattgtacgaccgttacaattttgtagtcagaattgtggtcatagtggacaaatggacgacggacaaaagagcatggagcaacattggacatgaaaaacgcatcaccgaattatttgaggttcattataaagggggaagaagggcctaaagccccaaaaaataaatggaaattcccgatatttcaaaaatattccctaaaaggtttcatatccgttctcgcaattggacgaagaagaattgagcaattcggaggaggttgtttttcttgacacttccgtcgctttcgttggcaataaatataaattgcgaataattcatgccgaaaatgtgaagaaaatggtcaaagagtcgccagtttttcgcgattttctctgtaaaaactcagacgattttgagacaaatataaagccgtcgctcgaacaaatggtgggctcgtccgaactaatacgacttgaggaccaattccccgaggctttgagaatcggtaattttgaaatttatgattaaaaataggtggatatgtccgggaatggggggggaggtcttggatataattaggaacaattaatttcttgatcaatgactgatcaataattctatggcttatggttgttcttccccaccttatccagtttcaatttcttcctaagaatgctgtgtgttaatttttattttaatgattttttgtaatctcttcaaattttaaaatttggcccaaaattcaccattttctccacaatgtttcaaaaatatccgccgctgccttacggcagcatcggactccattattctcttaaattttttagttcagcaaaaaacagcaaaaagaagaaaatatgaacaaatctcactcaaaattcaaaattttctcggcacagccggacatttgttctgattagacttttaaatcggatatatatatatatatatatatatttataatgtaaattctgaaccacacctgtatttttagttttatttattttatttcatcttttgtattttgtgcataatgtaagggtattaatgtgccgtaaagaaaattaattaaatattttaatccataataatcgtttacgaccacccatcatttgttcgtataagggcaatgattaagaatttaaattattatagacatgcttcaagtaaaatagcattaagttatttttttagatattatgagccaacagactttgttagaaatttatcggcaaatcctttcgccggcaacgaacgaagaagcaattgacgacgacaaatatggaagcaaaaaaatgttagcacgaaaaatgatggcaatgaccgtccaaattatgcgagaaaatgaaagccaattcaaaaaacaaaacccaaaaaatgggaatttgaaagaaatttttggacgaaaaatgaaagcaattttggcaaaagcatttgacaatttattctcagcaaaatccctttgtgagatggtcaaatttattagctttacgcgcgaaaaacgggcgcaaaagcaattggaaacggagctgaaaaagtgggagatgaacaaatgcgaaacggagcaggagcagaagcagaccatgtacgagttccgacagaaggagctgaacagtcgatttaagcaggacattttggtacttttggaggccggcggtgaacagaagaccaaaatgggcgaaattttggcaaaagacggtgccaaaagtgggttagtcgagctaatcgagtggaagcagtacaaagagttggacgacggcggatatttgcttggcatattcccatcaaatagttggctttttagggaaattcatttattttcatttgtttag

SEQ ID NO: 74888 - DNA, 3180 bp, Heterodera glycines
  Genomic contig location: Contig_ID=SeqID_1621; Location=1319..4498; Strand=+
  SCN-specific regions: Sequence locations=1-438,460-919,941-1028,1050 -1275,1297-1352,1374-1421,1444-1561,1584-1591,1613-1829,1852 -1962,1988-1993,2045-2637,2659-2705,2727-2765,2802-2927
  Gene Ontology: Biological process=N-linked glycosylation
atgctttccgcccaaaatgatgagcaattttttgagtggctaaaccgtaagtgctccactgatgagcggcttttcgttgccaatgccattcacacggtctgctccaatcgtttgcaagtgcgagaagccaatttcatggcatttcgccatttgctgctgagttcgcagcaattccgtgcctatttctgcaaattggccaactcatcacaaaataattacgtggaaaacaaaatttatgacgccgaaatttggtgcgacgatgggtggacgaaagtgtgctttgaagtgcaaaagattggcgaagtgaaggagaaaatattagcactaatcggcgacgagaaaatgcttttgttggaggcgcaatttccggaagttttgaaaattggtgggcatttgaaaatgaatggaataatttgtggcttttcttagatgccataatgctccaaacacagccatttctctacaaaaacattttggcacacaaatcgcacaccgacgaaaccaaattttggtcggctcggcttggcattgcgcatttggtgcaaatggtcaacgcaatgctttccaattttgggctttcagtctctttcgaattcgacattaaatatgggttcaccgtaaaaagtcgcgacattttctgcgaggcattcaaacatttgacacaacaaaaattccacggagggattggacggactttgtgcgcattggtccaattcaaaaattacgcgcaaacattttacgaagtgttttcggcagcaaacgatcgcttgaacttagaagcaattgccaaatggaggccaaaatgtgcagagaatgaggagcaggacaaggcttatcaggtgggcactgatcaaattaatagggacgagttgagaaaaactttctgatgggggaggactccgaagagtttcccttttggatgtaatttttcaaaattaaaaagcagttggcggaaaacaaagcgtaaatttaatatttttcgacaaaaaattgaccagctttgttcattttgagtctatctaaaaattttgcaaattttaagaaatttgttaagaagatttatacaaattttcataaaatgcacccattttcaaataattttatttctggggtccctccccccctcactttcccctatttacgttaaaaaagaaatgggtaaatataattgtcataatttgttaatgctacattttttaatgggaacgaatttagcaaatgaccaaaagccttgctacacaaaacggaacaatgctgaaaaatttaatcataggcaatgatgaatttaaaaagtttgtacaaaacacgcggggtgcacgagcacgaattggaaaattgctggtcagcgcagaggagcaccaaaaatttttggaattttgtggcgaaggaattcgaaatgaaaaaggtatttaagcgcacaaatggtgattggcttataccccacatttgcgcctcggattttacgttcccagcagatcccaaagaattattttaacagaaaatcatttgattctacatattatctcaataccttggcttgctcagtgcctgtcaaaatgggatttcagtttaaaataattcaatttttgtcccagtgggcttataaataattttttgatatttttgccaaataaatcaaacattcgaaagccattaaaagaaaaagctgcctttataagcataaaagaatcaggaaataattaaaataaagaatggatttttttatctgttaaaaattccgattatttaaaataatatgtgttaaaaccccttcaaaaaatcatagaaaaagttatccctaaattttttttatcgctagcaaaaaatcctttgttttcctcctcttcaaaaatgtttcattgtaatgtatttttgaacatattttttgtgaatcgcttcattatccaaaagagcactaacttttctccactaattatcttctctctaattgatggctctgcgatttttaaaaaacattcttttgttgctcgcgtttaaaagtataataattaagtgtttaaatttgtttaaatttttattatttgccacaaatatagcattttcagtgttcactgatcaatggcttatggaattgtatttggaattcttgaacaaatttgcaataatggacacagaaacacaaatgagatactttttgtcgttgtcctattcagtttgggtgcgttggatggaccgccaaattgacccaaaaaatgcaaaccttccgattggactgagacaaatttatgagcaaatttggaagaatcaacgcatacagtatgaacaaattgcgtatgataaaatatttgacgtaaattttgaggaattgtgtttcgaatttgcactgattttgaaggtatttgagccgttgaaaaaatttgttgaaacgaaacgaaacgaaaaaaatttgagaaaatttggcatcgaaataacaaaacgaaatgatgacaaaaactcaccacaaaagcagtacaaagagcacattgagaaaagtgagaaactgttggagcaatgggaagcaatttggacaaatgcgaagcaaaacattcgaatttggaagacgacggaatgccaaacgacggaatgccacacaacgcaatgccaagagggaaaactcaaaatggcacgaccaaccgaatggctacaaacattacattttgacacattgatggattttctggagaacaaagcgatgcaaagccaactaaaaaatagtatttcattaataaaaagaataaaaagattttcggatttataaaacaacgaaaataaatattaaatttaaattctaaatttattttgtgtcaattaaacaaaggtttgaaaaaacgacgagaaattcttaaaaaatggcttatgcaatttatggacaaagaaattgttgaaaaaattcaattggcaattcaattaaataatgaacaaattggagaaatgagaaaaaaacaaaaagagaaaaaagaaattagtgaagaaaaacagaaaatttatgaagaacatttgggaaatttagaaaaggaattggcggaagaagaagaaaaggagcaaaagaaaaaggaagagaaaatggcaaaagaaaaagagcaaaaggaaaaggagaaagagaaagtggcaaaagataaagagaaaaaggaagagaaaatggcaaaagaaaaagagcaaaaggaaaaggagaaagagaaa

SEQ ID NO: 74889 - DNA, 2094 bp, Heterodera glycines
  Genomic contig location: Contig_ID=SeqID_1622; Location=38..2131; Strand=+
  SCN-specific regions: Sequence locations=1-168,476-527,551-716,760 -1074,1113-1426,1460-1561,1583-1663,1685-1804,1827-1839,1879-2094
  Gene Ontology: Biological process=N-linked glycosylation
atgcaatttatggacaaagaaattgttgaaaaaattcaattggcaattcaattaaataatgaacaaattggagaaatgagaaaaaaacaaaaagagaaaaaagaaattagtgaagaaaaacagaaaatttatgaagaacatttgggaaatttagaaaaggaattggcggaagaagaagaaaaggagcaaaagaaaaaggaagagaaaatggcaaaagaaaaagagcaaaaagagaaaaaggaagagaaaatggcaaaagaaaaagagcaaaaggaaaaggagaaagagaaagtggcaaaagaaaaagagcaaaaagagaaaaaggaagagaaaatggcaaaagaaaaagagcaaaaggaaaaggagaaagaggaagtggcaaaagaaaaagagcaaaaagagaaaatgaaaataaaacagcaaaaaagaaaagcaaaaaaggaagaggaggaaaagcaaaaaaaaagtgaaaaaagcagcgaagtgacgaaaagcagcggcaatttgggaaaatcggcagaagcaattgggaaagaaagggggaaaaatgaaagggatgccaattccatcgaaattggggacgaagcagaaggggatgaattggaagatgtcatggcaaacattggcttaaaaggtaaaacaacccgaaaatggagtgggagtaatttaattactaattagtaggcaattaaaagcaaacaaaaacctaatgacaaataattttgtttacaaaaatattaaaaagaatggggggaaattaagcttaaagacaacaaaatttaagattttttgcaagagaattatttaatgacaaaatacgacgaattcttagaggagccaaatgaattacaaaggaaaatcctcgacattggcatttatttttacgagatttcaaatagaatttctgccgccgaaggaataaaaaaggctatttttatgcttaaaaaaagcgaaattgaattcaattataatagggagaacgaatttaataatttaaagcaaaaatgggaaaaaatattgcaaaaaaatgcaattaaaacaacgaaattgagccgaattgagtaccaagatatgaaaaataatttcaaaaaattatgaaaaaaaattattttggcaacggaaggaattgaaagtgccaacatagctgagataaaaacggacaaaaacaaaggagaaaacagaatttaaaaacacaaaattccaaatgcatcgaaataatttggcaaatgcaataatagcacgaaacgaaatgggaaaaagtggccaaaattgggccaaatgggacgacgaaagacgatacaatgcgctgattttgttgtttgagaaggacacacaaaaaaggacgatctgttcaaatttggtcgcccaattcggcacacatttggagggatggcggaaaatgagggaacagcagcgaattggtgggaattaattaatcaattatttaattgattcattagtgattagacattaaattcaattaaatttagaccaaatttcgataaatgagcatgtgaattacacaaacagcaaaatgagttgctctaatggagggactgaacaaataaaaatgaccaattcacattcatttatgctgccccaattaaaccagcaaatattttttaatgataacaatgatgaagagcatttaaaagaggcatatgaaaatgtattttaaaaaatttatgaataaaatcatttagttggaacgaattctcattgaagagcatttcgtgctgacaatggacccaaccaaagcattgaatgagctaaaagcagttgtgtccaattgggtacgatataaatcattttgcattagaaaacaattagcaaaattaattaatttcattagaaaacaataaaaaattaagtaatttcattaagtcgcaaggagaggcaaagcttttggagatcggctccttaatgttgggcacaaacacagcaacttcggacgtggacataatttatattgtgccacaaaagacaaccaaatcggaggcaatggacaaattctttggcacttttcaatgcgatttgtcaccgcgaaagtgcgaggacaattcgctgtattgccttctttgcctggtcaattaa

SEQ ID NO: 74890 - DNA, 297 bp, Heterodera glycines
  Genomic contig location: Contig_ID=SeqID_1623; Location=750..1046; Strand=+
  SCN-specific regions: Sequence locations=1-9,33-39,61-80,103-108,130 -229,251-297
atggaagagaaaacagcagaacagaaacaaaatttaccatcagaaaaagaggagggacaaagggaccgaatgataagccatttaaatttaaaatttaatgagcaatttaatgaaaaaattgtgcaaaagtatttcgaatctttgaaaggatgctttcaacgggtttcgctggtttcgaaatatgtcgatgagaaggaattggaaaatcagtgattgatttaaacctgttgattcttttttgattaaatgtgcatttttggaatacccattgtaataataattcatttgttgtcaaaa

SEQ ID NO: 74891 - DNA, 1361 bp, Heterodera glycines
  Genomic contig location: Contig_ID=SeqID_11480; Location=1491..2851; Strand=-
  SCN-specific regions: Sequence locations=1-232,256-345,382-677,759 -766,902-1081,1104-1180,1249-1361
atgcttactgctaatgaggccgttcaaagagaccaagatgagaaggaagtagaagaagaagagtcgtgggccaaacgttttcctccatacagtgcagaaacggagattgaacagcttgacgaatttagtttgcttcatcaacaaattgtggccggccgtgttgtgccgtgttgtgtaaatttgccagaaatcacggtcagcaaaagcgggactaaaaggccaaaattttcagttttttgatgtcatggcaaaactatttttttacatataaaatgatgcattaagctgaaatatttatctttctaagaaaacactaactggcatttcactaagttggaaaattatgttgaaatttttgaagaaaaccaaaaaagattgtgtattttgtgtaaatatgctcaagtgaactaactaccagataagcttggtaattatcgaaaaaaaacttaagggaaggcaggtatttttcaacaaatgacgtagaactcgaaaatttaatttaatcacaggaaatttccgaaattgcggcccaaaaattgaactccgatcggtctgccgggggcatccctttgcttgatattgtcaaaattatcaatgccacaagacaaagcgttgcaggcacagcttatcgtgtacaaatactgttcaaattgagaaaaaaggtgaaaaatatttggaaaaattaaaaagtttttattcaaatttaaaaataaaaagattaacacaaaaatttaaaaaattattcaaaaaaaataaatgaactaaataatttacattatttattttaaaataaattattaaagttaatttttaattttttattaaaaaaatgtaatagtataatttttactttaattttcttcgagttgtttcaattaaattagttaatttatattatttttggttctgttttttttctctttttttattaatttttgattttttcacaaacaaattcaggacttgggaaaaaaatcggaggccaccggaagcgaagtgcgttgatatttaattaatttcatggaaacgaagaaatagtttattttttgaattttagcaaactactgaacaatttatgactgggattttgtttttcaaaaaacaccaacgaaattttgattttaatatagtttttttcagaagagcaacattcaggagcgtagctattctttaagcccggtaattaaacaaaaaataattttaaaataattttaatttaattttaatatatttgttgaattttatattcacagatttatttgttcaaaatttatcgcaacatcaatgaaaccatagaaatcaattacaaaggtgtgtctaacggaggttcttatcattattggaaatagcaagcaaataaa

SEQ ID NO: 74892 - DNA, 358 bp, Heterodera glycines
  Genomic contig location: Contig_ID=SeqID_11480; Location=3258..3615; Strand=-
  SCN-specific regions: Sequence locations=1-187,210-358
atgttgatggatgcctgggggatcctcccaggcggggatcgattggccgttccactgaaatggctcccgactgatccgactgcccctttgactggctctccattgccttttaagcgcccctcgggatgggaggagtttatcggagtaataaatgtgcgtgggaaaataaaatgccatttccggtccaggccttacaatattaacttcagctcgagaaaagctcatttcaaagacgtaacatttaatctagcaaagacgcgaaagtgattgatcgattgatttctttgaaacagcagataagcatttcagaagatgagagcggatcggtagcatcttaaagtgagggacaacaaataaa

SEQ ID NO: 74893 - DNA, 934 bp, Heterodera glycines
  Genomic contig location: Contig_ID=SeqID_11482; Location=851..1784; Strand=-
  SCN-specific regions: Sequence locations=1-74,96-387,426-934
atgtatcaaagggagggcaccggaagagaatcgccaacaaattcaacaattgcgatgggtttgcggaatgtacggaattcaaaatgaaaagaataattgacactcattttttcagatgccgacaccacaatttcaaagaggactgcttcaaatgcggcgccccaaagtccaaaggcttttcctgcggaatcggtggcgagtcgttggacgacgggtcgtggtattgtgtcaggtcagtcgattccaaccgagcagcaaaacagtgccgtggcgccaattgccaataatgtcgctcagtttatttttgagtcataaaaaatctttttaaaattgtggggctatgcgcaagtgtcatttgacaactttactcaccactgaactctcttcaaaaaaaaaattgtttttttgaaaaattaaatttaaaagggtgcacccgaaatctcgccgccgaaagaagatttgaagaaaagaaattttgaattttctgatttttctgattttttccttgaaaaatttctattttttaaaaaccggtggagacattttgtctcggcgaaattttgtgtccccagcatttccgttttcagtgttttaccttttctttgccccttcagttgctggtttcttaacttccccaactttttgatgtgtcgtcagtgccgtgagggagtgccgaccgacgatcaattatttgccattcgcaattctcgttgggaatgcctcgagtttgttggcacattccgtgtccatccgtctctcccccgtttccttttcagttgcggtgcttacaattacgcgtccatcgcctcatgttacaaatgctcttcgcccgccccttcccttagcattttccctccgtcttaaaatgaaccgcaaacaacgcttttttgttttgttttgttatgatgtattgacagccgtttcactaaataaa

SEQ ID NO: 74894 - DNA, 428 bp, Heterodera glycines
  Genomic contig location: Contig_ID=SeqID_11483; Location=103..530; Strand=-
  SCN-specific regions: Sequence locations=1-217,239-428
atgtcttcaaattcagcgaatgaaccgaataacggtaagggatgaagtgatggttttgaattttgagtgaggaaaacaattgcttctttagtgtttttaattggtaatttgtggtcaagggagggcgtagccgaccctcggcttcgggcggggagctaaaagtcctccacctattccagcgacaacgccctttttacttttcggttttgtaatttttcatcgcaattttccaaacaaatttgaaaacttaagaacgaacgaattttaccgaacgtatttgggttcattaggttgccttcttttcacaaaaaaaaatttccatcatgtttaagtttctgtcgaacaattcgaacagttgcaaaatgatcagaagaaacttttggaacggatcaataaagtggcaaattcccaacagcaggaaaaatacg

SEQ ID NO: 74895 - DNA, 178 bp, Heterodera glycines
  Genomic contig location: Contig_ID=SeqID_11484; Location=24..201; Strand=-
  SCN-specific regions: Sequence locations=1-2
atggatgagttgggtatggatgagttgggtatggatgagttgggtatggatgagttgagtatggatgagttgggtatggatgagttgagtatggatgagttgggtatggatgagttgagtatggatgagttgagtatggatgagttgggtatggatgagttgagtatggatgagttgg

SEQ ID NO: 74896 - DNA, 573 bp, Heterodera glycines
  Genomic contig location: Contig_ID=SeqID_11484; Location=1..573; Strand=+
  SCN-specific regions: Sequence locations=1-21,200-272,294-573
atccatactcaactcatccatacccaactcatccatactcaactcatccatacccaactcatccatactcaactcatccatactcaactcatccatacccaactcatccatactcaactcatccatacccaactcatccatactcaactcatccatacccaactcatccatacccaactcatccatacccaactcatccatcgggatccgggacgcgaaaaataacggaattcggaataaacgaaactattacatatttacttggatgctcgaattaattaaaaaatggttaactccggttgctatgtttcgactagctatattactgctgacctgccctttaattttgtgtatggaatggcaaggctttatcattgacaaattcggatatttttttccggttgcggaacgtgatgccgcaacgcttttgacgctgattgctgataacattgaaccgggaacgttgattgtgtctgacggatgggccgcttacggagggattcagaatatgcagcagcgatacgaccaccgctgggttaatcaccgtgttttttttgtagacccccaagaccg

SEQ ID NO: 74897 - DNA, 1681 bp, Heterodera glycines
  Genomic contig location: Contig_ID=SeqID_11484; Location=990..2670; Strand=-
  SCN-specific regions: Sequence locations=1-94,116-426,450-1448,1470 -1681
atggctaatgctaatttacaattccctttgcctgattggggccacttcgacgcagacagaacaaattacgacgcaatttacgacagtgatcagcaaagcgcttccaacagtggcaacggggtgatccaggacttgtttaaacaggtggacagactcatgactcaaaataaacttctaatgtgaaagtaaattacaggttctccgctcgggcttgacaaatttagtgttaccaatttctgttcttgaacgacggtcgatgttggaaatgtacgctgatttcttcagtgagtggcattccattttgaaattttaactttaacagtgcttcccgtttttagcccaccccgacgaattggtctgtgcatccaccgaaaacacgccagagaagaggtggtgtttttttctccctccgccctaaacaaatgttcaaattttttaattttcagattccttgccgtgctcaagttttacctcaactcgttcttccccgcccggaaagaaggtgtcgcaaaaaagccgtacactcccatcgttggtgagacgtttcgttgtcgctggacgttgcccaaccaattgccgagcggtgaactcacggatagaggaccttttcctggatcagctaccaaccaggtcgagtttgacgggggggcgggggtctcatgattcaacatattacaattatcattttcagttgaccttcatttcggaacacatcagcaacagcccgcgcctctccgccttttatgctgagcacccggactctgccatttcgtgcaccgctcaaattgaatcaaagccattcatcgcgggattgacttcactgggcgtgcacaacgtcggaacgatggttgtgcgatttgggagggtatgttcacgaatgtgtctggccatttttgatgtttttcaccatttttcttttagcacaacgagacatacaccgccacattcccggatgccgtcgcccgtgattgtcacgccaccccttgggttgaactggctggcaaagtgggtgtgaatctattcgtgtttttgtattgaattttccttttctttaaaggtcgaaatacgttgtgcgcagagtggattcgtggcggcgatcgagtttctggcgaagcccttttttctcggacgggcccatcaaatttcgggacaaatttcacgcgacggcggacggcgggcgtcaatggtgctcaaaggcgcgtggaacggcgagattttcctgcgaaaaatagcgcgcggtgacttccaactcttcaccaatgtcaaggatagccctgaagtgcgcaaggtggaaattcatacattttctctcaaaattaatggacaattcaattttggcaggagtgcattccagtgatggaccaacagaacaacgaaagtcggaaaatatggcgccacctcaccactgcactgttccatcgcgacaaaacgctggcaaagctcagtgggttttgaatgaggggtcaaaaggctaaaaactaatggatttcattttttagttaagaagtactttgaccaacacaatcacctgccggggcatcaccatccgcgttatttcgtccagacaactgccgacaattgggagtaccgcgatgcgctgttgtgaacgatcggatgagcctcgcagaactctgatgatttggcgagcgaaaaacaaatgaggaccccgatatttaataaa

SEQ ID NO: 74898 - DNA, 1128 bp, Heterodera glycines
  Genomic contig location: Contig_ID=SeqID_11484; Location=3037..4164; Strand=+
  SCN-specific regions: Sequence locations=1-119,141-263,286-799,821 -1128
atgcttcttcctctcccttccgttttgtgcccttttcaacttttgcttctcatcgtcggcgctgtgtttattattctcgctcagtgctgtggttgcggtgggaagaaggtaagcggacatttcaaaaaacaaaatgccattcattctaaccatttttttcattttcagggaaagaaagcggataaaaaaggtgaacggcagcagcagaggacttttttatttatacaatgggggaggggaagccactacaaattaatgtcatcaaaaaatggcatggtttgagtgaaccaatcctctaacattttcataattaagtgctgctctgaaaagaatttttgcagttttgtgggcccgatttttttttcttctaaattcgtacaaaagcagaaaaaaatctattgttatgggttttcggttggggtcgttgatcgcggaatttgacattcatttttgtacattccgtatcccggacctgaattcgaacgtgaactcagaattcatatttatgttcgagtctttaaattacatctcctactcaaaaagcaaaaaacaattcatttaaatgttacagcaaagaatggcgctggtcaggcgaactcgggcgaacgcagcaaattggagaagtcagccgtaggcgtcggcaacggatcaccgaaagaagcaggtaaaaggaggaggtgtagaggagaaatgtgatttgtctgcgagtttaattttccctttttcagccgtcccggccaccacgccacagccagcagcaggagaagcgagtggtgagagataatggggagacgaaaacggcaaattcataatttcttttgttcgttcagcaaatgccgcggcgaaagcggagggttcgcagcgcaaaaaggaaaagccggacattttcatcacgaaaaaattgcctgagaacaagaagcgcgaattcgtttcaggtagagcgaagcaaggaatacgaataagggcgaatttttccaacaattccgttccttttcaggcaaaaacccggactacgagacgctcaagcagttggacatgcaaatcttcctcaagaagaaactgtcgggaacgcaggcgaggccgcacgacttccaatcgcaagtgtcgtcgcaacaatcggccatgtag

SEQ ID NO: 74899 - DNA, 1308 bp, Heterodera glycines
  Genomic contig location: Contig_ID=SeqID_11485; Location=288..1595; Strand=+
  SCN-specific regions: Sequence locations=1-303,325-358,396-777,799 -973,999-1032,1177-1203,1225-1308
atgcgatccatgaccgcctcgggcattcggaacgtgtccacaaacagctcgggcaaccgcagcggacatgtgtacgcaaacgcagccaaatggaggtatacggcggcaacaacggatggtaggatgtgggccagcgcgtagcagaccatgacaacttcactgacgaagttcgcaaatgcccacacactctttgacggcgaagtgtagaagcgatagcgacgcagaaactgcatggagtatggcacgctgaggttaaacttgagcacggacaacacctttataatgcgcacacaaagttatgactttttgaaattttcaagaaaaatcgtgaaaaacatttcaactttatttctttaacaaattttataataataagtttagttatttaaaaaattcgccggtgagatttggggtgtacacataaaaatccggtaattcaaaattaggtttcctattcacccgcggttccatgcgcaccaacagttgcaggatcgtcttgttagttcctgggactaccaacagagagcggtcgagaatgtgcacggataggctgagcgtttcgatggtctgcgttaagcgaacttgtacctgaattaataccgtttcaccagttttcaacatttttaaaatggacataaacaagccaatcgacaagaattgtgccaccaccgaatttcaaagaggacatcggcttctcaatgttttgctgttgaggttataagactgggaaatgactcattttaatttgctcttttatcattaatattctaaaaaccatattttttaaattctttttgtcaatgcttttcgaattcggttcatttgttttggtgggttaagtgttgatgatcagccgaaaatggcaaagaataaagaaccttattgacttgaaaaaaatagggaaatgaataaggttgttagatgagaacgacggactgccatgaaaacaaggaaaaatcgaataaacaatgagaaaatttttcaaaataaataataaaatcgtacaaaagtaatcatgtaggtaaataactgttataaaaaaatttttatgagaaaaataaataatttatttgtaaatttaaaataaaaaatataattattatttcagaaataacaataatttgataaatctttttaattacttaatttaatttataaatattattttaattatttggtcaaccatttcctttaactttaaagtttggaaaattccgttaattatttgtttattggctcccttcccttttgataatttatttagttggctcgcttaaggagtactgtaattaattttaacgaatagaa

SEQ ID NO: 74900 - DNA, 372 bp, Heterodera glycines
  Genomic contig location: Contig_ID=SeqID_11485; Location=4433..4804; Strand=+
  SCN-specific regions: Sequence locations=1-372
tatacatcccattatgaacgctataattatcagagtgccgaaaatcgcatgtgatctaagcctagaaaaaaatggtgtaagtaaaatcgtaattacgctcaaaaagcttctcaaacaattttagcgcatccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaa

SEQ ID NO: 74901 - DNA, 180 bp, Heterodera glycines
  Genomic contig location: Contig_ID=SeqID_11485; Location=4026..4205; Strand=+
  SCN-specific regions: Sequence locations=1-92,114-180
atggcccgcgctcacttggcggcgctcaaatggctggcgctcagttggccatgcacccctcccacgcctatggggggctaccgtaatccggacaaaatggagtctctaactactattatgagcgctaaaattatcagagtgccgaaaatcgcatgtgatctaagcctagaaaaaaatggt

SEQ ID NO: 74902 - DNA, 162 bp, Heterodera glycines
  Genomic contig location: Contig_ID=SeqID_11486; Location=64..225; Strand=-
  SCN-specific regions: Sequence locations=1-162
atggcacttttgctgtttctcaaagtgctcattccattcttcgtcctttcattgtgctttgtttctgccgcttccatcgatggcaaaagttttgcggaaaatcggcacaaaatcggccgactttcggcaatggttgcgatgataacgaacacaatggcaatg

SEQ ID NO: 74903 - DNA, 379 bp, Heterodera glycines
  Genomic contig location: Contig_ID=SeqID_11486; Location=544..922; Strand=+
  SCN-specific regions: Sequence locations=1-117,231-379
atgtggccaagtcaatgtttggatgctctaaatgaacgtaaagcatcaaaaaaatggagaatattggcaaaaaaagcgcttcatggccaattgaaaggagcacaaaaggtaactgaaaaataaaaagagaaaatgttaaaaaagatttaaacaatttaattatttaataaatgaattaaatataggaaaaagaagataaatcattaaataataaatggatatttaattaattgggcagactttaagggaagaaatccaaaggattaatcgatcagaaagtcgcgcgggggaagcccaaattggaagaacaaatgccaaaggcaacgaaagccaagcaaagggacggattgaggtggaagaaccctaaaaatgaacaaaa

SEQ ID NO: 74904 - DNA, 1518 bp, Heterodera glycines
  misc_feature (1419)..(1419): n is a, c, g, or t
  Genomic contig location: Contig_ID=SeqID_11488; Location=1..1518; Strand=-
  SCN-specific regions: Sequence locations=1-260,294-394,434-576,599 -685,707-780,802-934,956-1219,1242-1518
  Gene Ontology: Cellular component=membrane; Biological process=GPI anchor biosynthesis
tttcggcttttgctttgtttcgtcggcttctccgtccatttgcttttgctctacgccgtctttgacatttatttttcttctccaattgtgcgcggggcgcggccttttaaaatcgccaaaaattcggagagttttacgcccgccgatcgcatcgtttttttctcggcaggtcaaacaaatttgagacatttaccagtaaaagttacttaaaggtaattttaaaacaaatgaaactttgagaattggacacatttaaagcgaaaataaaaatttaaaaaaaacaaattaaaaatgaaagccaaactttctcaagatggacttcgagcaagaacattctaccaacacccgcatctttctccttttttgcatgggcttattcgtgatggaaaagttgtaaaaaataattaattaataaaaaaaaaaatcaatttttgaggctgcctggggcaatttggaaagtcatgtgccaactgagtccaggccgggccatgtggcgatgatggctgggttttatgaggacgttagcgcagtcacacgaggatggaagtagcgaactttaagcatagaaaggggaacatttaatttatttaaaaattaacagctaaaattaattataacatggcgatttaatccatgcaaatttcgttaaaaattaatggagaaagtttaatttgggtcttaaagggcttaattcataaattaaaacctattcaattttatttgcaatcctttgcccccaggcacaatccggtgccattcgacagcactctgaaccaatcctcaatggcatttctttggggttctccggacattgtgcacttattctccgaaaatgtggccaatgtgcgatccgacgcttattcgcccgaattggaggatttttcagacgaagacgcggccaaattggacagatgggtctttgatagggttaaggtggtggacaaattggaaaaagcgaacccgaattagttataatggttttttaattctctagttgttttttgatgaaattcgttccgatgcgaatgccaaaagtcgccttttgggcctccgtcgtgccatttttttccttcatttgctcggccttgacaccaatgggcatgggcacaagccgaactcggaacagtacttaaaaaacattgccacggtcgacgagggcattcgcggcattgttcaaatggttgagggatttttcggcgacaatcggtccgatttttttaaaagttttcctaatttaagcttatcaaatttgaacctccaaacttcagcactgcttttttgttcacagctgaccatgggatgaccgattggggctcacatggtaatcaatcgcccaattttttcatcgtattattggccattgacgcagtttaaggggacggaactgacgacgaagtgaatgtgccatttttggcttgnggtgccggcattgagccgagcggtgcgagtcgcaaattgtcgttggccccagtggacttggccccacttcagtccgcgctgctcggaacgccattccgt

SEQ ID NO: 74905 - DNA, 292 bp, Heterodera glycines
  Genomic contig location: Contig_ID=SeqID_11488; Location=2753..3044; Strand=-
  SCN-specific regions: Sequence locations=1-292
ggcgacagtggtggtccgttgttggtcaaaagttacgacggtcagcgctgggaacagatcggagtgaccagccgaggcaatttcgtatgcgaatcgaacggtgagggcagccaattaacaatcaattaactgatttaatcaatttttaattacccattagcattcattaattactcactgtgttatttttgaattgccttttcctattttaggcttcttctcctgcgtttatatctactgcgaatggttggcaaaaataacggagggcgaagttcagtgtctaaataatgag

SEQ ID NO: 74906 - DNA, 2696 bp, Heterodera glycines
  Genomic contig location: Contig_ID=SeqID_11490; Location=163..2858; Strand=+
  SCN-specific regions: Sequence locations=1-475,515-620,644-833,874 -1143,1177-1587,1626-1839,1872-2361,2385-2642,2664-2696
  Gene Ontology: Cellular component=DNA-directed RNA polymerase III complex; Biological process=transcription from Pol III promoter
atggaagtgattgaccctcgaaacactttattgtcaaatcaagaagtattggaacttctgaatcaagcaaagggacgtcatattccaacaaagggtcagcaaatgaatccagcccaattaaatctcattcattacctttttcgaaaatataattcccttccattttagattctcagaatcataacacaattgtgtatgaggcactaaagtatttgaatgaaacccccgcgactgcgcaacgccgacaggacataatttcgttgattaatgcgctgaaaaagttcaaattgaccggagcagaggtcgtcttgcaaataaatagcaacatttggcacctatcaggaatcctgcattatttaaatcatttagtaaaaattcctaaatcgaaaaatttgactttatgttcgagtccggggaccggaattgatcaacaaaagactgggttcataatcagcgacccaaaaaaacctagaacttttttaatgatataaaattttttgaaaattttattaaagtccgggtccaagattttcagccgggtatcgggtccagccgggtcctgaaaaaatccaaaaaaaatcaattcttttcaattttttttcatgaaaataaaagcttatacttttaaaaaagcatgaaaaatattaagttttacaaataaacgctttattaattgtctaatttttttattgctatttaaaccatttttttgcggtgcgcttttccaaaaaacttttcgggagcaggggctgtccggtggtgccgataggcgccgccgggaaaaattttgaaagtgcttcgagttgttagcagatttattggaaaaatgaccaaattttgtgattttggccaatatgtttacagaatttcttccaaaaatgttcaaattttcaagaaatatatagggttaaattttcaaaatttcttatggggaaattataaaaaaaactaagaaattttttgtaaaatactatgaaagcaacttttaagctttatttacttaatgataaaatggcagttttcaacaaaaattaaaaaaaaaatgcgagaaaaaacatgtgatatgagaaggaatgaacttgagcaaataacgaaacgaatccaacagaataaccattaggccacaggatcgcactccttaacaataaatattaaattttttccttcaactttggtcaacattttgaccctacccacattcttaccagtgtatttttggacccggacctaccggatcgggtactggattttcaaaaaatggggtctgggtcttagaaaagccgggtatccggatctggacccggtcgggtgcccggacccgtctaaccctaagatataccactcattttttcacatttatttcacttcacagataattcaaattgtaaatctacgaccaaaacaagcagtagaagtgcaactgatcgttgaagaatcggaggaaaggcttacggaggagcaagtcgatgaattagttgagacaatcatcaacagtttacctcggaattattaatggacttttaatattttaattcgaataaatcattaaatgtaaaatatgtagaaatcaactgattatttaccaaatgttttgtcttttatcgtttttcatttttgttgttatttatcttcgattatttcagacaaatgaacaaaagaactctttggcatatgcttctcaaaaacaaaatttgcaatgattgtgtgcgacgtattattttggatggcgcgagagttcaatcgacctccagtgtttcaaaaaggtgccaggggtctatgttagcagaaatgtgccaattttatgacttctaccccttaaaatgcatatttttcctgcgggcattttttaaaaaacaaatttgaaaatgcttttttatgcattgaacttattcctgtgtgtgccgaatgtcgcctattatttttagcttaattgtgcataaaccaacacgggaagaaattgcgcaaagagtgaccaaactgctgagagagttccacttggccaaggaatggcaaacaatcgaaggcattggcagggaactgagggaacagttgctgaattacccggccagtcgaatggtggtcattgaggtgttactcaataagaaacacccaaaattgccttagtttgaagcaaatttaggaccgaatcgtaatcaaaaatattaaaagatggtcaaaacgatgttcgaacgagcaaaccaaggcattgttgcaacagtgcttggcattgtgtggaacggtgccggaaacgaagaacccggatggcattgtcgcgttttgcgaaatgattaagccttcttcccccccccccccctacactttacaacgcctcctcgcccggtcaatgatgcctttgcttatccaccctctcccccttcccccacataaagcctttaaaagggattgttccctgctcctttttgcttattccctttctgttccctattcgtgcaatttccgctttttccattgcgtcccatcgcttttcaccgttgcatttcttcgccaatttaaagagtgatcgagaaatagtgatttgttgaatttttgtgtgaacaatttttgagtcctattcaagagtctggaagggttaaaatcgcattgggcaaatccccgccaatcgcgacaatataatagaaaaatttcctaaaatagaaataagaaaggaaatacacatgcaccgccactgctaaaag

SEQ ID NO: 74907 - DNA, 275 bp, Heterodera glycines
  Genomic contig location: Contig_ID=SeqID_11491; Location=1067..1341; Strand=-
  SCN-specific regions: Sequence locations=1-275
gaagcttactgtgggtgtcactattgccatcattttggtttgtgtttgtgtcatctgctgtgttccgatttgcatcatttgttcctgtgtgatgtcaaatattgcgcgggagaagcgattccttcgtcaaatgtcttcccacaaccgtgttggaggtggagggtctattggacgtgtgccgtgagcattttggcatttggtggctgccggcggcacatttgtcttggacacggattggatttttaaatgcgaagtgaaaactgatggacaataaa

SEQ ID NO: 74908 - DNA, 357 bp, Heterodera glycines
  Genomic contig location: Contig_ID=SeqID_11493; Location=68..424; Strand=-
  SCN-specific regions: Sequence locations=1-357
atgtcatttgtgaactatcctctggatagaatggaagaccaagtaactattgcaattgttgaaagaaatttattccaaaatataagcgctcctccaaattctaatgccccaatctcacttattgataaggttcaccaaggtgtaatacgtcttgaggatgccaccaaccgcagtttaagggtaattaataggagggcgactcaaaatactgatgccattaaccaaacaacagctgatatgaatgcaaacatggacacaattacgactaggttagatcaattggttgataaagtggatacacttgaatggtcagacaccaatgataacaggacatcactacaagggaattgcaccgtg

SEQ ID NO: 74909 - DNA, 282 bp, Heterodera glycines
  Genomic contig location: Contig_ID=SeqID_11493; Location=795..1076; Strand=-
  SCN-specific regions: Sequence locations=1-282
atggccgaatcgaacatgaacgcatgccccgcattcggagtgtgtcccacatgccaatggcattgcccttgcagtaagtcaaattcataatttttttttttctcccccttcgatttttcgctgaaattcgatctctaattttttttcaattcacttcaaatatcgtttattcacatactcattttcaattccgaattaagtatccaaagttactgtattattatagcagcatttccatatgaactttgctcattacagtcacttaatgttgatgatttctaa

SEQ ID NO: 74910 - DNA, 1864 bp, Heterodera glycines
  Genomic contig location: Contig_ID=SeqID_11493; Location=1246..3109; Strand=-
  SCN-specific regions: Sequence locations=1-67,96-252,275-444,466 -594,617-689,721-733,777-902,952-979,1007-1038,1071-1097,1119 -1159,1205-1360,1392-1567,1589-1864
atggttccgaacctcattggttcggaaatgacgccgatggcgaggatgggtaagaaaccaaccgtggtaaaattttttattttttttttaattttgagaaattcccgttagggaatcagaaaagacggccgtctataaataaaaaaaaagaaagaaataacgagtacctctaaaaaagagaagagatgtctataaatataaaaaaaagaatacttttacaaaagagagtgagaagagacgtctataaaaataaagcgctatagaaatgaatggacaaaagtgatcactcaaaatttggcaagaaaaatgtcccagaaatgaaagttaataggccaaagtctcaaaagtgaaacgccaaaagagctaaagtgaaaagcctaatatcccagtgctgatcagtttaaaaatggattactgtagagcgtcaatgaacttacctacggtaagagagagaaaaacaaaatgggattggtttcaccattaacataaacattcaaatcgtaaatatgcgccgtgcggagaggggcctaattgatctttgccctaagcaaaataacaaatttgttctctggtgtgcccctattcattcgccaaaagcaaaatgaagcacaaaaacccaaaagatggacgacgatttggcgtcgcttcacttacaatgtgcagcgatagtcattcccctcgtcagaggatgaacaaaacaaaatgttattttagttttaatccaagtgccctcgtcagaggaatagaaaatttttgaaaaatatttatttagctaattttttttttctcttttattttaaagtgccaattaccgtctttaattaattggaatctaagcaatcagcatttggcattggatttgaggtagacaatcaattaattattcataaatctaattagtcattaaaataattagttaagtaaatttaaaaaaaaaaaaataaaaaaaaacaatcttcttttgacgcgaatgtttgttaaaaaaaaaaaaaaaaaaaaaaaaaaagacaaccgaaaatatttatgttttttgtggggaccaaaataacccaaatttaataaattaaaaatgttccaagtggctttttatcaattcattttttatctttatctattttctatacactatatatatatatataattgttattatggcattaaaaaaaaaaatgaaaacgaaaaaaaagaagtaaaaaaaaaaaaacattcgaaatcgaaactttttgggggtagcgtgaatcgcaatggaaatcccggaggcccccttgccacctaacccataacaaatatgcgatatttccccaaatcagccaacgggatgacctaatgtggttcgttgccctcaataagtgagaaatcgaaaaaaaaatcaaaaaaaaaaaaaaaaaaaagtcgaaaaaggcataaaaaataaataattgaaaaatgccaaatgccttaacatgccatacaaattgccatttttacatcatattcatcgtcctaattactcatttatctctaatacaaaaaaggcagttggaacatgagttttccttacatgtttaattaatggtcactcatttcgaacaagaaatcgtatttgacagaatttgagttgtttttttttctcacgtattttacggtgtttttcgcggttttggttgcttgcgtttctgtaaattttcagtaaatttcagttttgaactcagcacagacactcaacgcatccggcacatttggtatgtacatcacttgttcagtgaatggttattatgtggtaaacaatgctggtacataaggtttattttaatttttgggctgatattactgattcttcgacttattcacacaaaaattctcagaaatagggtcaacaattaaa

SEQ ID NO: 74911 - DNA, 1921 bp, Heterodera glycines
  Genomic contig location: Contig_ID=SeqID_11495; Location=400..2320; Strand=-
  SCN-specific regions: Sequence locations=1-131,153-325,347-690,712 -1813,1835-1921
atgttgttgccccacggaaagacagcggggcaggtacgggagcgcgacgcaaagcggatggaatacatccgggcccgagtgaatcgtgtggacgtgtactgggagtgcaaaatcacgtccatgctagagcggagcaaagccatgaggaaatccttcgcgaactacgtggatgacgggccactggtgatcagggaggcatttacgggaggacggaccgggccactgaaattgctgcgcaaggcggggcccggagagaagatctcctattacgacttcacgtcgttatacccttacataaagtcagttctttttctccatttgacaaataaattttaaatcttaagcttcaccactcgctatcctgttggacacccgaaagtgcacgtgctgaaccaacaagtgcagtggacaagcgcagcggacaatcctttcccgctggcgctgctcaaagtcttggttgtgccaccccgccaaatcgatgttgcagtgttaccggtcaaagtggacgaccgactgtgctttccgctgtgcatcgcctgtgccaaagaatatccaactggaggcgtggacaacgactaccactgtcagcacactgatcaacaacgcgggtgggtcagcacctgtacatcgattgagctcaacgcagcgctcgacgagggttaccgcgtcacgagggtgttccgcgtgctggagtacgaacagagcgacgacaaactattccgcccctacattgctgagttcatggcccagaagatccaggcaagcggttttgacagcagcataagaggggacgctgagaaggaagaacaatttgtccaagagtgtgctgagcagtttggcatcaacattgacccggcaaaaatggtggtcaacaaggggaaacggtccctggcaaagctctgcctgaacaatttatgtgagttttgacatatgaattttgacaaaaaatgtaattttcagggggacgtttttcgcttcgaaatttcggtctgtcccagacacttataacggacgacccggtaacgctagccgaatacttggacaacaaatcgatcgaagtcacatcgattgatcagctggacgagatgcacatcctcatcacctacctccacaaaaaggaatgggtcgatgagcacgcttgctcaaacatcggtgagaataaacttataaaattgtgctaattttataactttagtcatctctctgtggaccacttccgctgcgcgacttgttctgctcaaagccatgcagaatgtggttaggtcgccggggtccgagctactctacaccggtacatatgccctaacaaaattacacaaaataaattgcaaatattttttagatacagacagtctcatcctcgtccacccggaggagcgatgtccgctcaaaactggtccacacctgggccagttcactgacgagtacccggaccacgacattgtggagttttgcagtgggggtgcaaaacaagtaagtttaatgtttatacattaatttgtattgattatttcacattttagtatggtctgtgtttgcgacgaaagggagctggggcggatgccgaaaaggaatacgtgctcaaggtgcgtggattgacgctgaactacgacgtgatcaacaaccaaggcatgcgttacgagacgttcaaagaagaagtggtgcggtacgcaacaacgggtgattatgagccaatcattgtcacttatcctaacttcctccgaccgaacattcgggagggagggagggtcgtatccatgcccctacagaaatgttaccgaccatatgttgggaagggaattataggcagcgatttcaatgtgaagaattttggccacactttgtaatgtttttgttttctgatgtatctgtctttctcatcaatacaccataaattgtatttaactcgtttttcaataaa

SEQ ID NO: 74912 - DNA, 1164 bp, Heterodera glycines
  Genomic contig location: Contig_ID=SeqID_11496; Location=7..1170; Strand=-
  SCN-specific regions: Sequence locations=1-246,268-1164
atggtggccaaaagccgtggctgggcaagttggaagttccatcgctaccttcacagccaacacggccaacagggttgtcttcaaagggatgctttgcaactgatgcaacaaattggcgcacggcctggactcaatgcgtatgatgctgaaattgttgtgccccgggtggtggaccattggaacaacagccagcaacgacatcgttttgctgtgtttatttttggctccacgggtcagtacaagccgctgtacaaatacatcaacaactattacgacacaccaatctcactctacctaaacaacggccattttgatggtgtgcagaaggaatatggcttgtttggtcaacactactgccttgaatgtgagaagccatatcaacgaccatcaacacatctaaattcttgcaaagcacgctgcatgctttgttctcgtgttggacctcgcttcccctgctctccgttggatgggtttttccgtgaatgtgcggggtgcaacaaggcatttcgcaacaacgactgtcatcaacaccatttgacatcaaacttttgtgtcgaatcgaagcagtgcaaagagtgtggagttatttggaatgttcgcgacaacaatcgaaatggaagaaaagtaataatgggaaaaatatattaaaaagtgcgattgtattagggtcacaaatgctacgagacgtattgccaattatgcaacacctaccacaatcccgagaggggctgcttcatccagcaaattgaaccgaaagaaaacgacccctaccggattgtggcctttgacttggagactatgcaacaccaggcgatggacccccaacaacctgataagagggaacatcagccaaacttcattgctgcccgggttgcatgccccgactgcattgaaaacggcaaatggaagagggaaactgcaggatgtcaaatctgtggaccacatcggaccgttgtgttctgtcaacgccgattcttgggcacatacgtggacaagcaagtgatagctgagaacccactggagccatttgtgaattggctcgtgttcgaactgcccaataaattcgacacctatgcctactcgcattttggcggtcgcttcgatatggtgcttgtcttccgagagctgttccggattggttttaaccccgaaatgctgcgacgg

SEQ ID NO: 74913 - DNA, 326 bp, Heterodera glycines
  Genomic contig location: Contig_ID=SeqID_146; Location=659..984; Strand=-
  SCN-specific regions: Sequence locations=1-140
atgcgcttatgcaaccgaaatcagaaaggtaaaacggtgtttagaagagctacaacagtgatcagaagaggtacaagggtgattagaagaggtacaacaatgtgaaagaggtcaacatgtttaaaatcaaataaataaggaaatttttttattaaatattaaaaatcgaatgcatttaatttaaaaatcttataatttaaaatactctttttattaataaaaaaacaacgttgaaaattaataatatttattttatttaaaatgaaattaatttttttacaaattcagaaaaaaataatgctattctttaatttaaaaaaaataaa

SEQ ID NO: 74914 - DNA, 1060 bp, Heterodera glycines
  Genomic contig location: Contig_ID=SeqID_146; Location=2146..3205; Strand=+
  SCN-specific regions: Sequence locations=1-247,270-361,382-389,428 -986,1008-1060
atgtttggatgggcattttcccttaattttgaccatcttcaactcggcctcaaattgtcactgatttcgccccatttcgatgttttagtggacaaacacttcaatggcaaaagtggattcatgccgtaagttttgagtttataagcacaaaaattttctcagttccaaaaatggcctgaaaattaaaaaattttcgaaatacgtaatttttttgattttttttgttagtgtcaggttttttttaagtgtttaattgttatgtattttttgggggcttaatgaattttaagctgggccttacatttatattttcccttatattcatttcttattgttagtttggcaatttcatggcagaaaattttttttttttttttttttggaaattttgtaggtttttggttttaaatataaaaattttggttttctgtaacattcactaagattttaggccaaaaaatttttgtccaacacctattgcttcttttccgctatattattaattttcataattttagttggtttgcagcgatgtttggatggacattttccctctttttgaccgtcttcaactcggcctcaaattggcacttctttcgcatcgtttcgaacttttggtggacaaacattgcgatggcaactcgaaattcggcaagtttttgttttttgagtttttttgtaaaagtcaatagtcttttagggttttcattgtttttttatgtttgtgtgcccaaaaaccgggaccgcctatttcaaaatgactttaaagtaatttttttttgctaaaatgaccagttttttaggctttcttcttttttctgagctttttcaatttataaaattttaagtgctttttccagcaatttcgcaacgacctttggatggacatcccctttttgcccagctccgcctcacattggcactgctttcaccccgtttcgattcacaggtggacaacaattagatggcaaaacgaattccggcaagtttttagagtttttaatgttgcttaaggattttgtgcccaaaatcagggctccatttcaaaacggccaagaaa

SEQ ID NO: 74915 - DNA, 581 bp, Heterodera glycines
  Genomic contig location: Contig_ID=SeqID_146; Location=3959..4539; Strand=-
  SCN-specific regions: Sequence locations=1-581
atgcccgaagggccagtcagcgaaccgcaaatggtgcgacacatgcccgaagggccagtcagcgaaccgcaaatggtgcgacacatgcccgaagggccagtcagcgaacagcaaatggtgcgacacatgcccagaagggccagtcagcgaaccgcaaatggtgcgacatatgcccagaagggccagtcagcgaaccgcgaatggtgcgacacatgcccagaagggccagtcagcgaaccgcaaatggtgcgacacatgcccgaagggccagtcagcgaaccgcaaatggtgcgacacatgcccagaagggccagtcagcgaaccactggtgcgacacatgccccgaagggccagtcagcgaaccacaaagaaatgtgaatcaaaaaggtgttaaaggacagaacaactaaacattccaaaaatttgcaaaatttctatattttcaattggcagtttaattgttcttattattctatcaaagaacttatagcgtacctcgctatacagtattacctattccatcctcagatttgggatagaaaaactatttctatatatagcaaggtataatttaaaataaa

SEQ ID NO: 74916 - DNA, 4458 bp, Heterodera glycines
  Genomic contig location: Contig_ID=SeqID_146; Location=5313..9770; Strand=+
  SCN-specific regions: Sequence locations=1-522,548-658,680-1724,1746 -2194,2216-2256,2278-2832,2854-3250,3272-3368,3390-3421,3443 -4256,4278-4458
atgacgaacaaacaaaaagctaagagaaagaagaatcaagagcggtaccagcggcaggcagagcaatctgtcagcccaggtagctcacccgtcccagacggaagtgcagatgagaatggggtgacatcacacccgggcatcaaaacgcccaatattggtgctttgaaattaagcaccccggcttcttccatcggaagtaaaagaaggggcagacccccaaaagccggagcggagtcaattgtgacttcgcaacacagtgtgtcatcagttggcacacaaattgtatcggccactcaaaatgaagagtcatcgcctcgcaacaaaaaggggaagatcaacgattttgatcgacccatgtctgctcttgaggcaattgcttcgacgccggtttccacacaaaggaaccgtggagggcgaccatccaaaaaaagaggcggtcatgctggctcaggcaggagcaaagctaatgattccataagcgagagctcgttaatggatcatagctctgaagctatcacaaatgtggttgttttgccaactgtgactgataaaataaacttcagcacagtgcaaatcaatttcgcaaccacgcgaaattttgcctgtaaaatttggaagtgggcagcaattggcctttacgaacgtgatggcgaaacagcgcttgccccaaggtctggtccaagattcattgaaacgtgctggaatgatctgacccagtttctcaatgacggctttgctgccacatatttggcatacttggcaagcatatcacaacgaaaagtggtcgttgttgacccaatggtatgggaaaatggcttggaccgtgtcatgcaatataaaaatatgacatttgggtatgacccaaatgttcaggcagaagtcattcttttgccagtacatttccctggacattggactctaattatccatgatgttcagtgcggtacacattttgccgattctttgcctaccccttatggcaggttggattggcaactgacggaaaaaattggaaagatcatttctgacattttgccgtcaacagtgttgaccgggatttttaatgccgtaaatcttacggtacaacacgatggtaacagctgcgggtacttcgtgtgcctatatgctgaatcatggctcatgaacaatcgcacgtttgttctgccagatttgtccatcaattatgaaaagcggcgcatattgtggcacattaacgagctgtataactctgataatgttccatatcatccaagggaaggggtacctactccgtgcccaattgtctatcgacatgcggatgaggctccatcgacatccaaggccgctgagccagttgaagttgatgatcatgatgatataatgatcatcgaaccacagacgagtggacaagcagttgatgccattccaacacaagcccaagtggcaggtgaaaaccaagctgacacgcttggattggtgtcggaaacttgcgtcccgcaagagccaattgcgcagactgacgattcaatatttgtcagaccaaagacgcctccaaggcgttcatcgcgcattgggagacggcaatcagcttcgattagccgttctccttcacccgcgccgagacgtcggtcatcgacaaatgccgctgagcaagtcacagcatttactcggcgttgctaccttgtccacaagggttggtgctgtgctgcagcagcggcaaagcattatccagaatactcagattctggtaagcttggtgacaagaagtgttctcactgtggagcattacatttcccacacgaggacagcagcatttgctgtcgtcagggaagggttgttttgccaaagctcaaccctcacccaaaagagcttgaagagctaattgtggaggaaaaacaatcccgtaaaggaaaagaatttgtacgacaaatgtcgcggtacaataatttgctccaatttgcaagtgtttcggctggccataagccaagtcctgcaggcggaccgatggcagtaattctcaacggagaattccatcgccgcattagcagcatgcaggcgggtacaacacagatacctggcttcggtcagttgtacattctggatccagttgaagccatggagcagcgacgaaaaaatcccacctttacgggagagaaaatcacaaacgaggaagagtttgtgcagggtcatcagcttaatgaagagacccttgaaattttggaacaaatgatccaagaaaatcacccggctgcatctgcttacaagcaggctcgtgagcagctacaagagttgttaagacaacaaaggactgaagagctgcggttcttcagaatgactttgttggacgagcgctctgccccgggtggtatgaaagacccgaagttgcatccccaccagatcatcaccccctcaacgggtgaagggatgttcgcgattcatgcggatcccactggtgcccctgcacctaaagggatatgggtcgaaaacaagcaagggcagttaaatgaaattgccccgttcagtgcatggactgatagcttgacctatccattaattaagcctaagggcgacgatggatataaaattcgcattccatatgccaaacctgcacaaagaaggcggaaaagcgacatgtctgctgatatgtttgccactgaagcaatgtccgatgatgacatgtgcgagactgagtcaattgcagagtcagatgccggatctgaagcatcgatacaatcagtgaccagtcgttatgacaactcgaaaaaatttgtctccctgcgagattactgcaagtattatctcgccataagggatgaaaatttggagtggcaataccaccacattctttcatgtggaggtggtcttggacagcgctgggtcctagaccaagcgtccaaaattgactggcaaattgccacttttttgcgccgtccagagatggacctgcgcgtaagtactccaaaaaatttgctgcagtacttggtaaaccaatacaataagcagcaagttcggcaaaaccccaatgctcgacaaaagactgtcgatgacattggcagcgttgttcgcctttctgaaaagaatgttaattctcttcagtattggaaaaaaatgtatgaagactgcaacaccatttttgcgcgttgccacgacgcaaaaaaggcgcggctcttcatcacattcacgaacaaccgtgagtggcccgagttcaaggagaacatttacaaaaacggtcaaatgttcactgaccgttttgacatgtggatgcgtgtatggtgcagcaaaattgctgttttccaccaggagctctatgaaaagagtttcttcggaacaatccttggctcaggcgagtcaatggagttccaagggcgtggtggcccacacgcacacattgtagcccagactgacctggacgcagtcccagaagtcatccaggaatacatatgggctcatattccacctttgccagacaaagatgatgactccccaattgcacaaatgcatcgcgaagtacgagattatatgcatatgcaactgcacagatgcagtgatagttggtgcggtccacgtgaccccaactttgggcggtgtaaaaaaggcttcccagccccgtactcgaaatgtacgattctgcacccggacaggcccgcgttgtattaccggcctagcccaaccgatggtggtgccaaaattgaggtgaacggcttaatatacgacaactcacaggtcgtgccgtacaacccatacattttgctgcgttaccgagtgcactacaatgtgttattcgcttatggtaacaaagcgaacatcaaatatgcactcaaataccctttcaaagggcctggacattgttatgtcgagtgcaaagaggagtccggcagcaaaatcggtatcgatgagccggctcaatatgccaaaatgaacttccgtggtgctacggaagcttttgcagttgtgcattcaatgcaatttgcaaaactctcacatcacgttgttcagttgtccattcatttgccaaaccagcagcccgttgtatacagggccttccaactggtgagcaaagctgaggaaattcagcgaggcgagctcccagagacgccatgctctgcctattggaagcaatggcaaaacgaatggcagcatgttccttcgctcaaggacatgctttttgaaaaagtcccagagcaatttagatgggcaaaagatcgatgggtcccatataaaaggaagcctaccaagaggcccccaatcggtcgtgttgtacctgtcgctccaaaggacattgaaagatttgcactttatgtgctgatgcgtcactttcctggtgatcccgaccacttaaaactggtcaatgggcagcagtacagcaccttccaggaggctgctttacagcatggtcttcttgaagatgaccaaatttggcacaaaacgctcggcgaggcagccttgcatcgctggccggatcagatgagatggctcttc

SEQ ID NO: 74917 - DNA, 85 bp, Heterodera glycines
  Genomic contig location: Contig_ID=SeqID_1624; Location=503..587; Strand=+
  SCN-specific regions: Sequence locations=1-62,84-85
gtttttttggactcaaatcggcaaaatgactttgacacacatttgcttttgatcagattgtatattctgtttcaaattaaggaaa

SEQ ID NO: 74918 - DNA, 2188 bp, Heterodera glycines
  Genomic contig location: Contig_ID=SeqID_1624; Location=645..2832; Strand=-
  SCN-specific regions: Sequence locations=1-27,49-205,227-511,536 -638,662-677,724-1061,1084-1387,1409-1661,1685-1898,1921-2188
atgtccctcactaatcatgataaatctaaagaccaagcccaaatggacgcatcgatccgactgattgacgatgaaatggaactgatcgacgctgtgaaggtgaacgacaatctctcgtagaagaaagtgactgttgctcatttgttcaggattttctcattgagtccaacacaaaatattcggtcattggtgcgattggggcacaaggtgaaggaattcagaaaaaacagcatttgatagagaatttaaggcactggcaagtcgaccatcctcagttcgtaaggttttctaatgatttgcacatcccttattttaaggtatgctcgccgggaacaatccggtggatatgtaccggtgggtggcagggatttttttggatttcgaagcattgtacaatgcgtgaattgagccaatgtatcactacagtacaagaaacgaaagtcaaattttaccgaatttttagtcttaaaatactttttgcctttggttttcggctaaatttgtgattatttcttcaaaggcttttccattaccagtattaagccagtacatttttcgtcctgctgcgagggaagctgttgaggcgtgtcgttaccaaaccacaaaagtctcagtgtatgttgtgcccaaactgcgcactttctttttggactgtcaggtaaagtttcgaaaataggaaaataatttataaaatttaatacaaaatgtttatgaaattttttagcccttaaattgtgctccacttctcgaggacttttgccgtgcgcgacgtgtcaaaggggcggaggcattggacgcaattgaagtggaagtaaaattttatgtgaatggaaaggtcatttctcttttatcaaatgctttttagagcctccacttgcttttgcttctgtactccatttgccattccgtcgtcctttgcgtcgattggttcatcgacttgagcattgtgcggcgattgatgcgcattgagctgttctacccaatacttttcccacaaagtgaagcacgacgagtgaatttgggtgattattggcattttaaattcatcctcattcaaaaaattttctattgttttcctattcagttgtccttcaccaacgtgccaaatccatcgatctcgagcctcttttggtgtcccaacggatgcgcacgttgaatgccatgtttgagacaagttctttcaacgttaacggcggactgacaatggccaagcttggattcggcatttatgagcatatttgtgccgatttaaacgtcaattacattttgttgggcgagctaaaaccccggacgagaatggatgaatttggtgagtgacaaagtccatttaattctctgaatatcttatgccttaattgatttatattttctttattgaatgtcgcagaaaaacatgtgatgcaccaagatgattatgggacagtaattgcaaaacttcgccgtcagatataccaattgcctaatagtcgctcaattttcgctaaaaaaacagaggcccaatggtctgattttatataggtagttgaatattttaaaaaaatcattaacattttaaggtttaccgagctggcagaagcatggaagcgaatccgagaggaattgccgacaatgacagaggatggatgcacatttaagcgacagcgtggcattggtgcccattcacatttgtttggaattttaaatcctcggtactcatccttcagtgactccattttcacgcaatgcatccaacgatgtgtttatgttgaagcaacgaacggcgccgcagggaagtgaaattgggcgcgggagacaaaggcgaaggagccgtaagggaggcaccaattgggaggacaacaccggaagcatcctccggagagaagcagtgaattttaccgaaacagctacggatgaaaccgaggaagtggagtcgaaggccaacgaacatcgaaagacgacagcgacagccgagacagagggacaacagcaccaaaaacggagagtgtggcgaacgcgaaatcgaacagcacttgactgtaagaatatgacaaggaagcaatggaacatcgagcagaagacgaaggaagggtcatcattaaagcacaaatctgttgtagaatgggtggacagagagcagcagttagacgaaagtggaaggtcgggcacaccagaccatggagacaatgaagaatttgaccaacgggaatga

SEQ ID NO: 74919 - DNA, 129 bp, Heterodera glycines
  Genomic contig location: Contig_ID=SeqID_1625; Location=175..303; Strand=-
  SCN-specific regions: Sequence locations=1-13,51-129
atgccgaacattatgggattgcatggtggctccatgattgccatgagaagcaaagatagtgtggtgattgcatgtgatctgcgcttgggagagcaagccatgaaaaacattgctactaatgcgacgaag

SEQ ID NO: 74920 - DNA, 4113 bp, Heterodera glycines
  Genomic contig location: Contig_ID=SeqID_1625; Location=676..4788; Strand=-
  SCN-specific regions: Sequence locations=1-572,598-745,777-1043,1065 -1546,1584-1756,1778-2199,2226-2480,2502-2665,2687-3111,3134 -3494,3516-4009,4031-4085,4107-4113
atgtccacactcctttcccagaaagttttttggaacaaagcgaacgtaggtgcttgaaagaagaaaatctaaattgccaacgcaacattaaaggccaaatggtattcaaacagaacgccattttattaaatgtttgtgctaactttgactttgcttttcttttgattttttaatttttatcatcacaaatcatcaaattttgctaaaaaaaagaaataagtgaattttagatattccatctttcaatttcaatggatgtagcgaattcagtgcaagaaatattggttagcttatcttttaatagtttattttttcaattgactcagattaactgttcatcggtggaaattggcgtatatttttttgcaccaactaaacaaattgaacttacacatgaatttgttacattgccattggacaagggaaaagaaacgctgatgctttccctttcattcaaacacattactaaagttgaagtatgtcatttaaattggccacttcaaatgagtgaagttgaggaaaaaattttctgattgagttgatttcttgaataaaatttaatgggatatattccctttttattatttatagtttttggataattcggaaggagagggagcgggtttggtcctcttcgtcaatgatttcatggcgagaaagatccaaacttacatcgaccgagaaggagctggctttacggactttgggttggaaagctacacaagcaactccaaggataagttggtttctttctatttgtctttttattttacacaatatcagtcgcattttcaagatttattgtgttggccattcaaaacaaagagttgaaattctttcaccgtcttcacgaaattcttcatagagcggacgcgtaccatcgaaattatgttattcagcaaatgaacaaaatcaaaaagaaacattttgacattcccattacatttattggtcagtttgtgtctactgtaattgataacccactcatataacttaatttatctaattacaaaattgttattagtctgaatttagatgtgatctcttcatctcagtggaaaacactgaataaattgctgggtaattttcaatttcagttacaatccttcgctttgaccaacataatcacatttaaggtattgcaagatccgactttaaacaacgccagctcaaactgatcgacaataacaatcagaatggcgttggttctcatcgagtgtcggtcgtttcgactctttctgacagtccgaatgtacacccgccggtgaatgttgaatgccaacttcgagttcaagttggacaagtgcatcagcaacaaccaaagtgtcatctgccagcgtacaccgtaatggcccttccaattctccctcacaatcagcccagcgcggtagttacaatcaatggttggttgatcgaaacgtatttatggaaatattcacttaattatgtgatttttccgtcgttaagctcctttgccttcttcatttgttttgagtgttcctacttctcatcagtcttccgcttctcctcaaatacgcgctaacggtattaaaaaacaaaataatttagcatttcattttgattggttatgaaatataatagttttttttatgtgttgtactgctctagtaattgtcccttcagcttctcacaataagtcttcacctgcgtttttggccattccatcccttcggtctccatctgccgccgttacgactgtcgttgcttcccaattgtctccaactctttctacgcaattacctatttcaagtcaagacacatttgatatgcttttccaacttgaacctgtaccaaatcatttatacaatgaacagcaaacgccgagtctcaataatcacagtccgacggtatttggtgagactacagtagcccaatatttgtccctaggtaaagcgagcattgtggaaaaccccaaatattcaaattttaggcttaaacaattgtcctttttagcagttgtttgtttagaatcgccgagcgttaataaatttctgccacggtcactcaaattgccaaaggctccgccaaccaatggaaactctcaaatctgcagaagcgcacctccttttctctctattcaaacgccccccagcacttcgcaagacctgcaaacgcaattttcaccccaattgcaaagtcacagaatgtcaaaaactacaaccagcggttcagcaaaggttggcaaaagggagagagaagtgcatttgattgacgacgaggaaaatgagtcggaggttggcctcgtcatatttttggtggaaaggacttgctcattttaggttaaagatagtccgtccgataaacgttccaacgacactttgttttcatttccaccaaccggaagagattcctgttctgtgcattatgccgatctgaagtacttgtcgaggaatttcatgctcaatgatacgatcatcgatttctacctcaaatacattcatcattggtcagtactctcatttggttttttaatttctttttagccttgtcccacaggagaggagagcgagaattttcattttcaacactttctttttcactcgtttaacacagcccccagctggtggaaaaccttccaatacggttactgcaactactaaaattcgaagagttaaaatgaattttttaattggtcaaacaaattaaccaccacttttaggtcaccagcaattttcaaaaagtgaagaattggactaaaaaagtcaatctgtttgacatggattatattattgtgccgatcaatgaggacattcattggtactttagttttgcttaatgtcactattttgcatttaggtatttggcaataattgtaaacgtccgacatggcatttgctctctcaataccacggacaatgaatccatttttcctacttcaagtcattattcaccagtgccgcatcttatcgtgctcaattcagtgcgttatcatttgcaaatattaccccttatgccggcaattcgaaaaaatatatttccaacggtaatatttcagctcatcgacccagctgaagacaaacatttggcagttagggaccaactcggagaatatttgcacttggaatatgcagataaactcggacaggacaccaagacttatttcaataagcaaatgatggacgtggttgtgccgacgatgctgccccagcagaagaacttcatcgactgtggactatttctgctacattttgcgcaattattcctcagcaatcctccaaaagtttgtctgatcaacataatataaaacaattttaagtacaaccatcattatcacatacttaagttattgataatcgtcatcttttaaatactgtaaaatataaaaatcaaagatttgacgcaattagatggaggtttaagcatagatttcttggcatcaaaaaaaaacagttagaataattgttatttttactaaaccaattttaactcgaattttattttgtcatcaattttgaaatctgattttaatttttgcaagtgaaatttattgacgatggtggtgcattaaactatcgcttatttttcttcaatcaatcatagaaaatttttcatgacataaaagcgacactaaccatgcaaaacccaataatggttggattaattgcagtttatatcgaggcacagctcatttcgccgctggtatccaacttttaaaatcaagcataagcgagatgagttaagaagtgtgataatgcaattggcgtcccatgtcaagtcctctgatttcgtccaacttccaactccgaaacggaaaaacaaaaagattggccgtcgttcgcaagtggataaaatgcagatgatcttagacggtaagcaaaccttaaacattttcttgtaaaaggagcattcacatattcaggaatggcactgatgggccgaactcgacgttacagcgactcggaattagacggcattatgaaggacgaacatttctcttgtttgtacagaccgcgctcgttggactcgctgatatatgagaacagagagaagccgctggtgttgcagccgccgaccattgcagaaatgtcacgtttcaaacaattgcgaagagtgcggcaggaaatctttgcctcccaagtgcgccagggataa

SEQ ID NO: 74921 - DNA, 1705 bp, Heterodera glycines
  misc_feature (512)..(513): n is a, c, g, or t
  Genomic contig location: Contig_ID=SeqID_1625; Location=7891..9595; Strand=-
  SCN-specific regions: Sequence locations=1-13,36-61,101-102,239 -253,275-416,438-637,664-696,732-788,831-947,977-1212,1252-1319,1366 -1371,1394-1545,1567-1633,1655-1705
atgcaaatatgtgtattattaattttatttttaatcactttaattgatcaaaccgaaacagaaaagaaaaagttggaacaaaagtcatttgatggaatatttggagaaaaatgggaagaaagggaagaagaaaaacgaaatgaactcaaaaaaagagaaataattggcaaatattataaaataaaagaaaaaataaagcaaaaaggaagaaaatattcaacaaaagaatggaataaaattaattcgaaaatagcgaaaaaattggggacaaatcgacacaaaatttatgaatggattaaagaaattggactttataaatatcacaaatcaaaaactgatgaacaaaaacgcaaaattgtgcaaaaattcattgtaatgaaaaatgaatttaaacaaaacagaaaatattcgcaaaaagaatgggagaaaaattatgccgaaatttgcaagaaaattggagttagcctttcagtaattaagaaatggaagaaacactttggcattcgcagtannaataacggagaaagaaaaaatggaaaaatgaaaatttactggaaaataaaaagagaaaatccgaaaatgaatgacatggaaattggaaaaacattgaaaattagtcgaaaaagcatttcaaaatggaagaaacaatttggagaagaattgttctaagaacagtagaagaattttttttcccgccatttttccttcatttattttacaaataaaaaatgattcttattttgtgcccaccctttcaaaattgtttttcgtgttctatcgatggtggcatttttttttctttttttttttacaaaattttaattatttttctgaaattgagcaattttagcggttgagagcggccagttcagtgttgtccagtgtagggtcgacaactcgtcgttccatcggtgctgttagttttcgacagtggtgatctcgacagtaaagtttgtttttaaaaacttgttctatatggtaaagtttcgataaattttgaaaaattaaaatgattaggacaggctctttacattgcagcgggatttgcgattttcgaattctgctataagaaagagcttgtagatatttgcatcttggcactcaacgccagcatttgttagcatattttcccacacgattatgcatattcgttctatattcaagttgttataatcattaaatttaaaaatcgtgatttcagagttttatggccataatagcaataatagcaattatatgatcattttacaagcattttttaccgtagtgccacattgcggatcgacatttacggaccagtatttcccgattgaactgtcaaaataaagaaaaaaatttttttttgaattttcaaaaaattaaatactccccaaattgaaattagtgaaggtaagctgatgcaaggcgatctgttttaattggagaattttattttatcttagaagtcccaaaacaagtggaaatttttttcttgcttctctacacgtagtgaaattagcgaaaaaattcgctattttaatacacataaaagtcagttcaggattttataccaaggaaaatttttacgtgtttcacttccatgctttggtaaagtcggtccgcaaatgtcggctaaccttttttactcctttatttgaatggaatacaaaaattatgagaatgaaaagaatacggtgaatacaaaaattgatgtggtcaaaataaa

SEQ ID NO: 74922 - DNA, 315 bp, Heterodera glycines
  Genomic contig location: Contig_ID=SeqID_1626; Location=283..597; Strand=-
  SCN-specific regions: Sequence locations=1-39,61-190,212-242,280-315
atgcgcgagaatgcgataagcaaatgcattgcacgcaagtgagattttgtgcacattcaagcgcttttatatgtgcgtaagagcaccgtaacttcgtctttcacgtagcgcgcagcactgtacattttcgctatataaaagcacgcaaatatgatgcaaaacttcattttaatcagaagattttttgcaaaataaaaatgaatacttttaataatgttcagcaaaacatgccggaagaatctaacaacaacaacaacaacaacaccagcaacaataacagcgtcaatgagaatgctcaattatggtagcttgtac

SEQ ID NO: 74923 - DNA, 402 bp, Heterodera glycines
  Genomic contig location: Contig_ID=SeqID_11497; Location=319..720; Strand=-
  SCN-specific regions: Sequence locations=1-370,399-402
atggcgcaaaaccctgctcaaaacgacgaccaagtcgtttttgccctgaccgaagaagaaatggtggagtgggatgaacgcgagaggagatggcaggaagaatcgcgtctcaggcgtgaagaacggaggagggaagcggaagaaagacggcaagagcggggcggctggcacagtgacatgctgaggcggcaacatgtttgggagcaacaaaaagaggaacgagaaagagacagagagcgatgggagcaaagaatggaggacgaaggaagaaagtgcgacgagagaagcgcagcaacacgaaagaaagagaaagaagaaaaggacaagaatgatgttaccgatcattactctttcaaatgggaagaatggagggaaaaggaaaaattattttttggaaaataa

SEQ ID NO: 74924 - DNA, 1744 bp, Heterodera glycines
  Genomic contig location: Contig_ID=SeqID_11497; Location=1433..3176; Strand=-
  SCN-specific regions: Sequence locations=1-212,242-539,561-649,674 -845,867-1191,1213-1349,1382-1395,1418-1477,1499-1647,1669-1680,1702 -1744
atgtgtcaagaattagcagaagaggccaaacaatcaatcgaaatagccaaaaattatcggcaagaaattgggcaaatttatcggaccgcttactcgcagcccgatttaggcattggagacttggcaaataaactaaaagaaacaatgcgcgaaaaccaaatacggtttgaaaggcaaagacctcaggaagaatttagggatgaatttattgcttataaaatttaagaaaaaaataaaaattcgagaaaatgaaactgcatgagaatcaaaggttgtgggacataaaccaaaaacaggtgaaaaaggaaacaggtgaaaataggtgaaaaggaaacaggtgaaaacaggtgaaaataggtgaaatttcacctaaaaatatatagaggtgtgcatttaatggggcatattagagaatgtctcaactagtatcaataaaaagtgccaaagggaaattttgtgatggttatcgctattacaaacataaaacgaccaagttcaaactttggtggaaatgtgaacttaattcacatgggtgccagggctggggttttgaaaaggaagggttttttacaatgacgcgccgacacaatcatcatcctgacactatattgattgaaatcgaagaggacataaaatatcataatttttctgcgggggcaaaatgttttttgggtgacaacaagaattagttgatgatgctaagaaaaatccgagactccaaactgaatttagagatgaatttattgtttgtaaactataaataggatcaagaaaaaaaataccaattaaataaaaatgaattctgaaaaatcagaaaaagctaattccatattattggaagctgcaaaaaagagacagaaagagcatggcgggatgtagctgcgctaacggatgaagtaagcgattttgccaaatcttctcgcgaaacacttaatcgtgcaataaaatctagagaaaaggctccttacgctaatggtattcgagaattatatcttaaaatgtccgattcaatttgggaaatcttcacaatcctggacaaaatcaatttggagtcagaaaaagccgaatctacgtggcgtgatttcgagagatgcaaaacttttgaccaggcaacaaagctcgaggaacaatcgcaaaattcattaatggaagcccgaagattacatttcgagtcccggagggtgcagagccaaatgttaaattatgaaaataggctccaaacaattgtttgggagcatatgggtatataagaaccaaaaaactaaaagggccacactcaaaatggaagggtgttctgtaattgagtcattatgtcatgaggacttaaaatttggctttacaaaatataaaaccaaattttattttaaaaatcctttcctaattaatgcggaggaaaattttaaaaatatcctcgcatcaataatcgaaaaaatttataaaaatgaacaaggaaaattcaaaagcattctgaagatttcttttggttttgaatcattttattgccctcttagatgccctagcgaaaacacagctgaggctttgttccaacatgtcctattaaaagaagaattatattcgcttttctatcctttggatgatgtcataacactagaagtaactataatcccagatgtcgacaatagaccaagaaattaattttataaaaaacaaaattacgagaaattggaaaatttctggaaaaatacttaaacgatcaattaatctcgaaatttttgcaaataaa

SEQ ID NO: 74925 - DNA, 918 bp, Heterodera glycines
  Genomic contig location: Contig_ID=SeqID_11499; Location=256..1173; Strand=+
  SCN-specific regions: Sequence locations=1-204,226-918
atgtccaaaatcctgcgttctttggccattttgttggcatttttatctttgactgatgccattggcttcccaatgcaacaatgttgttgtcccatgcagcaacagtcatgctgtgggggtggaggaggcggttgctgtggccggaagaagcgcgaggcagcggcattagaagcggttcagccccacttcaaatcggacgaaacgccgtgcccacagacagagtggagacaagtcattgacgaggttggcaaactgatcacttatccaatcattcgcatatccctaattgcttgctaattttgtagagcatccgcaccgacgatgccattggctcggtcaatgccattcaaactgctttgtaccgccgctatgccaatcagaagttcctgatcacctgttcggcagctgatgaggacaaaactggcaccaacaaagtgcacttcagctcatccggcgacggttactgtaacttggtcaaagaacgcatttggtgccaggcggtcgcgctgagcgtgtgaaaaacgcatgctatgcataaacaattaattctttttgatctttgattaattaagttaaataattttccattagctaattcattttaatcttttgattcatttgaaaattaacaaaaattaatttatgatattacatatattaggtagcttttaatttttcgaattaaattcatcgtcaatggccatacactgtataaaagcattgcttctcctgaccaatgaatgacaacactttagcaaaagcaaagcaaatcctaattgacttcttcttcagttttcgctgaaaagttttagtgtgaaaattaaaagcgtgctaaaactgtcaatgggcatttcagaggaaatttttcgcatccgaattaatcaaaactaattagaagattttttaagcagcacaaga

SEQ ID NO: 74926 - DNA, 522 bp, Heterodera glycines
  Genomic contig location: Contig_ID=SeqID_11500; Location=327..848; Strand=+
  SCN-specific regions: Sequence locations=1-201,223-522
atgtcttcctccctcataatgaactgcttaattgcccttaccattctggctgtgtttgtgtccaccatcgatgccattggcatgccaatgcaatgttgcggtcagcagcaacagtcatgctgtgggggcggcggtggcggctgtggtcgtagaaagcgcgacacggaagcggttcagccccacttcaaatcggacgaaacgccgtgcccacagacagagtggaaacaaatcattgaagaggttggcaaactatcactgatccaatcactgctgtcttatccctaattgcttattttgtagagtatccgcgtcgacgatgccattggctcggtcagtgccattcaaaccgcgctgttccgtcgccacgccgaccaaaagttcctggtcacctgctcggcagctgatgaggccaaaaccggcacggctggcaccaacaaagtgcacttcagctcttccggcgacggttactgtaacttggtcaaagaacgcatttggtgccaggcggtcgcgctgagcgcgtga

SEQ ID NO: 74927 - DNA, 795 bp, Heterodera glycines
  Genomic contig location: Contig_ID=SeqID_11500; Location=945..1739; Strand=-
  SCN-specific regions: Sequence locations=1-498,522-731,772-772
atgtccaaatttgttccactatttttgtttctgttctcggcacttttgctcatttttctgtgcccgtcgacctcggcccagggccgtcccccgccgagtaagtcaggccggccaactcagcacggacgagtgacaacggacggggaagagaaagacggcactgccgaggggggagcagcggatgtcgagagtggggagaaggaagagccgggactggtaagtcggatatagaactaatcattgtgataagcatcatattctcagatgccatttgcagtttccagctttaaatttaaaacgccctaaaccgaccaactcggaattttcattatgccggatttaattggacatctcagaaccgaatagtcttccagcaggagtctattttgaatttagttaaattagtttttcctaaaattgatagatattccacaaaaatgtattatttaaaaaaacccttttaaagcctgtgataaatatcactttattatgaactcgttttattttattataaaaattaagaatttagagccaaaaactgctgaatgtgctgttgaatcatttgagcagccatttgccaaagattagcacggaaagtgtggtcaattgggtgcaggagacattcggattggaccgacaaacttcacggaattatgtgagaaaggcacaggaaatcaaaaggcaccgaggcgaagattgagaaagaatttggcattttccatcgaatgatcaaagcaggaagaagaggaacaatgagcaaaatgatttattatttatgcaaatttaaataataaa

SEQ ID NO: 74928 - DNA, 1048 bp, Heterodera glycines
  Genomic contig location: Contig_ID=SeqID_11502; Location=223..1270; Strand=+
  SCN-specific regions: Sequence locations=1-87,110-139,181-575,607 -646,676-785,807-849,1028-1048
atgccaattatgggctcgttgccatttttcatgaaaaaatcaggtactgaagtaaccactttcaataggactcagttattcatcattaaaaatgaaggaaaaatcataaaatcaagagtgtggagtcggcttcctgcacaatttaaaaaaatgtatttttaaattttttgtataatttttccatttagaaattggaaaaaatacttcttatctatttacaatacattttgacactttaagactttttcatgcgttatttaacgtcggacaattcagtcccctttgaaaatagacacttcagtacccgattatatgaaaatattagcgcgtcttaatttgtattttctcatcgtttgggccgttctaaaccgattcagaccggtttggagcggttttgagtttggggacccatttgtcagattaatattttccttaatttttttttctaagtaaaatttagaataatttgttttcattattatccaaatggaataaatttgttgagcagccaacagcaattgacgaagaagagaaggcgcattttgatgagacgaattggcaactgcactttgacgcactgattgatttgatattgaaaagcaaatcatttagagaaaaactcacagaaggtaaaaattaaattgccaaaattaaaaaatattaattttttattatcaaaaaggctttgataatgatgaaaatacaaaacagcgctttttggaatttgtcctgccaaattatcagaaagcggtgctgaaactgctcaattctggtgattttgctgaatttgagaatgaaattgcattgaaaatggagcaggaaaatggagaaataattgaaaaaatggacaaagaaaaagcaaaagccgatcagaaaatgaaagaactgatcggggaagaaaaaaggacaaaaaagaaaaacaaaagagcaatgaaaaggaaacaaaggcaaagatcagcagctgatcagaaagagggagagagtgagcagaaggaggagaaaggaaaagaaagaaatagggaagagagtgaaaggatcagtgaagaga

SEQ ID NO: 74929 - DNA, 2469 bp, Heterodera glycines
  Genomic contig location: Contig_ID=SeqID_11503; Location=1..2469; Strand=+
  SCN-specific regions: Sequence locations=1-16,286-326,365-472,653 -851,873-1022,1044-1056,1080-1101,1123-1367,1390-1397,1419-1657,1681 -1779,1819-1925,1947-1963,1988-2307,2372-2469
  Gene Ontology: Mol. function=structural constituent of cytoskeleton; Cellular component=neurofilament; Biological process=histogenesis and organogenesis
ggaagagagcgagcgaaagaggagataggaaagaaagaaatagggaagagagcgagcagaaggaggagaaaggaaaagaaagaaatagggaagagagcgagcagaaggaggagaaaggaaaagaaagaaatagggaagagagcgagcagaaggaggagaaaggaaaagaaaggacagaagaagagagtcaatggaataccaaagagagtgagcagaaggaggagaaaggaaaagaaagaaatagggaagagagcgagcagaaggaggagaaaggaaaagaaaggacagaagaagagagtcaatggaataccaaagagagtgagcagaaggaggagaaaggaaaagaaagaaagggagaggaaagtggacaggattttgctagagaggaaaacgacgtggaaatagtgaatgaccaaaatggtggtgagagaaagcaagcaaagaaaaattgtgaaaacaattcaatggagttaagagaaaaacaagagagaaaaattagaaaagaaaagaaaacgcaaaaaagagagagtgcgcaaaaagagttgaaaagaaaaaaagacaacgatggaaaaagtgagagaatcagtgaagaaaaaattgaagaaaaaggcagaaaaaacaacaatgagagaaaggagagcagagaaaaaaatgaaggagagagtacgcaaaatgagaggaaaagaaataaggaaaaaagaaaacagaaattgaaagcattggaggaaaataaggaaataaacataaatagttggaataaaacagcaacagattcagtgacaacagaagaaagtcaaaaacagggacaagaaaatggggaagagacaatggaaaagggaggaaaagcatcggcagagaaagaaagggaaaaatgccatcgaatgttgggagcggaattggcaaaagtcaatttgggaagtaagtaattacaattaaaattatgaaaatttgtttaatttatccattcttaaagcacgagatatttacattaaagccctgtaaattttcggactttaatttttatttcttagggtttgaaaagcaatgattttcagactttttgccattttgccatttctgtcctttttgtgccgtttgggtcttaaaattgcatgatataaaacaaaaattatttgttggtttgcaggtttcattttgaatagctttttgcactcaaattaccaagaatttctggcaaatccaaacgaatcgaagcgatgctttttggacattggagtttatgtgaatgaaatttggcacagaatggaaatcattggaatattgagcaattttactggggtaaaatggatggaaagtgcgggaattgtggtgaattgggaaaaaacgatgaaattgaggcataaatggcgggaaatggaaagagaatttgcaaatattagcacaaaatctgatgaaaaagcagtggatttggatgagcttgagagtaatttgcacaaaatgctgaaaagtgtcattttaacaacggagggaattttaattgacgacggacaaatggaagaaaaaagtgagcaaaatgagcgaaaaaaggtcaaaatgcaattgcacctgaacaaattcgccaaaacgatcatttggcaaaggcgatttgagaatgattttgcggaaaagaattgggaaaatttggatgaaactgagcaaaataacattttaaaaatgctaacattcaatcggaatgacaaaaagttggcacatcgtttcaacgaacacttggaaaattggaggaaactgacggagcaacggcaaattggtaaaaatggcaaaattaaaaattttaaaataaaaaatattttaaatttagataggaagttgtttgaccaattttacaaacacacaacccacagttttggcctcggttctgtccatcttggcgtaaattttgctgaaaacactcagcaaatatattttggcagtgcaaataatgacagaatgcatttatccattgtaaaattttaattattttaaaaatgtgccgaaatttgtcgtcgaattatttttataaattcaaatttaagataaatgaacttcttacggaaaacggatacactgattgtccatcggttgagttggcattagacaaagtcaaagaaattgtctcgaaatgggtcggtaattaacagaggccagatttttaggcaaacaattctttaaataggcatctcaaataacgtgaaaaaagaaatatggcaaaagggcacaaaatttaaaaaaggtgtcaaacttggcaaaaaaagcggacaagggaaataattgagtaaaaaatattttaaaaatcaaaaatcttgactgaaaaattaattttcaatatatgacttttaatttaagtttttattggaatatttttttaaaaattgggtcgattctttggtgttttaagttttttgttatatattttttaaggaaatacagaaaaagccacgaaatcaaaaaaaaaagttacagacattacaa

SEQ ID NO: 74930 - DNA, 894 bp, Heterodera glycines
  Genomic contig location: Contig_ID=SeqID_11504; Location=3..896; Strand=+
  SCN-specific regions: Sequence locations=1-420,442-448,470-616,652 -681,703-826,852-863
  Gene Ontology: Mol. function=RNA binding; Cellular component =cytoplasm; Biological process=mRNA polyadenylation
atggcacagttggccaaccaaacgattccccaggaggcgatgctccaggcattgtccggtgagtcatcgtccaacagtgatcaaagggtgattgatcagtggtggaaacatttcataaaattattttttaatccctcactccctttcctatgctatttttccggccttgtcgcgactttcagttttttaaaaccgagactgaggctataacaaccgggaattcccgacatggtcccgtttccgagccaatcggtcgtttattatactgatatggagcttttgtgaatggattatttggtagaaaaaaaatttttcaatttgttttttaggttatttagcaaacgacgcaattaatcgaatgatcgaacatcggaactttgcgaaattcaaaaatttattatggatcattaaattttgggcaaaaagtaattttaattactaacaaaatacaattcaataataaatttcaggcaatttcatttacggaaataaatttggctttttcaatggaatttctctggcaattttatgcacaaaaatattcttgttttatcctaatgcttctgttatatttttatttgagaaatttcttttgattattttaacatggtaagcgataaaataaaattttgatttaaaaaaactttttttgttttttgaggaattggccaatgccaataaaaattgatgaaaataaaaagggcgaatttgaacttttcaattggaggccgtcgcgcattgaatttgaaaatggcgaaatgcaaatgccaataattactccgattggacttggtcaaaacacaagcaaaaatatgaacaactcgacaaagaaaataattgaaaaacaattgagacaaagtctgattttaataaaataaatttaaaaatttttaa

SEQ ID NO: 74931 - DNA, 1401 bp, Heterodera glycines
  Genomic contig location: Contig_ID=SeqID_11505; Location=2631..4031; Strand=+
  SCN-specific regions: Sequence locations=1-343,365-425,448-618,640 -649,683-685,716-755,777-1242,1264-1270,1310-1401
atgcataaaactgatcaagcactgattagtctggatagggcctattttcctggtcattattgcgataccaaaaagagtgataatggaaatgggagtatttccaaagggggcggccgtagctcagtcggttagagcatttcaggaaatggaaaggccctcgttcgagtcccaccgggcgaattagcttttatgtctgctgacctggatggattgactaacataggccatataaaaatacatatcatcgatcagtccgacaaaccgcgcattttttatggagcactagcatatacacattaaaacattaagatatgtttggtacgaatccctacccggagccgagtgactgtcacacagatgaacacaaacaatgttaaagtaagaatttgaagcagtacaccgacccaaaatcaaaaccccagactaattatgtaactttctctccaaccttgggatagaagaatttttttgctatgttttgctgtgaattttcagcataattttaaccctgattttttttttgtaaaactattgaattaagcaatgacaatttactaaattaaatttttcccaagagttatgtgaaattcatcgctggttccacgcagctaagcatgccactgcatactaatcatattcattccggtagtttatttatttattttttgaaaaaaatttttttgcattatttttcaaaagttttaaaaacaaaaactagcaatgcgatagacatcgccaagaaaatgaaaatttgcccgatttatcaaccacattttatcccgtacaagcacaatttttggaagattagttggacaaatggtccaaaaagtgacccgaatcaccaccaaaaaaaacccttcactttttctacaggccaacacgaaaaatttgggccatggcatatgccgtgccgttacgcctacattgtgttccgctcccgaagtgatcagcttgaatgggtggagttccggcttgagcccgaactgaaagtggactcggccgatgatcagcgcaatgactgcgcatcggaggaacacaattttgccgaatcgctgttgaagcattgaactgactactgattggagtgtgacatttgaatgtgtgggttgatcgacaacctcaatcattctcattcattcatataaatcacacacacacaatcagctcaaaaaagaatctcatttttttttacaaaaaataggaaaccaaattttgatcaacaatcattttttatcagcgaaattatgtatttgttttgaaaaattcgttcaaatattatattttaaatattcaattatacatattatttctttgaatatttgttagtgattttatggcatagcaaaatttaccacttttatttgaatgtgataaaagcatcacataatatcatcattataa

SEQ ID NO: 74932 - DNA, 520 bp, Heterodera glycines
  Genomic contig location: Contig_ID=SeqID_11505; Location=4336..4855; Strand=-
  SCN-specific regions: Sequence locations=1-21,43-72,94-404,426 -474,502-520
atggttgggaagcgatggaaaggaataaaaatttgtttggcccaatggccatatgtttgtgtttctatgcgatgtattaaataaagccttttgtttctagcaatggccaagcagtggaaggaagaaggttcggaaggcaaggcaaagtcaatgtgcaaagagttggccaggctcagatgaagctaaatgctttggggaagggttggcccaggagacacaaataattctttcggcttagttcaccacactgcctgaaattccatcattagtcaaacaattttccccgatccatatcgatcaatcggataaattcgttgatcattccattcattgaagcctctcaccttcgcctatgcttttccttttcatacaacaatcgttgtttctctgttctcctctctctgtctggtaaggaagcacaaagaaaaagcattggttgaaatagagagaaatagtgttgatttcgtgtgaaacagagagaaagagagagagagagagagaaatcggaaaaagaattaaa

SEQ ID NO: 74933 - DNA, 79 bp, Heterodera glycines
  Genomic contig location: Contig_ID=SeqID_11505; Location=5071..5149; Strand=+
  SCN-specific regions: Sequence locations=1-79
ggattatttttcaaaacacctcgtagactgggggataattggagactgcgggattaatagagactgggctataattaga

SEQ ID NO: 74934 - DNA, 462 bp, Heterodera glycines
  Genomic contig location: Contig_ID=SeqID_11506; Location=1..462; Strand=-
  SCN-specific regions: Sequence locations=1-434
atggctacccgacttttggggatttgcaacttggggacccgacttttggggattccgacatttggagacccgacttttgggaatcccgacatttggggacccgacatttggggatcccgacatttggggaccgaacgacatttgagcaaaaggcacttagggaaaccaccgacatttggcgacccgacatttagggacccgacatttggggaacccgacatttggggaacccgacatttggggatcccgacatttggggatcccgacatttggggatcccgacatttagggacccgacatttggggacccgacttttggggacccgacatttggggatcccgacatttggggatcgaacgacatttgagcataaggcacttagggaaaccaccgacatttgccgacccgacatttagggacccgacatttggggatatttataaaacaaaaaaaaaattaaa

SEQ ID NO: 74935 - DNA, 774 bp, Heterodera glycines
  Genomic contig location: Contig_ID=SeqID_11508; Location=221..994; Strand=+
  SCN-specific regions: Sequence locations=1-358,380-774
atgtcttctattgataatttgcggatttatgcatatggagagggcggaacgggtaaaatgggttccttcaaaatgggacaaatatgctatccagaaaaaaacggaacgtaccccttcaacacgagcagggaaatgccgaggaggcgacagttcgcatggcgtggcgaaagacgtggcggcggcgaaacgtacggcggacggagggagcagcagaggaagggaagcggaagagcggtggaggaaggcaatgctaacagaaaagacgaaacagcggaaaagcggagggacagcagaaacgaggcgtcgcaaaaagagagggcggaggaagcggcggaagacggccaagcggaggaaggcacgggaggaggaggagacgaagcggcgacggcacggaaaaggacgacggcaccgaggacaaactgcgacacaaagacgacgaagagcggaccaaatgaggacggggcggagacgggcactgaccaacagcagcaacaacagtccagggactactggtaggggcacacggagaccagagacacggggtaatccttcggaattggtgtcccgacggaaaaaaagagtaaaaatttttcttgcacttttttctagggtaaaaagaactgtcacgaacccgaacccatgattttgcaaaatcattttctttagtcgttctaaaatcgtaaaaaattaaattagacttctctatacatttaatagctcattctaaaactttttatgattttacatcagtctgaaattgcttttttaccgcca

SEQ ID NO: 74936 - DNA, 1931 bp, Heterodera glycines
  Genomic contig location: Contig_ID=SeqID_11510; Location=1308..3238; Strand=+
  SCN-specific regions: Sequence locations=1-146,250-442,464-544,567 -677,708-714,736-909,938-1319,1343-1637,1659-1731,1803-1827,1850-1931
atggcgggagccggaaaatccgacactggaaaatccgacaccggaaaatccgacaccggaaaatccgacacaagcagaaaatccgacaccggtggaaaatccgacacaagcagtaaatccgacacattggaaaaaccgaccccaactttaaattttaaaaataatttttgattgtttgagttagtaaatatttaaaatacatataataaaagttaaatacttaagttctttaaaataaatatttttattgctataaaatagatttaaggtaggcatataataatcatattatttcaatgtcctttttgatcatctcaaaaaaattgtaaacaatccggcaaatggaatcagaggaaagggcatgaagcataagaaagtgtacgtggtgcaagacatgaatctcacagagatttatgcgactcgcaacaatcgacaacccttttattatttgccatcaatatcccatcggatggcagaaccaattaatttttttaaatccaattcgaaaacttgataaacttgccagatattaactcaaacaatcaaaaatattttttaaatttaaagttggtctcgtgtcggattttcctagaggcgttttaacagagggggccgttccgtttcaataaatggatttaacaaatcttaagattttcgaccccccgtcccaaaagaagaaaatataaataatttattctaataattttcagcccaacagaaggggaggctgacgctgaaaattgaaaagttttccgatttttctcgcggcggagaatccggcactgaacggtacagcgatgccgtgaacatccgaggcttttcattcaaaattttggccaacacttacacaatgtctgctgacaagagcaagaaatgtttgggctttttcatcgaatgcaataaaaatggtaaaatattaattaatttattaaaaattgaatttgtaatacgtacagataagcacaaaaaacgcattttccgcttggtttggggggtgtctacaatgacttttataatgccaactttgcttatttctgtgtcccccccccccgcatcgttcccccccccccgagaaataaaaaaaaaatttgctaacttagaaatttttcaagaaaaaaatcagaaagttatttcataggaaaattctaagaaaaaattttttgagaaattttcagcaattttttggaaatttttttgaaaaatcttagtaattcaccataaaaatttctcgggggggggaaatttttttcttagaattttcttgtaaaaaactttctaagatttttttcttgaaaaatttctaagttagcaatttttttaaaaaatttctccggggggaaacgatgcggggggggggaatgaagtgcacccgtcaaaattttacttttcaaaattttttaataaaaatcttgtccattccaggatctgattttgactgtgctgttgaccgttggctggatgattggcacgctgagtttttcgctttcggcacgtgccatttcagaggcgacgacggaagagaatgtgaacaaaacaatggtggcgcatggcatttgcgatggggtgaagagcggggacgaatgcaggtgggaatcgcatgcgacgcacgcgccactctctgctgttacggtgagcaaagaaaaaggaaataaatgtatgggaaagaaagtgcggacgaatgaaaggagagagagaagagagaacgagaaaagaaaacccaatgccaggggcagagagagagaaaaaaggaagagaaaaagaaagaagaggagcaaacacaaagagagagagagagagagggaagtacagaaaagagagtgaataagaaaaaggaaaatttaatttaattaactttttccctcatttttttgtagttggccggtgttggtctgttcattttgtttgcctcaaatatttggttcatctataag

SEQ ID NO: 74937 - DNA, 389 bp, Heterodera glycines
  Genomic contig location: Contig_ID=SeqID_11511; Location=488..876; Strand=+
  SCN-specific regions: Sequence locations=1-20,42-275,297-389
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctctcccagttttaagtcttggatttgtcaaataa

SEQ ID NO: 74938 - DNA, 595 bp, Heterodera glycines
  misc_feature (496)..(496): n is a, c, g, or t
  Genomic contig location: Contig_ID=SeqID_11512; Location=548..1142; Strand=+
  SCN-specific regions: Sequence locations=1-20,42-275,297-595
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattntgtttccataattttcgaaaagtattcggtatcataatgccaaaacaaaacgaaatcgttataaaatattccttttctggacttgacttggatttctga

SEQ ID NO: 74939 - DNA, 614 bp, Heterodera glycines
  Genomic contig location: Contig_ID=SeqID_11514; Location=813..1426; Strand=-
  SCN-specific regions: Sequence locations=1-280,303-614
atggcaaattgcggctatcaaaggaacaaaattcggtggaaactttttgaatgggcaaacagtgaaaaagtggccgaaaaattggagcattaccaccaaattccgcaattggaacggacgacgcggggcaaagatttgaaagggtaatttgaaaaaatagtaattaagtaaacgataggctaaaattaatcggttaattagggagtcaatgattttattggtccattcgaattatctgccgtaaagtgagctgctccccccaattaattttttttaatgttttaagcattttcaaaaagatatttttttaagtaaaaatgccttttgcaccgtttgggtcgccggattggtaatgaaagatgaaaacggcgatgtgcaaaattttccgccaatttactcgccaaattcaaatgggcctttcaattcgtcctatttaatgcacacactgtttttcacagatgcgcaacaaatgaatgaaaatgagaaattcaatggttttgatttgacattttaacattattattattcataattttctatgattcccacgataaacagaacaattcacagttaattcaattacaaatgaattaaaaagaaattaatttaataaa

SEQ ID NO: 74940 - DNA, 1740 bp, Heterodera glycines
  Genomic contig location: Contig_ID=SeqID_11515; Location=12..1751; Strand=-
  SCN-specific regions: Sequence locations=1-56,78-96,151-239,392 -588,610-687,719-772,800-841,908-1507,1531-1657,1679-1704,1728-1740
  Gene Ontology: Biological process=N-linked glycosylation
ttcactgattattattctccgacggaagaaacttttggcaatttgtcttcgtctgaatgtgaagaagaaatttttaaagacacaaaagaaacaaacgaagaagaagaagaagaagaaaaagaaaaagaaaaagaggaaataaaagaagaaattaaggaaaaagaaattgaaattgaaaaagaaaaagaaaaagcggagcaaatttggaaaagtaattataattattgtgacaattggacagaaaaaaggaaatggccaaaaaagaaaaagggaaaagcgaaaaaagaaaaagaggagggaaataagagagaaaaagcatggaaaagcgaacaacaaaaaggagaaaatttaaaggcaaaaagcaaaggcaaaaagaaaaacggaaaagaaactttggaccaaaaatgggaacaaatggaagaaaaaagcgaattgaaatgtgaagaaaagccgaaaaaggcggagaaaaagcgaatggtaattaaaaaattggcaggtaattaattaccaatggactttaataattgaaatttcaaaataagatttgctaaatgattttttactggccaagttgtacgttttttacttgaaaaatgaattaaaagcagaaaaatatttggaatatttgcatatttcgatgttcgtcagaacaacgcatgcgaaaatgaaattcgttagaatgcatttgactgattttaaaacttatgaaaaattaaacgaattttggcgcatttttctaaacggagaattaaagaaaaatgagcaaaattcgcattttgtgatggagaaactgctgctgatgcaaaatgaattggacaaattcattttgacaacggaagagtaaaaaaatatataaatttgattgaataaaattaatttatttaaaaagtaaatttgaaaataaattcagaaaagggactgaaacattttataacggagaaaaaatgcaaaaaccggtcaaaattggcacttttggcaatgccaccgtcggcacaatgctaatccaattgcatatgcattccttttcatctcttaaagccaaacaattgatcaattcggaagaattcgcatcaattgtaaaaatggacgtggaaaaaatgaaaggaatttttaatggggaaaaaattggacaaagaaaaatagaaaaatatgcaaaagcaatggaaacggtgctgaaacagcacaaattaggtgagaaatgaaaatcgaagtgaatttaaaaattaattatttgggtaattaaggcaaaaagtgtttgccgaacatcgaacaaagtcagtacaatttgatcagaacggagccaaaattgcgagaaaacgatcagaaaatatccgaagaagtttaatttattaataagcaattaaaaacattttttggtttttagatttatcagtttatttcgaagcattctgtcaattcgtttaaaagaggacaaattctcgaacttatggacaaaattgaacaaaccatcggcgaatgggtgaacagaatgtcgggcaaaagaacgggtaaataaatgaattaatgaattgtcgcgacaatttaccaaaataaattggcaatgaatgctttaaactcaaaatcaaattcgctctctcagatgcccatttgctggtgaacggctcgcatttgatgggcaccgaattggacgggtccgacttggatttgatttgtgtgctttctgatgaactcaattttaacgggcaaatcaaaggcaatttgttttctttacttggaatg

SEQ ID NO: 74941 - DNA, 195 bp, Heterodera glycines
  Genomic contig location: Contig_ID=SeqID_11516; Location=1549..1743; Strand=+
  SCN-specific regions: Sequence locations=1-7
atggcatttctcctccctcggcttgccctcgcctcctcctttcttgtcctcttcgccccattgtccgattctgccaatgttttgttctcttccacatcgctttatcctgtccaccgctttatccaacgtgaattggcttctgaactactgcgtcgtaatcactcagttacttggtttgaatatggcttaagcccg

SEQ ID NO: 74942 - DNA, 1052 bp, Heterodera glycines
  Genomic contig location: Contig_ID=SeqID_11517; Location=557..1608; Strand=+
  SCN-specific regions: Sequence locations=1-929,951-1052
  Gene Ontology: Cellular component=membrane fraction; Biological process=lipid metabolism
atggtcagacgccccagcggaagtgatcgtaagtgtgctgagaaaacaatttatgttaatgttttggttggtcaaattccaaggagaatttggttggtgccattcgcgagttgccagacattcgctttgtctggcagttcgatggaccagcgttaaggaacactccgaagaacctttttgcggctgaatggcttccccagcaggaattgctcggtcattgacaattaattattcaaaattgttcatttacgagtcaaaacgaaactttctcgggccaaatggcaaccaggtggcattagtaaatcaaaatgcctttcagctcatcctaaatgccgcgcccatttgtcccacgggggagtgaacagtgtcatcgaaagtgtttggcacggtgttcccgtcattgggtggccgttgagcgccaatgggagggacaatttgttacgagtcactgctcgtcaggccgggcttatgctggacaaaaagcgaccgtccaaacaagaatttatctcggcattccaccgaatttacatcaaacattacaaggaagagatgcttatatttcaagtgggcttcccaacaaacatcgaatgccacttaaataattgtgccaaataaggatatggtcatcgacgtgccttacaccgagttgaaccactcggccttttgggtggaattcatcgttcgtcaccaggaagttccccacgcccgctcgggtgcggacgacctgaatattttccaggtaattcgcctcttaaaaggctgctgatccgactcacttaaacattcagtacttcctcgttgatgtgatccttttcctagtcggcctctcactgctcgtcctttaccttttcattcttttgctcaaattgttcttccgtctgatcatctttttgatcaaatggcctttttccgccggttggggcgctatcaaagagaaaaaagggacaaaacacgcaatggctaagaagagagactgatcgacataagcaaattcacttaaaaccgagctgctgactgatttaactggccgtttttgctgagccaatttttaa

SEQ ID NO: 74943 - DNA, 838 bp, Heterodera glycines
  Genomic contig location: Contig_ID=SeqID_1627; Location=1888..2725; Strand=+
  SCN-specific regions: Sequence locations=1-27,50-258,280-464,501 -566,642-815
atgacgtcgacaagatgggcagagattgaaggggaggaggagaagagggcgtttgtcaagcgggaggtccggcggttagagggatgggccatgagaacggcccggaaggagttggacgccgaatggccggatgttttgcgggtaagtgccaaaaaaatacaaaaaaaaattaatgctaattaatgatgctcctaattcagctctgtgacctgctgatggaaaggaagaccgccgggccgaccgacctcagaacgtttgttcatttttgttaaagaatttaaaaaaaaatagtcaacgggaatttttttgaaaattgctgctaaaaatgagcaggccgatcaaaaaaaacaggcagacgaaggggaaggggggttaatccaggaaattcaaaaacaatgcccacctgatttttgctgccactccaaccacgacgcgttcattccagtcgttcaccaaaggacaccttaaaattttttatataaatttaattaagaatatttggcgcatcgctgtgggaacagaataatccccagcacgccgattattcgtatgaggggacggatggagaggaggatgatgaggaggaggaggagggcggtggaagagaatggggatgaggaagagggggaggaagatgaggaccagcagattgaatttgtgtttaaaaaaaaacattttgatttttttttgtttgataaatttttgttgtgttgacagaaagcttttttttcccaatcggcggtgttcggttccatgccagccaacacattttttttgaaaaccatattttaaaattttgtttttcgtttttttgcacaatcaataatttaaaaacaaa

SEQ ID NO: 74944 - DNA, 2545 bp, Heterodera glycines
  Genomic contig location: Contig_ID=SeqID_11518; Location=60..2604; Strand=-
  SCN-specific regions: Sequence locations=1-225,291-384,411-568,592 -908,931-1030,1053-1066,1090-1136,1158-1193,1215-1403,1425-1497,1526 -2211,2233-2284,2309-2545
atgccaaaaacagtacctaatattattcaagttataccaaagcgaaacattgttattacatttaaaattcaaggatatgcatggttctgttgttgcatgctgtccctagcccttcgagaagtaggcagtaacgggtgcacagttgcggctgttagtcagtaacagctaccggaacatgcgtggcatccgtgcagtggtcggatccgtaggcttcattgattaatgaaatttatatattctatataaattgtcttttgaatttaaaaaataattatttcatatttataaaacagtacctaatattattcaagtttttataatcaatccattttaacttcattttcaatgaaaaacgtaatttgcaaaaaacatgcttgatatttgacaaataaaattcattttaaatttttgggtctaaatgagttaggtgtctctaattatttgaaacttatattcatatcatttagcgacccttctagtgcttaatttttccaattttcatatctcaagccttttttcatatggtgcagccttgaggccatatttagtttttggtgcattacttttgtgacaccaaaaagggctggtccgtttttgggtatttgttaaagcactaaatttgtaaatgagtttcttgcttccctcaccaagtaggatccaaaaacttagtaatatgaattgaatgcaattattatattatgtttttttttgaatacccattcctacaaaactgtatggcccattcaatttatacgaattgacgaaattagttggcaaaacgtccgaatttacctaagttggctatttttttcaaattaattactaagaagactgaataagagagaataaagaatattttaatttcgtctaaaataattgtatgaaaaagatttacaaaaaaaaatacattaaaattttcaatttttcgactccaacatggcgagacaacgcactcgggaaattcgaagaaattcaataacggtgaagtcttagacttagccactctaatgcttcaaatagggaatttttaaaatgggttctatggacataatagatttaatgaatttggtttttctaaaaaagttataaaagtgtcaaagtccatcacactcaaattgtgatatcatttggacttcattaattatttaatttattatgtttgttttggcgttccgtttattcaaattgaccttaaataatttgttttgttttttgattagttcttatgattgtgaagtaaaaagttaattgtatgattgatttactttcgtctgtgtctaattctcgctggttttcaagtttgtttgaaattgtgtttgttttggttatttcgttgtctttaatttcgttttgcataaagcataattttattgttttcgatttattttgagacagggcaagtacctttgactgatcaacaaatttaaattgttcgaattgcttcctttgccttcgcttgccaatttggaaaataaagtcgaagcctaattggccaaaaaattttgctttttccattttcctctcattctaaaaaacatttcttgcatttaactaaactgttttccccgcatttcagttggatttgcattcccattttttgaccatgctcaactcggcctcaaattggcatttctttcgccatgtttcgaagttttggtggacaaacatttcgacagcaaaagcgaattaacgctttggagaccaatcgaaattcgtcgcaagaattcagtgccagaccgtccgttgaccagcaaaattcgcttcaaatgccttcagattaggtcattcaacaaaatcagagttagctatcgcaataaaagccatccattttcagttacattgaccatcccgtgatcgcttttctccgtgccaatcagcaaatttgggacaaaggcaccaatttgtggttgagtattccttttgcactagatgaccagccaatttgtttttgtccgtgaaatttggccaatttttgcgcaaaacattcgctacttggacttttccggtgatgacctccttttggacaatttacgtcgtctcatttcgccaacaattctcactgatctcaacattatttccatcttttgtgttctgttgcccgattcgactgatgattttgacgggccaaatgcaattccaactgctggccaaatgttgtcaaaatggttgcacactccgcgaaaagatgtccaactgaagcaattgcgttgccttttgaagccaccaaatatcggattggccaacatcaacactttgaaaaagatgggccatattttctttaagcaactgattttaatttttgttttccattgtttagaaatttctcaatgccaccacttccgtccgctacaaaattcaatttattattgatccattgtcaacgcaaattgtgacatttgaattagcgaacgaacggaccaaggaaaagctgacactgatcaaagcaagcgaaaatcatcaggaggaccaatggataatgaaacggtgccaaaatggggagacggcgactgcggttcaatgggaatttgttaatttgacgatttga

SEQ ID NO: 74945 - DNA, 1494 bp, Heterodera glycines
  Genomic contig location: Contig_ID=SeqID_11520; Location=1554..3047; Strand=-
  SCN-specific regions: Sequence locations=1-79,109-306,333-1341,1366 -1366,1395-1403,1434-1494
atgcttgtcgctactttcttcttgtttcatctgatttattatcatatcatgaacattgacggaattttgggcattggacatgatgatgatgatgatgatgatgatgatttgtttggcgaattatggaaaaatattccaagaaaaaattcaaataaacaaaataatcatggattgaaggaagaggaggccaaaagaaaaataaaaattgagcagaagccgcaggacgaagagcaaaaaaatgtggaggaaaaaaaagaggtttcaaaaaatcattcaatgcaaataaaaataaagaaaaaagcaacatttttggatgataaaaaggaagaaaaaagtgtcggcaccaaattttcggaagaaaattgccgaaaagtgccaaaatttgattttgaagaaaatttagccaaatcactaacagaagcatcgccaagaactgctgatatgtgcgacgaatcggagaagccttcttcaattgatcacaacgacaaagtaaatttatttgcttaaaaaaataaggcaaaaaatctgtgatcatttgtggcgattgtcctgataatttgtggcgattgtcctgataatttgtggcgattgtcctgatcatttgtggcgattgtcctgatcatttgtggcgattgtcctgatcatttgtggcgattgtcctgatcatttgtggcgattgtcctgatcatttgtggcgattttcctgatcatttgtggcgattgtcctgatcatttgtggcgattgtcctgatcatttgtggcgattgtcctgatcatttgtggcgattctcctgatcatttgtggcgattctcctgatcatttgtggcgattgtcctgatcatttgtggcgattgtcctgatcatttgtggtaattgtcccacaaatattgactctaagctccgcaaaaagactgatttcgcttttgattgtattactgtagaacataaaaggtaactcgcccggtgggactcgataccaagaccccaacaatccgtgccgtgctctaaccaattgagctacgggcgctcctttcacttccttctgacatcacattaagcttactaataattttagggcaatcaaaagcggtacggtacaactaactcttttgggtgatcaaagatggacaacttggttttttgatttatcgctattatctaccagggatgtatagattccgagaccaaaaaatgtcgaaattcagatttaagattgaaattgcaagtcgaatattaaatttgttgctaatattttttacaaaatcttttaacatacgggcaaaaatctaaatttcgaaatatttggacatttattgttcaaatagttggtactttcctgttagagtcgggggcgtttgggccccagtttttgggccctcgtttttgggccccagggtcgtttgggccccaagtacagaaaaatgaaaaatcacagtaaaaacaactttttaaatttcagcataaaaatgtaaaataaacattttaaaaataaa

SEQ ID NO: 74946 - DNA, 256 bp, Heterodera glycines
  Genomic contig location: Contig_ID=SeqID_11521; Location=409..664; Strand=-
  SCN-specific regions: Sequence locations=1-192,214-256
ggttttcggggtcgctgaatacgaatataccctttatattaccccttgcctaaccttaggcaataactctcaaaaagtaggacgacgacgccgacgctggcgaacaggaaaaagggaaggatcgcaaggaggaaaagagcaagacggagagaagacgccgtttttggagatgccaaaaacagtaaacatgaaaaggaggaaggaaaggacaaaggaaacggaggagaaacccaacaaacgggcccctaaatcaggg

SEQ ID NO: 74947 - DNA, 656 bp, Heterodera glycines
  Genomic contig location: Contig_ID=SeqID_11522; Location=146..801; Strand=-
  SCN-specific regions: Sequence locations=1-102,124-383,405-656
atgttcctagtcttcaacgtaatactttgcaattatttgcttctcctgtcaattaatattttttcacatattaaattgaaattaaggcattaaaatcaattaattaagaattatataaaatagttgtggtcttttgtctgtgggtattttttgagtggtttttttgactgtggatcttctgtcattatgcctaatattttgagcccaagaattcccgagtcagtctctttatgtggtattaattgcttaacttcttccctatcgcattcctacaaaattatagagaaaatgaaacaagcaaaaacttcgccccaaaaagataacaacatttcatcgcattatctgagcaagtctatccgtttgatgcctcaaatttgcaatacttttaaatataaaatttgttcatttctcagcttggcttcggctggactaatggcgctgtgttggaccttttggtcaaatatggcgacaaaatgacgctgacacagatgccggatgttaactgcagcaaaatgacgaaggatcccgagcccgaagtattcccaccggaataaatagaatggaagtgatcagagcgaaagtgatcggaattttaaacttggctcccccgccacagaaatatgtccatttattaatccttcattttataaattaaa

SEQ ID NO: 74948 - DNA, 332 bp, Heterodera glycines
  Genomic contig location: Contig_ID=SeqID_11522; Location=883..1214; Strand=+
  SCN-specific regions: Sequence locations=1-73,95-134,175-182,205 -257,284-290,312-332
gggtcgtttcctaaaaaccgccatgtggtaggaaaacaaaaaaatgtaagacatataaattcataacttggtccattttcaaccaaattaataattcttcgtatcattcaatagctctaggtgttttctatcagaatataattttattaaattttttacttaagtatataaaaagatatggtaaaattccacaaaaccttaagtcggaattttttgtccagaacttttttgaacctcaatgaaattttttgaaattagaaagataaatagaataaatagagtacttgaaattctaaaaagaaaatttaatctatttgcttctgaaaaaaagt

SEQ ID NO: 74949 - DNA, 1361 bp, Heterodera glycines
  misc_feature (134)..(134): n is a, c, g, or t
  Genomic contig location: Contig_ID=SeqID_11523; Location=93..1453; Strand=-
  SCN-specific regions: Sequence locations=1-273,295-551,576-723,758 -838,860-1220,1267-1298,1320-1361
atgacggaggcccaagtgagcgaactgaagaaatttgtgcgcaaaaattttggaaaagccgagggagtgctgaaacagtgagttaattggctaatatcctggccaaatgcggtttccaaatttgcaatttgttnaagacatgacccggaagattggatggaaaatccgcccgcgtttgagaaaatcaaagacaaagatttgaaggaatgggccaaggatttgaacaatctgtggaagcaattgggaagaaaaatgccagatgaggtgagaagcattgaaaagagccattggcctaaaatccaattttatattcaaaattctttccatagttgaaagacagcaaaaggcattcgcttttgtacgttcccaaccccttcgtggtgccgggtggtcgtttccgcgagttttactactgggacacctattggatcattcgcggacttctcgcttccggcaagtgatcggagtggcaatttgcctccttttcatggccttactgacaaatgatcggtcaatcgctgttgatcagcgaaaatattacaatttaactgatttaatttttttaaataaaaaaacaactgtaaacacagggatgaagaaatccgtgaagaacatctgccagaatattgcttcgatgatcaaacgtttcggctttatgccaaacggaggccgaatttactacagcaagcgatcccaaccacccttcttcgcatcgtaagcatcaaataattaataataaatttttaaataattattagcatggtttacgattattacgaggcaacccaagacaaagaatttctcaaggaaatgcttccgatcattgaaacggtccgataaatttgcttttttaaattaacacttcttcaatttaaggaactcgaattttgggagacgaagcgatcagtgaccgttgttgtgaagaagaagcccattaaactttgccaatacagggccgacagcaacgttagcattaagcaatgataattaatttagaaatgcaaaatcgataaaatgggatgttaattggctaattaacttttcaggtgccgcgtcctgaggcatggtgcagagacacgcacctggtaaaaaacttaactgaaccaagagaaaaggcgaaagtttggcgtgaaattgcatctgcggctgagtccggctgggacttcagttgtgagttgggatatcagggttgttcgtaatttcggatgaccgattaggcgaatttttattttattctttctaattttaaattaattaattaattttccattgattctttatttttaaatgcaaaaaaattcggctttttggcttccaattccttttttgtaggctttggtttattacaggtatttaataaa

SEQ ID NO: 74950 - DNA, 2787 bp, Heterodera glycines
  misc_feature (210)..(210): n is a, c, g, or t
  misc_feature (2489)..(2489): n is a, c, g, or t
  Genomic contig location: Contig_ID=SeqID_11524; Location=1168..3954; Strand=-
  SCN-specific regions: Sequence locations=1-965,987-1313,1335 -1335,1369-1377,1399-1982,2017-2102,2124-2234,2256-2540,2562 -2574,2603-2761
  Gene Ontology: Mol. function=GTPase activator activity
ggcgtgccgacattgtcccgtcggcgtccttcgcccgtccgtcgaatgcccccgccgcttcgctgcctttctacgccaatccgcgcgttccttcgcttccgtcgggcggtgccttttccgacatcgaagtcggacgacaaagtgaggagagggaatcatttttggatttgtttgagtacaaaaataggacggactgtgccttcgatgtgncaacggggcggtggtgggcggcacgggacgaacggtggcggacattttctcggccaaagaatatcgaaattgggcgagcgaagttggaccaaagcacacataaggaacaaaatcatttcaaagtgggtaattaggacgaggatgacgtcagtcgcgatcatttcgcgggagggcgtcgtcggacgcggtggacgggaacggcgggccgaatgggggcacagacgaggtcaaactcactcccgccgaaagccattctcatggacaatgtgaatgtacatcaaaaaccaagaattaaccgagtctgatcatgtttaagcatttcatgggacacgcccaaaacaatttcgaacaatcggcacaaaacccattttcaagggcggaacggatgagccccgcggaaaaggcggtacggcatgggcaaggtggccaagcagtgccaaacattggccaatttgggggggggggaagatgaagcctttggggcgaaagggcagcattttattttcccattaaatccgaactcggctttatctaccttcccttaggacattttggaccgtctccacgtctctccattgaccaatcgccgcgtccctttgcgtactgctgggcccggcttcgacgtggacggattgagcgtggccaattcgttgagcggaattctcagtgttacggtcagtggccaaaatggacatttttcggcattccaaatgtcaatctgatttgatcagattcttttgacatctgcatgacaaataaattaaatattttccttcgttcgcttctttaagatcgtcgagggtcgcaatttgaaagtgccggaccgcgtccactccaagcagttgtactgcgtgttggaggtggacgagcagcacagggcgcggacgggcatttcaacgcccgaacagcacttcaggtgacagccaaccgatgctcttcccaaatttgtttaactttggttaatcgtttttatgttttttcagatgggccgaacaatttgacattgatattctgaacgcaaccaacgcgtccttcttcatttacgcttggcatcccaaacttcggtgagtttttttggagctaacaataaacaagtgcaatttgcaaataatgttcattggtttcttaactaattagctagctaattaattaattaatggcattttgtttgtttgttcccttaggcatcgtttctgccacaagggcgacattcgtctgatggacgcttttctggtggaagggttcggcaccgatcggatgttcactctccaattggagtcccggggtcagcttctgttgaaggtgcttccgttcgatcactgatcagtccccaaatgaaatgactttgcccttccgagcaaaggtcgctttttccgacttggcccactctttttgccgaattcgtcgcccttccgccgattgcagcggcgtttttggtcggtcgttgaattggttggtggagcacgaaaatgttgaaggttttggtcggtggatggatggatagttgttcactttctctgtttagtccccgtggtactgaatcgactggcgaccgaattggagaggcgcggcgtcgacaccgccggcctttactttcgtaagtgccaactaatttcgggggatgtaacagatgacaatgagggcatttcggattcagtttgtggggccactgaacggaagttgcctttgcgaatgcaattggagaagaacagcgcggagacggacattggcgaacggccggtgcccgacccgaacattttgacatgtttggtgaaggtgaggggagaggaggggggggggggggggaatgggccgaattgagagaaagtgccatggaaaatgaggcgcaaaagtgcagggaaagtgtcgaatgattgcatttcaaggactttctgcgggaactgcccgagcctttggtgccctttaacatttactcaatgcttttggacgccgcttctgtgatgccatctatcgacaaagaggcaaaaacgggaaaagcattgtgccgactcattcaatcattcgtttttcaggaaaaccaaaagttggtgatgcgaattgtggactgtttggcgacgccgaacaaagtgagaagagaagggcacttttgcaagcagttcgttggcattatcccaaatgttttgcagaattcgttggtttttctgatggcccatttccgcactttgctcgcttccgaaccgcacaacggactgacagcgcaaaagctgagcgtcgttttcggccctttggtatgccaaaattctccgtgtttaatttcncaatttatgccattccctttgaattcgtttcaattgtccccgtccttttcagcttttttgctcttcctcccctcctccaaattctccgcccgtttctttgccttttgtctccccaaaagcgtccctttccaatcctgcgaattcgctgctcaacgcccaacacgcggccaaagcattgcgacttttgttggaccattggccccgagtcagtaagtgaaaagtgaaaatggcaaaggacaaacgaacgaacacagaagccaaataattgatcatttgttttttgagatgggagtttcga

SEQ ID NO: 74951 - DNA, 517 bp, Heterodera glycines
  Genomic contig location: Contig_ID=SeqID_11525; Location=679..1195; Strand=-
  SCN-specific regions: Sequence locations=1-99,138-411,434-517
atgtgtcaaggtgctggaccagaagaacaacgaaagccgaaaattgtggcgtcatctcaccgctgctctgtacttcaacgacacaaaaatggcgaaccaaggtgggaggggagggaggaatttggaattatgaattaattagttttccccttgtttttcagtcaagcgcttcatcgagcaacaccagcgggacgaggacaggcgacgcaaagaacaacggagaccccagtggaggccgcgccattttcaacgcgttgggactggtacgccgaccgacgcctggagataccgcgacgcgcaggaatgaggaacgaatgggatggcgattcgtgcacacctccgaagaacgaactgtgctgcctgttgtattaaaagaggatgtttgtaaatcatttggcccaagttgcctccatgtataattgtatatgcatatatcacttggccctgagttgcctctctgtgtattttgtatgttattgcgacgcactattgtacatttcctacatatatgaataaa

SEQ ID NO: 74952 - DNA, 626 bp, Heterodera glycines
  Genomic contig location: Contig_ID=SeqID_11526; Location=106..731; Strand=-
  SCN-specific regions: Sequence locations=1-283,305-403,425-626
  Gene Ontology: Mol. function=oxysterol binding; Cellular component =cytosol; Biological process=Golgi to plasma membrane transport
atgcaagcgccagattggggcaactacgacaccaacggaaccgactacgactacatctacaacaactcggacgaacgggacaactggaacagcgagcaggccggcgtgttcagacatttagtgggccaggtagacgacgcgttgttcgatgaattgttttaatagaaattctcttttcagctcggcaccggtcagactctgcagaatttggcgctgcccaccttcgtgctggaacgacgctctctcctcgaaatgtacgccgacttcttcggtgaacacagcttttttaaatttttccaagttcaatcttacctcatttcagctcatcctgatgaactgatcgccggcgcctacgagaacacggctgagaagcggtgtttattcccgattggttgacgacaacgcttttgaatcaacaatttttcagattccttgccgtcctcaaatactacttgaactccttctaccctgcacgcaaaaccgacgacgcgaagaagccgtacaatccgatcctaggcgaagtgttccgttgccgttggaccctgcctggcgtgccgttgtccgcaagccgaaccgccggtggaccgttcccgggctcagcaaccaaccaggtccagtttaagtga

SEQ ID NO: 74953 - DNA, 1247 bp, Heterodera glycines
  Genomic contig location: Contig_ID=SeqID_11527; Location=630..1876; Strand=+
  SCN-specific regions: Sequence locations=1-219,241-434,456-494,517 -691,721-1247
  Gene Ontology: Mol. function=ribose-phosphate pyrophosphokinase activity; Biological process=nucleobase, nucleoside, nucleotide and nucleic acid metabolism
aatatgacaaaatcggatgtgagcactggaatggttcttttaaccggcaattcacacccagagttggcccgtcttacatcagagttggctttttgatttcttaattgaaaaccacttccctttcagccgtcttggaattgctcttggtgatacaacaatttacaacaaacctaacaaaggtattagccttacaaaaagcacaaaagaattttagcaaatagtaaaggtattcagaaaaaacttaaaaattttgactttttcgcaattttcatgttgagtcgccgaagcgatacagacccatgttgattctgccatttttttttcaattttgccaaaaaaaaacctaatcttaaatttagaaacttcggtggatatcagacagagtgtgcgtggaaagcatgtgtttatcttgcagtcctctaataagttggcactttttcatttcttttcaatttaaagttcagaaatgtcaacaactgtgtcatggaaatgcttattttgatttatgcatgcaaaacttcgatggcaaagtttccctctttttaaaacatttttttttgttaaaattcagatcaattaccgtcataatgccgtatatgccctacagcaagcagtgccgaatgtttcgtcggtcgtcagtgccaatgaaacttgtcgctgatatggtctgcaaagctggtaagaatttaccaacaatttttaaaatgttttaaatttccataaactattttatcctaaggagcgtctcgaattgtttcacttgacttataccgcaaggaaattcaaggcttttttagcattcctgtggataatcttcgcgcgtctccttttttgcttcaatacatgaaatacaatgtttgttggggcctgggccaaaattttgagtattctaaacattagctgattgagagttaaaattctgggtttttgggatagagcatggcatgacgtttcgatactaagagtccattccctactcggcttctattggaaagcattttaactttttgttttcctttttattagattcccgactacaaaaatgcggtaattgttgctaaaacgcccggagtcatgaacaaagcgacatcatacagcgagagactgagaattggcatgatatgacgtcatctgttttcatttgttttttcgtttttaaaggcattgctgtaattcacggtgaggagaaaactgacgagggagtccaggaggatggacggcaaagtccgccgccatcgccgacggac

SEQ ID NO: 74954 - DNA, 77 bp, Heterodera glycines
  Genomic contig location: Contig_ID=SeqID_11528; Location=477..553; Strand=+
  SCN-specific regions: Sequence locations=1-77
tagagaaaaaaagataatgtttttctctggcactctctatttattggtacacatctcgttttttcggacggtgtgtc

SEQ ID NO: 74955 - DNA, 2927 bp, Heterodera glycines
  Genomic contig location: Contig_ID=SeqID_11528; Location=1461..4387; Strand=+
  SCN-specific regions: Sequence locations=1-713,735-1131,1153 -2147,2169-2287,2309-2341,2364-2681,2703-2927
gtcacaaatgccgcaccgcaaaacgccacaccagcaaatttgagcaatgccaatttggcaagctccatcgatgctcgcctttcagcgttccattacaatccggaggtcggcacaacttttgaatgctggttcaaacggtacggaaaattgatcgaggacgacggaagcactctgcctgaggcctcaaaagtgcgactccttctcggcaaacttggagaggaggagtacaacaaataccgggacacgatcagccccacacagccggaccaagtgaattggaatgacaccatttcgcacctcaaaagcctttttgctgaaacccgctcgctgttcgtccgtcgctacgagtgtttcaaaattcgacagcaacaaggacaagatgtttcatcactaattgcgcagatcaacgcatcatgtgaaaatgccgatctgagtctgacaaaggaacaactcaagtgcattattttgatcatcgcgctcaacgatgaacatcacgatttgcgacaaaaggcactgaaaatgttggaggacgctcagaaaaatggcaccaacatttcactcaagaaaattgaggaggagttaagggcaattcaacttgtcaaagagagcgcactttcgctggtcaacccgccaattgccaccaacgccattaacacaaggccgcggcaatggaccgacccagcgcaaagacaaagtggctccaatcaacggcaacatcacaatgcaaattcaaatggaaagcaaacacgtggtcgcccaacgcttccgtgtgcatcatgtggcaaatccgaccattggcgctccgattgctcattcaaggacgccatttgcctcaagtgcaacaaaaaagggcacatttcaacaatttgccgtcaaaaaaaagcaaagtcggcaccgaacaacaatcggtcattccacacagtcaaagtggacactcattgcctgcatattagcactactcaaggccgatggtggaaattaatcattttgattaatggaaggcaaacttccatgaatggcgacacctgcgctcaagccacagtcatttctttgcaaacatggcgagagttgggagaaccgaatttgactccatccgacatcgatgccaaaaactgcaatgatcagccattcgccttgcttggcaaattccaatgcaccgtccaattttccgacaaaccaccgcaaactctgatcgtctatgtgagcggagaagtcggacacaatttattgggattgccgtggatcgaagcttttgagataattccccgccaaattttatttccgaccaacaaaacggctgatcaggcgacaaaaatgatcgacaatttttcgacagtgaaaccgccaaacaaatcgatcaatgatgtggcgtcacttacagcggcacttcaaagtgatttctcggaagtttttgatcgcgttcttcaaattggcgcaattaagccaatcgatttcagtcattgggcagcgcctatcttagccgtaaaaaagaacggcaaaacgagagtctgcattgacttctcaactggcctcaacaacgcactggaattgaaccgccatccattgccaaggccggacgacatttacgcctcactgaatggcgcaaaattgttctcaaatttgaatttgcgcgatgcatagttgcaaatggatgaagaatccaagcaattgtggccatcaacacacatcgcggacttttccaatgccaacgcctgccattcggagtcaattcagcaccagcaatatttcagcatttgatggaccaaatttgtgctggtgtccctggagttttcgcgtacctcgacgatggattaatcgcgaccaaaaccctggatcaacacatcacgacactttacacaatttttggacgcataaaagaatatggtcttctcatccaactggacaaatgcatttgcagaccgaacttttgttcctttggcatattgtgtcagcaaatggcattcgtccatgcccatcgcgttcagacgcaattcggaaaatgcccgcaccaattgacaaaaacaccctccgatcgttcttgggagctttgaattatcatggaagatttgtgaaatgcatgcgcgaattgcgtgcaccgctcgacaaactcctccaaaatgacgtaatttggaattgaacgtccggccaacaaaatgcttttgaaaaagcaaagcaaatgatgatgtctgatttttgctgactcactacgtcccggcacgcacaatcgtcgtatcagcagattcgtccaaggatggcattggcgccacattaagccacacattccccgacaaaaaggaaaaagtggtggaacacgcagcgtgcactctgacagcagcgcagtaaaattacagtcaaattgaaaaagaggcattggattttggcaaattatgactttgaaattcgctcgtcaacaccacatcatttggccaagccgacgttctgtcacggcttatcgctaattatccacgtccagaggaggacatcctgatagcaaacacttgtgccgacaaagattgctatatcaattatgtttttgaaaacagaaaatggatcaactcccagtgacaacaaccttaatcactgcagcaatggtctatgatcaaccacttcaaacggttcttcaatttctaagaaacggatggcctgccaaagtcgtggattccgaaatcagtccatattttccaaaaaagggacaaaattttggaagtcgacaattgtctactgtatgaggacagagtgatcgtcccaacatcgcttcgcagtctcatcctaaaggcattgcacatcgcacacccaggcattgtgctcatgaaggcacttgctcgtcgccacgtgtattggccgggaatggactcagcgaatgaaaaagttgtgaacacatgcgaagagtggcaatcgggccagaaaaatccaacaaaagcacctct

SEQ ID NO: 74956 - DNA, 217 bp, Heterodera glycines
  Genomic contig location: Contig_ID=SeqID_11528; Location=739..955; Strand=-
  SCN-specific regions: Sequence locations=1-119,141-217
gtgatgcggactatgcaaaagagtttttcccaattccgccgcctcatatcgaagcccagcaattggccgccgccgccaaagctgcgcaatgatattagaagtgatcagcggaatgagtgatcaaaatgacaaaaaacaaatagcgattttctttgcctctttttttgtgtgaaaatttttgtagaatccgtctccgtgtaaaaatgtgttgttacta

SEQ ID NO: 74957 - DNA, 1276 bp, Heterodera glycines
  Genomic contig location: Contig_ID=SeqID_11529; Location=141..1416; Strand=+
  SCN-specific regions: Sequence locations=1-332,361-1276
tatttcaagggctatatcccaggccggtccggttcttgatccattcacttggagcccttcatgggtcgggcacatatgccggaggaccctcagcctcgcccccgaccctatcggtggccaacccaagctaagcgtgccggtaccagcggcttttttgtacagctcgatgagctctacaaaatggtatcaatggcgtccggctgtgtctactacaaatggagaaaattggcgagaagtgacgtgaaaaattgaaaaattaaaaaaatttgaaaatgacttgcgtcccgccgtacattagggttaaccggacggcaccgtgattttgtgaattgaataattaatttatttatttaattttatcaatcactgagtttttttttggattgacctagcaccgcatttgtcatttaggtttaaaaacggagacgaagcaatcgcatttttcaacgtcgacgcggtgtaccttaagcatgaacaccaaagggatgcgtacgattttcgggtgattcctccattttcccctccatcccaaatattcttttcgctttccttaattaattaagcatctccaagtcggacttagccgtcgcttcagggcactaaaaatttggtttgtgtttcgtgcgattggcattcagcgaattcaacaatttttgagaatggtgcgtcaaattgggaaagtcaaatttgcaacattttgcccattaattagcaaaacgaattggccaaaatgttcgccgatcttttgctcagagacgaccgtttcgagctgttcgtcccccagcgtttgggcttagtctgctttcggatgaaggtaatctttacaaaggaatcactctaagtgatcgcaatttgctaatgccattcccaatgccattgtcgggcaaaaagtgccgtggtagtttactgtatgtctagtgataaccctgccgtggttactgtaggacccacagttttttatcgtagctttgttcattgtcccttatgttgagactagcaatgaactgaacgagtcgctttatttggccattaacgacgatcgacgcgttcatttggtcgcttcattcactcactgcacttttttcctccgtttcgtcgtttgcagttcaaagacacgcgaaacgaacatcgaaaaagcggtcgaagtgatcagagaaatggctgacaaagtgacgacggtggaaaaagcaaacgaagcgacggaaagggacaaagcggcgaaagcattggcggacgatggaacggaagaaagtggcacactccgacggacaaatgg

SEQ ID NO: 74958 - DNA, 243 bp, Heterodera glycines
  Genomic contig location: Contig_ID=SeqID_11530; Location=81..323; Strand=-
  SCN-specific regions: Sequence locations=1-243
atgccaaatcttgatgagatttgtttcataggttatttaaaaaaagctaaattagtacagaaaaatttttagatcacgaaggaactcggaagaggcacacgcggaccggccaaatcgaaatgtttctgtactacgctgtcaaaaaagacaactttaggatttctctttgttgaattgaaaaaaatttaaatacaatttaactttgttggatttaaaaattatctgttgttgaatttaaataaa

SEQ ID NO: 74959 - DNA, 181 bp, Heterodera glycines
  Genomic contig location: Contig_ID=SeqID_11530; Location=1054..1234; Strand=-
  SCN-specific regions: Sequence locations=1-181
gttggctaccaacctgacaaacaacgtccgaacttcttccgaatgatcatctcaaacccggcaattcgagtaaatcaatttaatactaataaatggattgaaaattataaaaaaactaatttaggagatcgatttggactttttgatcaacgaaattgtcacactgggagaagatttgtga

SEQ ID NO: 74960 - DNA, 1031 bp, Heterodera glycines
  Genomic contig location: Contig_ID=SeqID_11531; Location=1..1031; Strand=-
  SCN-specific regions: Sequence locations=1-50,80-149,190-302,327 -471,494-505,527-574,604-1031
aaaaacacaatgtcaatccctttgaaataatttggaaggaatcaattgtctttcctctttttaaaaaaggggataaattcaatcctgaaaattataggcctatttctttaacctgctcactatgcagagttatggaaagaattttcagcaaaaatatttacaattttctattaaaaaataataaaatttcagagtcccaatttggttttattagaaataggtcaacaacgaatcaattaataacagttgtcgaagattggtatgaagcaattattaatggaaaaaaaagttgactgtatttatattgactttaaaaaagcatttgactcggtacctcataatttgcttttatataagttggaaaaaattggtatacggggtaaattgctaaattggataaaagcatttttaattaacaggcttttagcgttaaaataggggattctttatcctctgttaaaaaagtttgctctggtgtcccccagggctctgtcctgggtcctttattattccttatatatattaacgaccttcctgatgtcataccatcaggagtgaatattaaattatatgctgatgatgttaaaatatatttgttataaagcaaaaactgaaacggaaattatgcataaagcattgcataacttattcgaatgggcaaataaaggtttcaattcaaaaaacttttgtattatatttgggttcaaaaaacccaaaagaaacttataaatgtgatgggaatacaataaatgctgtggatacaattagggacttaggaataaatattgataataaattacaattttccgatcatgtttaaccaaataacgaggaatgcctatttatgtagcgttccttgtttagaataattaaatctaaatcttctaaaatttggattaccttatataaaacttatattaggcctttattggaatatgctccggaggtttggaaaccgtctcttcaaaaaaatattaaaaaaatagagaagatgtcaaaaatttccactaaaatagtcttttcaagtgtaa

SEQ ID NO: 74961 - DNA, 365 bp, Heterodera glycines
  Genomic contig location: Contig_ID=SeqID_11533; Location=899..1263; Strand=-
  SCN-specific regions: Sequence locations=1-365
atggaaatggtgccatttgaattggtgaacgaatgcacaaaggaaaagctgacattggccaaagcaaatgaaaatgaattggacaaaagttggataatgaaacgctgcaaaattggagagacggcagcggtcaattggaaagacggaaattgggacaacaattgtaacaatgtgttcttttggctttttagtggcactaattgcatcgggtgagcaatttaaaaacatttgatttttatccgaatttgaattttgcgcttaatttaggcctttgtctccgccaccaccagcaagtgaagacgaagaagcgggacaaagcatcacaaagggcgaaatgagtgagggacaaacgaacaaaaacagtg

SEQ ID NO: 74962 - DNA, 117 bp, Heterodera glycines
  Genomic contig location: Contig_ID=SeqID_11533; Location=1392..1508; Strand=-
  SCN-specific regions: Sequence locations=1-117
tgcgtctaacaatttctgctggccaagcattgtccaaatggttgcactctccgagaaaagatggccaacccaagcgattgcgttgttggcaagggaactttgaatggatcaacaatt

SEQ ID NO: 74963 - DNA, 1161 bp, Heterodera glycines
  Genomic contig location: Contig_ID=SeqID_11533; Location=1917..3077; Strand=-
  SCN-specific regions: Sequence locations=1-655,678-788,811-1133
atggttgcacagtccgagaaaagatggcatgccgaagcaattgcatttctttttgaaggagccaccaaatatggaatgggccaacactctcaaaaaggtgtggccatattttcgttagccaactgatttcgtttgcatttaattaatgtccgtccgttttcccattgtttagcattttctccgtgccaatgccatttcttcggtcagctaccaaattcaatttactgttcagcaaccgtcaacgcaaattgtgccatttgaattagcgaacgaacagaccaaggaaaagctgacactgatcaaagcaagcgcaaatgtttgggaagaccgctgggtaatgaaacggtgccaatattgggagacggcggcggttcaatgggcagcccaaaatttggacggatttagcactgtcgagtttcattattacgtcgaagctggcattgggtgagcaacaaaaaagcatttgattttgtttaaaaaattgtgccgaatttttaggcctttgtcgccacgtcgcaaatggtgtccaattatttgaaggtgatttaatgcatttgagaaatgttcgatcattttgaattatggtgatgaataagagtgatctgaccattttttatgctcgtttttactctctgatttgttgttgttttccgttaaaatataaattttctctctctttctcgatgcatcccatgggtatgtaccagggatggcacggaattccgacatttttggggttggaattccgattttcgaaaatttttagggcctcggaatgccatccctggtatgtatcaattaaaaagaaaaattcagggtgtgaagtttttcatacgcaatttatagttccaataacagtacagtgcttgtcattaaaatcaggacacaccccattttcagaatttaaccgcttcccgtgaactggtcgaattgattattaattcaatgagttatttgtagacacgactaaaaaggcaccaaaaaatcgcgaaaaaaggactatttacatataataggcatcaaaaattgaaaaaaggcacgaaaatggaccgatgggttagacaatgtgccaatgggagacgaaaaattattgccaaaaatggaagggatggaaacattttgacacaactttgtttttaaaataagaaaattttaaataaa

SEQ ID NO: 74964 - DNA, 1026 bp, Heterodera glycines
  Genomic contig location: Contig_ID=SeqID_11533; Location=3773..4798; Strand=+
  SCN-specific regions: Sequence locations=1-1026
atggacgagacggccgtttggttcgattgcccggacagccgatgtgtggacaataaaggcgcaaaggatgtaagtttttttagataaaatgaacctattctaacaaattaggtgacagttgtgaccacaggacatgacaaaatgcgggtgacggtgtgtcttacagcacggaataacggacaaaaactcaagccgtacgtgctggtcaacagaaagcgaccggtgccgcaaattgtcaaacaatttgctggaaaattagtgatcaatttcgctgggtcgatatggatgaatgatgacacaacggaggactacctgcacaaaatcatcggggcaaagctgtttgttggcgaacgcctcttggtttgggatgcgtttgggagctacaagagcgagagaacgaagaaagtggtgaagggattgggaatggaaacggtttttatccctggcggctgcaccaaattcatccaggtaacaaatcatccttctcaatgaaattcttttttcttccctaggctcccgatgtctcgtggaataagccgttcaaggagcgaattcgacacttctacagcatttggatgtccaatgaggcggaaaaggagttcacatcagcgggcaatccgaaggcacctgctcttcatgtggtacttgattggatccaccgatcatggcaggaaatctccaaagaagtgatcatcaaatcatttaagggtcagttaaaaaattaattcaggaaaaatgtctaaacttttaagtctgtgggctgactacgccattggacggaactgaagacgaaaaaattgcttgcttcaagccggaaggagcaattggaccgatagggataaaatttttgcgcaagtttaggataaatgaaacggcgaaagatggacgaaaacgatcacgaagaagacggcttatctgatgacgatgatgcagggctggatggagtcggagatgacgacgaattgttcattttttgagccccttttactgttgaatttattttaatttttttggaaaatgtgccaa

SEQ ID NO: 74965 - DNA, 564 bp, Heterodera glycines
  Genomic contig location: Contig_ID=SeqID_11534; Location=604..1167; Strand=+
  SCN-specific regions: Sequence locations=1-154,177-185,207-240,274 -283,309-486,512-564
atggtcgaaacggtggccaacgaattggcactgtccgccagccaaacgcacgcgctgttgaacaaggcgatcagacggtgggtgagacggcggaggatcagggccaccaagatggatgaactgtgttcctgtccctacccccaaccgcatttcaattggttcctccaattcttggcaaaaaaaaatttaaaaatccaaaattctttagaaaattattcgagaattttttgccgaaattcctaattataagaaatttttaaatttaaaaaatttgcaatcctacaaaaaaaatttaaaaaaaaaatattctaaattcttaggaacaaattttatattgataaaatttccaatttaccaaatttcaagggctattattgcttttttggattctaattttgggtttttttcagtttgtccgaatatttcgactcaatttgccgtgaggcacttgaacacaacacaatgccaatgatcgccaacaacaaacagaagcagcaacagaatcagaaggaaaattggtggcaaaaacgaaaagcgacgaatgcccggcgatcaaaaaattga

SEQ ID NO: 74966 - DNA, 770 bp, Heterodera glycines
  Genomic contig location: Contig_ID=SeqID_11534; Location=1382..2151; Strand=+
  SCN-specific regions: Sequence locations=1-56,212-373,402-618,642 -710,732-770
atggctaaatgcacaaaaacccaaaataagcgcagcagatccgaaccgggtcaactccgtcccgccaactccgtcccgccaactccgtcccgccaactccgtcccgaccaactccgtcccagccaactccgtcccgccaactccgtcccaggccaactccgtcccgagccaactccgtcccgagccaactccgtcccgccaactccgtcccaatacaaaaaaggcccaggccaactccgtcccgagccaactccgtcccgccaactccgaaccgggccaactccgtcccgccaactccgtcccaggccaactccgtcccaggccaactccgtcccgccaactccgtcccgccaactccgtcccaagcaaaaattcaagaattttttaaaaataaatttgagtttatgaacaattcataagtagagaccggatttttatgtttttacatatttttttgcggcttagttatggcgagagaagcccaaaaatagcattatctccgaacaatttttgattttagcacataaaaatccggtctctattcataagtcttgatttcaatgaccgatttagtttttatttatgcaagttcctaatttgtgaaagaaaaacttttaaacaatgacaacttttattttcagggctcccaagtgtgcttatttctaagatttgtgcttattttgaggggccggatcttagaaacctaaaatatgcttatttctaagatttgtgcttatttcagcattacgtgcttattttgggatttgaaa

SEQ ID NO: 74967 - DNA, 1905 bp, Heterodera glycines
  Genomic contig location: Contig_ID=SeqID_1628; Location=1040..2944; Strand=-
  SCN-specific regions: Sequence locations=1-85,107-169,194-505,527 -715,737-1382,1404-1905
  Gene Ontology: Mol. function=microtubule binding; Cellular component =spectrin
atgcttttgacagagtacggccgaatgcctttgtcagcggcatcgccaattggagaaggaaatcggagcgtaccgagcggaaattgcccggttggaacaattggccaatggcatgtccgagatggaattcgcattgggtgcggagggcggcgagggaaaggcggaggagcggacggacgacggacaggcggaagcggagcaactcgaggagcaaattgttgtgccaaaggcactggtaacggatggaccatgcgctggcttttgcaaaatgcatccaaggtgctgtacccgtacaacggcaaaggcattgaagtgctcggtggggaggagttggcactgatcgacggcaccaaccgcgactggtggcgggtgctgacacggcatggcgtggaggggtacgtgccggccaattactgcgaattggccccggatgaagagaaggtgcgcccccaccctcttaattagttctactatctgcccaaagatcaccgtcagccaactttcgtcccaccgcccttcccccaaatcgcgtgccgaatttctcgatggcgcctccgtcgtgaaaaaccgccgaaaggcactgagtgccgactatcgtcgactgtgcgcaactgccgaacgacgcagaaaactattggaagaggcgctgaaattattcaaattcttcgccgaatgtcaagactttgagcaatgggcgcgaggagtgtgccaagcgattgaaagagccaattgccatcgaacacatcgcgagctgtggaagacaaattcaatgtgatcgactgactgagactgtacataaaaagtttatttgtattgtaattttgcagaaagtacgcgacgaaatccgtggccaaggctccgtccaattgcgacaattggacgcgacagcagacgaactgctcgagcaggaacactcgcgcagtgaggacattgacgcggcacagaaagcgatgcgtcacctgtggaaccaattacaaaaagcgatgaatggcaaacagaacgaattggagaggacggcacggctggcgcagtttcaggacgaatgcgcggacatgcgaaattggctgacggagaagagcgcactgttggagcagaagccgggcggagaagcggacatgcgaacactgcaaatcgtacagagacgctttcagaacttagaaagagtgggcgagggaatgcaaaaaaaagggagggacaaaccgaaacattaaaaggatttgagaccactcggggaaagaatgaccgcactcaggcgaaaagcggaagaaataatggaggagcagaagcaaagcgagcagcaggcgatcagagagagaacggacgaattggacagaatgtacggacaactgctgaccaaggcacggcggtgcatcgaagaggcggaacaaagccaaggcagggaactattcgagcggacggtgaggtgagacggactgaactgaacggatgggtgaggggaggggcgacttaaatagtgggacaaatggcaatggcaacaaacgcagtcacaggggggggaagtgactggccagcagggatagcaaatgactataactcattaagctgaaagcttacttacagccaaccactcactcactgattaagggagctgttggaatggacggcaaagaccagcgattgcattcggttggagcctctctcggcccattctcaagcggaggatgtcctccaccggcacgccaaaatcagagaccaaatgcaggcgaaggaatacgaattttcttatgccgaagaactcggagggcgtctaatgaaaaaaggggcagcgaacggagtggaaaagcgattggccgaattggcggaagcgaaagggacgttggaaagcgaatgggtgaagcgcgaaacggaatgcaagcagttgctggagttacaggtcgaaaatga

SEQ ID NO: 74968 - DNA, 227 bp, Heterodera glycines
  Genomic contig location: Contig_ID=SeqID_1630; Location=1..227; Strand=-
  SCN-specific regions: Sequence locations=1-227
aattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcagaaatccaacgcataattaaagtacaggctatagggaagctattcccgaaagattcggtctccccataaatctgggc

SEQ ID NO: 74969 - DNA, 1989 bp, Heterodera glycines
  Genomic contig location: Contig_ID=SeqID_1632; Location=1134..3122; Strand=+
  SCN-specific regions: Sequence locations=1-148,192-227,249-489,537 -599,621-640,662-1365,1393-1453,1475-1577,1611-1801,1823-1939,1962 -1989
atgactgtctgtctatgcgggcagcggcagatgggaggggcagacagtgaacagacgcgtgctgctgtggctgctgtgcagcagcagtctgttggacgcgtgcgtggtgtgtgggagggagggagtggggaaaaagagagattaagtggaaaagtaaaagaaataagagaaaagaaatgaaagggagagaacaattgaaaatttgtctcgcatctcttgcttatttacatcccattttttattttaataaaagaaagggaaatgagagtttttttatttctgttttcgcttcagtgagaattttcctatctttcttatataataaagttgagtgtgtgtatgtgtgtgtccattgtttgaatttgtgtggcgttttgtattggttttgcgttaaaaatgattttgaaaaaaaagaaatgttggttttgtttttttcattttcgttttgtcagttttgcaaaaagcagtctttaaaaatgttttctcttcttttttaataaaaaataattttatatgtttattaataataattaaatcgcattgaatgctttcaattgcatttgttaagagaaaaaaataattagtttttgttattaataaaaagcatttggaaatgaatgctcttagtacttttgtaaacaaaaagaaaatgtttttgtaaatgaattcctttgttattggattaaaattgatttgattagttatgaattaatttatgttgtgagtattgtttttgattatggcaaactcgatggaaatgttattgtttttgatattgcattgaaaaagttttgattcaagaatttgttttgaactttgaaatgaaaataatttgcattctttttatttttgttttgtaaaaaatatttgtgtattcgttcattctcattttctttaaatgtttttacttttttggtattttgttgttaaaagaatacgtttatgtttttgatgcgatgtttggttatgattttttcattttgatttttctttttacgctgaaaaagaatttcgtgatattttcgtctttgtctttgctgtggttttttgttgtttttgttgggttacgtttagataagtcgattgtttttcacacaatgttaagctgttttgaggacataatcgcgatcccatgtgggactttgttagcgtaagttattttgtttttaaaatttaattggttgttatgtaatttgaatttttaagatctgccactggtgttattactaaagtgatggaatcggagaaaaaagtcagcgttgtcttggtgtgcggatctggagaaaattttgttgttactgaatttaaacaaaattctgcgaacgctcttcaaaagtacctttcagttggaaatgtaaattgttgtcataattttaaattattttgtatgtttaaggtgctgaagcttcaatctgtcaaagcccaacgcttcaatgagaaatttgatggtcaaaaattttttcaaactccttttccgtttgagtttgttgtgacaaagcactcgaaaatttgtttggtcaagactgaagttttggtggccgagaaatttacgcagcttgtggcgggccgtttttatagtaatgcattaaataaaaatcttttaaattttctttttagaaattaagtgtgttttaacgactccgttttcattaattggagaaatgttcgctgctgttgttggcgatttctgtgggaagcgcgcggatttatttatttcgggcgaaaaactcccagaaatgtttgggcaattggacagcaaggaccagcttgaactaaaacgttgttttgtcaaaattgaaggtttttgcctaattgattttttgtttatctatgatttaattattttgtagatgagtgtatgcagcttaatgttttggcttctgatgttaatgtgtgtggatgtaaagtgacgattgatgataagttggtcactccggtcaagagaaagagtgatgaagcaattttgagtccgcaatcggctaagaaata

SEQ ID NO: 74970 - DNA, 893 bp, Heterodera glycines
  Genomic contig location: Contig_ID=SeqID_1632; Location=3188..4080; Strand=-
  SCN-specific regions: Sequence locations=1-598,620-728,750-893
tcaacccaccagcatttcaatcactgggactcaattctgcatttcaatcactggcactcaacccaccagcatttcaatcactggcactcaacccaccagcatttcaatcactggcactcaacccaccagcatttcaatcactgggactcaacccaccagcatttcaatcactgggactcaacccaacagcattccaatcactgggactcaacccaccagcatttcaatcactgggactcaacccaacagcatttcaatcactgggactcaacccaccagcatttcaatcactgggactcaacccaacagcattccaatcaccaggactcaacccaccagaatcaatcaccgagactcaattctctggcatttcaagcaacgcgactcaaattaagcaattctccgatattcttccggtctctcaatcaccagacaaaaaattgtgccaaattcatcactgcaatataatatcgtgtaattttaggtctatataaaaaacaaatgcttattaacaacacaattaataaatataaaggtaaaattgcaaattcaacaaaatagaaaaaaatgttaagatttatcaatgaaaaaaaaaattgatcaataatcaaattatataactaaccaagaacttaaacagacctgttcaacgttaatttttaaattttcttattaaaacttcattaaattacgaaacacaattaattgtggaaatccttaagccacattataaataaaaacaaaacaatacaccacataaatgaacggacacaaacacatacataacgttttaatatccaaaacatcacacaaatacaaacatagaactgacaacacttttaaattcatacaaaaatctagctaaacaccatccaaaataaattcacaataaa

SEQ ID NO: 74971 - DNA, 870 bp, Heterodera glycines
  Genomic contig location: Contig_ID=SeqID_1633; Location=343..1212; Strand=+
  SCN-specific regions: Sequence locations=1-305,329-336,359-395,419-870
ggtgggttgagtcctggtgattggaatgttggtgggttgagtcccagtgattgaaatgctgttggtttgagtcccagtgattgaaatgctggtgggttgagtcccagtgattgaaatgttggtgggttgagtcccagtgattgaaatgctgttgggttgagtcccgttgaagttggtgggttgagtcccagtgtttagaatgccggagatttgagtccattgtttggaatgccggagatttgagtcccagtgattgaaatgcaggagaattgagtgccagtgattggaatgttggtggattgagtgccagtgattggaatgctggtgggttgagtcccagtgattggaatgctggtgggttgagtcccagtgattgaaatgcaggagaattgagtgccagtgattggaatgctggtgggttgagtcccagtgattgaaatgcaggagaattgagtgccagtgattgaaatgcaggagcattgagtgccagtgattgaaatgcaggagaattgagtgccagtgattgaaatgttggtgggttgagtcccagtgattgaaatattggtgggttgagtcccagtgattgaaatgtaggagaattgagtcccagtgattagaatgctgttgggttgagtcccagtgattagaatgctgttgggttgagtcccagtgattgaaatgttggtgggttgagtcccagtgattgaaatgttggtgggttgagtcccagtgattgaaatgttggtgggttgagtcccagtgattgaaatgttggtgggttgagtcccagtgattgaaatgctgttgggttgagtcctggtgattggaatgttggtgggttgagtccccagtgattgaaatgcaggagaa

SEQ ID NO: 74972 - DNA, 989 bp, Heterodera glycines
  Genomic contig location: Contig_ID=SeqID_11535; Location=165..1153; Strand=+
  SCN-specific regions: Sequence locations=1-507,529-989
atacgtcgatttggatgtcattgcctttctgaaccgaatccaaaggttgctccaagatggtgagatgactttgcgcgttcggatcttccaccatcagcgacgcagcttgcaaattttctgcgcccaaatttggccactcatcaacaaaaacatcgtcaccgccgttgtctacccatcgatttggctcccaccgctccagcaggacaacgcgcaacaacaaaccacgctcaacgacctgcccaatctgaaattgctggagtactgtgacgtatcgcccagccaggaggtgatcgattggctgcacaattcgagcgcggacggacggccgaaggcggtgcgctgcgggttacctcgtcaaatggtcgacgaactccgagcggtacagttttgttgaacatagccaattctgttgattttctatgcttgttgttcatttttggcaatgctgcactccttttgcaatttttttttgtcacagacccccccccccccctctaatttgattacaaatgttttttaatgtttatgttgatcggaatacagtgggcccttttttggaaaaaaatatacccaatatagacgctaactcaaattccaagtttaaaattcaaatagattttcttgaaatttaaatggaacagtcaagaaatatgacttcaaacatgtaaaaaaatcactaggtccttttttagcgatttgttgctgcatcatcgccgacaattttcattgttttggtccattgtttgcaccccattgaacgcttccaaatcgacaacgatgtgaccaatgagcgaatggaattgcaactgttggagaatgcccgccccaacaccactgaactccatcatcggcgattgttggtgcgatgtccgatcggccgaaacgaggaacagtgggcgcaattcgaggaaaatgctcaaaattggaagttggccgagcagccgttcctgttcattgagctcgacgacaggcatcttggcgaagagtag

SEQ ID NO: 74973 - DNA, 2337 bp, Heterodera glycines
  Genomic contig location: Contig_ID=SeqID_11535; Location=1217..3553; Strand=+
  SCN-specific regions: Sequence locations=1-168,214-235,260-632,655 -753,775-831,874-1234,1256-2112,2134-2337
atgagggaggcgaaggcacgagtaaccaatgagagcgatgtaagagaatggcggggggacgacgacttttttttttaccttttgatcaaatctctttttttcattctcgagaattcatttctatttcaaacatagcataaaaatatcttattttttgaagtaataacgttaaatacatgaaaaatatttaaatgtatgtataatgccattattttcttgtaaaacaaaaaacaagttctaagtccagcccccaaaacccgcatattaatcctgcttgatcccttacagtaaaaattttgagttccaatccgcagtggctgggactcgcgaatttgaaatttcaggactcatatatatatactagagtccggcggaggcgggagtcccgcgggggtttacgggagtcccgctcccgactcccgtacttttttgcccaactggatttttacgggagcgggagttttacgggattcccgctcccataaattttgacccaaacacgggagtaaaaatacactggtaagaattgagttttttggtaaaactattaatttttgatgaaaatctgttaatatatagccaaaatttcaagaaattttcccgccggacccttaaaagccttaattttcttaaaaaagctagctcaaatttgcaaaaattggtcatttttggacaaaatctgaacaatggtattgtcttcaaatattcaattttttttttcccggcggcgcctatcggcaccgccagccaccctcctcctccctggtccccaaaaagttttttttcaaaagataagctgcaaaaagttgtttaaattaataaaggaagtcgaaaatataaaattaataaaaaataatttgttattattttttacctgtctctaatatgtacatactaaataaagtacacttttgaccattgaaagtagtgctttatattgccattcttcaaattaaacttttgctaaaattccatggacgaatcggcgaaaaagacgctaaaacaatattccacttcttaagacaaatgcaggaccaaggtaaataaacaaaaagtttacgtatattaaagtccaaaaatgagttaggaaagtgaccgacaaatttcgtctcgagactgccaaaaaaaatttttctggttttggataggaaactcacgataatttattttattaacccaaatatctctgcaaatttttttgatattgctagagacggacccctttggcttgaacggttgaaggaggagtacaacagtttgatcgcgttcattgagcacaacaagcagggcgatgccgactggtttcgacttgagtcgagcgcggatggcactcgatggtcagtgaatttggcatgtaaattggtgatgattgttaactttgtcttcccccccctttcttacaaaaatgtttcattttttcatgaaatccttgggtttccgggatcgctgagctcgaaaacgacattgattttgtcggacggatttttcgaatttaattttggtgtgaaagcggtttatataatgctgaaagcatttttcgaccttcgtccgtttgtccgttggcactctttcccttgactaaacatttgtgtctatgcccaaaaatggtgtcaaatttagggccgcttttcaaatccgggaacaaatttttagctacctatgcgcctgtttatccttttttaaagattgaaaaaacacaaattttgaatccaattttaaacatagaaagcaaatgtcgggtggtaaatgtccatgagcggcatttttttggcattaaaatttaatttccgtatgttaattctacctattgctgagagatttttgtacggatttggagtgccccaataccatttaattttgcgggcgcgaatttgagggactttggacaaactatcgccaaatagtcacattttcggttccatgtatttttggcccacccaaaaaatctatataagattagaagtctaaaattcaagcgaatgtttataaagttagatgtaacagtcctaaaaaatgtggattagaaaagcacttttttagcgatttgttgctgcatcatcgccgacaattttcatcattgtgttccaatgtttgcaccccattgaacgcttccaaatctacaacgatgtgaccaatgagcgaatggaattgcaacagttgccggatgccgacccccgcaccactgaactccatcatcggcgattgttgatgcgatgtccggtcgaccgaaacgaggaacagtgggcgcaattcgaggaaaatgctcaaaattggaagttggccgagcacccgtgcctgttcattgagctcaacgacaggcatcttggcgatgagtag

SEQ ID NO: 74974 - DNA, 179 bp, Heterodera glycines
  Genomic contig location: Contig_ID=SeqID_11536; Location=410..588; Strand=-
  SCN-specific regions: Sequence locations=1-72,94-179
atggaagaccaaatgggcacggaacttgcggtacgtactacattcatgagtgcaacccctacggcttaaatcaagaatgaaaaataatgaaattaatgcattatccgcattacttgcaggaatgcttctcttctgatgttgattggttgcatttaaaagtagttttatgattgaataaa

SEQ ID NO: 74975 - DNA, 829 bp, Heterodera glycines
  Genomic contig location: Contig_ID=SeqID_11537; Location=216..1044; Strand=+
  SCN-specific regions: Sequence locations=1-116,154-541,563-604,627 -696,718-829
  Gene Ontology: Mol. function=protein serine/threonine kinase activity; Cellular component=centrosome; Biological process =chromosome condensation
aaagaaatgaacaaattttcatggacattgaacgatttcgaaattgggaagccacttggaaagggcaaattcggcactgtttatttggcgcgggagcgagaaacgaaatatttaacggcactgaaagtgctgttcaagaaggacatggacaagcacggagtgtcgcatcagatgaagcgcgagatcgaaatccaataccatttgaggttggtggctgagttttgctggctctttccgtcttcgattccctttgctctcccccagttaataattgcttttatcctctcttagacaccctaacattcttcgtctttacggctatttctacgatgaagaccgcgtttacctttcgctcgaattcgcctcgcgtggctccgtctttcaacttcttcgcaagagcaaatgcttttcggtgccttactccgcccgtttgatttatcagcttgcggacgcattaatttactgccattcgaggtaaaatttagtgaaatttggtttaaatgaaaaagtttaggaatgttattcatcgggacattaaggtttgtgtgccgggcaaatggggttaaactcacaaacaaattcaatttaagtttatcagatcaggtttttgacaataggcttttttagtaataatagttttaagagttcaaaaatttccatcgacaccgtcggtcaataatttcatttgttttccaactcttaaaatgatcaccaaaattcttaagccggaaaatctgctgattaatactaacggagacctgaaaatcgcagactttggctggtcagtgcacgcgccttcctcaaagtgtgtatttgtgatttttgctct

SEQ ID NO: 74976 - DNA, 2205 bp, Heterodera glycines
  Genomic contig location: Contig_ID=SeqID_11538; Location=707..2911; Strand=+
  SCN-specific regions: Sequence locations=1-72,95-696,719-808,830 -855,877-883,905-996,1362-1511,1534-1834,1857-2165,2188-2205
  Gene Ontology: Mol. function=protein binding; Cellular component =axoneme; Biological process=N-linked glycosylation
atgccatgccaaccgaaacttcctttcccctctttagctgcttgtcctcgaccagtccactcgcatgccattggaggagctgcagaagcacccgtggattgtggagaatatgcacaagagtcagtccaatgcgccatcggccgattccgcgaatccttcggaccacaaatcgtccacttcgtcataaaattaatgttcatttgtttggtgtgttggatttgttggtgcatttatctatttatgttgtcctcattttttatttttgctttttaaatatatcattaaaatttaaccgtcccaagagggcaaaatatgcattttgtaaataaaagttgagtttttataatgaaataagggctataaagcagggttcggaccggacaaaccctttccagggacgggtataccggtttccaaggacaaggggaaaattccataaaaatcaaggacatataaaaatttaatcgtatgtaaggaaaaatgattaaattttatatatttgcgccggaatgaatttttataaatattttttgattctggtcatttcctcacttcaccgcatattcatttttttagcggtgcgctttttccaaaaaatatctaggaacaggtgggtcaggctcaaggacgaaccgaaccctgatataaaatgatacttggacgaacagccaagtacagcatttttctcttccgccgagctcttctcttccttctcccttcccaacggcgctgctggtcacatcggaatgtcttagctgctcctgctgacactgttcttttcaatcacgatgccgttcgaatgtgtccccttgccccctcctccccttttctaaggcatttgaatttaattgaaggttggaattttcttagagaatgtaaacgatcctgtctcagtatttcaggtgatccccaaaatgttcaattaacagagttaaaattgacaaaaaaaaatttctgaacaaattaatagaagaaattttgattcatggtttacggaaaataaaaaaaacgataaaaatgaaataaaccaaacaaaacttaaaactaataaaataggaaaaaggaacagaaagagaaagaaccaggaagagaaccagaaaagaaaaaaaggtggaagagaaagaggaacataaagtggaagaggaagtgaaggagaaagaggacaggaaagatgaccagaaagtggaagagaaagataaagaggacaggaaagtgaaagaggaaaagaaacaggaagaggaacagaaagaggaagagaaagtggaagaggaagtggaagagaaagaggaacagaaacaggaagaaagaaagagcaggagaaaatggaagcgagagaggaagaggaatggaaagaggaagagcaaaagtaagagattttaagtggtcttattaaaagttagagtttaaaataaataattgaattcccgtccattaaaaaacccatttgccctcttataaagttttttggcgcggagcgccctatagagactgttaaatagcgaagctatttcaatttaaaaaaataaattaattcgtctttttcagtgcccgtagggcactggttttactatatttttgaaaaatggggaccaaatggcaatagatgtaattttttggcgaaaaacggcgcaatatttagtaaaatacaccccataattcgggatttcaaaaaacgaaatacactcccctaaaaaccgaatttttgaattcagcccccccccccccccgaagccaagggtctggctacgccctttgtcaacagtgagcttcactgccgaaaccttcagaaatttttgatttgcaattacaaaaacaaccgataaaatttatgaggaataaattttttaaattaatttgcacccctaattttcaagttttttgtgcatatttggtgcatattttgcgatttttgtgcatatttggtgcatatttcacgaatttatttgcatatttatgcgcatattttggtcacttttcgtgcatattttttgcagccctgattatgacaaatcacagtaatggttttcaattgttttcagggagatacctattgttaccagtatgtcatggtaacttacgatttggaatgcgacctgacgtgctctaaaattgtcgtcgacgcccaaaatagaaactcccaaaaatatttcttcaaaaactggcgctcctatatatttttaaaatttaacacttactattctacaa

SEQ ID NO: 74977 - DNA, 3105 bp, Heterodera glycines
  Genomic contig location: Contig_ID=SeqID_11540; Location=381..3485; Strand=+
  SCN-specific regions: Sequence locations=1-499,521-630,661-773,795 -1344,1366-2046,2068-2506,2528-2573,2630-2763,2806-3105
atgcgcaaatacgtgttgatgtgtgccgactgggtgaacgcgttgttcatgctggccggcctcgacagcccgcaggaaaaggtgtgggcaaaaggccaaacattcaaatttaaaaatggggccacataaaaaagtgccaacaatgaaatcactatgcctttattgatcggctaatatattttatatcgggattgacattaacccgaaatggattaatcatggtcagaaactcaagattaaaaactcagttttttctttgtttccgctaaattttggcatttaatccgatttaagcgccattcacttcttttaagacaatttgtaaattgtctttgatgagctgaaaagatttgatcaaaaactgttcattttggtgacaaatgatcaaaatgtattcgcgtaataaaacaatcacttaactgagtttttgcagaatttattaatgtaaaatgactaattaactcagcaaatttactcattaattaattagacgtttttaaacatttaatcaaagcgtgatttatttttcttttgatctggtgataaaaaacaagtgaatcctcaaggtcgtgcatcatcattaactttgtcagatcactttccagcctacagtatcacatcgttatactgtattttaaatttaaattttaaataatttttcatttttcagttgacactgatcaagaacgcgttcgtcgccttctacacgtttgagcaggccacgtgcacagccaaagtgtgccgaaacgcggcggcaacatcaaacgctgcgagcgcggccggcggcggtgcgttgctcggtggcattccgccccaggcaatttgcttgtgcaacggcactctggtggcacgggacgtgccgcaagactgcaccaccaactgcttgctggccaacaacattgtgggcaaagtgctggacgagctggtgacgcctttgcgccggctcaacctgtccgagcaggaacgggtggcactgaccgcgctgatcctgctggacggaggtgaatgattgatggggctaatgtgttcaggggattcggaaatggcaccctgatcaacattgtgatcagggaattcgggaaacaaatcagccctcattaggggccagattaactattgacagcacaaataatcaataggtgcatttttgaaatctccgcttacattctacccatttcaaacaaaaagggacttttctagctaattactaattcatgatcaatcaggtccagtgttgtctggtcgccattttcttgacccagtgaatttgtggcatttttatgtcgtcctaattgcccgctttcccctgcctgatcagacagtcgcagttcgctgggcggtctcagcagcgactccagcgacgacggcacttccgctggcggcgattatggcgccggcgccggcctgtacctggtcaaggacaagctgcaaaacgcactgttccaacatgtgcgcgagcggtgcgaccagtcgttgaaccgggcggcgtcccgtttcgccaacattttgttgctgctcacctcggtggccaaggtggcatccgtgtactacgagaatgtgcagatggtcaaaatgtttgtgcgccaatccatggacccgttgttggccgaaatcttcgactcggaggtgtgaagccccgtccggtggtggtgatggtgggatatggaaaaagccgtgagcatttgttcaacatcaaaggatagactgactaattgggtgaaaatgccgaattttgggcgggataaattccgaaattgtcaaacccgagactattttgaccaatatccgcccattcttatgtcaatactatttcggaacagaaataattctgttcgtttgattaccatccccggattgttgatctgatttcttatattatttagtttccagaactttgatcgattttttctgatcaattttgaagtcggcacaaaaaaagcgaaaatttgcaatagcaaatctctatgatcaacatgatagaatgttttaaagtgatctgatcacttacgatttggaatcttcccttgtgggtattccgtttcgtaatttagataaattatccattttgggctaatcggtatcccgtttaatcggcttttcgttctttgggattatcagatttaatttgggtcccttgttcttttccgattgagctgactgatcaaatgattttaacaggtgtcacagccccagggcctgttgacaaacagttgcacaaactcagccggctctcccgccccgatctcggccacctccgctgccagcctacagcaattcggatctcaggtaatcaagagtgaaaactgtcttaatcctcgagaatccaaggcaagaaaatttggtcgagagtctcgaatttaaagattttttccttagggattttgcccttgtcggcacaaattatttattgctctttcctaagattgagatcataataaacatggtatctggtgtggtcaaagacgggatcattctcagcatcgagagtcttgggcaattaaaattaattagtgccggaaaattggaacgccttttaaggagtttgagccgctgttgctcggctttgacgaagtgcgacggcgtcagcagcaacaccatcaactccatcagcagcagcaacaacaacagcttgacgacatcggcgtagagcagcgcccgcggcgaatgtctgccacggaaatggaccaactgttgttggcaccgcttttcgtcaacggcggcggcggcaacttccaccaccttcaccatcagcagcatcatgagcaacaacaacaccaacaacaacaacagaaaagcaacaacaacggcacgggcagcaacgagttactgctttcgtcatcatcgccggagggcaccggtggtgccgcaacagtgacgacaactgcggcaacacaaccatcgtccgcggcggctgtcacaacgggaggcggtggcgattctgctgccggggcggcaaacatgtactttggatgccattccacaacaaatgttgacaggagtggtggtgccaacggcactgacgacggtcagtctcatagtcgagaatgggtgtcaagaatttcgcaagatccgggccagcattctctgccagggttcaattcgtga

SEQ ID NO: 74978 - DNA, 360 bp, Heterodera glycines
  Genomic contig location: Contig_ID=SeqID_11541; Location=68..427; Strand=-
  SCN-specific regions: Sequence locations=1-135,158-161,183-360
atggccgacattgtgcaaatattagagaaaacgatttcaccaagttggttgtgcacatttatttattggtttgattcttttgaggttatgccgaccagcaattggcacttaccgccttaaatgaagccgcacgaattaattttgtaagttttcttttggtgaaaatttattttaaaataattctgaccggtctcaaaaaaaatttttgtttttttctagcctgaattcattcaacaactcgccgtcgttttgtcgaatacgtcaaatagtccaattgttcgaaaagctgctggacttcagatcaaaaatgcactcgtttcgcgtgagcaagcagtgtctgatcagaagagaactcggtaa

SEQ ID NO: 74979 - DNA, 99 bp, Heterodera glycines
  Genomic contig location: Contig_ID=SeqID_11542; Location=4285..4383; Strand=+
  SCN-specific regions: Sequence locations=1-78
gtttgtatattatacattgaaattgcgatggacactttgtttgacgtgcgaaacaacttttatttgggcgcttttcaacagtgcatcaacgaggcacag

SEQ ID NO: 74980 - DNA, 1394 bp, Heterodera glycines
  Genomic contig location: Contig_ID=SeqID_11543; Location=544..1937; Strand=+
  SCN-specific regions: Sequence locations=1-231,253-654,680-1394
gttcggcagagactacgaaacggacccaaaccatttttattttggcgattttgaacgacacaatgccgagatcgcaaccttccacttggacaagtcactcactcattgtgccctttccatttgccattgcttcttcagaatcctcggctatcgccgtgccgtgccaacggtcggccgagtgatgaatatgaccagtgagctgttggaaaaggcggagaggcgtcttcgcaagactttcttcgtttccccaggcatttcgtctccctttggctttaccccccccccatttttttttttgcttatagcaaagaatcgctgtttcgtcagcaaatgcgactattattgtgacacgacacatgcaatttgcgggtcgcccgagttgaaggagggatcagtccaagtctttctgcccgacgacacgagtgtgccacggaaacacaacaaatcaccgtacagacggtacagtatgccaaccaaagtgaccgtaaccgttagattgttcaggacatattcaaagaagacacaactcgctgcctggcagcaggacatgaactattgtcagtcgaaggtgaaggggatgaagcagtacgcgcacggaaggcgactgcttgacctgatcgacttgcatttgatggattatctgatcggaaaccaggaccgccatcactacgagacgttcagcgttttcggcactgacattccatcatacgcaattcatttggacaacggacgatcgtaaaaatgggggggcgcgatgccatggactgtttcttcacagatttggccgtactgactttgacgatgacgacatccttatgcccttccgacagtgctgtctgatcagaccgaaaacattgggcacttttttcggcttttacagcggtgtcaaagggctctcagaaacactgcacgagtgagtcacctttagggcgtccgtccgtcggtcattcgtccgttcactacgtttgttcgttcagttccctctccaaagaccccgttttccccgtgatcgccttcaaacattacgccgccttggaacggcgcctctacaaaatcatggagtaccttctcgaatgtatggacaaacagaatggagacctaacccaaatggttgtcaacgaatttcacaatccgacggtggcggagcctttgccgggcgaagagtcggagacggaggaggacgaaacgaacgacgccccggcagggccaccagcggaccaacagcagaagcaacgggaagtgggagcagcaccagcggaagcgcagcaccagccggcggatgaaaatgaaaatgcgaaaaatgtgttgaaagcgccagcagtggaaccaattttaaaggaggagcaacggcaaagtgccgaagggcatgggaaattcccgaagccaccggcgat

SEQ ID NO: 74981 - DNA, 878 bp, Heterodera glycines
  Genomic contig location: Contig_ID=SeqID_11544; Location=986..1863; Strand=-
  SCN-specific regions: Sequence locations=1-398,425-878
atgattgatattgattgtttttttgaacaggagacaaactcgttggacccgggctgcttggtccgactggacgagtacggcttctacttggtgtgggagccgaagggcaaagatgccggcattttggacatgaaccaagtgaggtttttgactgttgatcactcttaaacaccatggtgtcgagagtcttgattcgagaaaatgtctaggaattttggggtttcgctctcgaatctgcaattttcgaccctcttgaatttcaatgtttgtcatgacatagtttcaagaggggcctttttttagtaaatctttatataaaaatttcagaaaaattttcagcgattttttggtaattttttaaaaacttaattttgccataaaattttgaaaagatagttagaattttttaaatttttccttgaaatttactgaaacatattatttccctaacaaataagcgtattcctgtcaagctccaaaaatcttaaatgctagggccgggtgtgtcagttttataaggaacatgaaaatcttcagcgcttcttgcataggtttcagggcaatttttgaaaattttttttacaatcccgatcactgatcagttttgattgatcacttttctcgcttcaaaggtgtgggaggcacggccttccggcactgtcaaagacgggcgcgtgctgtacgagttggagcagcgcggcaggtgcggcctggcgggcgagacacttgaggagcggacagtttggctgacctatggtcttgacctggtcagttttcgagagtctcgatttgagactcgggattctctggttttaatgtgtgcctctgtatttactgttaatgggttttttttttaaatcggcggttcttccaataaa

SEQ ID NO: 74982 - DNA, 657 bp, Heterodera glycines
  misc_feature (613)..(613): n is a, c, g, or t
  misc_feature (649)..(649): n is a, c, g, or t
  misc_feature (653)..(653): n is a, c, g, or t
  Genomic contig location: Contig_ID=SeqID_11544; Location=2215..2871; Strand=+
  SCN-specific regions: Sequence locations=1-56,79-171,193-398,423 -423,445-535,568-584,612-657
atgtattttcctggtcacttgtcaattaatatcagcgccctgatcaatcaatatttcactgatcagcccttttcttcttacatcgtcataacggtcaaacacatcgccacgcagcagtgtctccggtatgttcactttgttgcgcaaagtccataactctttgttgttcatttgtctgctaatttgttcagcagctgctgattgcggcaccaatttttgatttatgttaattcaaaattttataggcaattgtatgtacagcaggaaattgttggccaaaaaatggtttgggaagaagccaattcgcacgctaattatacgccaccaattaggcacggccgatcagttaattagtctgtgcgcgaaggatcagtcgtcaagactctcgagaggagagtggtgttgttgtcgttgtcgtcgtcctctcgatgattgatttagtgccgccaattttatttgattgtctgctgacaagaaaaggggggaatgaatgatggatgggatatcagaaaaacttcaaaaattaaaaaacgggtttttattttttaaaaattgtaaaatttttatcgatgattccgatcttttaacattgtaattttattttagtgattgngtacacacacattttaagtgctgtgattgagtcggngcgngcca

SEQ ID NO: 74983 - DNA, 268 bp, Heterodera glycines
  Genomic contig location: Contig_ID=SeqID_11547; Location=259..526; Strand=+
  SCN-specific regions: Sequence locations=1-8,45-127,187-225,247-268
atggccaagcaaaagccggttctttttctgcagatggagtgtgtgctttgtctgttaggggttggttggttcatttgtcgctgcttctttgcttaatacccaatttttcgggctcccatttgggcggattaatttttaaaagaaaatatataaattaaaaaaagaaattatctttagtatttttaaggatgaaaaactaaaaagaagacaataagtgaacactgataaaataaaaatttaattgtcagaaattaattaaatatgtaaa

SEQ ID NO: 74984 - DNA, 503 bp, Heterodera glycines
  Genomic contig location: Contig_ID=SeqID_11548; Location=44..546; Strand=+
  SCN-specific regions: Sequence locations=1-503
cgcatcacacgaacatttttgacatggggccgttacttcggaaatctcgccgaatcaacgactcatttctttcggctccgccagtttcattcgcctttcgagctctaccaggaacagcgaggatactttggttggagggctcgcacgcttcgccacttttaacggccattaattacccccttaattagatgaagtcccacccccaactcaatgggcactctctcacgcctcgtcattccgcaccgggcccacccgtggcccatttctccgtcttccgtaccctccgtccccgcatttccaccggccaatggatcgtcccgctgcgttggcatttcttccgacgattggttccctttacgggtcaatttcgggtacaaaaaatcgcagccaaaaaccaaaatgtcctcgtcaatttcaaggagtactcatcgttttgatgatacttttggttgcgctttttggttctgctctttggtcatgccgaaattacaaaaagaaatgtg

SEQ ID NO: 74985 - DNA, 3622 bp, Heterodera glycines
  Genomic contig location: Contig_ID=SeqID_11550; Location=11..3632; Strand=-
  SCN-specific regions: Sequence locations=1-602,624-656,679-840,865 -1339,1362-1830,1852-2236,2284-2802,2833-2987,3094-3219,3241-3622
  Gene Ontology: Mol. function=ATPase activity; Cellular component =nucleus; Biological process=cell growth and/or maintenance
atgtctgacgtaccagagaatgccaatgagaattgtccaggcactgccagtgccaatgctggtaaaacgtccgcctgtgccggctgtcccaaccaaagtgcctgctcaaccggggaaagggcggtggacccggacattgcgctaatcacagaacgattggcgggcgtcaaacacaaagtgaattgatcattgtggatttggcaaatccgtcgtttccaattttcagttgcttattctcagcggaaagggaggcgttgggaagagcacagtgacggcgagtttggcctacgcaattgccaatttgcaggaaggagcgaagccgttcaaagtttggcgtcgtttcacgcgttttttaattttcttttttcttttatgtggccgtgttggacgtcgacatttgcgggccttcccaagctcggatgttcggctgtgaggagaacagcgtacaaaacagtgatcagggtaacagcaattgatgtgataccattacaaactaattgcaaaattatattttgtcgaaaaaagaagtcaaaaaaattgttaccactgcagctttaaaaaaatataaaatttgtgaggtgttcgggttttcagttgtcaacaaaaaataaattgtttcaaataactttattaatgcgatttgccattgactcccttaattaaaaatttcaatttcttctaagttatttcttaatcgttgacttttcatttccaggatggacacccatttttgtgcagaacaatctgttcgtgatgagtattgcctttttattggacactcgcgacgaagcggtgggtgtcacatcgtttccccacccgatttctttaaaaaaaaatcataaaaaactggaaacttttcagaaaaaatttttcaacatttaccggggggaggcgaactaattccctgagcgatgacccaaaaaactggcattgaataaccattcattcatccctcacaaattgtcagataatttggcgggggccccgaaagaatgcgctcataaaacagtttttgcgggacgtcgactggggcgagttggactttctgatcattgacaccccgccgggtaacaaaaaaaaagggacaaattttccattcattgctttgccattgctgcaggcacttcggacgaacacatttccatcgtccaaatgctgctccaagcttcttgcctggacggcgctgtcattgtgaccactccgcaggaaatttcgctgttggatgtgcgcaaagaggtgccaaacaattactgcactaattcgcctgtctatttttaaataccaaaagaggggaaacggaacgcacttcaccccccccccccccctaaaatgaaaaaacggaaaatttttcttttcttttgacactgtaaatgccggcactacagaatccaagtctgggttgatcagaagcgaataaacttttgattaataccacatttgtcttgatccgtccacaaattaaaaaaatccctatactttacatagccaagttttctgaatacggtcttggttctgcttacatttagtcaatcccttccctgttcaggtcaatttctgcgtgaagaccaaagtgcccgttttgggtgtcgttgagaatatgtgccaatttgtgtgtccgtgctgttccaccgcctcccaactgttccccaacaccaccggcggggccaagaaaatgtgtgccgatttgagccttgaactgttggctcaattgccgctggacccacggctggctaaaagtcttgacgagggtcaatcttatttcgaacactttgccgactcgccggttgccaaacagttcagcgatttggcccaattggtggtgaacaaatgcaaaacgaacagagagagaacggaaattaatggcgaaacgaattgaaatgaacacagaacaattccaattgtgacatttgtttgaagaatttaaacacataaatacggtggatttaacggaagatttttggcggatttgaattttaagttggttaatgctttacaatgtgaatgggtggccaatgatattttgtcaattgtaggcgcatttaaacggtgagaaacttttagttttgttatggatgattatctcacaattttcgacaatcggtcgaacggcgtgaccaaatttgaaaggtgggttttggttttgtctcttttttccattatgggccgttttatctgtttctttcctattcatgtctcctccattatcattgctttagtccttttcctttgtccatggttctaaatctgtgattcctttttgtcctctctctctgtccctcattagtccttaattgccgtttcacttttcgtttggtcatccatttcccctcttttcagtgtccaatctcgcttcgaccgtttgcacattccccgtaaggatgtccaatggattctctgcgaatcttgcggcagtttggtgaacagagtgctctatgataatcacgtgggcatcgactattttctctttccgtcccatttcagcctcctttttctgtttagatcgtccaacatgagttcatcaacctcgcttactcaatgtgtcatttcgaattggcggaggagaaaaaaatgctgaagatcagccaacggattcaggcaaaaatggggccgtgggggggaggcattttggcatgggacgacgaaaacacccgcagtttttggagatcgatttacttttaaaaaaatttgagacggacaagtgacagaatgatccctttttttagagaaaggaaaagcggcgtcagcgaaagaatcattcgttggttggcttagacgcggaggaggacaccgacgcgtccgacttctcctcttcctccgcttcgtcctcctccgatggatcgtcggaggattcttccgactcggcgagtggggacgacaacgacgacgccgaacagttcactgctgactcattgccgggctgttccagttcagtggctgttcagcagccgcaaaagcggaagaaaactgccacggaaagtgacggcagtgaaaagcgaggcgaagacgggcgagggaaaggggcagaagaagagagcagcggggaaaaagaggacgacgaacggaaaaggtgagggagaggaagaaagagagggaaggtagggacaattgcaaaaggcttgcggactcgacagaattcccgtctcgcaattttagtctcgaaaattgcacatttgtcctaaatagatgcgttagtcgacttttaagtgatatttaattgacttttgcctccctcttttttcagcaacggctccttccgtgcttgacggagttgtgaagcgagagaatggggagccgaaacgacgaggatggagcacaacggacgcggcatgggacgaggacgaagcgttggacattggcaaaacggcggaggagtgcgacggcactgtgccgtctgttgccggggggacggcacgcggaaaacggacggcacagcagcaaaagacggaaatggccgaacaaacggcggaggagcagcacaaaagggaggcggaagaggagcagaagcgggctgaggccaaggagcgcaatcagcggaacagagcggcgaatcggaagagacggctcagggcggtggtggaggagcaaatgatgcggcgccatctcggccccaaccatcacagag

SEQ ID NO: 74986 - DNA, 2247 bp, Heterodera glycines
  Genomic contig location: Contig_ID=SeqID_11550; Location=3496..5742; Strand=+
  SCN-specific regions: Sequence locations=1-135,178-179,201-619,641 -935,959-1021,1043-1075,1124-2077,2099-2247
atgtccgggtccaccgccctttccccggttgagcaggcactttggttgggacagccggcacaggcggacgttttaccagcattggcactggcagtgcctggacaattctcattggcattctctggtacgtcagacattttaaaacaaaaatttgtaaaattaaaaacatataaaaatggcataatttaaaaaatggcaatggaattgaataaacaatccaaagaaattttgctgttttttcaatttttattcatttgttgttgctgtctttgcaatttgttctgttggattctggccaattcgctttcggcacttcgattctcagtgaatttgaacgtttcgatgaattcggccgcctcctccacggaatagcaaaggaccaaagaaacgtccattcggtagcagaacatgttcaggtcacgaagcaaaaaggaagggtcttcgacattgacgtaagccaacagaacctgaaaatgaaaatcgatgagaaatcatggggaaaaattgtcaatttaattaaatttgaaattgtgcagtcgtaaatcctcccacctttacggggtacgccctcagatcggtgaaacgagtctcaatgtacccgcagtggagtttgtggtatttcagggccaggtaaagaagcccacaattaccagaacattcaaaatcgcatcttaacggcggaaagttgctcaaaatgggacaaaaagtatgttccaattcactttacgtcggatgaccattcgtacggcacattccgaatgtatttgagcaccgggttgccctcttgtcggcgccggtttatttttaatgtggacaaaccgaacggatttccccttgggagtgccggggccaatagcgccgatgtttggggctggtcattttcagaggaagttgttgccattgaacgtaaaaaattaattaaactgagtgggaaatttgtctcgtctctctcctcgctaatttgaagaagggattcattttgggcgctctttcattggttttttgaattctccctactttttggcattttgctcattcttttattttccccgacttttctcggttgttttcgatttgtctcttctcttctttgcttttgctgtttgttattatttgtttggtgccttttccctctctcttataaattcgcttccccttctacccattccaaaactcatcaaaacaaaacagcgatttgtgctgttgtgccttttcttacacattttcttttcgtttaaaatttttttgttttttcagctttttcccatttttctcaaaatgttccgtttgcaatcttttcaaactgttggcaaacagtttcgacaggcaatgtcaatgcaacaaattgcgaaacggtaaaagcattgaccgccccttcctaccagtaatagtttctgggaatggactttttatttaccccctttgggtgtgtaccactcccgccgcctgggaccgtctccccccccccccctgtacattcttcgctcttttagctcaatttccgcttccgccgtgcgtcagtccgctttgcgtgaccctttcttccgcgaccccatcgacctttggctgtacgaccccttgcgtccaatgcgtcggatgctccgccgtgcgtccgatcccttcgcgatgctcgaccatttcttcaacgaccggtgggtccctcaggtgaataggaaaagagggagctgtgagaaaactgttgtaattcttgaaacaatttaattgaaggtccgcgacaacgcggccaaattgggcatcgatgagaagggcaatttcacgtactctgtggacacttccggatatcgcccggaagagctgaacgtcagcatcgaaggggacgaagttgtgatccaaggggagcacaaggagacggtggagggtgagttcaaacgaaaaacaattaacccctatttaagtttcactgcatttccttccgtcttaattagccactaattgttttcagatgagactgtccaccgccaattcgtccgtcgcgtccgtatccccgacggtttccaaaaggaggggctgaagtgcgcgatggacgacgcgtgccgcatgtgcgtcacggcgccgaaggcgggcgcggagccggcggccgaacgccgaagcattccgatcgaagtgaaggcgaaggcaatcgacgaaaagaaatgaaaaacgacggacaaatcgagaggaattgtttttttttccattttcacacctgggggagaaaagactcatcctttaagcttatgaaatgca

SEQ ID NO: 74987 - DNA, 904 bp, Heterodera glycines
  Genomic contig location: Contig_ID=SeqID_11551; Location=33..936; Strand=-
  SCN-specific regions: Sequence locations=1-3,29-89,111-297,332 -540,563-649,672-742,774-877,900-904
atgaaatttaaattattattattattatccctattaatgatcctactatatacaattaagcagaccgtgcaagtgaaattaaaacaaggaaaaagctttgatgaaatatttggacaaagatgtgacgatggagcagaagaaattgtctgccgaattgatcacaaaattcacggagaaattgatgatcagaataatcaaattcaacaaaatagtcgacaatttgatcaattttttgatgaaattttggaagtaaaaaaagaagatagtgaagaaatgtccaataattgtgatgaattggaacaattaaatgaaaacaatggacaaagttatgatcataataaacgaattgttgaaaaatttcataaaataaaagacaaaatcaagcaaatgggaaacaaatattcagcaaaagaatggaagaaaattgaaagaaaatttgcaaaaaaattgggatcaactcaaaagaaaatttatgaatggaaaaaagaatttggattgaatattagaaacagatattcggatgaggaaaaacttgaaatattaagacattttgatcaaatatatggccaaataaaatcgaaattaaaaggaaaattggatggaaaaagagaaaaatgtcaaaaaatattagcaaaacatttgggcacaaatatcaaaactatttataaatggaagaaacaattaaaagatgggaattcgatgaaaaagcaaaaaattaatgatgaaaaaacggaaactgttgaaaaatattttaaaataaaaaatgaatttatgcaaaatggaaaacattcacgaaaagaatgggaagaatttagagcagaaattaaacaaatgtttggtgtaaattatacgacaattgaaagatgggccaataaattagaaattgaacaaaatgtttcaaaaa

SEQ ID NO: 74988 - DNA, 137 bp, Heterodera glycines
  Genomic contig location: Contig_ID=SeqID_11551; Location=1429..1565; Strand=-
  SCN-specific regions: Sequence locations=1-7,29-137
ttttgaagatatttgtaagctattaataataaatacacagagctatcgaacaacaccaacaatgcttaatttgattgacaatgaacaaagttatggttcaaaaagtcttccgacgatgtttcggccgacgacgtttt

SEQ ID NO: 74989 - DNA, 429 bp, Heterodera glycines
  Genomic contig location: Contig_ID=SeqID_1634; Location=850..1278; Strand=+
  SCN-specific regions: Sequence locations=1-24,46-61,83-163,185 -207,229-429
atgctcttcaagaacaagcattcgctggcccttgaatgcttctacatctgccggatgtacaaacagctgcaggaacagcagaagaagaacaagtgcggaagtgccatcgtgtggacgactgaagcagagacggatggcaacgatgctggtgccaacaaattcaacatatatatatctagaataaatcaggataatctattccttccataaaatgctgtgaattcttttcattttaggccattgtcgccaccagcgtataaagaagaagaagcggatcaaagcaatgaaaaggtgtgctcgacgattcacgggcccagtgatcagcggaatgaagaagaggataatgaagaagcggatcaaagcaatgagaaagtatgcagaacgattcacgggcccagcgatcatcagcggaatgcaaaaggattatga

SEQ ID NO: 74990 - DNA, 816 bp, Heterodera glycines
  Genomic contig location: Contig_ID=SeqID_1635; Location=704..1519; Strand=+
  SCN-specific regions: Sequence locations=1-95,124-318,366-385,407 -547,570-816
atgccttcttcagcacttcggtacgtttattatttcttttttctgtcgtttcgcattttcttttgctcatttttgttgccaaaattgcaagatgaaaatttaaaaaagttccaaaaccaattttgaaggttttagcttcattggcctcaaaaaatatgaaaaattcacttattgattccctcactttgatctttgaccctttcattgattcatttgcccaattcatttttcagtttgtttgccgtgactttactgttggccagctctggaagcattctttggtccttttttgatcatgtcaaaagccttcgaactcgcaaaaaaatgtaaaaattaaacaaaaaatttaaaaattttgaaaaattcttcaatttttcagctttatctctgccgattgttggcttctggtgttcgactttctttcgccttctcaacttggctttggaattgcattgatcagccgtcgatttgacctccgagtggacgaacatttcaaaacacgcaaatggaaattgaacaaacaattgctaatccaatgggacattgaagaaaatggcacaaagaaaatgcaaattgtcgaacccaatggaaatccattgccaattccgcaagaaccgttgccgagcaaagtgatcggattcaacggacgcattaatatcatgtaaaaaatgtttagatcagcgcataggcaaacccttggcttcgggggggggctgaatttttaaaaaatcgctttttagggtgtttttttttcaattttagaatcctgtctgaattagggggggggggggggtaagagattgtttgaaattttca

SEQ ID NO: 74991 - DNA, 1769 bp, Heterodera glycines
  Genomic contig location: Contig_ID=SeqID_1636; Location=153..1921; Strand=+
  SCN-specific regions: Sequence locations=1-297,319-964,987-1200,1222 -1394,1424-1665,1687-1769
atgttccgcgcttcaattcgtggtatcaatttgaacgccatcacttttcgtcgcatgtgccaattggccccatcaatgctcaccgattgtccagcacttcgttatgtcgattccgaggatgccatttttcccgaatttcttctgcccgatgatgacaatgcccatgcggcggatggccaagcggtggcaaaatggctgtttacgcctcttccggatggtgcgtccaagcggatgaaatgtcttgtgaatttatcggtggatcaatggacggcttctatggaacagctcagaacggtgagcatcggaacgggcaaactcagtctggccaactcagtctgagccaactttaagcgtcaatataactttttaagttgttgactgaaagaatatccaacaatcttgatatccattcgaaagctcttcacaggctcaattagtctactaaataattacagagaatgtcaaactgtaaaaaggatagaaatagatggagacaaaaaaaaacttcgaaaattctgctttttttttttgcggttttcaagcgacaatttttttttgttgtgagctgcttaatcacttcgaaatagctcagaaacatcatcttctaaacattaaaaagcttctcgattgatacccaatgtttgttaagtttggtgaacaaataaaaagaattaggtataactttttgaactttgctgattgtgtgagacgggtttggccagactgagtgccccttatattcttcctctatttaaatggtttttcaaatgatttttgtcccattttcaggcattttcaaatgcttcttcaccagtgactttccacattaacttgacgctttcgtccactttggttggctccgttgtgccattcttcatgatgaacgaagcgactggggaacaattggcactggaacaatatgacctggatgactttgagctcttccgttgcccaattgaatgggattgggaaaattggaaaaatgagtggaaagaatcgtgtgctgctcgaccgagacggattagcttttggatcagagacggcggatttgaagaggggtgaacaaccatttaattaaaatgatcaatgctttttttcctgttgttttatggggtgcactatctcaattccccctcattgtttccccccgagaaattaaaaaagaaatttcgttgctaacttagaaattgttcaagaaaaaatcttagaaagttttgattttgagccgaagttatgaataattttttgtcaaaaatttttcatttaatggttttttgactaatgtctcccagcacctttgaaacggacaggggatatgtggcacaaaaaatcaaggattgttaattggttggactcataaaatgccatttggacccataaaaattgaatgagcttaaaatacaatttaaatctttatttttcagtcttctcgaggccgcttctcctggaccgagtgatcagcagcagtagaaatgaatgaattaattgatggttaattgatgcgattatatgaccgaaatgatatgttggcactgtgccatttcaatattatattgtataatttgcttgtatgtacctatttgtcctttgcttgttttccgtaaaattcgttcatttccattttattttatgtgcatgtgtaaaatcattgtgatatgtaatcattgttaaaaaatgatttgtgataaaatggatttgatttctgaattttacaaaaccaggcgggatattcatacaaagcatcttttttctagcattatctcttccaa

SEQ ID NO: 74992 - DNA, 356 bp, Heterodera glycines
  Genomic contig location: Contig_ID=SeqID_1636; Location=2325..2680; Strand=+
  SCN-specific regions: Sequence locations=1-356
atgaacaaacggtaaggaattttttaaaattccaaatttttgatttaccctaattttttccatgtttcagttggatttgtggcgacgtttggatggacattctcccatcttttaatcgtccccaacttggtctcaaaatggcattgctttccgaccgtttcgatgttttggtggacgcacattttgatggaaaaagcgaattgacaatttggaggatgatcagaattggcaaggacgaaggaccaaaagcgaaactattagtggaaattaatggctattttgtgcaatttccgatgccgaatcgtccgttgcctaacaaaattcgttttcatttccttcttattcgagtaatttga

SEQ ID NO: 74993 - DNA, 1218 bp, Heterodera glycines
  Genomic contig location: Contig_ID=SeqID_1637; Location=573..1790; Strand=+
  SCN-specific regions: Sequence locations=1-1042,1067-1131,1154 -1173,1196-1218
ttggatttgtagcgacgtgtggatggacattcttccatcttttgaccatgctcaacttggcctcaaaatggcactgctttcttatcgtttcgatgcgctggtggacacgcatttcgatggcaaaacggaattgacaatttggaaatggatcacaattttcaaggacaaaggaccaaagccgagactttctgtatggattgctggcaaatttttggattttccgttgccggatcgtccgctgcccaacaatgttcgatttcagtgccttcagattgagtaatttttttcaaaattgttgtttatgttaaagcattttttattttttcagatacattgaccactctgtgctcacatttctccatgccaacaagcacatttgggacagaagtggcaccaaattgacattgtggccatacagaaccgaggatgaacagcggatttgggatgtttttatccgtgaaatttggccactttttgcgacaaacattcgccatttgagctttgctagtagcgttgatttggacaatttgcgtcttcgcacttcaccaacaattctcactgatcttgatcaattgcactcaatcgattctggtcatctgtgccccgatggaattgctgattttgatgtgctgaatccaactgctggccaagtgttgtccaaatggttgcacacgccgagcaaaaatggtcaaccgaagcgattgcgttacagtaattttccactgaatctcggatgggtcaacagcttcaaagaggtcgtctcgccagaattttcgtcaatttgtttttgttttaccaatttttgtgtgtaggcatttcgccgtgccatcacttcggtcagttaccatattcaactttatttgtttacgacaacaatgacaactgaaccatttgaattggtgaatggacggaccaatgagaagctgacactgaaaccgagcaaagaatacaatttggttatttggctgttgcaacggtgcccaattggggagacgtcgacggcgccagttaaatgggcagaccagcatgaaaattcgggtgccaatgccaatttgaacaatatcaattttagtctgtggattttcaataaaacaattgggtgagcagccaaaacagcatttgattttgtcgaaaataaaattaattaattttaggccattgtcgccaccagcggaagaagaaaacgaagaagaagcggatgaaagcaacgaaaattaa

SEQ ID NO: 74994 - DNA, 1722 bp, Heterodera glycines
  Genomic contig location: Contig_ID=SeqID_1638; Location=953..2674; Strand=+
  SCN-specific regions: Sequence locations=1-196,238-316,358-441,516 -782,815-1219,1388-1540,1643-1655,1677-1722
atggatcaaagttcaatgatcaatcaaaactcactttttgtatgtgaaaatgccatttttttgcatggcatttgtgtgccgtaggtgcaaaaaatgcttgtcatatgtacaatgtacaatatccgattttgctgattgaaaatgccaacttttgtttgtcataaataactgtgtgccataggaagtgaaaatgctctattttattcaatttttttttaaatttaatttttaaaatttcttcaatgcttccatcggcagcaattctcttaagcgcaccttatcaaaatgttaatttgacttattttttaataatgcctttttaatgttaaaaataaaatttacaatttttaaattattgaagcgcttaatccctttacgaaaaaatgaccaacggcgctgtggaatggccttcgcatgcgattgccgagccaattttgtttgtttaaaaattaaattaattttaatttttttatattttaagaaatgatttttattattttgtaatatgtttttaagtatttaccatgaatattttaaaaaaacttaggagcatcattgttcaaatcaattttcgcccattttttgcacaggcattggattggcatttcacgtccggccaacaaccaagcgcaagcgcgtgtgctgcacaacgcactgcacaacacggtaaaaatccaacatttaaatttgtttttttttctctaattttttcagctaaatatttcgttaataagattttcactgaaatttttgggagaaagtatcaaaaaatgataattgtcaattatttctttaattaattaattaatttttagagcactaatttgcccgcgctttcttcggttgccttcctcttggacgtgtacatgcccggccaatctgatctgctttttgcgcttttgtacgttggcgccaaattgtccctcttctgatcatttaaaaacgccaaatcgcatttcataaattgaaaatcccaaaattacggaccaaaaatatgataaatgaccaaatgtggacagaaaattgattattttgaaatcattaacatttttggcactaatgccataccaaatttgtcaaatttgcaattaattaatggggagacaaaatgctaaccccgaaaaaggttcccaagcattaattatgcttttagtctcattggcgtgacaactgcagtttgcttgctgctgttactaattgtaaggagcaacgaataaagaaataattttaaattaattaattctttaaatattttggaggttttcatttaaaataattaataatttatttatttttatttttcgggtgtttttatgtatttaaaataatttttttttattattttgtgtgtttttatttaaaaataatttaaaattaattttattttcattccaggtatttttcattttgtgcacatctcgtcggaatggcatcatcagttgtggcacttcttcttcaaatgaattcggtgtgcgtgcttcttcaattgccccgtccagcgcctcgggggtggacgcattctcaactgatgaggtaacgcaaatattttttttcaacttttatagttttttatttttatttttttcaaagtttaatatatttttcaatgtttcccgaaaattttatatttttttaatattttggttgtttaattttttcgacatattttttgttgcctaaaaatgggactgaattggtcggtttcaattttttctctagaaa

SEQ ID NO: 74995 - DNA, 547 bp, Heterodera glycines
  misc_feature (511)..(511): n is a, c, g, or t
  Genomic contig location: Contig_ID=SeqID_11554; Location=1..547; Strand=-
  SCN-specific regions: Sequence locations=1-20,89-107,155-172,379 -420,455-489,511-547
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttangacaccctgcgtacgctttgacagatgtaccgcccc

SEQ ID NO: 74996 - DNA, 616 bp, Heterodera glycines
  Genomic contig location: Contig_ID=SeqID_11554; Location=1670..2285; Strand=+
  SCN-specific regions: Sequence locations=1-616
gtgctttgcgttggttggttggcgtgggtgagtgtggtggttgggccgtttttgcgatattgtggctggaaaaaaaaatgcgatttcactgtggggagcgcggccgtctgggttcaagtgcttgcttgcgcttgtgctcggcattgaacggtgatggctgctgctggggtgccacctttgtcgtggcctcagtttctccagcgtttggcagctgtcgaaatgaataaaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgaggcataagcgcccgaaggcctttggcctgaggaagtgtcctaaccggaaaatccggagtgctcgtgtgagtgcctgtgcactgccctcggagctgtgtccagcggcgagatgttcttcacaagtccgggaagctcggatgcctggccagcgctgt

SEQ ID NO: 74997 - DNA, 1461 bp, Heterodera glycines
  Genomic contig location: Contig_ID=SeqID_11555; Location=775..2235; Strand=+
  SCN-specific regions: Sequence locations=1-138,160-293,316-941,963 -985,1007-1164,1186-1461
atgcttgccgaccacttggaaggtgaccacttgaagcattcccttaacgccgtcggagagatcctcgacatgggcaaattgaagtctcttgccaaccaacggggcggcctcaatttcgaaatgggtcatatttgttcatttattgtttttcacaattttgttgtagtaattaaagatgttctcgatgtagtgggaagactgtgtgctccaattcgcgatgaaatggttgcaaatttaaagaaggaaacagacattgtcaaactgttcgagtaagcgattgtttggcaatttttgtcttaaaatttgtttcatttgcagcggcgtattttctctggtggaaatgatggaaatcgacatgaccaactttaaaatctcacaaaacagacaacttatcggctcttattctgcacaaatcgaattcgaagaatttgaaaagctaatgcaaatcgatgagagttggtcatactttgcttatttaacaactaacaatttctcaaggttcgtcgcaaaacactaaacggtggctgggcaagattctcgacgactttctttcttcacctgacattaagtcatgtgctgatggtcagaaggacggtctgacgcgagcccaagtgaatgaattaattgccaacttttacttggctttgttgacgacgaatccaaccgacagcgaccgaattccgttccccgaaacactcaaattggatgaaaaacttttggacgctttgaacgagaaatttttacaattggagttgacaatatcagcgatttttatctctgctaatttagtggggagaagcgtatgcgaaggaaatgatttcaaatcgcaattaaagcgtgatttaattgtgatcctaaacgacgtaaattggaggtgggtttgtgttcgttaaaaggatcaaaggcagattgaaaactgggatttatggtttaagcaacagtacacagaaattaaacaatgtgtacgttcactgtgagcacaaatgcagagaagcggctgctgaaaaaggatggaacgaagaacgagggaatactctccggcgacaattggacggcctttgcagaacggacgacccaatcagagtgatttcgagtgagggggacgtaacttataaaaaatattggccagaggaaaccaaaatgaccactgtaattctgccttgatttaaaaacacatttcaggaaaacgtttgtgcgattttgttggccaggccctcttacgcaggagcagccccatgcgaataccgtcaggccttagcacaattcagacggagttggcatcactcacttcgcagttttatgctattactgtgcacaattggaatggatttggtcgattttatggacaattgttggatcagttttatgaatccaaatggaaaataacctcgcctcattaaaattaaccattccttcgttttgtgcccaattgtcttcttaatattatagatgaggtcataa

SEQ ID NO: 74998 - DNA, 895 bp, Heterodera glycines
  Genomic contig location: Contig_ID=SeqID_11555; Location=3159..4053; Strand=+
  SCN-specific regions: Sequence locations=1-639,661-895
atgcaaaaatctcaaataactttcgcgcccgtttcctcttacactcttcggaaacaaaaaagacccatcagtcgttcaactgaagagccgccacccgttcttacaaagggttcagaaaccgaatttgacaactgtgaggagccaccgccgccgttgttggaggcagaaacagcaacagacggagatggtagtttttgttttcattttttaatattaattatagtaaaacattaggatcggagcatgactttgtccagaatggttcgattaaatcagtaagagatctctccgtgattatgacatcagctgcagaaattggtagggcagcggaagacagtgccgccggctgtgaccctccagcggaaccctttattttggagagcaggttttcacattagggacattatttacttcagcctccttgattgacaggcatttgccttcatggttccgaaattgccctggatgtcatcccgatcaaaattccgaacttctgtttcgtggacgaatcgctggtgggcctcagtctggccctattgtctcaatcgaatgcgcattttgtggttcgccgatttataacagcgattgtcactgggaacggcgaccgacgagggctgaaagtgtagaaaagaagagcacaaaaggctcacaatcagcctgtgatttgactgacaacgaactcgaaccgtcgacttccgcggcggaaatcggaggaaaaacagctgataaaactcaagcgaaattgacgaccaggaaaaagaaggagattggcttcgatcaaaattattctcaccaatttgggctgagttttccggtgatgttcgaaaccgaagatggccaacggaagagccattgcgagaggatcacatttcgtggattcgtctactgtcatgtt

SEQ ID NO: 74999 - DNA, 1155 bp, Heterodera glycines
  Genomic contig location: Contig_ID=SeqID_11556; Location=2268..3422; Strand=-
  SCN-specific regions: Sequence locations=1-237,259-401,423-714,774 -794,837-891,914-932,955-1123,1145-1155
atggccgcctcggatgtgttcgagacaatgtttcgttttgatgcccaaaatgcagcaacaaaacacaacgccaacggaaagggtcgaaaaaagattcgatttaattggagtttcaatcgggatgctcggaaaaagcgccagtcgaaaattgttgttggtcagtccgtatcagtggtactgtctgtactcggtgctgagtcgttagtgaaaaaaaatcatcaaatgaaaattttcaacaaaaaactgcccataaattttgtcaaaaatcaagcaaattaaatattcttggtatcaatcggtagccttaagtgttttctagtagcctgcaaaatttcaaaaaatttggctaagtttaaaaaaagttatgacaaaaatgtctgagcacctggttccttgggtatttttggccatcattttgttcaaacatgacgaaattttttgaatttcgagtgagctaatagagtaactcttaagactatcgaatgcaatcaagaatgtttagtttggttgacagacaaaagttatgggcaattttttttgaaaattttcatattttttttttcatttcatggttttttatataacgcaattattgatgttttttatataacgacattgcacctaaccttcaagtactgcatataattaatttttcttagtcttcggctttttttttgataaatagtttttggctttttttgaactgttattaggtatattttaaaatattaataattattttatttataatatacatatatatatatatatatttagaacatcaaaatgatcacatataaattagtaattataattttggaaaattttaaattttactttacctaaataaaaaaagggaataggcggcaccaatttcaatggcgtgaaacgaacacaatttaaattaaaataactgaaactcgtgtaaaattttctgaaaataaaaacttgggattcttcaaaatttctcttgtttttctttcagaagaagggccaagtccgattttgatcactgacattgatgttgatgcgttcaagaccatgttgcgcttcatttatgcggacgatttgagcggattggacggggaaaatgtcatctccgttctttacgcgggtccaaaaaatacatatatactgtatatgtttcttctgtag

SEQ ID NO: 75000 - DNA, 1596 bp, Heterodera glycines
  Genomic contig location: Contig_ID=SeqID_11559; Location=2305..3900; Strand=+
  SCN-specific regions: Sequence locations=1-123,145-181,203-504,545 -804,826-931,961-1163,1185-1233,1267-1388,1411-1439,1463-1463,1485 -1596
atgccattctcagacttcggtggccgtgccatgcaaaatgatttccttcgtttaaatggtccgtcgtttttgtcggattatgccgacctttggcttcttggacttgacatgctgccgatggcacaccaaacagaagagcaaaaagaacagctgaagatgaagctgttcagcagccgcagctccaaatgcttcattgaagcatgggtaacgatcaaaagggaaacattttttgggtatttgccaatttttctgttttctggcctccccctttgatctcagatttatgataaacttacaactcaattttgtaacaaaagtatccatttgatcaaatttaattctttaagtttgtccaaccatcgcattaccttgagccatccgatccaaaaatgcaattcgccttatagcagcatttttgttaaaaatttggacaaaactaaaatatttgaaaataattttttcaaatattttgtctttttaggcactaaaaataaaaaaactcgaaaagcatttttgttaataattttggaaaaatgccaaaataggcaaaaataagttctttcaaaatttttttaggcttttaggctccaaaaataaaagcctagaaaataggcactaataactcgaaaagtagcttaacaacaaccaaaaaacatgggtttcattcgtttcagcccactgggagctaaggaaaaaattagtaaaaaaagcactgtttaacaccaaagtggctcaaaatagcatttctgctttaaatttttttgttttagtgaaggtttttcgtggtttctggtagtttttaaggcatattttagtgcatatttgagcatttttcgggtttttaaggcatatttaggagggttttaagcaaattttatgcacatatttggaattttttttagtgcatacaacatatcacccaaataaatccattttatttaaataaatataaataaatttccaatcttttcagaatgatcagtcacacaaattttgtgtgcacacccgcaggggagattttgttaaaagaggttgggactcgaagaaggaacctacggagaaaggaattgatttgggatttgaatatttaaaggtgattcaaatggcgaattgtcagtcatttcttcaaaatttaggaaaaatttgacaacatttccatttctgttgttttgcttggagaagacaaacaatttttggcgaatttatcattcaatcggcatgtaaataattgacatattttattactaaaattaattaaaataaattccctttctttttttgtcttttgccaatgtttacgtgccgaaaccaatgccaagggctaatgatttggcttttgccgttttgtcatgcgattctttgtttatctcggcacaaacgtcaacttttgcttggtggattggctatttgatgccggacgatgcgaccattctgtataattccgatttccttccgggtcaatttttaatttcgttgaattttaaaataatgagtaattctgttttaggccttcatacacgtgaccattttttgcctgaatggattccgatcaaactgatcaatggcacaatggctctcgattatcaagcggagtga

SEQ ID NO: 75001 - DNA, 278 bp, Heterodera glycines
  Genomic contig location: Contig_ID=SeqID_11559; Location=4149..4426; Strand=-
  SCN-specific regions: Sequence locations=1-190,220-278
atgaaagccgcccaggcttttgaagtgccaaaattaggcttgctgaattatgccttgatttggcttggaggttgtgcagaatatgccttgatttggcttgaagattttgcagaattagccttgatttggcttgatgatgtgcagaatttatctgatcctgctgactgcgccaaaattgttgtgtatcaacaatttattaataaacaaataaaaataaatgcacaaaatggtgaggtcggaggagtgcagcggcggaggagaacaaaataataaataaa

SEQ ID NO: 75002 - DNA, 2357 bp, Heterodera glycines
  Genomic contig location: Contig_ID=SeqID_11560; Location=56..2412; Strand=+
  SCN-specific regions: Sequence locations=1-171,193-562,639-738,794 -859,884-1324,1346-1364,1389-1485,1507-1585,1607-1872,1894-1898,1921 -2048,2070-2111,2133-2155,2269-2287,2309-2357
atgactgcgtttcatcagaccacgaatcgtcaggggaatttgaccacatcggaacggaatcatcgacgaatgactgcgtttcaccagaccacgaatcgtcaggggaatttgaccatatcggcacgtgagcaaacgactgggaatcgcaaaattgtcaatgtacgtaattgaaagaaatacattatacgaaagcggttcatgctcagaagtacaatgtaaaagcttcagaagctcttccagtttctcgcaaaattttgtcccgggattgaaaagtaatggagaaggacataagcgcagagttgactttccgccctatgtcaaaaatttgatttgggttctagtcggttttacgcgtcccatgacatttaacgcgtcccaacagcagtttacgcgtcccatgacttttgtatcatggcggggatcaggggtggagcgcgcacagaaaagaaccgcggccgcgcatcgcacattcaaattgccgcggccgcgcaccgcggattgcccaaaaaaaaaaccgcggccgcacactgcgcatccaaattgccgcggccgcggatcgcgcattttttaaaatttttccattttttaaaccattttaaaaattttttaaattttcttatgtaaaaatttgttaaaatctcggtgtacactgtagactggaaatgtgaaaatgacaggaccggcccgggctcgggcttagacaattggccgggcgcccgccgggccagggcttttttcaaaaatttttgaattttgattaataaaatttaaaaaaatttacttttttattttagctttgaattatatcaagccatgtaaatcaaccttttttgctttttaaaaaacttttttaatggcgcattttttcaaaaaattttggggtacaaggggggggggggtccgatcgcacatcgcgcatcgcggcgcggccccagccctggcggggatggcattccgagcctcataaaattttcagaaatcgggattccgtgccatccctgtttccatggtattttagccatcctaataacaatgaggaaacctttttttgtccagtattcagtaatcttttttaaataaaaatttcgttgttaaaccttgataactcatacacaggcaactcgaacaatggcttagactaggcctaagctttaggtgtgcttagggttgcctttgcacatttcgataatcaaagtatacaatcaagaacaattagacgatttaaagtataaaattcgattgacggtttgaaaaaactgattttgtgacgagtaaatgatgggacgcgtaaaatgttatgggacgcgtaaaaccgactagaacctttgattttattataaagtacgaatttgagttacaattagcagatataaaaaatttaaaactaactacacagtgaagcacttttccttcacagggtcctaagtggtgaaggccatcctcaaggttaaagcaagcaccatctgtgagagaaaatgaaaattcatatttaatttaatcattttaccaaagtcttccaaagagtcagtcacttgtacaatggacaaattgattagaaagaaaaaagagtaaaaaagccaaaacattgtgtaagaaaagctaaactagttacctactttaggtacagtcatggtcaaatgtttatctacacagaaaaccgtgtccgaatcggttcagtaggagccgagatataaatttttgaaaatcaaaaaaacggttcaaaaccgtataggtaatagtgcaaaggggtcgactttttcgatattcaaaaatttatatatctcggcacctactgaaccgattcattcggacgcggtttttgacccatagtgtaaagggaaagagggcggaggttcgagtccgttgtgcaacattaatatttttatttattttgtccaaaatattaaaatatgacaatttttagcgccgataaatgtaatggacgaaaggaatagaagagataaagtgaagggaatgtcggaagaaattgcgaggggaaaagggacgaggcgaaggggcggaagatttctttatctcgccgaccgtcacatcccttcaatcattcattctctgttctcgaaaatatagacgcattgcgtcactttccgtcctttaacatggccttttatttatgtgtttctttatcatgtttttgcttttccccctccccctcccttcttcccctcttcatccttctctttccccactctctcttcatctctcctctgtctccctccttgtctcttctctccttttcctctctatttcaatttattttccttattccagcaagaaaagaaatggaccatcatcatcagcagcaaaaaagcgaggaagattcatgttcggcacccgga

SEQ ID NO: 75003 - DNA, 750 bp, Heterodera glycines
  Genomic contig location: Contig_ID=SeqID_11562; Location=461..1210; Strand=+
  SCN-specific regions: Sequence locations=1-455,487-511,538-627,649 -674,698-720,742-750
atgcgtttgattgctagaaagaagtgtgcgctaatgacgcctttttcaatcaaagaaagttccatgtgtcgatattccctaaaatggcactgagagaaggcgggtcttgttcttcagcggcggcaatgggtttcttagcgcttgggagggatcggctcgtgcaagacttttcataataattttgtcccattttattaaggcactcgcgcacttttcctttccatcgcttttctcactttgtgtgttttggccgtttattacgcggttaatttgaaactgaaaaacgaatccgtcaaatattcgggctttgacgcgttcgacgaagacaccgccggcggcgaaactttgggttaccgaaaaataaaagcacgccaaataaactcgtgaattttacagcccctcaaggccttccgatgcattgctttggcggcaataaggtgctaatgattacaggctaattataattaattatatatatttttaattgtcattagcttcactttggactaacttttgggatttttaaatttcatttttcgcctcgcaatttggccaatcattcttaagattgcggaggcattcaatcaaacggcagtgacaaatcagaattatggtgccattgaagagaacagcgaggaaaaacaaagggacgacgcttatgaccgatatgtgacgggacaatgaaaaagaaaaagcaatagccaaagaaggatttaagaggagaaatgatcaattaaaaaagactgacaa

SEQ ID NO: 75004 - DNA, 259 bp, Heterodera glycines
  Genomic contig location: Contig_ID=SeqID_11564; Location=613..871; Strand=+
  SCN-specific regions: Sequence locations=1-259
ttagaaacgggcgcgaagcgcccgtctgaggccgcgaagcggccttaatagcccaacaaatttagaaacgggcgcgaagcgcccgtctgatgcctcgaagctgccttaatagcccaacaaatttagaaacgggcgcgaagcgcccgtataagcccaacaaaatttaaaaaacgggcgcgaagcgcccgtataagcccaacaaaatttaaaaaacgggcgcaaagcgcccgtccaaggccgcgaagcggcctaacaagct

SEQ ID NO: 75005 - DNA, 1457 bp, Heterodera glycines
  Genomic contig location: Contig_ID=SeqID_1639; Location=8342..9798; Strand=+
  SCN-specific regions: Sequence locations=1-211,233-280,310-427,453 -1081,1103-1120,1143-1457
atgactaggcgcattaggagcttcttcacacctagtgctacaggtaaatgcatggcctcaacaacacgacaaatgcagtacaatactgagatggatgaaaaagcactttggagggctgttcgcggcaggagtttgagtctaaaatccaatgggtcacatcattcgggattggaattaccatttccaagtggtttctgtactcaattttttcaaaagcaaattggagtcttatcgaggaggatttaattgaatttgcgcatcaaaaaagtaaaacatgaagtttaaaaaaaatattttctaattattttacagtcaacagagaatgtagcacaagggtggaagaagcaatggctgcgcctttggaagacttcgattctttgattgacgacacggaatcagcaagcgacgacagcattaaatgtatttgaataattattttatttttaatttatcatgctttaagtcgatatttggaagcccaagtctccagggagtgtttcgatgccctcaattgtttctggcacttcacagtcgtctcatcaatcacaaattcatcttcaattagcaattcctgatttgtttatactggcccggattgttcattcaattcccgccacatctgtgtcatcggaaaggctgttctcgtaacgttccctaattttctaaggtttcgcgccccttccattttttcaaaagattgggattatttttgtccttttattgtaaagaaactttggaaatgttggaaaataattgcgaaattgccaaatgtttttaggggccaactcattgactgttagcccccgacgccgcaagcgcaactcggagatggtaaagcatatggtcgtgttgggcttgtcgctgggtgtttcgtattttgggctgacatcactgaaaaggacgcttgagaagtacctccaatactttgaccaacccgtgacaatattcggaacggctgtcttactgtatctcagcacactctacgcggtacggtagaggccatttcagagaagaaaaagccacagcggaagaagaaactgtgggcagatatgattgattgtccgtctgtctgaggcccttccccagcattttaaaaatatttagcatttaaattatgaattttggaagaattgtacggtaaagaattggacatcgaagacgtacaggaactttacattgactaccgtaagcaaattgcccaaacaaaaggtagagaagataggcgaacgaggatggaatacggtagttcgtcgaggaacgcaaggcacagtatgagaagggaggcagcagaacggagacggtagtaatttggaggaaatactgcgggaaaatgacaatgttggggacgaaatacaaacagattatgaggaggagtatttgagatatgtggaaaaagaaagaaagaaggcggaaagaagagggaaaagcataaaaaaggcaattaatctaattaaaaa

SEQ ID NO: 75006 - DNA, 875 bp, Heterodera glycines
  Genomic contig location: Contig_ID=SeqID_1639; Location=1097..1971; Strand=-
  SCN-specific regions: Sequence locations=1-8,64-91,125-671,694-875
atgggtcttttcttcgtttggctttctttgttcgtcctttccccaccgtttggcggtctttgcagcgcaaatgcaaatgttacctcctttccgacaattgctaatggtgccgttcccacaacactttcgccgggccgatcccccgttgtaattagtccatgtgccccaattgaaattgcctttgcaaatgttgtgaagcctggcgaggcgtcggtaaataccgaaaagcgtcagaaatatttattccccccccctcctttaattttaggtttgccaatgcattttgaatgttccgccaccaattgggggcaaaacggtgccaacgccacaccaaaagggcaacggcgaccaattttggatcggttgcactcggcacaaaatgaccgccgtcttccgagcgttgcaaacactgaacggcactcgcgtgccgcacttgcacatttgggactcactgatcaacattttgcctaacgacccgaagccaatgttcacgcaggttaattatttatgagcagcggatttattgcgttgcaacaaattggggggggggagggtaataaattaataaatacctagtgaatccctgcaaccaaacgcatttaaatcggatttcgaaaaatgacatttcaactataaagccatttgtggcgtacatttcgttgctttgtgttttattttgtataaattaaatattgtaaagcttgtccacttcccattcattttcacaaatcctcttttttcagctgctcgccgatcggctgaccatcgaacgttcccgagttggactgattcgggagggcgccttcgccaccatcggacggactcttcgcgggctgagtttacgccacaacattctcaaggcattttttaattag

SEQ ID NO: 75007 - DNA, 1052 bp, Heterodera glycines
  Genomic contig location: Contig_ID=SeqID_1639; Location=3697..4748; Strand=-
  SCN-specific regions: Sequence locations=1-38,66-72,108-577,599 -803,826-1028,1050-1052
atgagcaaaccaattataaaagtgcgaattgttcagattattggtttgttgtttgtttttgggttcttcaatttaaacttttgttacagaagcagacgaagctgctggccaacctaagcaagtggtggctgagtatgtggacggtacgggcagacgagttaccatgaaagcaagcggagaggtccgaattggccaacttgttggtttctttgtgagttctctgcttaaaattttatcataacctggggcgggtggactcagttaaaactgaagaatgcttgtaacttactaaattcggcttatgatataatactcgacgactcggtctgtaattcccgaaccgaagaattttggcggttgggccgtgttatggacacgggactgaaatggccaaatgccttcgggccgaaccttccaaccggtaaaacgatttaatgctcaacaaaatatttagcaaatgattcctctcgctctgcaaaagactaactcgaagagtttagacaaaattctttgttaagatgagtaaacattttgttgaacaccaatgcgtttttacccgttggacgtttcaagcccgaaggttttttgaagtcagaattccgacttccgaaaaatttttgggcctcggaaattccgattttctgtttccgaaaaaatttcgaccctcgggtttcctattccgaaaatttttgggggctcggaataccatcactggtccatagtgctttccgacaaaattctttcggttcgtgcattgcagactgaggcgtccaatgttaagtcatttgtctcaagtatgtacaagtattcttcggttttccggggtttatattggtagtcacgtaataactaattttttccctgtaaatttgaaagacccagtggccaaaatgtctttttattgcgtggctttcctaccccctccccccgtcgaagcctttgcttctttgaatttagcaaacaaaaaaacaattgttgtataattacgcatttaggatggtccggacaaaagacacattcagacgtgcttcacgaacaacaacaacaactga

SEQ ID NO: 75008 - DNA, 927 bp, Heterodera glycines
  Genomic contig location: Contig_ID=SeqID_1641; Location=585..1511; Strand=+
  SCN-specific regions: Sequence locations=1-55,101-174,196-421,472 -479,504-625,659-927
atgggcagccgaccaatgctcaatcgaccggaaacaattggggacagacaaattgtaaaaaaaaaaagttaaatttaaataattatttttaataattattggggagggtaagtgcactttccgtttcaatttaatgatacggcaaacaatagcatattttaacattagtcgaggaaaattcaattaaaaattaaaagggctaaaattttgggtgacaaaaatttcgccgaaataaaaaaatcaaatctttaaatgaacaattttcagcagtgggaaatggtcagcagaatcagctgaaagggttcggcccggaattgaaagacgtcgctttggtggcgggcgacaatttgaagcgaacggcgtccaaaacgggcacattggtgaaaagggcattttcaaaccaacaaaatgggggaaaagcaggtgaaaacaaattgaagaattaatttaaaataggcaaaatgattggccaaaggcataaaaagggaaatattttgtaaatggttttggaaagtcaaaactcgaaattagacaaatttagaagggttttattataatgctttctaattaattttaatagaaataaaaacatccaaaaatgcagaattggttaaagaagcatctgaaaatgttttgaataaaagtgaagagaaatcaaaatcgaaaacggaaggatcaaagaatagcgaaaaatgggagacaaatagtgaaaacggaagaacaaatggacaaatggcaattaatgatacaaaaaaagataatgaaaatgatgaaacggaaaatgatcaaaatggtaagcaaacggaacaaagtgatcagaaaaaagaaaaatatgaacacaaagcagcagaagatgatggttcaatgattgagaaaaatgagaaatcaaagacaattggagaaggatcatcaatattttcaaattaa

SEQ ID NO: 75009 - DNA, 814 bp, Heterodera glycines
  misc_feature (10)..(10): n is a, c, g, or t
  misc_feature (17)..(17): n is a, c, g, or t
  Genomic contig location: Contig_ID=SeqID_11566; Location=16..829; Strand=+
  SCN-specific regions: Sequence locations=1-320,343-382,410-529,556 -740,764-814
cagcgactcnggagcanggaggaccttcctacaaaaaacggtttattggggttgagaaaaaacagggcataatcgaccgaaaggtcggtaatcgaacctttatgagacttttccacatttgcatttcgactttgaccggataggggtgggggcaggagacctgtctttgtatttccaagaaaatgaacaaaatccaggctccccctgcgaaaaaaaaaattttaaattgttttatcgaaaagagagggggggggggccattttttgtcaaattgctttgaaacgattgaacataatttgcattatttatcgttttgtaaatttaagcccaacgaaaagaagacgccatcggtgccgggaaatatcgcttctgcttcattgggtttgtcaatttttaaagtttaaaaacatttgcatgaaaaatgcgctttctcggcgttccataaaaaaaatttttcgtgtgcacctacaaaatttattatcatttataattttagtcttataatatgtaggctggcgcttgcatcactcaaaatataaaaattttgtccaatttttgaaaaaaaaaaaaaattcagaagagccctccgaggggaagatttacatggtggagaagggtagcacagtggacactgtgctcggtgtaaggcgcgatcgtccagccgttgttgcattggtccgctacatggacgagcagtacgaattggtgccaacgtgagaaacgggggggggggggaaccgaataatatatatttttttaaattcattttctaccattttttaggcctctgttggtgaagcataacccggcaaag

SEQ ID NO: 75010 - DNA, 136 bp, Heterodera glycines
  Genomic contig location: Contig_ID=SeqID_11567; Location=13..148; Strand=-
  SCN-specific regions: Sequence locations=1-136
atgctggcgccgaacgccagcgccgaaacgccggcgccgaaacgccagcgccgaaacgcggtggaccccccggtcccgggttttttcgcggtcccggtcgaaaaacttggtcccggtcccgacttttctggtcccg

SEQ ID NO: 75011 - DNA, 58 bp, Heterodera glycines
  Genomic contig location: Contig_ID=SeqID_11567; Location=23..80; Strand=+
  SCN-specific regions: Sequence locations=1-58
aaagtcgggaccgggaccaagtttttcgaccgggaccgcgaaaaaacccgggaccggg

SEQ ID NO: 75012 - DNA, 753 bp, Heterodera glycines
  Genomic contig location: Contig_ID=SeqID_11567; Location=2659..3411; Strand=-
  SCN-specific regions: Sequence locations=1-373,462-500,540-753
atgccatcaattgcaatgatttatcaatttcgttggcaaatgccaattaatttggccaatttttgtctaattctggtaaaaccggcaccaattgcttgttcaaagtccaaattcctcaatctgccaatttcagtgccaaaatgttcacggattcgttgtgccaacacccagtgaatttttggcaccaaaaatatttctgttgaccctccaatttcttggccaaacaaaaacatttgctcaaatttggcccagttcgtcacgcttttcatacaatttacgattgcttcaattgattgttgatgtatagctgagttatcgtcactttttgcggaagatgacagccaaaatcgaggaaaattgaattaaattatgcataaatattaaatatattaattaagcaaattgtttttatttattttttgaaatttatacttataaattaactgatttaaaaaaattttgtctcgaggtgatcagaagcatattttcaatgtaatgacattttttttattaaataatttttgaaaatttatttttaaccgttccaattgacaaattgagaagccgaagtatgggcgactgttccgccattaaattgttgatacatttttttgtgccattctcgcccatttgggcaacgatttgttcggaaaacttttgacatgtccaaccaacatttgaaagttcctttcttataatgtcgttaagcatttccaaagtttccacagacgcaccgaatacagaaaaaataaa

SEQ ID NO: 75013 - DNA, 984 bp, Heterodera glycines
  Genomic contig location: Contig_ID=SeqID_11569; Location=2204..3187; Strand=+
  SCN-specific regions: Sequence locations=1-13,42-110,268-645,667 -675,697-740,762-764,814-984
atgaaactccacctattattagttttaattatatttttaatcatcgaaattgatcaaattaaaacggaaaagaaaaaattgcaacaaaaatcatttgatgaaatatttggagaaaaatgggaagaaaaagaagaagaaaggcgaaatgaactcaaaaaaagagaaataattgcaaaattttataaaataaaagaaaaaattaagcaaaaaggaagaaaatactcaacaaaagaatgggaaaaaattgaattaaaaatagcgaaaaaattggagacaaatcgcaaaaatatttataaatggatcaaggaatttggtcttcaaaaacaaatacataaaagctataaatcaaaaacggatgaagaaaaattagaaattgttaaaaaattcattggaatgaaaaatgaatataagcaaaaaagaaagttttcagaaaaagaatggaaagaaaattatgacgaaatttgtaagaaaattggagttagccattacgtaattatgaaatggaagaaacattttggaatgagtaaatttataacggagaaagaaaaaatggaaaaaataataatttattgggaaataaaaaaagaaaatccaaaaatgagtgacaaggaaattgctaaaacattgcaaattaatagaaagagcatttcaagatggaagaaactgtttggataaaagaatcattgaagattgaaaggatgattataagaaaaattggataaatttgccgaaaaaattatcagaaaaactatgacaatttctagttttttttcaaattttttgtatttgtattaaaaaaaattattttaaataccctaagttttgaaatttttcttagtgtaaataagtgaaaacagtcaattcaaggattgggagggtatcattaaaaactgaaaaatgttggaactgggctcccagtatgcctaaattttcgattttagaggccctgtaaaactccttgggcttttgctagggtgaaaaaca

SEQ ID NO: 75014 - DNA, 1461 bp, Heterodera glycines
  Genomic contig location: Contig_ID=SeqID_11571; Location=1..1461; Strand=+
  SCN-specific regions: Sequence locations=1-115,143-478,500-1461
  Gene Ontology: Mol. function=extracellular matrix structural constituent; Cellular component=collagen type V; Biological process =cell-cell adhesion
cgcttgaacagagagaagaagaggacgagagggaacggaggcgggagaacgcgtacaaagcggtgctcgtgctaagcctctgtttcagccgtaataacaaacgaattgaagaccattaattcccctctcccccctttggtcagtgtgcgcgtggacatgcattttgacagtttgtccgctgctttaccaattgctcagcttcaccaccagccaatttgacggttggttccgccgttttaaaaagggtcaaatttattgggttcacaggcattctccaattctgtgaagacactgctcagactgttgccacggaatcggcagagcttatcgaagtattttcacgggagcagcaacgcgaagagcagttacgactcggaggagtcaataggacgaaaagcgtaagaagccaagggggcgggggaggggaaggcgtttaaggaacgcgaaattgcagaggaactttcgccatgttcttccgctacatttccaacatcagcaacagttgcaagatggttgccggtaatccaacaaagcaataattgatttttaacttgtaaatttcggtgccttttcagttgttcacccgaccaaggcgcacagggaacgccggggaggaagggaatgaaggggacaccgggagcaaaggcgagtgttttagtcagctgtcgtggaattaatttacttttctaaagggcgctcccggcattcctgcacggttgccgtgcgagccattgcaagacttgaaaaagtactgcccagagaaatgtccactgggactacagggaccgccgggacttcgcgtgagttaaaaacgcactttaatgtctataaaatctcacaactcagggacatatgggtgagaagggccgacgcggaccaatcggaccctctggaaagaatggcgacgatgggaagacgggcccccgggggatgcccggaccgccgggagtgccgggactgtaagaaagtgaggaaaacggagtgacgaatttattaaacagagacggcgaagacggggaatcgggcacggatgcgcagccgatgcaggtgagttggacctttgtcccccttgaaactgactcttcgcttaagtttgtgcccggcccaccgggagcgggaggagaaagcggtatttgaacataaattggaagatcaatccctatgctaattgtattccttccaaggagaccctggcccacccggaccaaggggactgcccggcatcgacggaccgcaagggccccagggcagaaaaggagcacagggaaatgcagggaaaatgggcgcaccagggacatcaggtaaaggggaacgtagcgcaaaagggacgtccattccaaaaaaggacccccgggaccgattggagaacccggcgaagacggtcataagggtgtgtgtccgacgtattgcgccatggacggcggtgtgtttttcgtggaaccgcccgaatggttcttcaaa

SEQ ID NO: 75015 - DNA, 1254 bp, Heterodera glycines
  Genomic contig location: Contig_ID=SeqID_11577; Location=369..1622; Strand=+
  SCN-specific regions: Sequence locations=1-472,494-620,643-819,861 -1074,1096-1225,1250-1254
atgctcaaggctgaggtgaagaagaagcgagaggaggtggagcgagcaaaggaggagcgactgaagaaattggaaagtgaggccgaagggctacgagccatggtggcagaggcgtgcttcccgcataagccggcggagaagagcggggaggaagagaagagcggggaggaagagaaggaagcgagggcaccggcaagccccccgaggacgattcgtcacgtggtcatcgacgaggactgcttgtcgatcgacagcgaggatggcccggaggaggaacggcagcgggccgcgggggggagtgtcgccaatttttccattggcaacgagagagcggaggagggaagcgggaggcgacccactcccgggcgcggtgtgggcgacctcgggttcctggtgttcaatcgggacgacggcacgccggtggagttggacgaagaagaagagaacgaatggggaggtggcgtccttgatcaccccgcagcgccgccgcggcgcgcaccggaggacgcaaaacgaaagaaatggcgccgatgagccggacggatcccacacttcaccgggagagccactcccgacagccaatttcgatccttccgccatttccttcgcaatttccccacatttattttgccatttcttaattttattcacatttattattctctctctctctctcttctcttcgcctatcgtatccaatcgtctcacttctccgatttgcaaattgtttatgcatttcttcaccattttcccaacctgccaatctcccattttgcgctggcctttggccgtcatttatccgaaaacatttcttttgtccccaattttgcacatttttcattccattcattcattcatcccccctcttctgcattaccatttgtttatctgatcggcctttggccgattcattttgccgtctttgtatttgtaattcgccaacatttgttcgggggcgtctcccccggtctcctccccctccctttgtcattgcgtaatttggccattttcattttcaaattcattcgccaattcgtaagggggctcctccccctactctcatccgtcctcattttttcatttatgcttaatcctatcgcatttttaacattcgttttccactaatcaccacgggggagttgtctccccaaatttcaatttcccccaccacaaatcgcggcattttttacccccctgccgtttgtcactgtcaccccccatgttcggtttaattacccaagtttgagctgctta

SEQ ID NO: 75016 - DNA, 852 bp, Heterodera glycines
  Genomic contig location: Contig_ID=SeqID_11578; Location=51..902; Strand=-
  SCN-specific regions: Sequence locations=1-153,186-193,233-690,712 -792,815-852
atgaaaccactgggagagagctacaaaaagcgacaactagcttgcggaaattattgtgaactggaccatgttaaaaatacaagaaaaagatcatgaagtaaaattagaaaataataataaaatttctcactgaattttttttttgtatttcacatttaattaaaaatcttataaaataaataatagtgaacccaaaaatattatctaattgaaaaaattaattttaaaaaaactaaaaagctcaaagagaaaaatattttgttttcgagcgaagttgagtgatttacttaagaaacatgatgagaaaaaagaataaaaaatgtaaagaatcttggaaaattaattttgaatccatgtaattcaaacacaacttataacataattgcactttgcaaattaattagccgaaaaattaatagttaactaaattacaatttttttaaataagttaattgtaaaaaactgagtactttaaaaagcttttctttaacaagttatgaaaatataatccgttttcacaaaacctaatccaacaatttttcaattttaagataggttaactacaaataagcaaattatactcaaatgaaatttttataggttatatggcaaatatttgatttaaacaaagcagtcctttatatcaccagcaagagtgaattcaagctggcctttagagttcgacctggacctggatccaggcctggatttttcctggattcaggtccaggtcattttttgacaacctggatttttcctggacctgattttcctggatttttgtccaggaaatccaggtccaggtccaggcaaaacaggaaaaaacctggattttcctggacaaaattttag

SEQ ID NO: 75017 - DNA, 2609 bp, Heterodera glycines
  Genomic contig location: Contig_ID=SeqID_11579; Location=1679..4287; Strand=+
  SCN-specific regions: Sequence locations=1-90,129-244,274-295,324 -326,348-467,501-805,847-956,978-1437,1474-1562,1599-1730,1752 -1756,1783-1839,1861-1959,1981-2098,2165-2244,2284-2294,2316 -2431,2483-2501,2529-2546,2573-2609
atgagcattgtcaatctgcttttctttgcagtcttattcaaattgccaccgtttcttcacagcttagacaaagcatacgtcaccgaaccgtaaaatttaaaaaatttaatttatttaaaatattttaaggtttagctttctcttaacgggtggaaaaattggaaaagtttccgtgccgtactttgcgcttgaccaatgtaagccgtacaaaagcatcactcatgatccgaaggctgagtctcagaactttggtctgtattttttgatgaagcaccgaggtggacactgtgatgaggggtaaatttttgaaaaatattatttaggcctaattaaattttaattaccatttagcatattgatctgttacccgggcacactgatgcgcaatcatatgacaagcgagttcaaaaagatgtccgatttcagattgaaacggacattccaagtcggcaacaaagaagtaatggaaaatttaattaaaaaatttatttaaaatttttcaattttcgaacgatttgctttcattggagtgcgcccaaaaagccgaacaatttgttggcatttcaaacccaaaacaatggcgtggcatcaaagtgtacacgaaactgacaaactcatcaaatccgctttcggcacgagaactaattctggagacttcattgacaaatagaaggtaattaattttggtgtaattagtgttaattaacaaaaatttaagttacacctttgagccaatgactcgtcagctttcacttaattttggaaccagagtttcaatgttcacttgggtcacaactcattttggtaattaaattttaaaaaatattatttaaatatttaaatttaggacaaccgtttcatgacgaagaatttgacttggctgaacagtacgcccaacaaatgggctatggaccattcttggaacagcatgtcggactttggctgctcggcatggacatgttgccatggatggccgaagagtatgtgagcctgtacgtctaccgtggatgctcctgtaccatggacgcttgggtactgtactattatttgaaattttactgtaatttattgggatataatttaatgaagttcactcggccaaccgatgaaaatgacccaattgagccgattgtgccatcggccggctcatcacaatgcccgacgaagcaaatggacgaaacttttgaacttggccaattggacgcgcaacatttgcaggctgatcttgtgttcactgtgctgacggatgaagaatggcaaaacttcacagtggaattattacaacaagaggaagaaggtaagaggatgattaaaattggcaatattaaattttttgattaaatcaatcatatttgtatttattgaccgttgaataggagggaaataaataaacaataacgaggattgatgatccctatgggcctaattattgggatgtaaattttatgtattaaaaatattttttcaaaaaatgctgattttctaacctggtttaaacatgacgtacagatttgagatttttgcacaaaaataccttggcacgaagcctacccttctgcaacattaaaaaaatttattgtagaaatttttataaaaatcagcttgttacaatgaacattggacggacatttaaataaaaatttttgcaggtaaaaagctctctgtggtaatgaatttcacaattcgaacaatcgacgacatgaaagtgcctttttccggggtaataaattaaaaatcaaatcaaacaagtattatgtaattaatttttattaattaattaatgtagattaatacatcggtggtcaatggaactcaaatgcctaacggaattcaacaattgcgttttgacattttcctgctagagcattggcatgtcatcatggtgaacggcgagcagcttggcgaagtgttttggccaaaggaatggtggcaaggggcggcatggaaaaacatcacggcaattagggtgagtgaaaaagaaacgccataaatttattgatttgagccgattccgaaaatttgattttgaattgaacttaattgtcaaattttctgcatagattagcgaaaaagccaaaaatttacaattgggaataagaaaattaacttaaaaatgaatatttttatttaaaatattattttgataattaaaaagttttattttgtagcttaacggccaagtattattgctttatgggcctgaattggatgaatacggtattgaaaatgaaaatgtaagaaacgattaaaaagtaattaaaattaattaacattattattttagttcaacgtatctgtgccacttccattttcacagagaattgatggttttcgcgtgaattcaacattttttttccgtgttcaactgcttaatgaaacgcataatacagtgaacataacatttacaaatgggaacagcagtaagaaaagcataaataaatttaaatgattttttaaaattaaatttataataaaaataaaagtaacaaatacaaattgtcgatttaaaaaataataatttagctgatgcaactgatcagacggaaatgaacatcaaaattgaaaattttgagacaattgaaatcactgcttattatgtaatattttaa

SEQ ID NO: 75018 - DNA, 1061 bp, Heterodera glycines
  misc_feature (653)..(653): n is a, c, g, or t
  Genomic contig location: Contig_ID=SeqID_11579; Location=5232..6292; Strand=+
  SCN-specific regions: Sequence locations=1-102,124-297,331-364,386 -1037,1059-1061
atggagttcaacgttgatgctggtgggcttggcaaagagtttttctgtgaacacatatacgtggagaacgcatccatagtacgataaaattttccgcactctaaaaaataatgaaaagcaaagggtccaattttagataaataaagaactgataaacgaaaataagattttcttgctcaaaaaaaggacattttgtaagaaactgttcaaattaaattaaaaatggtgatttggggttgggctgagccgattggttaatgctattaatgttcttctaggccataacttttttgaaacaataaaaaaaaaaatttttttttttgaaatttagccgttaaatattttgtaaaatgatgtagaaattaaaacaatattaaataagctaaaataatgggggaaaaaaatttatgaaaaaaagaggattacgattcgatatcccccaaataaggacaaaatctttaaaaaaaggtcaatataattaaaagcaaagggcagaatcaaagataaaataaggaattcatgggacgaaacataaggacattttgtaagaaacggttcataattaaatttatatgaaaaaagagggttacgattcgatatcctgaaaaaaagaggattacgattcgatatcccccaaataaggacaaaatctntaaaaaaaaaggtcaatataattaaaagcaaagggcagaatcgaagataaaataaggaattcatgggacgaaacataaggacattttgtaagaaacggttcataattaaatttatatgaaaaaagagggttacgattcgacacctccaaataaggacaacaacacaacccgtctttggattaacaaaaataatttacatttgaggtgacccgtcaaggacctgtccaagaaaactcattgaacatattatcaagaagagcgttatcactgaaaattctgatggcccaggacggtttctatggtcgatcatatggtgattacataaaactgtgcccatatttttggacatattggcaatactgggggatgtggccatggactattgaccatgttcaagtggtaaattaa

SEQ ID NO: 75019 - DNA, 156 bp, Heterodera glycines
  Genomic contig location: Contig_ID=SeqID_11580; Location=139..294; Strand=-
  SCN-specific regions: Sequence locations=1-102,124-156
atggcacttgtggatttcactaagaaattttgtgattttttttttcttgatgtttggcatagacgttgtttatggtacttatgtggtttaccgcccataaactttttgtttgtcaagtcaaacaaaaaaactttcaggggttttgatgggcgctga

SEQ ID NO: 75020 - DNA, 130 bp, Heterodera glycines
  Genomic contig location: Contig_ID=SeqID_11580; Location=3998..4127; Strand=+
  SCN-specific regions: Sequence locations=1-28,52-130
aaattgtgcaaaacttactagttttttgaaaaaaaaaaattaaaaaaatttccgacttttcatcaaaaatttcggaagtcggaattccgaccccaaaaatgtcggaaatcggaagtcttttcgtgccata

SEQ ID NO: 75021 - DNA, 2023 bp, Heterodera glycines
  Genomic contig location: Contig_ID=SeqID_11580; Location=446..2468; Strand=+
  SCN-specific regions: Sequence locations=1-277,299-302,324-517,546 -1099,1121-1676,1698-1712,1735-1874,1896-2023
atgggttcgtcatttatggaatcagttggaaatcggcgaagttctcggctgaagatgaagaaaaagaaccggaaaataagctggtaatacaatactaattttcgatttttttgaattttgttatactcttggttctgggtccgaattaattaaaatggatgcctgaattggtttctccgaccccgaaaacccctaacaaatttatcccaaaaatttttttgcttgatatctccgcacagataacccacaagtaccttttttttctggaaattcagttaaattttgttttcagtagagatcgacctggatccaggcctggatttttcctggatccaggtccaggtcatttttcggcaacctggatttttcctggacattttcctggatttttgtccaggaaatccaggtccaggcttttttcaaaataccgatctctagttttcagtaacacctaggtttaaaaaaagctttaaaaacaatttttgataagttttttgcgacgacgttttggggtggcaaaaatataaatttttaaacaaattttagtgaaattctgagcagtttctttccccacttcagttggatttgcaacgacgttttgatggacattctgccgttttttggtcttcgtcaactcggcctcaaattggcactgatttccgatcgtttcgatgttttggtggacgcgcatttcgatggcaaatcagaattgacgatttggaaagctatcaggattcacaaagacgctttcacagaagtgccgaaattaagtgtgctaatcgataatgccaatcgtgtggaatttccatggcctgaccgtccgttgcacaacaaaattcgcttcaatttccttctgattgagtaattattccaaaaaaatttctgtgtaaattaatgcattttatgttgctccctttttcagttacattgatcattccgtcgtcgaatttctccgctccaatcaaccaatttgggacagaggcaccaatttgtatttgcatttttgttcatccaacaccgaaagcaatttccgcccgatttgggatgtttttgtccgtcaaatttggcccatttttacgacaataaatgtccatcatttgggccttcactttgctgatcatttggacactttgcttcgtctcacatcgccgacaattctctccgatatgaacattaattcaatccaatctgttcgtctgttcccagaagcaattgatgacgatgatgggccaacaaatacaaattctcacggacaaatgttgtcaaaatggttgcacactccgagaacagatggccgtccgaagaaattgcgttgcgataaacattttgaatcaccaaatctcgaatggatcaacagtttcaaagaggtgtgaccaaaatttccgtttttaacgactgactaattgattgcctttaattttcgtttcccattgtttagaaatttctccgtgccaccgcttcaatcagttacgaactgtattttgaattgaaaagttcaacaccaattgagccatttgaattggagaatgaacggaccaaagaaaatctgtcattggagaaaataccaccttatcctggcagttggctgttgaagcgatgtccaattaatggagaaacggcaccgattaaatgggaaaacgaaattcggctgacaaattttaacggtgtccgttttgtgcttaacattaacaaacagtgcattgggtgagtgtaacagataattgacaattcaattcaaatttcacttaattttaggccattggcgccaccagcggaagaagaaaaagcggatcaaagcatagaaaatgtcgtctaattgcgcggaagtggattaattatatttgagaaatggtcgatctcaccaattggaaacggatttgatgctcattttatgtcaaaatgctttgttgattttatttcgttcgaattcataaaaatcagggcttccaagtgtcctttttttctaatatttgtccttttttggcaagacctccttgttttgtgcttattcttggatttgaaa

SEQ ID NO: 75022 - DNA, 428 bp, Heterodera glycines
  Genomic contig location: Contig_ID=SeqID_11580; Location=3178..3605; Strand=-
  SCN-specific regions: Sequence locations=1-428
atgccatccctgatagggaccgccggaccctctgttcctagttttttgaaaaattgcaccgcaaaaaagtgggtttgaaaagaaaaaaatagtcaatttatgaaccgttaataatttgatttccgatcaactttttaccgtcggatccaatcgaaaatcttagtcgacccatcagccccttttaatacatcccgccagcccctaaaaatttatttttcagcattttttgatttttggaaattttttgaatttaattgaaattttttcgaattttccaaaatcccgcaatcccgcaaattttaaatgcgggatttgcgggattaatcccgcgggatcccgtcccgcaaaaaattttgagttccagtcccgcagcgggatccgcaaatttgaaatttccggtctctagtaacaacactaattcaaataaa

SEQ ID NO: 75023 - DNA, 128 bp, Heterodera glycines
  Genomic contig location: Contig_ID=SeqID_11582; Location=2192..2319; Strand=+
  SCN-specific regions: Sequence locations=1-128
tatggcacggaaagacttccgatttccaatatttttggggtcggaattccgacttccgaaatttttgatgaaatgtcggaaatttttttaattttttttcaaaaaactagtaagttttgtacaatttc

SEQ ID NO: 75024 - DNA, 414 bp, Heterodera glycines
  Genomic contig location: Contig_ID=SeqID_11584; Location=572..985; Strand=+
  SCN-specific regions: Sequence locations=1-271,293-321,343-414
atgaaaaatttgatacaaaaaataaaaacttgtagggaaagaaaaggggtctggcgcccatttggctggcgcccatttggttggcgcccatttggttggcgcccatttggctggcgcccatttggttggcgcccatttggttggcgcccatttggctggcgcccatttggttggcgcccatttggctggcgcccatttgattggcgcccattcggcttcgacccggtccgaaaggaccattgttttttctattgatatttttaggccattattttttgccatttatttattgcctcaagcgcggaagataaattctctctatttttatcattttaatgctcaatataaattttaatttcatcggcaaacatcttaataccaacattcttaggcaaattattcggaagatcatta

SEQ ID NO: 75025 - DNA, 2302 bp, Heterodera glycines
  Genomic contig location: Contig_ID=SeqID_11584; Location=1..2302; Strand=-
  SCN-specific regions: Sequence locations=1-277,300-626,649-775,797 -889,911-963,985-1294,1328-1389,1411-1770,1806-1952,1974-2091,2121 -2302
attatatatttacgactgaattaaaaaaacttttttataaatatgtacccatgaaattgcttaaaacaactattaagcaaaaacatgatgaaaaatgaaaaccttagtccgggaaaaagccgaacacatagcatgctaaaaggaaaagctgagtgtcgtgagcttaaaattaaatacaaaatattatgcagggaatataaaaaacatactcataaattatattgtgaaaatgaggctaaatgtatttcaaatggaagaaattctctctataaatttgttagaaacaggcttaaaaataacaccggaataccaatacttattgatgaacaagggcaaattatttttcagaatgaacaaaaatgtattatattggctgatgtctttcaaaaatcatttttgtacaaggaaaataacatgactttcgcagccatgtaaatcctaatcatatcacagacatgaattttattgagaaaactccctcgaagaaattctacatcgcctgatggcatcccttacatattattaaaagaatgcgcatttcctttggcacccatactaactgaactctttcgaataattttagattcatttaaaatccctgaaatatggaaaacatccacaattatccctgtcttcaaaaaaggagagacagataatcccataaattatcgccacatttcactgacttgtactttatgcagggcaatggaaaaagtaataaggctggaaatacttaaatttttgaataaaaatcaattttttagtccttttcagtttggattccttagacaaagatccaccacaacacaactcttatcaactttaatgatttttataaatcgattgaaaataaaagttgtgttgatgtaatatatattgaaatttcaaaagcttttgttagtgttccaattgaattacttctacaaaagcttaaaaatgtcggtattaatggcaagattcataaatttattaaaaatttcttaaatgaccgttcattcagagttaaaatctctgagcagtattctaactcaaaaaacatttatagtgggatgccacaaggtagtgtcttaggcaccaggactggagcgcgaccgcgatgcgcgatccgcggcgttttttttttgcgcggtccgcggccgcggcaatttgaatgcgcgatgcgcggccgcggtttttttttttgcgcgatgcgcggccgcggtttttttttttgcgcgatgcgcggtccgcggcaatttgaatgcgcggtgcgcggccgcggtttttttctgtgcgcgctccagccctgttaggcactttgctttttcttatttttattaatgatcttccgaataatttgcctaagaatgttggtattaagatgtttgccgatgaaattaaaatttatattgagcattaaaatgataaaaatagagagaatttatcttccgcgcttgaggcaataaataaatggcaaaaaataatggcctaaaaatatcaatagaaaaaacaatggtcctttcggaccgggtcgaagccgaatgggcgccaatcaaatgggcgccagccaaatgggcgccaaccaaatgggcgccagccaaatgggcgccaaccaaatgggcgccaaccaaatgggcgccagccaaatgggcgccaaccaaatgggcgccaaccaaatgggcgccagccaaatgggcgccagaccccttttctttccctacaagtttttattttttgtatcaaatttttcatttcgtatggtcaaacattttttataattgttttttcgtcaaatttagtttatttttaaactatttattttttatgttttgtttttacgccactgttagagtgcatatgtagcaccttgtggtttgttcgataaataataatagacattaaaaaaagtcacgtaggcctaaatgaatgcttaatgcattaatgcattaatgatttaattattttattggcaacatttaagattttgttaattactagagaccggtaaaatgcggaccgggagtcgggaacgggagtgcgaaatgatccggaaaaaggacaggaattccggtaaatacctcgtcgaatccagccggactaactcaaaaatgtaattaaacaaaaacaaaaatatatatttaatgctaaattttgaaaggcaatcttttcatttaagaaaaaataatcaaaaaaataaatcagtaagcataaatttgaaactttaatgatatttctttcccaaattggacggttttcgaattttaatccgccaccaaaaaatgatgggaaaaacgaaaatgtattaacccatcgaaaaggaatt

SEQ ID NO: 75026 - DNA, 1670 bp, Heterodera glycines
  Genomic contig location: Contig_ID=SeqID_11585; Location=78..1747; Strand=-
  SCN-specific regions: Sequence locations=1-287,314-438,460-695,717 -771,793-879,903-1023,1045-1131,1155-1275,1297-1383,1407-1527,1556 -1578,1604-1670
atgctgcccaccatcaccagtctcgtcatcatgctcgtcgagattttgtcattcagaaatgttgaagcaaatgatacagtcacaatacaagcttactgtatagtagaagagccttatccacctgaaccggtctttaaacatgtcaaggaatatattgagaattgtgaaaaactcggatatgttcagcagccaggtgataagtgcatttattattgttacatataaattaattttgaaaaattcacatttctttttaatcaaactatctcgacatttttgcgcctgcaatcagaaaacacaaaaataaaccaaccctaaaaataatttgggcctttttagaagtgaaagccataaaagatggcatttattatgcatttactttggaacgacctcaagatttttcggcggttgacattccaaaagagaataaatgcatggattatgaagatgagaaagacaataagttggaaaacctgttgaataattatcagaatgcgaaaaaagagatggaaagtgaaagggaatatcaacagaagctggatgattcggaatcagttcaatcgcaattgacgttggcgttggaggctatgttgagtgcgtataatgaagggaagaaactgtcagggtccaaggaggagggaagaaagctgttaaggagtaccaacgtaatcacaaaagcttatatgatccgctttttgaaaagcaaaagccttttaaagagaagaaaaggtggtgtgaaattgaaaagtttaagttggatgcatacattaaaacgatggaggaggagaaggatttggtggaatacaggaaatattatgatgctaatggaatggatgaacagtttgagaaactattgaagacttataaggagaccagggaaaagaaagagaagtgcctaaaggattacattcagataatacaagaaccagaacaggcggatatgatgtattttgcaaagcaggctttgacgaatgaagaagaatcgtgtgaaattgaaaagtttaagttggatgcatacattaaaacgatggaggaggagaaggatttggtggaatacaggaaatattatgatgctaatggaatggatgaacagtttgagaaactattgaagacttataaggagatcagggaaaagaaagagaagtgcctaaaggattacattcagatgagctcaataccagaactggcggatatgatgtattttgcaaaaaaggctttgacgaataaagaagaatcgtgtgaaattgaaaagtttaagttggatgcatacattaaaacgatggaggaggagaaggatttggtggaatacatgaaatattatgatgctaatggaatggatgaacagtttgagaaactattgaagacttataaggagaccagggaaaagaaagagaagtgcctaaaggattacattcagataatacaagaaccagaacaggcggatatgatgtattttgcaaagcaggctttgacgaatgaagaagaatcgtgtgaaattgaaaagtttaagttggatgcatacattaaaacgatggaggaggagaaggagaagcataagtcagatagtcccaaaagaggaaaattttttttaaatttttttaaactgccaaaaatagcaaaggaagggaaggaaaagaggagaaaatttgagaaatggaggcggaagatag

SEQ ID NO: 75027 - DNA, 264 bp, Heterodera glycines
  Genomic contig location: Contig_ID=SeqID_11585; Location=2280..2543; Strand=+
  SCN-specific regions: Sequence locations=1-264
atgaatatttatgaatatagcaatatatacggatttgttgaatctgctttttacgatttagcatatacatgtagaaggctgacttcgtttaattgtacggttattttaattaatcgcatttttttttattttccataaaaaatttcagtggcattttcgctcgccctgcgctgtccgttgtcgcaacttttcgtcaatcgatgcgagttccttttccgactgcgcaaggccaactacgtgccgaagacgacggctgatcagtga

SEQ ID NO: 75028 - DNA, 1288 bp, Heterodera glycines
  Genomic contig location: Contig_ID=SeqID_1642; Location=1722..3009; Strand=+
  SCN-specific regions: Sequence locations=1-348,371-497,520-679,702 -962,985-1211,1237-1288
atggcgccgttttccctttcgcttttcccttcggtttgccttttcttttcgctgctctttcccatagaatttgccgcttcctccgctgatcaacagaagagtaatttggacaagtttttcacaaaatttgcggacgaattgccaccaaatgagcgatcggcggacactttggcactgtttgccgaaatggacgaggcagacgcactgctcactgaccaaatgtcaaaagttattccgccaccgcccagcccggcacatccgacatttcaggtaagattattttgctaattttaaatgcaaattgtagcaaaagtttatcgtcaattgtccagtaaatccctttttaggtaaatattaatcataaatctaaacaaactcaaaattgctcaaaatatataaaaatacgaattaaggattcgctttcgtaatatttcccccctttagactctgtatttggacaaaaacaaaggtccaaattcagcagaaaaaaacagtgcttttcaaagtgatcccaaaagtgccgtcgttcggcgactcaaagggagcaaattgtcaaaattgcgatcgcttttcccgaggacaaaattcatgaagcaaacggaaagaattgtgaaagtgtatttgaaactgaaggacaatcccggcggggggtggggcccactcatccaaaaaatgtttggcgaaatgattttggccaagaaattgggaaagggcgacggcgcgtcattgcgcgccaattgccaattggcactcgaactgatcggagaaggggacggtgccaccgaagcaatggtcgatcagttggccaaggcgaagccgtacagcaacttttggactctgacgaaacgaacgacaaaagcgattttgtgccttttaaaaggcaatggcacggaaagtgagcgacaacggagcaccgaagacattctgagaatgctgaagacatttgcggaggacggtgaatcattgaaaatggtgcaaaaaggtggcaaaagagaggctgataaagcgggagttatacgggattcccgctaccggaagatctcaaactcccggctcccgcccccgtaaattttgacccaaatacgggagtaaaaatacactgctaagaactgagtttttttggtaaaattcatcatttttgattgaaaatctgttaaatataaagccaaaatttcaaaaacaaattttcccggcggcgcctatcggcaccgccggcttccctcctcctcctccctggtacgcaaaaagttcttttcaaaaaatacggcgcaaaaagttgtttaaatta

SEQ ID NO: 75029 - DNA, 685 bp, Heterodera glycines
  Genomic contig location: Contig_ID=SeqID_1644; Location=523..1207; Strand=+
  SCN-specific regions: Sequence locations=1-9,31-122,144-445,467 -525,547-551,573-685
atgccaactacaattttggaaagaccaaacactttgccacatgatggtggcaatacggaaccggggtcggggtcgttttcgtacgggccgttttcgtacgagcacaagtttttggctataacttttttctttgccaaccaaatccaacattgttggtgtcattcgatagccctatgtatcctctattagcctgcaaaatttcgaaaaatttcgtaaaggttcaaaaaagttatgaccagaagaattcaaaaaaccaaattttccaacttttttggctcgaactttttttgaacttgacaaaattttttggaattttgcaggctaatagagcatctgaagagctctcgtatgataccaagattttagctataacttttttctttgtcaaccgaatccaatattgttgatatcattggaaagctctaagtgtcctctattagtatgcaaaattaaaattttgaaaaatttagtttatgttcaaaaaagttatggccagatgaattcaaaaaaccaaattttacaacttttttggccataaattggttcaaaattaacaaaatttttggaattttgcaggctaatagagcatctgaagagctctcgtatgataccaagattgttggatttggatgtcaaagaaaaaagttatagtccaaaaacatgtgctggcgcccaactgaggtag

SEQ ID NO: 75030 - DNA, 1822 bp, Heterodera glycines
  Genomic contig location: Contig_ID=SeqID_1644; Location=3007..4828; Strand=-
  SCN-specific regions: Sequence locations=1-140,162-739,824-1109,1141 -1249,1271-1382,1412-1465,1487-1822
gggaacagcaaaagaagcggtgacacaaaattatgaacagcgcctttggaagggatgggacattggggaggtgaataaaaccaaataaaacaattagcaattaattgtggcatgataattaaaatgcataataattaattaactgacaaaaatttgttaatttcaaggaaatcttgaacgaagcattcagcaaattggcaacaaattcggaaaacgccaattcaaatgaatcggatgcgctaacacttaaattttgcagacgaatcaacgacagttattgcgcggagagcgtgtaaaaaaagcgaaaataaattaacgaaaaatttccaatttttttttcaggaacaacaaaaagtttgtgatcgtcgtgttcaatgggaacagcaaaacatacacagggccaattcgagtgccaataaacgcaccaaatgcaagggttttggacagaaacaatcagcacatcatagcacaggcaaaaacaaaattgaaattattttgaaacttaaaaatttaaaatcttgaattttggttaattaaattagtaaatccctaatattatggacaaatttatctaactatattcgcatttttcaggtcattccgacatttgttcgtccttatcaaataccaatgaggaaattttggccctcaaaatgggaattggtgttttatgccgaaatcaaagggcttggctacgaggcgttttacgtggacacgacattacgccaaaaaaggcttgtattttaaaaatatatttaaaatttaaatcaatcaattaaaaggtaattaattaatttaagttaaaaataatttcaatttttttcaaaattgcattttacaattaaagaagcaataaaagagcgaattcaaaggagaaaaacgcacaaaaaacgacgccgcttaaggatggggcgcaatccaaccaaatttcgaatcaggtcaaaagcgagttttgaaatgaacatgatgccaaaattaattttcagtacattagcctcacttttggcggcaacggactgttggcatcgtttgaggatttaattggccaagtcaaaatggatttctcgcaaaaatttgcattttacacgggggcaaatgggcggaggagcgcagaaggagaggaaaagcagcagcagacatccggggcatatgtgttcaggtggaaactaagttcaaatattagccggtgctggggaatatttggcgaaatgcgcaaatttaaaattgtaaaaaaaaatttaggccaaacgaaaaaatggcaaatgaattgaaaacggctgaggtgcaatttgttaaggtatttaacacaaattaatgaaaatttgaatggtggattattattaaatttcaaattaaattacatagaaaattcaataaaattgaatgtcatatcaaaaacacttaaaaccatttttaaattgattttataaagttttgaaaaagaaaaaaacgaaaaaaatgtctaagcaaaatgttaaaactatttttgaaccatttacaaatttgaagaaatttgcccaaaaggatattttttaatgtattttttggtcaattgtatttaatgtcgtcctcttaatgtgctgatccccctttttctcgcatcggctgaatccaatcaactgaacttaattagcaacacaaaaaagggcataataaaagaatccaattaatttttctgtacatttaatcacagaatgacctcgttcacgaggcacgtcaaattgtgcagccgtggctctcccaaattgtccgactttacatggacaaacccttcgtggagttcgaatatttaattggtccattgcacaaggaccaagagtaa

SEQ ID NO: 75031 - DNA, 1492 bp, Heterodera glycines
  misc_feature (1392)..(1392): n is a, c, g, or t
  Genomic contig location: Contig_ID=SeqID_1645; Location=1..1492; Strand=-
  SCN-specific regions: Sequence locations=1-51,77-120,156-278,320 -428,468-516,557-722,762-819,856-1028,1080-1210,1233-1238,1275 -1360,1384-1492
  Gene Ontology: Cellular component=integral to membrane
agaaaagttttaaaaaaaggcaaataaggaagtacggcatttacaaatggctaaaataaaattttaaattaaaaatgatttgcatttattcaggtcaactcgaatttgttggaggtttggaaaattaaaaagaaataattgtttaatttaattttgcgattgttaggcggttggacacagcccgacgaggcggcaacgcattactacgaattggtggatcaatacgcactcggactgggcaaactgtcggagaaatacggtaaagaacatttggattgtatttataatttattaaaaataatttaaatttgaaaaaaaagattcatttccaatttgaaaaggcgtttgcgggcgcccgaaagtggcatggcaaattgacccattcggacacagccgagaacacgctaatttggtctcaatggtacgtcaataatttatttttaagaaaataaattttaataattttagatgggttacgaggctctgctttttgcccgaatgcattacttggaaagaaaatttcgaattgaaaacaaaagtttggaaatgatgtggagcacagatgatacaggtcatgaaaaacagaagagctaatagggaaaaaatggcacattaattaaatggtaaaatctgtggaagcaaaaacttaaaaattctcaagtttaatttcagtaaattaattaccttagtagccaaatttaaaaaaggtttttttgtgtttgtttatttcaaaatattaaaatgaccttttttaaaatttcgttaaatttgctttttatgaatcgatttcgcaattattccctctaaatacatatatgcttattttattttatttatttatttattgtaattttaggcaataattcgctttttaccggtgcttttgcgagtggaacatattcggcgccgaaaggcttctgttttgatgtgttatgtgatgacgatccaatgattgacgacccaaaattggagggatttaatgttgagcagaaagtgaacgcatttttagaagcggcggtggaagaggcaaaaataaaaacaaaaattaaattgaaatgaaattaaaattattaattaaatcctaattgattttgaaaggcgaagacaaaacggcacaaccacgtgatgttcacgatgggcggcgacttcagctatgggagtgccaacagatggttcaccaatttggacattttgattaatgcggcaaacgaaagggtgaaaaggcatttaaaaaatggataataattattaaatttttcaaaattttattaaaaggaagaaaattaaattttgaatgtgcgaaagaatttcttttgattaaagcaaaaatcgtccattaaattttttaggggtgacaaattaattaggcatttaaattcatttttaaagttngaatttttctattggttagaccaattccacgggcatccgcctgttttactcgacgccctcgtgctatgcgaaaagcgtgcgcgagtcgatcaaaatactg

SEQ ID NO: 75032 - DNA, 1762 bp, Heterodera glycines
  Genomic contig location: Contig_ID=SeqID_11586; Location=166..1927; Strand=-
  SCN-specific regions: Sequence locations=1-380,408-484,517-1040,1136 -1203,1225-1386,1452-1762
atgcaactcgtgcacatagacggcgatgctgatttggtgggtggaaattattatgaattaagcaattaacgaatgaaaagcaaattaaaaacagaaaatggcaaacaatgataatcagtgaaatgacaaaaaaatattaagacaattcacaacatttccattctgccagccgaccaatgcaccactgaagaacaaagggtacaaaaagagcataatttgacaaatcaaatttaaattttgcattgcttaagacagcaaagtgttgttgcggaacgggtaaaacaaaggcacaaaaattcaattaaattgaaatggcacttttagggtttttctacgatttcaatcaacagaagtgtctcgtttcggttgttattaaaacgaatatttaattataaaaattaatttttgctaggcgaatgttgcttttatgttcggcagaatcaacgacgcttggccccacgtcgccgtttatgggtcgccttctaaatgttttgcaacaaaatttgatgccaatttcagcttcgtttatccgatgctcgtcctgctaatgatcgctccattaagcgccgtgtaataattatttttgttaattaatcattatttttcacataagtaattactttttcagaatgttgggaatgagcagacgcgaaaagcgcgagggcgaccgacgctttgtaatttgtgctaattagggcattaattgcatgctcgttttgtttgttctgccagccgaacccgttataccagctgatctcgcttttgtgcttctgcgcttgggtctctttgttgtcgccgctcccttttaccgtttgggttaagcattcaattttaaattaaatcctaaaaataatttattccaattagtattatgtgcttggcgatggccttcgtcaaatgaaccaatcggtggccatgtgccatttgtaccgcacctcaatggaagtgcttaattaacgttaattgatgttatgaaaagcacaccctgattgttcaggttatccctcatacaatggacactctcgtcacacttttctcggttttaatttattattttaattttaaaatatttatttagcaattcataattaatttatcgctacaaattaaaaataaaaatataatttttaaatttgaaaagtttatttcttaggttttgctcgctgttgcaaggttttccttaaattcaagaaaccaattttcactaaaaattctaagatttctcacgcaataccaccgaagcacattaaaacttcggacggtaacactctttcattttttcgttttcactttttttcaagattgagcgtttctcccgtgccattttgttcatcatcgtaattagcgttctcctcggcattttgcgcttctttgagcacgacgccgcactatacaggtggttttctttcaaaaatttaactcaaaatagtttttatttttgaaaaattaaagtttctgcatggacacggagccgggccctttctgggcccaacgctgtatgctaacggacgggtgggtgcgctgggtcagaaaatgtgttaaaagcatcccctgctggcctcagcccactgatcagctttctccggctcggccgtcccttttggaaagtgttccttcccctggccgatctgttcgcgcagttccttttgcctggctcctgtctgatccttctccacatcggcttcaaccgagagcccgtgctcgaaatcggcaacgaaaatagtcacaaccgatttggacgatcattgcgtgaccaaaccaa

SEQ ID NO: 75033 - DNA, 1071 bp, Heterodera glycines
  Genomic contig location: Contig_ID=SeqID_11588; Location=354..1424; Strand=-
  SCN-specific regions: Sequence locations=1-531,554-1071
aatgaacttcttgttatccgagaacggcagaccaaagactctcaacatgaaaattggttgttaagagggcgattgccccgcggcgcttattccgggtacaaagcccagccaatctcggcacttttccgttactcatgtaaattcactgaaaacaataccaaataaaatttccctttatgctgtacctgcaagcaaggcccacccggcctctcgggaaaaaggggccaaccgggcaaaaatgggagagcgggcgagtcgggaatgccaggacgagatggaaaggcaggagcatacataaatgcgcagcaattggcggaggaatcttgccaaatttgtccaccgcatgtgcgcgggccccccgggactccggggattaaaggagcacgcggcacatcggggtaaaagggaggggagggggataagcatagaaaacgggcaaaaagggataaaattgggaggaaatggctataaaaaaataaatcaattcaatccatgttaattgtttccattattcgactttttagttcgcctggtctgcctggtattcctggaagctctggcgaaaagggtcttagaggtccggtcgggccaaatggaaagcctggcaaatttggccaccaaggaccgatcggagacccaggcaaaaataatggatgatattagcaaaatcaaaatcgtgagtaatattaaggacggaccatctttagtgcatcgccaggaaggattgggccgatcggtaaattatctttaattgtgcaataaaacctttttcttttttaaaggactgacaggtccaaggggcggcccgggcaatgccggatttgatggacagcccggggaacgcgggccaaatgggcccaggggataccaaggaggtcgactaattccagatgactttgcaaaatggaatgaagttcagaacgtgggccaccaggctcgcccggccttcatggcccgcggggccctaacggtgcacttggtcaacccggcgaaacaaaattcttcaccaacaaagtgccatcacaaaacccaaaagaaacgttggaagaaggctccaatggcacggatgcg

SEQ ID NO: 75034 - DNA, 606 bp, Heterodera glycines
  Genomic contig location: Contig_ID=SeqID_11589; Location=704..1309; Strand=-
  SCN-specific regions: Sequence locations=1-29,52-223,246-606
atgatcaattcgaacaaaagcaaagaaaaaccaacggaagaagaaaaagcatggaccaatgcttgccaaatcattcaaaatttggacagtaaaaaaatcatagaaggacaaaatgaaattgcggaaattgtgaaaaatattggcgaaatgtgccaaagggaacggatcgccacggacagtgatgaaacgaaacgccaaattcaaaagtttacaacgaatggcccatttattctttcccacatgaaggcaacagagaaggaacttcaaaagttgaacgaaaaaaatgccaatgagaaatttcgtcataaatttgctcatttggcatcaaaattatgttcaaaagtattgccagaaggacattataaaaatgccgtaatcgaatttctgcaaataaaaaaggaccaaatgctctggccaagtgatttggcacagtttctccttgccaaattggatgattgccttgccactgacacatttcgccttcgtcggatgcgccgtgccttagaattggaaagctcacgagaagcggaacgctcagaacgctcaatttggtttcatatctattgtgtttttattatggttgccattgcaattgttttcatttat

SEQ ID NO: 75035 - DNA, 322 bp, Heterodera glycines
  Genomic contig location: Contig_ID=SeqID_11589; Location=1960..2281; Strand=+
  SCN-specific regions: Sequence locations=1-322
atgaccccgagaaacgatacgagaaccgagacccacaaaacccgagaaatttctcgactcgggaatcgagaaccgaaaaatttaaatgaaattgattcaaatgcatttcttaatcaaaaacacattaaaagggggtaggtcaaccagaatttttgcgtatgagtctcaacattaaagtaacagcatttttttgcttttaaaatcgtgacctaggcattataattgactcgaaactgcatttttcagaacatattaacaaaattgtacgaaacgcttatcttagagttttccctggtttttaagagtcttaaaaaccagggaa

SEQ ID NO: 75036 - DNA, 697 bp, Heterodera glycines
  Genomic contig location: Contig_ID=SeqID_11590; Location=754..1450; Strand=-
  SCN-specific regions: Sequence locations=1-392,417-438,532-697
atggcccttaagaaatgggccgcaaatttgcgtgacaagatccgaggatccgatcctgatctttatgcatacgggtacaggaaaaattggatggattgttgttactttcgaagaacagtgttgtcgtgactgttgtttgcagggtttttcgaagcatatctgaactaaaaaattattgcctttttatatccaaattattctgctggtcgcagttttatttatcccatattttttaatggctttgagcatttttcaattatttttttattgttttttatcttttagaaaggaaaattgtttggtaaacaattttttggggcgtttttttggataaatttatttgtttttctcgtcaaagcttattgcattttttttattacgaaaagcatttgcttcatttttcttttgaattaatgcacatgcaaatattgttttacctttttaaatattattttataatttagattccatcattgatttaattgtttttattttattattttttatgattatttattatttcaatattatgaatattctagcaacatacgtcaattggcatgtgatttattgaattatccgttgtcattaaccatacaattaattcctcgcctctcttttgcttttgtgctgtgccatttatttctcctacttttttacgcgcgcaaaatgtgataaaacgacgtcataaaataaa

SEQ ID NO: 75037 - DNA, 1167 bp, Heterodera glycines
  Genomic contig location: Contig_ID=SeqID_11591; Location=83..1249; Strand=+
  SCN-specific regions: Sequence locations=1-457,479-585,607-653,676 -1167
atgactgcgcagttcagcgccattgcggaacgcctgggtgaaattgagcgcaaaattaacaacaatggcattggcagcgcggaggagaaagaacgaaaaaggagccttgtgctcatcggtcttccggaatcggaggaggaagtgtcatcactgcgtgcgaaggatgacgcgaaaacggtggaggaagtgttggaccggctggacgtggaagtgtgcccgcaaatggtctacaggatgggcaggaggattgacgagaagaggaaaggaccgcgcttggtgaaggtggtcctgccagcttcaaccttccaacgttttgcgctgatgcagtgggggcgtcgtcggacggagctgaagaagagacctggatgggagcgtcttctggtcaggccatccctgacgaaggaggagttggaaattgagcgggaacagcgccaaaagaagtggatggaatttggaaagaagaaaacgggggaaaacatcacgacgcgacgcggaggcaatgaaaaaaacttttgaggtcacctccttttttaaattgtttatatttcaatgcacgaagtttggcgaacaaattagacaagttaaggtttttgtttttagaaaataggtttaaaatcattgctgtatctgagagttggttgagtaacaaaatagaaaacccccaaattttggaaaatctcccctattctataataagatcagatagacttaacaaaaaaggtggcggggttgctttcataatatcgaatttaattccttttgaaattatcaaaactacaaaaaacaaaaattccgatattctttgtgttgacctattttcaccctttaaccacacaaaaatacgttttattttggtctatagacccacctcccatgaaaaacaagaagatttcgaaaaattggtcgaacaactctctgttttagtctcggcttctgaaaaatgcattagagggatataaattaagactaatggtcaactcccctacacggggaaacaatttattagatttattatttacaaacaacgaaaatctattgaataatgttatagttgaacccccatttggtaatagtgaccataatgcaattcaattcagcataaatttacaggttaatagtaatgcttcaaaaaaattttataatttcaaaaaagcaaattatttgaaa

SEQ ID NO: 75038 - DNA, 226 bp, Heterodera glycines
  Genomic contig location: Contig_ID=SeqID_11591; Location=4071..4296; Strand=+
  SCN-specific regions: Sequence locations=1-13,36-226
ttttaaaatttcgaaaattttgaaaatttttcgagctaggcctaaaaaaaggttttcgggtttttgaattttaggattttttaacgatttttcccagagaaacggagaccacttccacaaacatagtttttcgagctctatcgactggtatttttttcggaaaaatttcgattttttcccggaaatagaaaaaatttctggcctgagcgggacatttgagtcccgg

SEQ ID NO: 75039 - DNA, 1563 bp, Heterodera glycines
  Genomic contig location: Contig_ID=SeqID_11591; Location=1909..3471; Strand=+
  SCN-specific regions: Sequence locations=1-9,31-116,138-247,283 -592,615-907,929-1178,1230-1563
atgactgccaaaattccagaaatatggaaaaagtcaattatttgccctgtcccaaaaattcaaaatccggtaaacccagtcgactttcgtccgatttccctgctatgttctgtttccaaaattttggaagaaaatatagcaggaaaaataaaaaattttgttgaaaaaaataatttgttaccaaattgtcaacatggttttcgtaaagcacattctgttactactcaacttcttgaagtggtggatgatttcagttttgctttagaaaatagaaaatcaattgatgtaatttattttgatttagctaaagcattcaacacggttccacataaccggctaatatctaagctccaaaacattggtataaataattccttattaaaatggattcagaattacttagaaaaccgaaagtttttcgtcaaaatcgggtctgatttctctgacgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcgatactgtaaattaaacggccttaaaatcgcttcaaataaatgtttaactttacatttaggacacaaaaaccaaaaaataaattattttattgatgactttccaattcctaaaaatcccggaaacgaaccagtcagagaccttggcatttattttactaatgatttgaaatgggcacaacatattgaaattatctcgaaaaaagcattacgatctgcttttgctatattaaagtcaatcaaaactggtgatacgaaaatacttgtaaatttgtttaatatttattgcagaccaattttagaatttggatctccaattttcaatccttatttaaaaaaggatattgaaaaactggagaatgtccaaaaaacttttttgagagtaatatttagacgtaacaattatgctgctgatttacctaattatgctgaattgttaaacatttatgatcaaaagtcgcttgagagtcgtaggttaaaaatagacttaaaactttttcatgaaataattttaggtaaaataaatttacaaaataatgaatccttttctttttccaaaaacattgtaaaaaatgaatacactataagaacagcttattgctcaaccaatgctagatacaattcgttctttattcgaacctctcgtctctatagacttttgcctaaagagacgagattactaaattctaatgagtttgccaaacttcttgaaagatctgatctgaatttgttgatttctttgccaccccagctccaaaagtgaccaattgtttgttttatttgatattgtttcattatttcttatttttcggcgtcacgcttatgcgtataaatgaatgaatgatgcccattttggttggagatatgagagattcatttgctcacccaactttttttgaggtcatgggaatagcctata

SEQ ID NO: 75040 - DNA, 3898 bp, Heterodera glycines
  Genomic contig location: Contig_ID=SeqID_11592; Location=260..4157; Strand=+
  SCN-specific regions: Sequence locations=1-280,302-613,635-655,751 -1246,1268-2721,2744-2819,2841-3747,3770-3898
atgtataaaaaacaggcaccattcaccggaaaattcgacaaacatttcgtagccgggggtaaatacacttgcgtgtgctgtggtgccgctctgttcgtgtcggagcagaagttcaactcggggtgcgggtaagaggtcaaaaattgaattgaatttccaaaatttgtgctttcgcagatggcccgccttctccaaatccattggggacgatcaaaacattgtccgactgcccgacaattcgtacggccgtcaacgaatcgaagttcgatggtaaatgtctaaaaattactaaatttccttttcatttaaatttcccataatttagtgccaaatgcgacgcacatttgggccatgtattcggtgagttttattactacgaaattgtaaactatccgttaaacatttgcaaattcatcaaaacctaacaataagatgacggaccgccggccgacggtgggcagagatactgtatcaacagtgtggccattgactttgtgtccgggcaacagaaatgaggaaattgagaattgccctttccgctgtgatccgtcattggccggtccatcatttgttacgagttcaaggggttttttctgtgcgcgggctagaatccctgagatttatttacaaattaatgaaaatgccggacagaccaattaatatttttttttatttgcttgtttggctatttatccaatccctttttcatttatttgtttgtgattttttggcttttgtatttatttttttcggttttcataataaatttctttggcattttgccgaaatgcttttggccgccttccgtcgcataatgttcagccaggacttggtcgcggaactgttgtccaaatacagcattacgaagcagcggattgtcatcgacttttcctctccgaacattgccaagacatttcacatgggccatttgaggtgagtaaggaggggggggggggagtcgaattgtttagggctttatgaatttgactgattgagaagtggaacattggcactgcttttgcttttccaggtcaacctgctacggtgattttatgcagcgcattttccgccatgccgggcacgaggtcagtgctttttgaaccaatgatagctgatctcaaacttgaacaagttggggaatgggattatgatgcccccgaatttgccatagattgtttcaattcattttctcaaaaaaatgattgtaaaagtcagtcacttacaattgacagacccagcaggatacaattttgattacactgttaaaaattattcattaatccgatataaaattacatttttgccccgtcctaaaggtggtctctctcaattatttgggcgattggggccatcagtttggactgctgacagtttattggatggaagtgatggacggcatggatgggcgaatggcacaaccaatggcggacgaatgggcggcgatgagcgcgcggaaaagggtacgaaattgggggaccaaaacggcatttgcttccagggattccctttcttttcgaattcagatttcaataaaaaaattaaggaaatttcaaaatgttaaaattaaaattttcggggaaaacatatggctgcatttgtaatggggggtgatggcacttttttacgccgaatttcaattttcaggtccaactgctcaccgacgcttatgtggcagcgaatcggctgaaactgaccaactcggcatttgaccagaaggcccgacaattacaggtcaaaaagctatatggcagcgattaagaccattttcaatctgaacgtaatattgacatttttaatagggcggacgtgtaatttaggatgagacaaaccaaaaattattttcagctgaacatggagcgccatatgatcagcaccggtgcggcgacagtagacgacgtcgatttggtcagtttatgttaaagcaaaggcaaaaatgttcattggaattattcttcgattttcaaactttttttgctatttcgaatttcattttccaaatctctctttctcttccccccccccccaattcctccgcctttaggcacaaattcaaaccgatgacaaattgcgcgaagcgtttggcctttggcgtgacttccgcgactcatcagtggcctatttggaggtggaattgccaaattcggatctctgtgtttgctcatttgtttcaggatttctatgctcgtttcggtactaaatttgaccgatgggatgctgagtcgtaccacgtggtggagggcgcccgtctgaccgacgaaatgattcagtccggtctctgccgactcacccgggacggttggcattcgaatttttctcgattaaaataatcaccggaatttctctcttagaattgtgggccgtctgtcagccggaggttggcttaggcagggaaaagatcactctgcgcaaaggcgacggactcaacctgtacatgaacaggtgggacaccgccctctgatggggtggacggagggcttcactacgaacgaagtccgacgggggacttaaccgagggggggggggggagttggacctaaaactacaaccttcaaatcccccgaaattctgcaatttttccttagatttcccgcgaatcaatggtatcttaagggccatcggaaaaaaattcacaaaattttcgatggttgcaccaccggctttttttctttgtgttttcacaatccaagttattaattgttttatcggcgtttgtttccccttttcagagatttggcttccatttatgcgcgacatcgtctttacaacgcggacaaatatttctatttggtggactatggccaggtcattcattcattggcttctaataaatgtgttttattattccttttcgtagaccaatcactttaaccaattgcgacttttgctgcgcatccgtggcgacgacgacttggcggaccgaatggaacacgtctctttcggtttttatttaaaaaaacaataaatcttttttgttttccgtcaactttacaaaattcaatattcgtctaattgtaacatttaaacggcaccttttattggtcaatatttaaatttgtatttctttccggtcgcatcatcggcctgtccacgcgcaatggcaaaaacgactcggtggactttctgattgaccagggcgcgcgcgaggcggatgcgtatgtgcacgcgtcgccgacgatgcgcgcggagccggccgaattgggcacaatttgccgacggttggccgagtcgacgctgctctttgaggtgttagcaccgttggaatatgtgggagacttttattgatatgttaacgggtggcccttcgatcgatgctaaaagttgtgtgaatggtccccaaatgttagtgaatttgcttgattgggttaattggcccaatccgtccgtgacttttggctggacaatgcgtttgagtccctccgttcgttcagattgtcttccgtcatcgaaacagtcacttcactttctcttttcgcaactcttttcgtccgggtggcaccaacgctttgctgctccatgtacgtccccccagggtctcctcgagagtctctactcgaatcatttcggggctatctccgaaagtgctatgcacactctcatggtgccgtttcaggagaagttcagtcggctctgttcgctggagcacgcccaccacgagcacatggaacgcatccgcgcattgaacgcggacggagaatggaaactgaacatggaaatgcgggagccgggacagaagttggctcggcgcatccaggagttcgacacggtggtgctgaccgcgatgaagaagatggacccgaatccggtggccatttacttggtcggtgatgacggactcgagtccaacctctgccaatgcttttccaataaaaacacgcgtcgtgccacactttcagcttaa

SEQ ID NO: 75041 - DNA, 57 bp, Heterodera glycines
  Genomic contig location: Contig_ID=SeqID_11593; Location=415..471; Strand=+
  SCN-specific regions: Sequence locations=1-57
atgaacggcttcttttcggtgtggcgacgaagatgggttgtcaaattgccagcacgt

SEQ ID NO: 75042 - DNA, 709 bp, Heterodera glycines
  misc_feature (18)..(18): n is a, c, g, or t
  Genomic contig location: Contig_ID=SeqID_11593; Location=180..888; Strand=-
  SCN-specific regions: Sequence locations=1-29,63-76,123-609,632-709
  Gene Ontology: Mol. function=transcription factor activity; Cellular component=nucleus; Biological process=regulation of transcription, DNA-dependent
agatttgcacgggccacnacattgacattcaccagcgcattcacaccggagaaaagccataccaagtggcaatatataaacaattaatcaattaattactcactaattaaaattaattaattgctctcccgagtcagtgtcacttatgtgacgctcgttttacgcaggatggccaactgaaaacgcacattttgattcacacgggtgaaaagccgtacaaagtgagattaaaagaatgtaactaaatcatgattagccgatttccaaaaataattcaattaattgccctagaaactgcaatgatcatccaacttcaaaactaattaattaaatgagtacctattaactgtataattaacatacctaattctcttcttttacattaatttagtgcacttattgtccccaaaaatttacacgtgctggcaatttgacaacccatcttcgtcgccacaccgaaaagaagccgttcatggtgtgtagatctggaaatacaaaaaagttaaaattgtttaaaatagatgaatttccatttttttaaatcgatgaatttccattttaattttcattttttaagtgttcccattgtggcaaacaatttgcagagtcaagcaatctgcaaattcatctgcttacacactacagaaaacgtaaagcaaacggacaattgagcaacagaatgaatgaattagtgccacaaaaaattgtc

SEQ ID NO: 75043 - DNA, 787 bp, Heterodera glycines
  Genomic contig location: Contig_ID=SeqID_11594; Location=374..1160; Strand=-
  SCN-specific regions: Sequence locations=1-45,68-100,155-160,183 -404,524-787
  Gene Ontology: Mol. function=protein binding; Cellular component =axoneme; Biological process=eye photoreceptor cell development
atggaggacaacaaccatcacttgctttttgcgcaaaagatcaatgaggtgggaaatgaaagaaaaggtcgaaaatattctcttctgtaaaatatttcagtaaatttttcatttttttataaatttgcaaatttttctaatttttttttaaaaacgaaaacaaggaaattcaattgcttaaaccccaaattctcgaaatttgcgaaatgaattttcatttcgcccgcccttttccatccgacatgctttaattgaaagcaatcatttaaaatattgggacattaataaataggatattaatttaatacattttacactttcagtgtgtcactgttgagcaagaggaagtgagaaaattgggaggggaagaagaaaatgagagaataaaggaagaattggaacaagaggaaaaggaagtgaatgaagaggaggaggaagaatgggaagaaaataatggaagaggggaggaggaagagcaagaggaggaaaacaatggaagagaggaggaggaggaagaaggggaacgggtgaaagatgaaggaataatggcggaagggcacgacaattacgggatggaaaatggcactgaatcgacacttggcactcaatttcaggcacatacaaaattttggcacaatgagaatttggaaattaaaaaaacaaatttcctcagaataagaatttttgaagacctattttttagaattttttattaagttatgagttttagtccaagttaattgctcaaacgatcggtttgtcagttttatggcaattttgaaataaa

SEQ ID NO: 75044 - DNA, 1352 bp, Heterodera glycines
  Genomic contig location: Contig_ID=SeqID_11595; Location=1175..2526; Strand=-
  SCN-specific regions: Sequence locations=1-102,126-158,187-215,238 -406,428-618,650-1246
atgtttgcaactgttgtcaccgcattggagcaccaaaagttgaaaagtgcgcacaacgcactgcagcaaaaagttgaacaaatggaagaaaagttttcgcagaaaatccaagaaaaggaaaatgaggtggaatctttcatttttacttttttaaactcaatatttaatttattattttatttttatgggaacatttaagtgacctctctaatcacattaaaataaaatttaaaatttcgtcaatttttcatttttaataccctttaaatttctgctgaagttttttacaatctttggaaactaaaagagaaaaaaaaacaaataattatattcatatttgaaataaagagaggaaaggttcataaaggactgatcagtataaaataacagtcagcaaaaatcagagcttttttaaaaatttaattaagcaattttttggaatgaaatttgccaaaattgaccaaaaactaaatacaaagtttttactctatttttttatttgtatgcctaattttcacagattgctcaagtgaaaagggcaaatgagagaatgcaaaagaaaatggacgaggcattggaaagaattggacgattaaacgaattggtgaggaaaaggggaaaaattaaaattttataataatttaaaaaagctaattttcatggcaatttttcgatcagatggaaagtcaaatgatacatttttatgagcaacaacagcaaaggttggacaatgatggcacatttattgccggcattgatgaggtgtgaagcaggggtggggcgcgcacagaaaaatcccgcggtcgcggatcgcgcatcgcggattcaatttgccgcggtcgcggatcgcgcaaaaaaaatcccgcggtcgcggatcgcgcatcgcggattcaatttgccgcggtcgcggatcgcgcaaaaaacgccgcggatcgcgcaaaaaatgccgcggatcgcacatttgtaaaagcataattagaaaattcccatattatcaataatcaaaattgtaaaggataatattatgatgaagaaaaataagccgttcgagattttcatgcgagagactttttcggaggtcattcaaaataaatcctgcatacaaaaaagtagagtgccacgggaccgggaatttttgccaaaaccgggaccgggacttgccgggacctgagaagccgggaccgggacctcgattttttttcgggaccgggaccgcaagaaaaaccgggaaccgggaccaaccgggaaattttaaaaattcaaaaaaattttaaaaattaaaaaaaaaattcaaattttaatttatatcaagtgaaaataatacaaaattatttggttttttatttaataaa

SEQ ID NO: 75045 - DNA, 400 bp, Heterodera glycines
  Genomic contig location: Contig_ID=SeqID_11595; Location=2585..2984; Strand=+
  SCN-specific regions: Sequence locations=1-15,38-54,80-152,308-400
atgaaaatgacaaacttaaagagaaagtgcataaaaagcgtcagcagaaagtgccaacacaaacaaaaatgccaaatgaaaaatggacaaatgtgtaggctgggcactgccgcatttgtcgattattatcaatttttgtgtgcatcgcttgcaaggaatggaagagaaatgaaaacagagaaagagtgagtgaaaaaaaagaatgataaaataatgaataaaatatagaaaaatagaagaaataggcagagaaaatagagaaagtaagaaagctaaggaaattaaggaaaagaaaaaaaggaaaagatcagacacagagcgcaaagacagagaagatgtatgtggtgttcaatgtgagaagaggtgagcatatgccgagctgctctagatgggtgagaaa

SEQ ID NO: 75046 - DNA, 145 bp, Heterodera glycines
  Genomic contig location: Contig_ID=SeqID_11596; Location=41..185; Strand=-
  SCN-specific regions: Sequence locations=1-85,123-145
atgaagctgatttcattggctccattggtcatttgttcattattttttgtggggacccctgtcgtgctaagtgacgggaaaggtgcgccaccgcctccgccgcctccaccaccgcctccgtcaagttacggtggacccccaccaa

SEQ ID NO: 75047 - DNA, 1968 bp, Heterodera glycines
  Genomic contig location: Contig_ID=SeqID_11596; Location=1032..2999; Strand=-
  SCN-specific regions: Sequence locations=1-163,187-256,278-337,378 -642,721-995,1020-1026,1052-1054,1076-1113,1135-1156,1220-1239,1261 -1287,1309-1357,1407-1613,1635-1686,1726-1945
atgaattttcattttcattttctattttcatttttttttgctgccactgtggtgatcggcaacacaattgattgctttaaattgaatttgagaatcaatttttcgaaagaagcagacctttatgtccgtttggttcccacttcaaaatttatttgcatacagtaattgttcgtgaaataaaaggagccgaaaaaattgtcaattcaaattgtacaaaatgccaaattgaaattgaagaagaaattcaaattctgggcaattattggccagaaaaaattcagtttgaagccgaaattcacacaaaaacaacaaatgaaagtgagggtaattgctttcgatttttatatatatttaaacaaattaattaattattatttgttccagtgattgtgcgacaatttgagctctttgtttataatccaaatttaaaaaaagttttggaattaaatcttggcaatttgacaactagtggtaaagttgaaaaaaatgtcatttttggcgaaatggttcctgaaaatgttcttttgtttggtgctttttttgtcgatttgggcaaaacaaatctgtccccgaatagacgagcaaaagaagttgttcatttgggaactgaacaaattgaaattaaacgcggaaattcaaatgtaattataatttctatttattaaaaaaaaattaaaaacaattgttaaaataattaaaaatatagttaaaaaaaatataccttttaacgaagttgtacatattttatttttctgcaagaaatttaattagcataattagtgagatccaattgatgaatctttgactttttaggctccgttctatggcactttcaatttaaatgttaatttgtcgaaagttaatggagcaataaacaaaatgaatttaaagatattcaaatttattgaattcaaaaatgaaaaaaatgaatttaacacctgccaaatttgtttacaggatttccaagaaaatgcacaaatagtacaaatgcattccaacagcaataataatgataatagcagtgaaaaggtaattaattaattattttagaattcttttaaagaaattctgaaaaattccggcctaattaacaatctactggtacattttgtattcattctgttttaaagaattttttctttatcacaaaattcgcaaatattaaatatcgaaaataattaatttaatcaattttatttacaaaatttttaaattatttctacatgaaaacatttttgataaatataatctttatgcataattgttgaaacaaaaaaactagggttataaaagtgtaaaaacatttaatactgcaaattttcagcatttgtcacaccgtgattgcattatcaataggtaaatttttaaaaacaaaaatattttacacaattaaatctttttttattctttagtataaaaactgataatttcaaatgcctgtgcggcttcaaattatatgaacaaagggtaatttaattctaattacaatcaattaaaaagtataaaaataattctttagtcctttaatttgccgccttttttaaccgcaaataacaatggaaatggacaacaacaacaacaacaatcaggcattttgtattggaattatcagcaaaagttgagcaaaattttggaccatgagcaaaatggcacatttaaacatcgccaagcagccggtgccttgaatgaaattaagcaatatattagggaattgaacaataaaattgccgaatttttcgggggcaaaggctatttggataaattgacactaaagcagcaaaatgacagcaacaaaattgcatcggttgacacggtgagaaatttgttgaaactaattgcgaaagttgaaccgggacaaaatgccaaagatttgttgcaacaagtcgaaaatgttggccaagtgttggatgcaattgccaagcaagcatttgacaccatggagatgatgacagaaaatgaatgaataaa

SEQ ID NO: 75048 - DNA, 459 bp, Heterodera glycines
  Genomic contig location: Contig_ID=SeqID_11597; Location=500..958; Strand=-
  SCN-specific regions: Sequence locations=1-122,147-160,184-459
atggacgaatttgataataaaaattgtcagtcaaaatccataaagcgacgaaagttttcattattaattgggcacaaaaagctgaacattcgtatagtcaatggtgagttttgtatttcctgtttttgttctcttttctttctccgtcccttcacaaatgtcttcaatttttccccatttttggcattaatttaaaatttgttttcagcgaattcgccaccccaacaattgccccccgctgatgtgccgttgcccttccaatgccatctttgcaccgcgcaattcctgaaacagtgccactgggcttggcactgtttcatcgcccattacggtgaacgggcggacacagcgggcgaaacactgctaatgacgagcacaggggaagagcacggagaagagagtgccgcaattggtacgaatgacgacggcataccatcattaatggtaattaaagcctaa

SEQ ID NO: 75049 - DNA, 674 bp, Heterodera glycines
  Genomic contig location: Contig_ID=SeqID_11598; Location=134..807; Strand=-
  SCN-specific regions: Sequence locations=1-178,200-211,239-400,423 -642,665-674
  Gene Ontology: Mol. function=AMP deaminase activity; Biological process=purine nucleotide metabolism
atgtcgcctttgtccaacaaccatttgttcctgccctaccagcgcaatccgatgcccgagtttctgatgaaggggctgaacatcagtttgtccaccgacgatccgcttcaatttcacatcacaaaagtaatacacttaaacgaaggatttgattatgttggattcaaataccgattagcattttattaattatttttcaatttccaggaggcactgatggaggagtacagcatcgcccatcagttgtggaagttgagttcgtgtgacatgtgcgagatggccaggaacaggtgggcgagttcaggcttaatcgcttttcgaattgcactgatttccctatcaatttcagcgttatccagtcaggatttgaggtcagtttggcacttttcctgggggtggatcattttcttccatttgtacaatttttttgctcatttggcaggaccgggtgaaagtgtattggttgggccccaactacaaggaggagggagtgctcggcaacgacgtggcacggtgcgttactgtacagtttcatttgtactgtccaatcgtagcaattctttgaaaaattgcaaaatttggcttttcagcaccaatgtgcccgacattcgcgtctcattccgtcacgaggcgttggtcagcgaactgtacaatttgttcaaggcgctgatgct

SEQ ID NO: 75050 - DNA, 1042 bp, Heterodera glycines
  misc_feature (1019)..(1019): n is a, c, g, or t
  Genomic contig location: Contig_ID=SeqID_11599; Location=1..1042; Strand=-
  SCN-specific regions: Sequence locations=1-77,136-141,166-331,367 -527,570-679,701-726,750-1042
  Gene Ontology: Mol. function=AMP deaminase activity; Biological process=purine nucleotide metabolism
cagtgttccgcaccgcgacttttacaacattcgcaaggtggacacgcacatccacggtgagtgatggtcatttcaacaattaaattgaataattattcaaaataatttttaatcattaaaatagattttaaaaatggataaaattttgaaattctctttttagccgccagttcaatgaaccacaagtgactttttggctttgatttgccggattttccgttctttgatcccttatcccttaaggcatttgttgcggttcatcaaaaagaaaatgcgcaccgatgctgatgaagttgtgcaggagaaggtacacaaataaatgcgtggcaacttataaattattttaaattttatttaattttaaatccgtataatttgtgatttgctccctaatttagaatggccaaaaggtgaccatggcccagctgttcgaaaaacttggcatccgagcgtacgatctgtccgtggatatgctcgatgtgcacgcggacagacacacgtaaaacggaaaatttgttgtctattttaaaatttcaattttcagattccaccgcttcgacaaattcaacactaaatataatccccgtaacattttttgtactgttttttgagaaaaaaaaatcaaaaatttcagttggccaaaacgaactccgtgaaattttcatcaaaacggacaattatgtgaagggaaaatattttgcggaagttatgaaggaagtgctcaccgatttggaggagagcaaataccaacaaatggtggggagaattgggggggggggatttgggattattaaaacataaaaattgaatcgtcggcaaacgatggaaaagactgagaaaggagggaaatttaattgcccaattaaaccaaaagagtataatgtttttaaattgaaggagccaagactgtccatttacgggagggcgaaggacgaatgggacaaattggcacggtgggccattggacacgatgtgagtgaacaaaattttcaaaaaagaaatgatccagtggcacaatngtgtcatcccattgatcggaaag

SEQ ID NO: 75051 - DNA, 631 bp, Heterodera glycines
  Genomic contig location: Contig_ID=SeqID_11600; Location=135..765; Strand=-
  SCN-specific regions: Sequence locations=1-75,100-162,190-631
atggctaagaaaagtgtaataaggaaactacaaagcaaaaaaggggcccaaaagcgttggactaaatgggagaataagcgagaggagcgacaagagaagttggagagggcgagaaaagccaaatccgcaaagaaaagtgagttttccaccaatttttaactcaaaaataattttttttttttaattttagccgctctacagccgaatcccaatgccgaaacgccacagcaagacgaagcaggaccgtcaacatctgctgcatccgccgaagaagcgatggaaccgccgccaccaactccaggaccagggccaacgccagaaatggacgaggaaattttggaattcgacgacccgccgccgtcgacacctgccacaccaattggcgatttggtgccgtttccgtcaacaccaactgcgccaatggacaccggagagacgaccccgccaccgctggccattgacgagcgatcagagcgcatcgaacaactggaaaagcaactgaaggaccgggatgacaccattcaatttctgcgcgagcaggtccgaaaccgagaagcgctgatcagtgatctgcgtcgtcagctggagcaatgtgcggcaccaccaacggcgacaccaaccaccagcaaaa

SEQ ID NO: 75052 - DNA, 76 bp, Heterodera glycines; identical to SEQ ID NO: 51705
  Genomic contig location: Contig_ID=SeqID_11600; Location=994..1069; Strand=+
  SCN-specific regions: Sequence locations=1-76

SEQ ID NO: 75053 - DNA, 1683 bp, Heterodera glycines
  Genomic contig location: Contig_ID=SeqID_11604; Location=158..1840; Strand=-
  SCN-specific regions: Sequence locations=1-288,324-1241,1264-1683
  Gene Ontology: Mol. function=catalase activity; Cellular component =peroxisomal matrix; Biological process=determination of adult life span
atggcacactttgcccgtgagcgcattccggagcgcgtcgtccatgccaaaggcggaggagcgcatggctattttgaagtgaccaacaaggacatcgccaagtacagcaagactgccatgtttagcgaagtcggaaagcggactccacttttcattcgcttttcgagtgttggtcggtgctttttttttgttaaattagaaaatgatacccacattcttcatgattaccagaaaatattagtttcagatattgtttctcccttttggttctatctttttatcttcggcaaatttttctttttcttttaaaaaataatatttttcctcaatttcttgcataattatcggcatccgcgagtttgtactgtatactttttacaaaatgcctcgactctgcgaaaatttagttttttttccccgctttaggtggagaagccggaagcgcggacactgctcgggacccgcgcggtttcgccatcaaattctacaccgaagagggcaattgggatttggttggcaacaacacacccgtgggattctttggcctttcaattctgtgtcaaatcaaaatgttttctgaagattttcttcattcgcgatccgtttctctttccgaatttcatccatacgcaaaaacggaacccagtgacgcatcttaaggacccggagatggtcaattgttattggcagtaacatacacataaagcaggaagaacttcagatgtgggatttttggacacttcgacccgaagcactgcaccaagtgatgtttctgttctccgaccgtgggactccggacggattccgccacatgaacggtctgtcgaatgtgtgaatttgtttagccacacacaatgggaatggcctgttatgtaagttgcgtcacctttgtttaggctacggtagtcatacgttcaaactcgtcgacaatgccggcagcgccgtttattgcaaatttcacataaaagtaaaatcctttaatcatccactcgaacgcacttcgtcctgttaagactcgccaaggcattaagaatttaactgctgagaaggcccttcaattggcagccgaagaccccgtaagaattacgaatggttattcagtgtaattgggatgggtttgctcaaggattacgcaattcgcgacctttacaatgccatcgccagcggagactttccccaatgggacttcttcatccaagtcttaccatacattccttttttgttactccatctctcttttgaggttatgacctttgaagaagcgtcgcgttttcgttggaatccgttcgatttgaccaaagtttggcctcaccgtgacttcccattgcttcccggttcgttaaaatatgtcccaaaccaaacttaatgtgctttgatttagttggtcgaattgtgctcaatcggaatccgcagaattacttcgctgaggtagaacaatcggcgtttgcccccgcccgaattgtgccaggaatcgaattttcgcccgataaaatgttacaaggtgagcacgtgttcgaaaagcatgtctgtatcttcattcagggcgcctattctcttatcctgacacacaattccaccgactcggcccgaacttcatgaagttgccgatcaactgtccgtatagaactcgagtccgcaacacgcaaattgatgggtgggcatgctttgatgacaacagaggtg

SEQ ID NO: 75054 - DNA, 236 bp, Heterodera glycines
  Genomic contig location: Contig_ID=SeqID_11606; Location=1653..1888; Strand=-
  SCN-specific regions: Sequence locations=1-236
acaattgtccaacttttcgcattggtcgtccaatactcgcaaagttcgaattgggagggacgcgtcactgctgccgaattgctcaatgcgttgctggaggaaacggacaaaaatttcgaggacgaattggtcaaaacaaaagtcaaattcaatcgggagaaattagcgcaatgtttgcgggccatcgacgccctttctatgcgtgaagtgttggacacgtatcgaacgttggtcag

SEQ ID NO: 75055 - DNA, 4161 bp, Heterodera glycines
  misc_feature (132)..(132): n is a, c, g, or t
  Genomic contig location: Contig_ID=SeqID_1648; Location=522..4682; Strand=-
  SCN-specific regions: Sequence locations=1-528,556-1061,1085 -1353,1375-1668,1690-1875,1899-2120,2193-2868,2891-3171,3193 -3288,3310-3684,3706-3833,3858-3914,3936-3976,3998-4161
  Gene Ontology: Mol. function=cation-transporting ATPase activity; Cellular component=integral to membrane; Biological process=mitotic spindle orientation
gtcgtaacgtttatttgatagaaaatggatgccatttatttttcgtttttccaaaatttctattgttgggaaatatgcatagttttttgtttatttattttgtaattggcaggctaattaattctcgatttntaaaattctaggccatcttctcttgcgtgttttatttcgcgtcagtgtctctgtaccagggcattttgatggttgcgtaagtttattgtatttttttaatatattgtataactagcaataaacagtgaggtattcaaagacaaaaatcccatgaattttggaattttcttatttttttacactcccaaattttcatttactctaattgttacagttattccaccgcttacacaatgcttcccgtcttctcgctggtggtggacacggatgtgacggcaaaaaacgcactgacctatccggaactgtacaaagagttgggcaagggtcggtcactgtcctacaagacattttgcatttgggtgctgatcagtctgtaccaaggtgttcgtccatttgtaatttttaaaattaatttttataattgaaaaacaggtgccatcataatgtacggggcactgtacgcctttgacgatgacttaattcacattgtttccatcagtttcaccgctttgatcatcaccgagttgatcatgtaagtcacgacgaatcattggcatggacagacgaatgtgaggggaatgaatgaattgtgtacccgttcaacaaatcttggagatgttcaatttcatgtttaattttgaaaaattaggcttgaaaagattaaaaaaattttcggcggcaagattttgtcccgtccccagatttccccgcagatcattcccttttccccaggtatattgtatttgtctttttagggtcgccatgacagtgcacacttggcactgggcaatgctggtagcacaggtaaacaaaacctcccttgtttaccttggtcttggtaattgtcattccccccccccccttaaaggccctttctctgacactgtacggcgcctcgttgatcatctttgacaagtattttgaccgccaattcgtgctgtcctgggagttcttggccaagaccaccgtgatcacgctgatttcctgccttccgctttacgtgatcaaatttttgcgtcgacgtttctccccgccgtcctatgccaaagtgaactaattgaactgacgaactgatcagtcagtcagtcactccctctgcccatcagtcgtcacaaattgattggtaattgaattgatcgattgggttgatcaacagccaaaaagtgatcaaatttttttacttttgacatttgattacgcgtcaagcatttttttcctgttaagaatttctctccatattttcttcattttacaacaattgtaatgtctgtccgccacgctttttccatccaatttagttaataggccattttgacgatgaaaaattaattgaaaaaaaataattccgttattttttttatcggatggattgacttcttcaaaaatgacgtactcaacacaatctgccccccatcctttgcatgcaaattttgtgacttctctctttttttgtgtattgccaaatttacgaatggctaattttttgaaaatccaattttgtctctcgaaaatttcggttttaaaaaattttctacccttcacaatgtgtgttattcatgtacaccatgtttttcttgtccggggttcgcctactagtcgggttgtgccgtgaaatgcgaatttaaaaattcacaccccaattttcaacagacatatttttgtatgatgtattaaatatacctaaatttatacccaacccttataatccatggtacatatcaggggcctaatcggaggcccccaaaaattttaaatttggaattaaatctaaaaaaactccggttaagcccctggtgaatatttgctaaatgtgttttactacaaaactcctttttgaccttacaaattagcaaatcattgaaagctcttcaatctctccatctttgaaaattgtattatcatactcttaataaaaaaattaaattcctagatcatttaaattgttcaaattttaattgttgttgctttcaaattttaattgttgttgctttaaaagtgcaaatttatttcatttccaattaaattcaaatttttctcactttttctgtaatttggttttagctaaaccagccaaacagataaacgacgacaaatgggtgtcgccttcgtcctgtgctgtttctccgtcgcctttacgccttcgctgttcatttttcgccgtttcgttgcccccgacccgttgcgcatcattctcttcgtgctcgggtgggttttcaattttgggcattttccatcaaaactcggcactttaatgttcccattggaaagtatcgccccggagttgtgaaaacggattcacaatacaacaacaatgaaatgtgccccattttcagtgccttcttttggctctgttctctgctgttgtccgccgtcgttttcgccgtgttcggccaacatctgttgctggtcgccattttcttctccattctgttccaagaagtggcgcgcgcactcttctacctgttgttgtacaaaacgcaaaggtgcgaaaaccatgggttttcaaaaattttaaacgtattttacgcgtggaatagcaattaatataactcgagtttaaaagcgaaacaaaagttctttggttggttaccaacaaattttccatattccaaatactggacgttcttaatgtggacggttgtcctgtttttgggcgggacgcagcgcgttttgtttttcaacccctcgaacatggccttatttttaaaagggacataggttagccctatggtatttaaattaaaaatttgtgggaaaatttactcggcggaatgtaaaccggtcgtaatttctcataatattcagcaatttggcccgactgatggccgccgatgcgaaccgcaccggcacagtgtccagcatgcgcttgctgtactcgtcccggcacattttggccattgtctgtggcctcggcatgggcaccgctgcggcactgtttcatctggccaacgtgttggccgcctattgggacgacggcgttgtgggcctgccgggcgctgtgcaggcaaatcgtaccatggccgaaccaacggacgcgtcagcaacggcacagccaaacgcagtgccattggtgagcataataaaatactttacccccccccccccccaaaaaaaaaatttttttttgaggctctagcagaaccgtcgaacaacaaaataccttttaaatttttcagtttgatccatttattaaaaaaatgctctttttgtcgaaaaattgataatttcagccccatcactctgacccggccattcttctctctgccgctgctgacggtggcgtcaccgccgtccccggcaatttgcacccgtccgacgcgttctttcccctgttctatgcgttgggttgtgccctgctcacactgttcaacattgtgtggaccgtctgcagttgggacgcctttcaccggtgctgctacaaaattggacggccctccgcgtgggtgaccaccgccgtgttcacactgtgcagccattgtgccaacaccggaatggtgggtttgtttgttgctgttgatgttcctgttgttgtgcattgattgcaggtccgtagccaaaacaacacaaaaaattcggagggggcaatccgaaggctttttttctctttgggccaaaaatttttttctccaatgttatttttcaaaattttcaatgccggggcgaaaaagcaggaatttgtagcggttttcgaccaaaaaataataaatatatatatatatatatatgtggcagcatgttgtgctaaaataccgaaaaaggaataataatttaccgggtgctgactcctttttaattactaaattttggtattaatcactgatcaatgcaacatttttccacagcaaatttaaattaaagagataggaaaatgagtattgtccaccatatatttgtttgtttgtgccacagagtctctacttgggcgtgtccccgctggttgtgctttcgcttcaactgtttctgcttctgctcggcgtcgtctacgcttattttcttattaaacgcacgtgaaaaagctgtagtaattaa

SEQ ID NO: 75056 - DNA, 665 bp, Heterodera glycines
  Genomic contig location: Contig_ID=SeqID_11608; Location=718..1382; Strand=+
  SCN-specific regions: Sequence locations=1-3,27-200,223-277,316 -513,543-544,574-611,633-665
ttgtgtcaaatcatcctcactttgttctatggttatcgccgtcgaccacgtgtccgttttcctaccaatgtaagacccttcacaaattttggcaaaatttttttcaatttttaaaggacactccgctctcgccattgcgccgctttcctccaccaccgccgccctcaattgcaattcgggcaacaacacagaaagtgtgtttaattttgtttctgtttgaacaatttgtattagcatttaacattttcaacaggatcagcaccacacggatgagcgcaaaaatgaacagttcaaaaagagggaggaaccgaagggggcggaggacggacggcacaatttgcacaactcatcggtggttaaaaagaaaaccattgttatatttctaataaaattaaagaagcccaggacgtttccgttcaacaacaaagcagtgatggatgggttgccaaacaacaagcgcaacaagcacaagccgttatacggtatttgtttttgttaaaaattaaaaaacatcacaatattattattattattcagctttggcaagcatcccggaggaggaggagacaaaaaagaatggacgtgaaaagccggcgctcgtgaaggatgacaaatatggggacaattattttgaggactgctattaccagtccacttgggtctag

SEQ ID NO: 75057 - DNA, 498 bp, Heterodera glycines
  Genomic contig location: Contig_ID=SeqID_11608; Location=1456..1953; Strand=-
  SCN-specific regions: Sequence locations=1-64,86-498
atgtccccatgccgtcgttttaaatctcgcccccagaaaaaaaattccgaatataaatggcttcatattgtgaagcgtcaaaaacatcgccagcagcggcaccaacaaaaccatttcaatgaaatgtgcgtggcatttcagagtatggaaatgtcggaatcggcaagaccccctgcctggtggaccaataaatggaccaaagtccttcggtagaacaatttttgatatgcattttcagttcttactgtaatttttaataattttaggatgtgcatttctgaaagaagatatcgacaaacagatgacgaatctgattttcacaatcacaaaaatcgaagagcgctctaacggactacccgacccgcaagcggcgcacctttatggaatagtcaaggagcagctcgaaagaactgttcgtcaaattgagaaggactgcttgtgaatcggtattgatgatgggaattattttgatggtgatgggattattttttaaataaa

SEQ ID NO: 75058 - DNA, 2634 bp, Heterodera glycines
  Genomic contig location: Contig_ID=SeqID_11609; Location=77..2710; Strand=-
  SCN-specific regions: Sequence locations=1-164,186-191,213-341,364 -539,626-658,680-962,990-1231,1253-1524,1546-1778,1806-2234,2291 -2294,2325-2592,2614-2634
atgtttgcatggaagcaaatggtggaggaatacggagataatttggcagatttatataaaataaccgagcgagttaacaaaaaatttggactttgtgttatcatcgaaggcgaaactcgtaagcattcaaaacaaattaattatttttcgttttacaaaaattaattacttttttcctattggtttaattcttcatatttttattttaacaaatttcagaattgaaatgtagtgcgattaatgttgaaaatgcggaagtatttgtcaatcatttctacaaaattgtttttgagccagaatttgaaaaaaatttggcaaaaagatcagaattaattgctacaaattttttcaatttgttgagaaccgaacaaaggaagagcttccaggatttggaaggagaaaacgaacaaaaagcaaaaaataatgccaaaaattggaaattggcagagccatccatgcgcgtacgggtccaagtgttggtgaacacggcgggcacaaagtgccagcaactgataaaatcgcattacaaattcgttagtaacaaaaataaacaaaaagttaaggaaacaaaagcaaaaaaattgcaacaggaaaacaaaaatcagaaagataaaaagaaaaaagacattgatagtaaaaatgagcaaaatctgacggaggaagaggaagaaagaaaggatctcatgacagaaaattacacaaaaaggctggatgaattaaactccgattttgccacttgcatttaccattacatgtatgcattttcagagaatctgatcaaaaaaattgaagatataaatggtgaaaattcttacaacaaagaattgaaagacatttataagaatttgaggcaaaaaacgcgaaagcgaatggaatcagtttataactccgagggactggaaaatatggacaaatggctaaatggggagaatgaaccgtcggcatcaactgctaaaaagggggaggacgaagatgaaaatgaagaagaaacatgggaagacccgtttaatgattgtgccaatgttgtggaggaccacgttgaagcagacactttaatgaatagagagggtgaaagataatattcaaaatcaaatacattaaaattcatgttaggtgacaaatttacatattagagtctggcgtggtgataggcacccataggacttttttttatctttttcgactcgaatcagtttagaacaacagccctatgtttagatccgcataaattcctttaaatttgcttttcaggtgaattaatggacaaaagctttgatgaccatctgtttcaatgtgctagccaattttttgaggctgttcgtagagatcaattcgactataaattatttgttaatcaacatacgatgcaattggacacggcaatgaaatttccatcgtctatgaatggaatacaattgaataatggacaaaacaccaaggacaaatgcttaattatgcggtattttaaaatggaggatcaaattagagaatgaaaatttcaaatttacggatatcgctgcgagattgaaactcaaaattaatttaaatttgcggatcttgctgcgggattggaattccaaatttttcgggacaggattccgaaggattaatcctcaaaacctcggaaaatccggatttccaaaaaggggattgctgctccgggctctagataaaatggctttcttcctgctatttttaaagccaagtctattaatgtttatttctacgggttattcgtatcttactgatgttcgctttacgtaccaatttcattgaaaatgatgacaaaaatgtttatttctctggtttttcagtgagttattgctgtcactaaatcagaatttggcacatcgcctgaattatgagaaaataacattgcgcgaagaaaaggaaaatttggtgtcattgaacgaaaagtacggcaagctacgtctggacaaaatggacaacaaatggctgctgcttgaaataggcaaaaaaattgggcaaggatatgagaaatggcgcttgacaaattcgttgggtacacttacgcatccgatacgggaccaataccgaattggacgcgaatttgtgggacaaatgttggaagattatgggataagtgacacgtataaaaagggacaagaagcagtggtactgacaataaacaagcttagtgagtcattgggcactcctaaaaaccaaaagacgaagatagatcggaaagaggatggtcctgtaaaggatttaggtaaaataaataaaatttcttagagtaaataacaatttttaaattaatattaattttgcatttgaagatataaatatatttaaggaaatgagaagatcggacaagtccgaaaaacactgaaagaatgcatagaagaggatcaggacaaagacgaatgtgatcaaaaaataatggaaatgcagataaaaattcagaaacatccattaacaaaaagattggaagcatacaaaatgtttttccgggccttttacatcgctttggcaatggaattatttgaacgaatgtcaaatcaggcagaggaaaattggcattttgtatttagaagcaatgagaccgaccaggtgggaatacttactgaaaaagacaaagcaaatgtggcaaagatcaaagagcaacgggaa

SEQ ID NO: 75059 - DNA, 438 bp, Heterodera glycines
  Genomic contig location: Contig_ID=SeqID_11609; Location=3517..3954; Strand=-
  SCN-specific regions: Sequence locations=1-89,133-405
atgctaactaattacatgcaactgtttcttctgacgcttctgctatttgtcttcatgaacaatttttctgaaggtaagtgttaatttggaaaaaataattgaaataaaattatttaaatattcaaaaatttagcaataaattgccgtaacttttccgtgaaaagtgcccaatttgctgccgaaaatttccatcaaatacccatagaaggaaaaggcaaagacaaaattgtgcaaaattttgttgaatcaatcaaacaaaaaatttcggagagtaaaaaggcggcaactgatcaaccgaagaaactcgaagacataattggtgatccggacacaattgtgaacaatgccagaaaaatgatcacacttgcaactcgatgctcgctatcgcgtgaagaggtatgattcttatataatatttaattaattaatataaataaa

SEQ ID NO: 75060 - DNA, 174 bp, Heterodera glycines
  Genomic contig location: Contig_ID=SeqID_11610; Location=458..631; Strand=+
  SCN-specific regions: Sequence locations=1-174
caaaagccattccctggcggcgttcacgtgcgtctgttgccgaacagcaaaaacaatggacgaccactgattcagtcggccaacatcagcagcaccaatggagaacaacagaagaatctgatcgccgtcgtcgagcagcacttggagcagtacaccaaggacctcgttaaggaa

SEQ ID NO: 75061 - DNA, 1894 bp, Heterodera glycines
  Genomic contig location: Contig_ID=SeqID_11611; Location=41..1934; Strand=-
  SCN-specific regions: Sequence locations=1-57,98-211,254-289,313 -502,587-756,799-890,925-1001,1023-1208,1243-1894
atgaaagaaacgcaaatgaaaaaagaaatcgacgaattaacaccggaggtatgaattaaattgtattttttgtcaatttttaaaataaagatttttgctgggacaatgcccatttatgccattagttttggcgttgtgacaatgtttgggatgtttttcaatttttccgtcattttcatcacatttcggacaaagtgtcaatcattttgtcaattaataataattaaagtttaatatttttttcaaaaaaaaacattttcttcccccaagggcactccgtggctccgtcaatattttgttggcattttattcattatgcgaaattgtaaatttgtgtggcaattttctgacaatattctccgcattttctggccaatattttgtgtcatttaaaacagccgtttattttgtggttattcctttaacaagcagtggatgcgcagtgaatttaatggtttttaccggcattgaacgattgttcgctgtgctttttccgctcaagtaaaatatgtaaaaaataataattaaaaacaatatttttatatcaaaataaaataaatgttttcaaaattattttatttaataagaaagttgaagaaaacatatatttttgccattgttctgatggttaatatggtgcaaatcattgcatcgtcactcatttatttaaacggttacgactcgcaaatgaattcgcttgaaacaattgacaattattttttaattatcggtcgcattttcaaatcagttagtttcatttaataataaaatttttactaatctctaaaattataattaggacttcttttttatgtaagaaaaatcgcgaattatgtaaataaaatatgtataaaaatgataaaatatgtatggaatagctataaaaacccaaaaatatataataaaatatgttaaaaattttttgatcaccttttagtattaaaattttttttttcatatctctttttttgaaaaaacccattttcttggggtacattttcaaaaataaatttttattatttcttctataaattctcaaaatatgtaaaaaaaatgaaaacatgtatgaaatatgtagaacaatcacgaaatatgtaaataaaagtccaaacttttgttcgtaaacacaaaaaagaaagggttttcctactatttcagagcatagagaatccaggaaaaatatgtatttgcatcaaaaaaagaagccctaattataatattaattaacatttattaattaaagagccactgggcaaccaatgttcagttggaaggcactttttgcgtattcttttcggtcattctttacgcattaattgctgttgctgttcagtgccgtaaaggtttttcagttaaaaatatgcaaaattatgtatttgccaattatttgtcatttcagtgccttcaaactccaattcgacccaatttaataatcgtattttccggtcgcttttcgcaattattttcgccaattttggcggttatctctttgcttgttccgttgctttaatatacaaattattgaacattaatgaaagtaatgcgattgttttgtggcattcttcacagattgttggcattttgtgccacatcagtgcttcgtcaagtggcctaattctctatttgacaaggtcaaaatgggtcaatggcaattcgtacaataaaatttttacaaaaaaagcttaagcttaggcttaaaccgaaggcttatacctagtctaagcctttgtacgaactgccgtgacatcgataaaatgttaattattctgttccgctaattgcttttcagttccgaatatcgcgcagcttttcagaaggaattttcatttctgttcagattattctcaaatagcagctcttctgtggtcgttcctcaacattaaaagccaataaa

SEQ ID NO: 75062 - DNA, 491 bp, Heterodera glycines
  Genomic contig location: Contig_ID=SeqID_11612; Location=121..611; Strand=-
  SCN-specific regions: Sequence locations=1-435,473-491
atggcactcggaggatggaagcgcgagcgtgctcgactccgttctctacaaaacctgaaccgcctgttcgtccgcccagcgctgaccaaagaacaactcaaggaagaatatgaagcgcgcgtacgtccgagtcgaaagacggcggttggttgggcctcaacttcaagatggtccaggatttttgtggcggcttccctgtcttcctgaacacgttccgatgggcgaatggcattgctttccgggaggccaatgaagaccagggtgcgttgtcgttcttgctccgcgagtgcgatagcgtttgggtccaggtcctgtgcaggtgccattgaacgttttgcgcgaggcggagtgatgtttgatgcgttggttcgcttcatgtcgaataattagcaagaataattgttttttgcgatcttatttggactacagagagacaaattaaattaattatgtttgaaaattaataattttagacctattttaaggtgtaa

SEQ ID NO: 75063 - DNA, 2336 bp, Heterodera glycines
  Genomic contig location: Contig_ID=SeqID_11614; Location=73..2408; Strand=-
  SCN-specific regions: Sequence locations=1-151,174-186,211-242,265 -284,307-328,393-659,681-1465,1489-1574,1597-2239,2261-2336
atgcagattcgtgatcagggactccaaatcctccgggaacaagttaataaacaatctaccggacgatccatccgtagttttcaccaaaaaaaagaatgaattgagccgtaaattgacgaaatgccaattttttattttgagaagattaatgaaaattttaaattcaaaataaactcgtgggtcagattttactcttttttcatttctcttgttgtttaaagatagaaagaatttttttctagtcaattaatcaaaataaaccttggaatacttcgaaagctacatgtttatttgcccagccttttctaagattttgctaaaccatatcttaaaatttattaaaattttaataaaaaccaaattattagaattattaaaacttataaaaaattcgttcacagttgatcggttttgtctgattttatcataaatgatagagttcagcctttgttccaccatatgtgtggcgtttggcggttctcaaacataacgattttatttttgaggaaatgcaacgaaatacagaagaaatggaccgaaagttcgaggaaatggaaaaaagactcaccacaaagtttgaacaatttcgcgaggacacatttgaattgctcgacacgattgttgagcgtatcgaagacggcaacaaggaaattgcccacttttgtcgacacacagcccaaacgatggacttactggcacttaacatcaccaccagtgtgtcggccttcaaaaggcgcaaacaacagtgcggacaggttttaagttcactgttttgtaaaacgagaagaaaagcatgtcactatcaaaataaatttccaacaaaaatgcaaaatactcaactggcaaaatgttggttctgtacattcatggttgaaaaattgggtttcacccaatggaacattttctttgggccgagcgctgactcgttgacataaaacatcattaattttggcaacatttttgctataaaatttgcgaactgtaaaaaattttggtccttaacaccgagtggttggaaaaacgggtttctccacatttgagggaaaaagctaatcctgagaaaatactaaacttgttggcgcattgtataaactttaggacactgattcagccatgaccgctgaaggaacgttcggcggcggtcaactgaccgccgctgctccgtctgccgccacatcggccgcacgcggcggcgaattcagtgcgaaagtaaataattttgaggctgtgtaccgtcaacgacgtcgccgatctgcccaaacgacaaagtatatacttggtcgctggcttaattcactacgacttaggcttaattgggtcgtcccccactctccttgtctcatattcagtttttcaaaaaaaaaatcaaaagaggtctatttgcaaaatttttagccgattttcgccaaaaattactattttcgccatttggtccctatttttcaaaatatgctaaaatatgagtccccgccgggaaaaataaataaagcaatttgttaagaaaaattacttaaatttcaaaatgctgaaattttttactttttcgcttcggaggggggggggggggtgttttagctccctcaaatcccctggatacgcccttagtggttggttgtggttgtcctcatttgtcaactagggctggaggagcacctctttcatttcaatctgctgtccttttgttaaatcacatcaatttacgcctcaggtttcgctttcgactgcgattcgccaagggcgactggacaatcccggtgtcgacagcgccatcaagtcaaattgtgagaagtcagacaaagcacttttttacgaacatgccgagtctcttcaatctctgctgcatgattttcctcgcaaactgcgcaacgaatgcactgacagaacgtcgatcaacattggttcgtttgtcatgcccggggcagctcgttctccgtcctctctcatccctttcagcccctcttcaatttccatcaaaaattaaatttttttttcttacatttagagttttcatcagtaagatactcagttttttcaaaatcaaaccattaaaaaaatttagtttttcttttagaaaaactaaattttaaaataagaatttcgtgttttggcaaattttttagtgccataccataataaaagtgccatttagctatttccgactttgaagcgcgattcatgtcttctttggacgagatgaactctgtcatgaacggccttcgctcatcaattgacgctgaagaagttgccaaattaaaagaaattgttcaaactttgtctaagtgggccttgcacattcatgagaaggctgaaaatgtgtcgaaggtttccacaattgg

SEQ ID NO: 75064 - DNA, 68 bp, Heterodera glycines
  Genomic contig location: Contig_ID=SeqID_11615; Location=932..999; Strand=+
  SCN-specific regions: Sequence locations=1-68
gacataaacatttatttgatttattttaccatattcacaattgatcaaaatataggtggtcaaaaagt

SEQ ID NO: 75065 - DNA, 816 bp, Heterodera glycines
  Genomic contig location: Contig_ID=SeqID_11617; Location=389..1204; Strand=-
  SCN-specific regions: Sequence locations=1-192,214-468,491-495,517-816
atgcgctggccgattgttctttcaatttttcttatgggtatctatcggacggaatccatcctccatgaccatttaaagatcagtaaagacttgccggtcgaatgtccaaaggaattgtctgtttcgataggccatgaagtttcactcgtcttatcatccaagtttgtctatcttttaatttgaacaattccattgttttgaatttatatttttcaggaaaagatttgagtacaatttgaacttggttctgaacacaagttggaccgtgctaaaactgacacccgaacgaattactctgaaaaaagaaaaggactctcaagtgcaagtgaatgtcaccggtctgtccctgtccagccgaacttatattgaactccaaaattgttcattggtttttgacaatgggtcatttgctgacatttgcccttttgagtgagtttatcattaacattagcattcattcttttcctaatgatgtcaatttctttcagtccacttgatttctttatccccgtcaccgtggtcagaagtaaaacgatctccgttttggtcattctctccggatggatttatttcgttgcgtgagtccctttccctttggccaattgtccgcttctcttcaggtggagtatttccttctatccgcagattattctcaacttccagcgaaagaggtggtgtttgtttcggttttttgaatttctttatttatttttcagtgtcattggtcttaacttcgattttttgctgctgaatgtcattggtttttcctgttacactgtttataatgtgttgctttatttcgatccgaatgttcag

SEQ ID NO: 75066 - DNA, 277 bp, Heterodera glycines
  Genomic contig location: Contig_ID=SeqID_11619; Location=190..466; Strand=+
  SCN-specific regions: Sequence locations=1-277
caaattggttgataatttgcggcaccggtcgctttctgttgaccaacacatagggcttgagcttatgtccattgctgcgggcttttgcagtagagaccggacaactggggtcggagggatcccgagtcgggatcccgaccgaatcccgatcccgatgaatcccgaagatttttttcgggatcccgcgggattatcgggatttgctaaaacccaattttttttaaatggctttttaatttttagttttgtgctaagttttgttcaagtgcttatctaa

SEQ ID NO: 75067 - DNA, 400 bp, Heterodera glycines
  Genomic contig location: Contig_ID=SeqID_11619; Location=875..1274; Strand=+
  SCN-specific regions: Sequence locations=1-271,293-351,373-400
atggagatttttcgaaaaattatcgtgacttcagtcccgcgggatcccgcgggattggtaaaatggtcaggagggatcccgattcgggatcctgatgaaatccttatcccgatcaattccgatgaatttaaaaaatcgctcgggatggatcccgaatttaatcccgcgggatcccgatcccgtccggtctctattttgcagacggaacagctgtggcttcctccataaattgcgttacaaacacagcaaaaagactccattgctaaatatatggaatttttcaaatttttcatgaacagattttctgtattttacatgaaaatttgaaaaattccataggtactaggtcgatcctaaaaaagtatcaatgataatgaataattatatttaataattctta

SEQ ID NO: 75068 - DNA, 560 bp, Heterodera glycines
  Genomic contig location: Contig_ID=SeqID_11621; Location=14..573; Strand=-
  SCN-specific regions: Sequence locations=1-203,225-508,530-560
atggcatatgaagcgctgacagataaagtgtcgcaggccttctgttggggcaaatggctgggtgaaaaatgcgtacactacggcaaagttttgctcggatttttggtcgaaaagcttttgacagcattggcagcatgcccgaaattagaaaaggtcgccaaaacaatcaccgacatttttggcattggcgaaaaagcgaatccaattgaagtcaaaaaaggaatgtctgtttgtgaagtggtgaagcagtacacgataatgcaagtcaagcaggagattcccaacgttgtgaatactgtttcccgtaagtttgtccaatttccccaggttgtcatcatattgcaaaaaggggctcaaatttaaatatgggcattaaatcttagaagattagtgcttagttcaaaacttaaaaaaaaatttttgatgaacaaaccgagagggtccgatggtgctgaaatttgagtgcatttgttaaaagattttatcaaaaaatgctcgaattttgcgattttgagcaaattctttaagaaaatttgacgtttttgcagggactgtcccag

SEQ ID NO: 75069 - DNA, 556 bp, Heterodera glycines
  Genomic contig location: Contig_ID=SeqID_11622; Location=106..661; Strand=-
  SCN-specific regions: Sequence locations=1-441,463-556
atggttgccgcacagctcgagttattccgcctcaatcgcatcccgccaataatgcttcacggtgtgtagtgaaagacccaagttccaaatgtgggggggggggggggggtgggagcggtgcattaattagtgtgtttggtatggtcattaaaatggtaatctgtgcacacactgatcggatcggactgttgggctccgtttatgtaaaaatatttcttatcgcggggattaatttattatttgatgcccacgtgttcatgccttctctatctctctccttccaggcgctctctaccagcgaatgtgccgaagaatccctgaaatccgtgccatgtgtgaaaaagcgggcgataagtgtttgtacgcatttattcaaattctcgaagcctgggccttttggaacaacaaaattgcctacgaaattgacaaaaaaattgcggagacacaaaaagaaggcaaatcggtgaagtgagttttaaaacaatttggtgattttattttttatactcgagttttggttttcacattttcgaaaatttgatttattatcattaaa

SEQ ID NO: 75070 - DNA, 499 bp, Heterodera glycines
  Genomic contig location: Contig_ID=SeqID_11623; Location=723..1221; Strand=-
  SCN-specific regions: Sequence locations=1-129,151-499
atggcggcaccgatgagaatagtgccggtggacaacatgaacagcggcatcattgagaagaactcgcagtacagcaacggactgcagcagtgtgttcagtcattgcaggacgtggagctcaccccgccgtccctgcacatttcccacaaaaataacctcggcttctttctgagcaaaaaggccgacataacgtcgatcaccggaactaccggaaacactgatgagcaagacttttccggcaacactttcaatataatgaacatcactttgccacgcttcaaagaacgaaaatacacgaaagacgatgacaaactgtgtgaaagcgatgaagagtggttgaaaagcatcagagaaaaggtagaagaagcatcacaacccaccgaattcatcgcattaaaaatttggaactcaggtggagggaaattttcaaattgaatcatgtttatggattttgaccaagaaaggctaattataggttttcttagactaagtgaataaa

SEQ ID NO: 75071 - DNA, 571 bp, Heterodera glycines
  Genomic contig location: Contig_ID=SeqID_11624; Location=495..1065; Strand=-
  SCN-specific regions: Sequence locations=1-390,499-525,566-571
gtcaattcggtacgtccgtcctccgagctgagcagcacgaatggtggtggttccgccgcaacaaatgcgggcggtgccatgaatggcaacggtttcatggcaccgtcgctaccgtatgccgtctccccccttctaccatcttccgttgtacagcaaccgtcggtagcagcagccgacccactcgctcaatcgccctgttgtgtacgaacatcggcaaatggtgaggagggggataaacagtgccgagatttgtacagcaactctctccatcgtttctacagtatgctgccgtaccgtatccatgggtccaatgccagggccggctcctcctgccacggcggcattctttctgcccactgctcacattccgtcgcccaccggcgaaaaaatgtcgccgccagcgcccacggcgccattggctgccgtcgctgcggcggcggtggcatcgaccgccgccgccggtgccacaacagtcgcagcgccattgatggcaccgccaacagcaacttcagtgcaattcgcggcacaactgccacaaccgcaacagcagcaacaacaacagcaaattagg

SEQ ID NO: 75072 - DNA, 446 bp, Heterodera glycines
  Genomic contig location: Contig_ID=SeqID_11625; Location=315..760; Strand=-
  SCN-specific regions: Sequence locations=1-446
atgtgtcggaatccgaagatcaacaacgacgagacatatgcaagaattttaacggtgagttttttcatgagggcgtcgtaaaagaaaagaaaatttcaaatttaagagaagttttaaaaaatttttctaaaaatgataggcctatggaaaattgcacaccatgcagccagcttatgccgcgcttttgtacattgtcgaaatccaacagtgcgagggatatggcgaagaattattcccttgcaaagtctgtgaacgttttgccaaacagaaaaaaaaaaaaatgccaacattcaaatttgaataggacggaagttcgctggaagaagtttcactgggctactcattggacttcatttttgtcagacgaccaaatgggacggaccaaaaattcaggcaaaaattttgaaaaaaaaaataattagttggacaaattaaaattaaataaa

SEQ ID NO: 75073 - DNA, 569 bp, Heterodera glycines
  Genomic contig location: Contig_ID=SeqID_11625; Location=970..1538; Strand=-
  SCN-specific regions: Sequence locations=1-119,184-251,273-299,321 -341,407-532
atgcgatgggtggagccggacaagccgatcagacgccaattggaacggtgggcatgccgacggggccaaaaatgggccgtcaatttggccattttgcacgcgtgcgcaaatgtgaggggaattattttaaatttaatttaaaatattttacaatgcaataattttaaaatttttcaaaaaatacagcccccccccccaatttaaagcccacccccctgaaataaagccacccttttgatgggatttgaaaaatagagcctctgaaataaagtcccccccccctcctttttgagagggttggaaaataaagccccccgggggctctattttagggaatacggtttataaaaatatttaattttctaatactataaacaaatttataatgttattttcaaatatttttcaggtgtttacgctgcatgacactgtttcgcgcagcatttattacactttgctaaaattggatgtgcttcagagcaacaaatttgccacgttggaattggacaaatgcattaatttgggtaatttgaatatttaattataatttttaattaaatttaaataaa

SEQ ID NO: 75074 - DNA, 244 bp, Heterodera glycines
  Genomic contig location: Contig_ID=SeqID_11628; Location=847..1090; Strand=-
  SCN-specific regions: Sequence locations=1-244
atgcggagcattgggaacagcgcattgtcggcagcggtgacacaattggcactgatcggcagcagcaacgttgtcgcccgacggcatcaaacagaagtgcataatagggaatcagaaaaccgatcaggaagccgaacgcgagcaccaggggcagcggtgatcggagacggatggtcggaagccgaaaaatgccgcttttttctttgtttgtccgccggctttactattcaatgagataaataaa

SEQ ID NO: 75075 - DNA, 388 bp, Heterodera glycines
  Genomic contig location: Contig_ID=SeqID_11629; Location=985..1372; Strand=-
  SCN-specific regions: Sequence locations=1-128,160-174,212-388
atgacgaatattttaatggacgatgaacaaaacggggctgaaaaatatcaagccaagactcggtcaaaagaccaaatttttcctggtaattcaatgtggactgcattatggaaattttcattgtttacaaaataaataaataattgttaaatttaatttcacggcacaaaatggaaaatttaaatttaaaaaaatataaaaatgttaattagtcggttgaagccattaatgatttactcgaattatagagaaaaattataattttgacagaatgacatggcattttccggcattaaatccgtcctaagtttttttaactatcgttttcggtaataataaatgaacaattttaggaataaaaacaaaatatattatctaattgaataaa

SEQ ID NO: 75076 - DNA, 699 bp, Heterodera glycines
  Genomic contig location: Contig_ID=SeqID_1650; Location=1345..2043; Strand=-
  SCN-specific regions: Sequence locations=1-68,90-699
atgaccgaacacaactttgagcagaatcgccggaccaattcatcaattgttcatgaaggaaatgtccaattcgacaacgaaaacaacggaattgaaatggatgaaaatgaaattagacgccttctgcttcaagtcaaggtgctacaagacggaaatgcagaattggcgagacacggcgaacaggacattggccgcagagaaaacggaaggccaatctctgatgaggcccaacgaccaccaattacgcgaagagcacagccatacgccgactcattgcatatgccaaatgaattccgagagaatgaccgatctcttcaccctgggctggtattcgatggcatgatggcacaggccattcgaagcctcgacggtttttcatacacgatgacactcaacgcaattccgaacctggacggcaacagaggttctgattcggtgaatgctttcttcaagcaatttgatgttgctacagaagagtggcccgaagataaacgattgcgagcgctacgctccaaatgttttggaaaggctgagagagctttcaattcagctgtggacgcaaaccgtcatgattatcagctcattaaaagagcgatcatccgacaactggacaacactgacgcaaaacaattgacgtcttttgaccaactgatgcgaggaattcggcgtcgaccgaacgagagtatcgatgagctgtga

SEQ ID NO: 75077 - DNA, 1403 bp, Heterodera glycines
  misc_feature (907)..(908): n is a, c, g, or t
  Genomic contig location: Contig_ID=SeqID_1651; Location=232..1634; Strand=+
  SCN-specific regions: Sequence locations=1-395,417-738,779-837,859 -1030,1054-1116,1138-1187,1210-1403
atggatagaaaagcttcaacatcgaaaaggaaggagcaaacgaagaaggcgcgcaacgaacaggagaaggtatgaacggtcagacagttttttttggtagcaggggagtttgtatctcattttttgcaaaaaaaaattttagaatttttttcgtttaaacgtcttgaaaacaagtaccaggcggttttctaggtcgctgatcacgaatatggcatccatttcgcccaattcagaatcacgtacccgaattcgaacaaaaagtcgaaagttcgagtttttcaaaattcgcattattactctaaaattgattaaaacaagctaaaataagtcacatatcattgaaacatccattttgttcagattataataaaacaattttcgaccttttgttcgaatttggtttggaggtttggaataactatattcgtgatcagcgacctcgaaaaccaccacaaaattgacactttctttaaaaaaaatttccctcgcgccaccggactccaaatttttttaaagattaatcttaaaattctttaatgaccaatattgcatttacaggaagcctctgactcggaagacactgactacgaaagcgacctcaacagcaatttgacctgtgtgcgcgatggcaaatttgaagaattgctagtccgcgttcgcaatgcactgaaaaagcggaaacagccaaaaattgacagtctgcgggtaagttaacaccaatttaatatctgatcaatgtaatatataaattattaatttttttcataaaagtatttaagcttttttgggggacccgagcatttcgacactcgttttcgccgactgtttttttgacactcattttttgtgttctttttgccgcccattttcggcgcacgggtaaaactatagatggtgggcacttttnnggaagaaaaagtcgttaaaacatgtgttcggggtttttctgggtcgttgatcacgaatttgaattcattttgaccaatttcaaatccttggtccgaatttgacaaaattcgaaaactcaaagtctatttttatgtttgtatctatacatatgactattttttgacattgcaatggttttgacaacatttagcttgttttgatcaacttaagaacaaaagtaaatttttaggatgtatgattaagcagaagtaagcgattagtaaattcaaaaaagtccgaaaatattttaaaaaatgtcttcgagaggatttgaatccgagaccccattttggtggcgatcatctaacagattattgcgacaaaaattaacaaagttaaatttggttaaagaaaagaatgatcaactacctcatttagcagcatcaaagttgtttgcaaaaactttattcgatttcaaatttttggtgttatttttttattgtgattggctcgca

SEQ ID NO: 75078 - DNA, 103 bp, Heterodera glycines
  Genomic contig location: Contig_ID=SeqID_1652; Location=404..506; Strand=+
  SCN-specific regions: Sequence locations=1-81
ttcttaactttttaatttttttatttcttgcggctagtatcttctacagtaatttgtcagtttggtcggatgtgcgtcaaatggaaaaaataattaaaatttt

SEQ ID NO: 75079 - DNA, 2136 bp, Heterodera glycines
  Genomic contig location: Contig_ID=SeqID_1652; Location=796..2931; Strand=+
  SCN-specific regions: Sequence locations=1-81,103-224,246-776,812 -923,952-1099,1122-1501,1523-1953,1975-2136
agagcgggaccgggaccaaaacacggacaactgagtacaactgagtaccgaggtcccggttttgaccgggaccgggaccagtcccgggttttttcccggttttcccagccaaaaattcccggtttttcaccccgaaaaggtcccggttaagcccaaaattcccggtcccgctctactctaattacaccgaacatgtgttttagtaatgctggaaggtcccccttttttccattaacacatggaatcattgttaggaccagaagtccaaacaacgaatgaatttataatatttttgaatatcagttattattgttctgaagaaaggagagcggattgagccgataaggtgcggctgtatgagttgaccaaactcaggggataagaattcgaaaacggtaaaaatatacagagacaatattgtctatagaacagaaccaggaatctcagatttttgcaatgtctccgcatgcgcataagattttaaaaacttggatgatccaaataatagctttaattcgctcctgttggccctggcaaaggcttgttcttttttatactgatataaagtcgggtcctcaaaagttcaaaagtcgggtactcaagtgtcaaatcctcaaatgccgcaccacgctctctctctatctcccctctctttctctttcctgcaacaacctctattagaacagcccaaaattgataaattggcattttgaccacaaaaaccggaaaaatttccaaaaaaattattttttcgcaaaattttctcgagaatattgaataaatttaaatatctaaaaatgaataaattaatgtcaaagataagcaaaagctaaaatttcgcatttcgggttattttcgcttaaaattagtaaattttagctttatcgtgttttaacttggaagccctgcttaaaaacactcaattttttgaaattttaattgaaattttaattacatttagcaaacctgaagaaatttgagaattttaccacaatttggaaaaaatagccctattataacggagtccggacaatccgtcaatggacaattcgtcagcaaattttttgagcaatgattaaaaatcttgcgaaaatgattgttaaatttaataaatataatttcttatagattcttaacatttctaattaccgtatatgctctaattatagcccatgggggattatttttcaacctcctcagaatacagaggataattagagactgcgtgattaatagagactgtgggattatttttcgactgatatcattcgccgaagggcggcttcactgttcatagacactgacatcaaggtgagaaaactgctacctatactactaaatgaaaattttctctaggcatcagttggatggctgcagaaatttctcaagaggcataatttcgtgctgcgtatgaagacatcagtttgtcagaaaccgccgtccaactatgcagaagctgtggcaaaattcatcaattttgttgaacaaagacgaaaggcgaaaaacaattttcccggcggcatctttgcgatggacgagacggccgtttggttcgattgcccggacaaccgatgcatagacatgaaaggcgcaaaagatgtaataagtttttgaaaactatttagagctatttcctcaaattatgtgacagtggtggccaccggccatgaaaaaatgcgagtgacagtgtgcctaacagcccgcagcagacataagctcaagccctatgtgttgataaacagaaagcgaccggtgccgcaaattatcaaccaatttgctggaaaattggtgatcaatttcgatggctctgtgtggatgaacgatgacacaacggaggactacctgcacaaataatcggggcaaagctgttcgttggcgaacgcctcttggtttgggatgcgtttggcagccacaagagcgagagaacgacgaaggtggtgaaaggattgggagtggaaacggtttttgtccctggcggttgcatcaaattcatccaggtaccaaagcatccttctcaatgaaattcacttttcttccctaggctcccgatgtctttcacatggtacttgactggatccaccgatcgtggcaggaaatcgccaaagaagtgatcatcaaatcatttgagggtcagtt

SEQ ID NO: 75080 - DNA, 1487 bp, Heterodera glycines
  Genomic contig location: Contig_ID=SeqID_1653; Location=387..1873; Strand=+
  SCN-specific regions: Sequence locations=1-232,254-1155,1177-1487
atggaacaggcgctgacgaagcacattcggtcgctggctgacttctcggcacagcagcggacggacgcaggggtgccattttacctggaaaacccggcatttgccgggttttgggggtccttgccgggtttttgccgggtttttgaagttgccgggtttttgccgggtttttgggtttttttccggctttcctattttcaattcatttatttgaattttattaaacattttgccaaaattaagagccaaatatagttttcgttaatgttcaggtttattttattgatttttgatctcattttctagtctgcagaatgtcccaaaaatctatttctgatttcatttccaaagttacatttcaacaatcatcttcaactcaaatttccagcgctgaggaagcaatttcagatttagccgtttctgtctcgagtgatgaatttggggtgatttcaacaaattgactttttacatagcaaagttcagatcacctctccaaaaaggaagaaatattcgcacaaaaagcctggaggaggaatatcaaattatgaaattcaaggcagattccatccaaaaagcaacaaaggaaatgacaaatttttttgcaaagcctgtgatctaaattacaaaatacacaaaatgggcgaaaaaataatcacggaccacatcaaaaccaccaaacaccaaaaaaatttggctgaacttaacagaagcgtgcctttgaccgattttgtcaagcaaaaatcggtagttcattttgggactcagtaattaatctaattcaatataattaaggctacagaagagaaacgttgtctcgccgcagaattaacactgcctaccattgtgcgcgattttacgcggacgcacatgaatatttgggcaattggtcacagcaattctctgagacggatgaaattattggagattgggtcatttcgagtcagagccaacaagtgaaaaagttcgaaaggcgtataggcatttctgtggggcatcaactgacgaaatggatgctttgtttggtgagatcgctgagttgaaacaaacattgaaggagctcgagggcgaccggttcaacaggaaaaacgtggacgaaaaatgggcggctattttcaaaaattggcatgcctttgttaaactcgctaatttcaatcaaattcaatgcaaatatttcatgtcccaatgctcacaattactttctttcattgccaaatttgctcaaacaggtgaaaagcggtgataaatatgttgtttaattgtttttgacgttttttacagtgaaaaattggcttaaaaaactgccgggttttttgccgggtttttgaaaatttttgccggggttttcaactggttttcgagttttcgagatggcacccctgatcagcagcgaccgccaccactacaacgacaccaaacagtacaacctgtgctgggctcccggacaatcggacagtagacaatccgacagtaaattacactaaaagata

SEQ ID NO: 75081 - DNA, 3677 bp, Heterodera glycines
  Genomic contig location: Contig_ID=SeqID_1653; Location=2158..5834; Strand=-
  SCN-specific regions: Sequence locations=1-161,192-605,628-675,697 -900,924-932,958-1107,1145-1167,1191-1289,1311-1474,1496-1611,1636 -2040,2099-2198,2225-2436,2460-2814,2836-2929,2951-3083,3105 -3122,3146-3247,3270-3567,3592-3677
atgcgccgtgttacaactgagtacaacattttgtccggcgcttcttttgacaccttggctcatctcggcaaaataagtgaaaaagcaaaaaatttcctaaagctcacaggaccagctggcagcattcttgctgcttttgctgagacggttttcccggtgagaaaattaattaaatcaaaaataaatttatagtgattaaattaactttacttattgatggtatttacatttaaatttgaagttggaaaatgaatttgattttgatttttttagcccgaacaccctgttctgaagtctcttgcatttttacatcagcacattgacagaaaattcgaagctcaaggcagattcattgagggagcattgagttcactaagatctgcccaagacttgaatcattacgacacagtatttgtttcaaattacgtaccgtaacccattgagcaaaaaagtgacactttaacaggttgtcaatgtcccgctagcccgcttgaccaaaatatttaaaaaagtgattaatcccgcgaaaacaaaaacgcacaaagaacaatttgtcgcggcgtgtacccgttggcagtttacgccgttggatattttggaagtaaattcatacaaaaaacaaaacaattaattttggtttttaatttaactaagtcagaaataaacataaattgaaaagtttgaagaataattgagaaataatttgccaaactttcagttcatcaatacgaaagtcaacatcaattgcaaaaagcaaaaaacgagagaaatgctgccaatcatcagcgaagtgaagtccgtcttcgatgaggtgttcgtcattatcaatgatcaaaaatatgcaacatcatatgaaaatttttttacaacatacataggtacgtaatatttggatgagtgataatttaatagttttcttaaaataacaaacgaaaaatattttaaaattttttttatggtataatgaaatcggatactgatttcaaaattattcaattttaatgtatttttcaagtatttttacattttagtggtgctcgaaagttttgagagtttatctttgggtcaagcaaatgaaactctagcagacctccgcgaatgtaagcctaaataaatttagaataaaattattttcattttatatgcaaattatttgtaacttgttttaaataatttcattttagtgttcacaaaaaaggacggacctgatttcgatttggatgaattgatcagatcaattttcgccgttgtccctggaccgttttctgacgtgtaattattaacaatataaatttcctttgaaatttaaaaactatttaattgtcactttttgcagttgccttcttcgaagcgtttacgagagttatgccgcaaaaaggaacgaattgctgcgtttgtccgagtcagtcacaatagacgtcattgaaactgtaagaaaacggaaaatttgattgttaggttaacggtttgcattaaaaatgtcagttttgttgatctttggttgaattccataatttacagtagcttgcggaaaagtatttgagaaaaacggtttaaaatgtttttttatatttcgtttcattaaatttagaatgggtaatggtaatttgcagaaaaatgtttgaaatttaaatttaggcaaaatttgcgagactgtcattgggccaagggctaaacgaaatttcgttttgtctcacctttttggcacttttttgtttcgttttcgtttacgaaattttttttaaagttttcgtacagccctgattgagccatagtgtttttacaatttggaacactttctaaaaattttgaagtaaattataaaaagccacctaaacatttcaaacataaatgcatcaaattttgggcttttataatatgtaaaacccattcttcaggcattgattggaggcttttgtgccaatttgagtttctctggtgcggcagaacaagttaaagagcagcttgatgaacttggctcatatgtacgagacatcactggcaatatgtcacagtggattggtaaagaattagtaagtcttatttattgaatttaataaaattattaatagttttaaatatatttgattttaaatttctggtaaatctttcaaaatctttaattttccttgtttccaaacagaaactaccaaaaaattttttttttttgtcttagtcctcaaagtaattaaaatgagaatttatttaaaaattataaaaatttcatatctttttctggcgtttcatttttaccatttaacaaaatttttcgtttcttccgcagagtgacgcgtggccagaagaagtcataaggaatatcaaacgtgaaattaccaaagacattactgacccgtacgcctacaacacgactgcaaatcgcatcaacaatgaagttttgtcaagaggaccactagggtaatttcatatgaatgcaatttataaacaaaaaagttacttttaataaaaaaataagtcaatcctggagaatggggttttctaattttacttttttggtttgggcttaaaatcagtttccagtggttttcgatggtgctgattacgaatctgacttggaattgcccaattccgaaccccgcacacaaattcgaacctaaatggattttttcaaaatacgcgttaatagaccaaattttcgcgcaaactgcgtttttttaacaattgttttgcatcaaataaatagatgcttaatgcatttgaagtttttccgcacattaaaaatttttttgttcgaattatggtccggtgttcgaaattgggcaaaccagagttcagatttgtgatccgtttctggttctggattttggagtttgtatcatgaattccaaataatgatcatgtgttggggcgaagaatcccgaattgcatagtcaaaattttttgtcgctaaaattacctgataggtaacttttcttttttaagaatcaatgaatcgggcagattttctcatcataatattcattttgttaagatgcgtgtcccaagttcttgttacgcaaaactgggattacatctccaatttttggtttcgttgtccatctgcctattgcgcatatttaaagcattttaatttgattaactttgtgatattacgccacagaacaggtgcccaggcaagggcagcaattgccctcgaatggtttggttcgaaaaaaaaatgcgatcgaatctgttatacggtgaaaatcgttattttaacaatcaaattggcaattttgtagaaaaaggcaaaaattatttatttatttattgcaggcaaaatgacaaactgtttgaccttggtacgatgatcgcaacaattgagcagcaaacgggcgacttaaccgaacattcacgattccgcagttttgtgatcctccacataagcacttggacctcaaaagcctgtgtaatcccaattggattatctacgaatcaatttttaaattattccggctttggatatgttgagatgtatgcacaccatttattcaccacaaatgatgaattgtataagttgttcctgtttctgtaatttccttgaaacgcatttgtatgtcaaaaaccattatttctggataaagtaacaaaactaaaattcctacccctattaatatagtcttaaaattaactctgttatattcttattttttgcgacaattttgttttgtatgaataaa

SEQ ID NO: 75082 - DNA, 1164 bp, Heterodera glycines
  Genomic contig location: Contig_ID=SeqID_11631; Location=1116..2279; Strand=-
  SCN-specific regions: Sequence locations=1-29,73-440,462-577,600 -613,638-839,861-1067,1089-1105,1146-1164
atgtggaggaaggaattggatgcggaagcggaggagggggcgaagtgggaggaggagaaggaagaggagaagccgtgggatgtgatcgacttaccgatctttggaaagttggaggtgggcacaatgcgataggaggaaagcaccagaaaacgaatcggatcgtggttagaccagggaagcacatttggccgagctttaccatcggaccaagaatcgggcgggagtttgtgatggatggcccgggaaagggaacccggtcaaaaggagctctgatcacgaatttgtgactcacttttttgattattagggggtcgattcatatggattttgcatatttttgcacattttgaaaatgttttggttcttaaagatccataatagccatttggggagtcataatcaccgcaaatcggttgtcctcccggttaaaaaagtgatgtgaaaagcaacataaaccatcaaattttatggaatgctcccattaacaatttgaccatcatctctctcaaacccccggaccctttcgaaaaatctgttgacccaccactcccttttcatgtatgccgccatcccacaaaaaatttatggtgtttatatttagtttgttgataacttttttatttaatttaaattttttcgaaatttccataattaccgcatttttgcacgggatcccgcaaatttgaaatggggtttgtcaaatacctaaacaccaattttaataagattcagcgcaaaaaatatattaaacgtttggcctttctctagtcgcagacaaccccaatatttatgctaaaaactgtataaaatgacttttgctggtaatccactaaatgtgacttaaatttcagatttggattaatgatcgcgcatccaataaaatgctgcaaaagtgtctgatcagtgccatcgataatttgatcaaaacattggaaatcccattcgttgcgatcaaacaattcgccttccgcgtccgagtttatggcgatgcgtattttgacaacacatacaccgcaagtctgaagatgtgcagcatcaaaacattcaatgagcttaacctctaaattttaaataaggaaaacactttgttatcattttcatattgatttttatttattttaaattaatgaaaagaataattttatcgtctgtatcataaataaa

SEQ ID NO: 75083 - DNA, 1167 bp, Heterodera glycines
  Genomic contig location: Contig_ID=SeqID_11636; Location=1197..2363; Strand=+
  SCN-specific regions: Sequence locations=1-513,543-586,610-791,814 -1167
atggacgaagtaagtaatttattttttcgcaaaactatttagcgaatttatatgagaaattaatagaattttgcgtcgtacgtactttgacaaccccctcatcaaaaaattgctctaaaatgaaaggaatgacgtatccataatttgcgccccctaaaatccctggacatggcattttacacgacacttaaaaatcattttatcgtttgaaaaactgcgaggagataaagcacagtattaccaaattttgtttcaggaatcttctacaccaccactggaaacagataatggacagtgcgaaatgtgtgcaaattatgaagtgtgtactgcttcatctgcgccttcaatgaataacatttttttggttgctttttaggtgtctcttcaaacattgcaaaccgcgcaagacacactccgggtaaacaaattagtgttttgtcaattctcatgagataaacttttatttagaactaacaattgatatcatgaatatgaatggggtttttagtggcaaaaaattacaaataattaacaaaaatttgaagaatttctaagtgattatgtaattttacgtttttttcaggaacaattggcagcagcaaaaggtttttgctattcgtttaatagttccccttttcaaatgtttctaaatttccccccccccccccgtagaattgtacgaaaaatatgggaaggaattgtcggaagagcggctctatcgtaaagaattggaaggccgttttgctgcacttaacgatgaaattgaacagaaaattcaggcaaacttgtgctttttaaaaaatatttttatttgttgttttttttgtcacagatttttatggacagtgtgaatcggtcagaagaacgggttgcattgttggccaagaaacaggagaccgacttggccgacatgggccacgaattggacgtggccaaggagcagcaaacagcactgcagacggagttgaagacgctctacgaaaagtgggacaaaaattttaaaaaatgcggacaaaatttgtgtcataaaaaacccactcttttaggtatcaacgaatgttgcacaaaaatgcacaaaaggcggacgaaatgcgtgaacagtgcattgatttgccccaaactgttgacgaactgacactgttggcactgcaattgcgcgaagatttg

SEQ ID NO: 75084 - DNA, 571 bp, Heterodera glycines
  Genomic contig location: Contig_ID=SeqID_11636; Location=427..997; Strand=+
  SCN-specific regions: Sequence locations=1-571
ggttccgctagttccgccacccaatcgcaagcggcgccaccgaagaagctgactgctgaagagttggaggaacggcgacgcgccatgttgacaaatgcctcatggcgagacgatatgcgtgagcggaatctgcgcgatgcggccgacaaattgagaaaggaacaggacgagatggccaataaccgaggtggcgccggatttatgcggttggttgaccggcacactgactatataccagggaatgggagataatcgccaaaaaagtcgcaaatgattcgtgatgttgcccgccgatgttcaatcctaatttaattgtatagttaaaaaaatattgtaaatctatacaatttggagcatttccagattttttgtcgggaaatttttgcgttacaattttataaattgcatctggcaaaaaaaatatttagtgaatatgtattcattttgtttattaagtccaatgatgaacaccgcaactgaagacgcgtccattgagaaacgcttacaaagcaatcggatgaacattcaacgccaacatgatcacatggacaagtcattcgtcagaaaatga

SEQ ID NO: 75085 - DNA, 1063 bp, Heterodera glycines
  Genomic contig location: Contig_ID=SeqID_11637; Location=111..1173; Strand=+
  SCN-specific regions: Sequence locations=1-559,587-655,677-767,793 -844,866-1063
atttttatggacaatgtgaatcggtcagaagaacgggttgcattgttggccaagaaacaggagaccgacttggccgacatgggccacgaattggacgtggccatggagcagcaaacagcactgcagaccgagttgaagacgctctacgaaaagtgggacaaaaatttttaaaaatgcggacaaaatttgtgtcataaaaaacccactcttttaggtatcaacgaatgttgcacaaaaatgcacaaaaggcggacgaaatgcgtgaacagtgcattgatttgccccaaactgttgacgaactgacactgttggcactgcaattgcgcgaagatttggtgagtgagtgtatgtattaaaaattctcattctatgcatgcccttcagatcagcgagaaagcgagtcgagaacacgagtgccaagagttgcgtgacgagttgaccgttgcccgtgaacaaatgcttgaaagtgaacagcagttgctcatctacgcccagcatgcacaacagcagcaagaccacatggagcagttgctgcaccaacaccgaatcagcgtgggcgaggagggcggcggcgccgccggtggtgaaactggtggaaacagtggtggcagccgaagacaacgagcaggaggacaaccggacatggtcatcatttcttttggacaaaagactgacattgggcacatttttaaccaaccatgcaactcaagcccctctttcgagaatgggcaaattccctcttttgaggccctttaaacaaaatttcgagaaaatttctaaatttaaaattctaattttgtttagcatccatcaaacgctgttgtccgttctccgcgagagcagcgacgacagcaacaacaacaaactccaacagttgtggaagttggcgatgccgactgctgttgtccggatgcgaaatgccacgaacagactgttgagcttgaacgtcgactgcaccggtcgatgaatgaacgggcgcaactgcaggaactgttgattgaacagcggaacaaatgcagccaaatgcagtccgagttggacacttcggaagcagtacagaaag

SEQ ID NO: 75086 - DNA, 532 bp, Heterodera glycines
  Genomic contig location: Contig_ID=SeqID_11638; Location=344..875; Strand=+
  SCN-specific regions: Sequence locations=1-232,256-532
atgacgaaccaccacccctctgacccctctaagattttacctggagaaaatcctgcaaatgctagcaatttgttgagaaaaattaatacaattcaacaaaaatgctccaaatttttcattagcataggcttgcttgggcctaggtaaattttcgtttaaatatttaatatggagagagaaatgcatgcggatattttatttaacgagtcatttaattgtttcatttgttgagaaattttgtataaattcaaaaaatgcttcagcaatacctgaagatggcggatttacgcacttgaaaaatcacagaaaaaacgcattttaaattttggggctttctcctttcaataaaattgctccatattttatttcatccatttttttgtttcagcaaaaaattgacagcggcgagttggccaagccggaacagacgcagttggacaaattggcacgacggggcgagttggagcgtgacattgagcagctgaacgaacagttggccaaattatgacgacgacgacaaaaaaaaaacaaa

SEQ ID NO: 75087 - DNA, 2172 bp, Heterodera glycines
  Genomic contig location: Contig_ID=SeqID_11638; Location=3414..5585; Strand=+
  SCN-specific regions: Sequence locations=1-43,74-137,159-186,225 -336,358-613,635-702,738-873,895-1311,1333-1385,1407-1497,1520 -1527,1551-1576,1598-1727,1749-2005,2047-2094,2116-2172
atggctaatttcttcatcattccccgtcgaaaaacaattcaacttttattgtttattattttatttaaaataacgcttcaacaaggtgatttaattttttgtttttggcattatcatttttatcatatgacattctgtaaaattctttacaaataaaacaccaaattttttgcttaaactttgacgaaatttttaaaaataattttattgaaaataaaaaaaatccaaagaaaactaaagaaaaaaataaaatggtttttttaaagacaaattttcttttatttcaaaagtttatttgatttctattttagactcgctcattgaaactaaacaattggttgaccaagcaaaaagtttgtttaaccaagtaaacgagggaaaatttgatgccgattcgtccattgaatggatacagaaaaatgcgattggcattttgtctaatagcgaatttgaatcaaaaatggatgaaagtttgaaaaaattgcaaaatgaattctgtgattcattggaaaatggcaattatcaaaaaatgatgaaaatatttcaaacgacaaaaattgagaaaaaaacatttgacaaaaggcaaatggacaaagccatagcaaaagatcaaattaacaagggcaaaaacaagcaaatgtttaaacaactatttaacaattctagcaagattcttgaaattcatgaagatttaattgaaggtaaataataattaaaattttaaatataaaaaaaatccaatttatcgtactcaattgtttcgtaaatcaaaattcgttgaatatttggcacaaagtgtcaattataagttaaaattgaaaaattcaaatattacgcttaggtaaaatggctaaaaaattcaaagatgttcaaattttttgttttcagcagaaaggcttgccgtgcgccaacaacaaatgccaaacggttttatgggcagaagaaaaaagcgtgcccgcgacagtgcaattaagggctgtgtcactgcagtgcttttaacattaatctctgctccatatttgggttattattctaacaaatatgccaacgagggcaatgtcatggttcaagtcaatagatgtaaaaagaggtttaatgtccgacattgttaccaagtccagcagtcggttgtcacgcagatttttgagtggacaattctattagccattggactaatctgtgcactgatattttgttcttgtgtccgttgatcatctaattattgtatgattacaattacggtacatatgactttggcaattggtttttgttttttttttgctaaatttttatggctataagtttttttacaaaaattttaaacatcaaaaagatatgatcaaaattatatttagacttttcattttcagattttttttcatagcgaaaaacaaaagtttatataatttacaaaatttcattttccgaattgaaacatttgtttaaggatttctctattctgtgcttcttctttatcaatctccatttatcacaggcttttatcttttccctcttttatctgaaatcctttttattttcattaaaaaattcggtggttactcgtcaataatagggttgctccccgacccctctgggggcaaaatgtcgggggccgggaaccttcggggggcacaagtcgggggtcggggacctcgatcgagtagtgatcaacaaaattttttaacgaaaaaactaatttttctttttaaatgctcgtaaatcttcccttttttctctttaattttctgattcaaattcattcgttcgcgccattaaaagtgcgtccgatttggcattttataataaggcatcctaggcaggggtgggcgaagctcggcttagtactcgaagccgaagctcgaatcgaagcccaacttttttcgaagcacgaagctcgaagttcgaagcccaaaaaacgcgaagttttcgaagctctaagcacgaagtttttgaaaaaatgattttaccctaacaaaactttttttcaaaaaattttcgtgttcactaaaaattaattaaactataatttaaaaaattataatttatgcttttcctaataatttttcattttttgattttgattatggctaccaactgaaaattttcaaaatcatcatttggccggtaaaaaatcagcattttggtaaattttattccaggtttaaaaactca

SEQ ID NO: 75088 - DNA, 1033 bp, Heterodera glycines
  misc_feature (1033)..(1033): n is a, c, g, or t
  Genomic contig location: Contig_ID=SeqID_11639; Location=52..1084; Strand=-
  SCN-specific regions: Sequence locations=1-95,120-137,159-499,525-1033
atggctggagaaggaagaatgagaaagaagattgattatgatgtaaagaaagatggcaaagaatttgatcaatgccaaaatgcattaaaaataccaaaaaaatatatatatttatttttgtatcgtaattttgtaaaaagattatatttatcatttttgaaagataataataatgtcatgatggtttatccctcaaaagagtctcagacttcggtctcaaacctaaatcgaacaaaggtgcgaagacctttttattttttgctcttcagtctcttcttttttcgccaggattttccaaaattttcggaagggtagggttaagcgcaccggaaaaattatcgaatttatggccgacttttaacaaatttttaaaagttgcgatttttgagtctaattttgaaatttttgataaattttttagaattggtatattttttcaaaaaatttttcccatttttattttgaaaattaaaggtcatcatcattaggaaacgtattcttaggttttatttattttttcttcggcttaattcaatgagaaaaaaacgaataatacatatttagcgcgaaaattcttccctttaaagccctatctgtccctaggaatccctattttggcactttggaattccgcccctattacggcatttttcaaaaaatttcctaccaaaaatgcaataaaaatgcatccataaggaccggttatggccaaaagaattcaaaaaaccagattttccaacttttttggcaataaatttgttcaaaattgacgaaattttttggatttttgcaggttaatagagcatctgagggctctcgaatgataccaaaattgttagatttgactgacaaagaaaaaagttatgggtgccggggcccaactgaggtgtaccgttctaaaaccctttttgaagggatcgactcatttccttaccaccgtttccttaccaccgtttccttaccaccgtttccttaccaaacgtttccttaccaaccgtttccttaccaccatttcctttacacgtttccttan

SEQ ID NO: 75089 - DNA, 136 bp, Heterodera glycines
  Genomic contig location: Contig_ID=SeqID_11640; Location=7..142; Strand=-
  SCN-specific regions: Sequence locations=1-136
ctaattctcttgttcattcttctaatcctcctcaatcccttccgtcccactcatccgatctcatcaatggccaccactgtcgcctcaatcgttctccaactgctcatccttggcacggttgtccatctgtcgtacg

SEQ ID NO: 75090 - DNA, 1649 bp, Heterodera glycines
  Genomic contig location: Contig_ID=SeqID_11640; Location=294..1942; Strand=-
  SCN-specific regions: Sequence locations=1-332,355-552,574-606,630 -890,934-1004,1031-1173,1195-1593,1615-1649
atgtcttggcattcttttgttcaacttgttataattatggcatttaccttggatggggtattttaccagagaggggcactgtattgttcaacccctcaaatctcggaaattttttttgcgagtcaaaaaggggtgaaaaccatttttctaaccggttttatagtgcagagcatgaatatgagtattattttacgttttacaaatttttgaatttttaaaaaatttcgaaaatttttcattttggccctcgggaatttggactcgtatttgaaaattcataactcatttcaaagtggatcaatttaagtacaataaagctttaaaaatagagaaaaataaggagaattttatgaatttattttaaatttctatcatcaaaatgaaaaattttttccagaaattctggaaaaattcgaattttcagacaaaaaatcagaactcggttcttaaaggatgttttcgaaaattaatatactcaaaaaacccgcaattttttgctctatagaactgtatttatttcatatttctactatttttttggaaaagattagaaaaataaaattgatttgggaatttgggaccaaaggggggaccacatggtttctgagtgggaaaaattttttcacccaaatttagctgaaaaatactttttagaggtattttagggtgttgataacgaatctgtaatcagatttcgctttcggcatcgacaaagccccagaatccctgcggatatactcgatccctcctggaggggggcattttattggagaggggcattctaccagagaggggcattgtattgttggatttccgaaatagggcatttaattggagggggcattctaccagagaggggcattcaaatagcggatttacggtatgtctggattatatttaaaatatttatttgtttaacattgtttttacatacaaaattcgttttttaatgtccaattggttaaaattatttcacaattttatacccattaccataaatcatcatttatttaaattatttttataaattcgttttgttaatttattcgctttttctttttcattttttgctgccatttccgtttatcgttgggaaagaacagttaattttttacgttttcactgcttttgatggacaaattatgtggttggatgatgaatgaatcatcattaacagcagaaaaactgtgaaaacagaaaaacgatgctaacaaaatgagcagcgaatgggcggaagtgtacaaaaattggtggaaaaatggacaaaatgggcaaaatgaatgaatgattcaccacttttggcacaatgctaaagccaatttctgctgctgggcaattggggcggaccttcggctaacggacggacgaacgaacgatgggcggacggattgtcggcgttagcagcgaaaactccgcccccaaaatggccgcataaatagccgttgatgggcccccagaaatcagttccaagcaatcattttgcagaccacgtaccataaactactcgacatttagtaaaattatgaccagaaaagccgagactgggcttggatttttcgtagcgcctggagttcccggcccagtcccaacactaactcttgagtaaatctaaaaagactttttggaaaacagaaaatttttgaaataaa

SEQ ID NO: 75091 - DNA, 788 bp, Heterodera glycines
  Genomic contig location: Contig_ID=SeqID_11641; Location=1..788; Strand=-
  SCN-specific regions: Sequence locations=1-96,119-241,263-273,349 -391,505-505,535-537
  Gene Ontology: Mol. function=structural constituent of cuticle; Cellular component=secretory vesicle; Biological process=negative regulation of cell proliferation
atgggttggaagttagtgtctctttttctttgtattgccatcattggaatagtaacaggctattatcctccgccaacaacaacgggttaaaaatttatcagaaagataaaatgtaaaagaaaatttagcatgtcctccggtaacttgtccatgtggatgcaaagaatgttacacgacaacaccatatgaagtgccaggaacaggatcaacatcgacgccaggaccggaatcaagcacatcaacaccatctgaggagccagaaactccgagcagtgaaacgcccggaccgcctggacccagcactgaaacgcccggaccgcctggacccagcactgaaacacccggacccgaatcaagcacatcaacaccatctgagggaccaggaactccgagcactgaaacgcccggaccgcctggacccagcactgaaacacctggaccgcctgaacccagcactgaaacacccggaccgcctggacccagcactgaaacgcccggaccgccaggacccagcactgaaacgcccggaccgccaggacccagcactgaaacacccggaccgcctggacccagcactgaaacacccggaccgcctggacccagcactgaaacacccggaccgcctggacccagcactgaaacgcccggaccgcctggacccagcactgaaacgcccggaccgcctggacccagcactgaaacacccggaccgcctggacccagcactgaaacacccggaccgcctggacccagcactgaaacgcccggaccgcctggacccagcactg

SEQ ID NO: 75092 - DNA, 1687 bp, Heterodera glycines; identical to SEQ ID NO: 11641
  misc_feature (1662)..(1662): n is a, c, g, or t
  Genomic contig location: Contig_ID=SeqID_11641; Location=1..1687; Strand=+
  SCN-specific regions: Sequence locations=252-254,284-284,398-440,516 -526,548-670,693-800,861-875,897-1179,1201-1316,1338-1375,1397 -1517,1540-1687
  Gene Ontology: Mol. function=structural constituent of cytoskeleton; Cellular component=intercellular junction; Biological process=cell -matrix adhesion

SEQ ID NO: 75093 - DNA, 417 bp, Heterodera glycines
  Genomic contig location: Contig_ID=SeqID_11642; Location=547..963; Strand=-
  SCN-specific regions: Sequence locations=1-108,130-417
  Gene Ontology: Mol. function=anticoagulant activity; Cellular component=nucleoplasm
gatgcccagcgattgtggcgcgccggtgaggcacgcctcggcaccgacgaaatcgccttcaactctattttggcggtgcagaactttgcgcagcttcgcatggtgttttttgtcttggtttgtttttgacgcccgttgttttgaaggtctttgacgaataccaacgacagcatggccattccattgaacaggcaattagcaacgagtttaggtgagttcaaattgagcggttcacttgttatcatctacgagttttttgggattttattttggtaaattttattttcctttttaagcggtgacattcgtgatgccaatttggctttggtgaagagtattcgcaaccgtgcctcatatttcgctgagcttctccacaattcgatgaaggcacttattaattttcaattgttactttaa

SEQ ID NO: 75094 - DNA, 1818 bp, Heterodera glycines
  Genomic contig location: Contig_ID=SeqID_11643; Location=944..2761; Strand=+
  SCN-specific regions: Sequence locations=1-246,358-367,390-603,626 -689,711-1586,1609-1769,1792-1818
aaggcgatgatggcattggcattttggagttgcatcatttgctggacattggccaaccgttgggcatcgttttggccacttggccaaatcagtcgttatctcgcgcgccgactgacattggcatgcaggcggcgatgcgcagcctaaggcgcatggaaagggaaacactgctgctgatcagtagtggcataggcggaatggcaccgatcggaagcggcagaaggcggagaaaggtcaaaagtgagtagagggggagagaaagagagggagaaagagtgcgcgagagagagagagaggtatagagagaaacagagagagagagagaaataaagaaatagagagagagagagatgagaggagggaatgaccagcagaaaaatgagaaaagcatcaatggcaaagtagtgtgtttgttatcaacggagccaatcagacaatgagagagtgcccttttgccagaattgagggccgccgcccctcaggggcggaacattatggtgctggaggcgacaagcccaaacgccaccaacgggggccgctgcatcatcagcgcggaccaagcggtgcacttctgcggatttgaggaggaaggttgggaacagagtgttctttgctctttgttcgtgccgtgccgtgacttgcgctttttttaaattttgttgtgccatcgaccaacacatcactgatccttttgttttggtgtctttggtgtcattattgatcagttaggctttttcttcccgatgactcatcaacgaaaatctcgagcagtaattagcaaaatgaatgagaaatatatgatggaagtaagcaaaacagctatggtattcgggacataaaatttttattaataagtttgacattgcactttcctaatttggccttttccatcgagtggtaattaattagcagttaattgtccttcccacaatccgtgataattttcaatatatgtttggatgtttttgctgtgaattttaatcacattgacattaaacagaagcaggatcaaattgtgcctaatttcagttaatgagccgccaattccgccgcctttcgacggaatttgcatgcaaagtgcgcgaagcgggcgagtgatctgttacccgaaatacgaagttggtggccttgatcagacaaactgatcagtgtattgccttgggcatatcctttatcattgatctcatctgactcggtctaaaaatttaatcaaatttcgggacttggacaccacttgtacggacgcagcttcgatcaacgaacgctcgggacttgtggcaccgccggtgattgcgcatgccaagtgatcggaagagaaatattttttgatcgcattgatcatcactttcagtgttcgaacgatggcatttgtgccgcccgataatttgcagagattgattcgacattactaccgaagatacggaaaaaaagcgtacccaaaaaacgagacggacaaaatcgccatgtaataataattaattcaattaatcgagactattcaaaaagcattctatttttgtcctaacaaaattttgagtagttgactcaaaattctacggtattccattttcggaaattatcaacttaattaatcaccagaaaataattttgaatcgaacttctcggtgaagaacacggccctttctgttcgtgaagtacggctgcgacgcgggctacgaaatggtggacgaggcggacacaatgttttgccgcaagggccaatgggtgcaaacggcacccatctgccggggccaaggcctttgcgaaatggacaacggcggctgctcccactcgtgcatttcattctcacacaatgca

SEQ ID NO: 75095 - DNA, 1388 bp, Heterodera glycines; identical to SEQ ID NO: 11644
  misc_feature (78)..(78): n is a, c, g, or t
  misc_feature (83)..(83): n is a, c, g, or t
  misc_feature (111)..(111): n is a, c, g, or t
  misc_feature (131)..(134): n is a, c, g, or t
  misc_feature (187)..(187): n is a, c, g, or t
  misc_feature (218)..(218): n is a, c, g, or t
  misc_feature (221)..(221): n is a, c, g, or t
  misc_feature (225)..(227): n is a, c, g, or t
  misc_feature (230)..(230): n is a, c, g, or t
  misc_feature (233)..(233): n is a, c, g, or t
  misc_feature (249)..(249): n is a, c, g, or t
  misc_feature (265)..(267): n is a, c, g, or t
  misc_feature (276)..(276): n is a, c, g, or t
  misc_feature (304)..(306): n is a, c, g, or t
  misc_feature (308)..(309): n is a, c, g, or t
  misc_feature (312)..(312): n is a, c, g, or t
  misc_feature (316)..(316): n is a, c, g, or t
  misc_feature (318)..(318): n is a, c, g, or t
  misc_feature (322)..(322): n is a, c, g, or t
  misc_feature (325)..(325): n is a, c, g, or t
  misc_feature (342)..(343): n is a, c, g, or t
  misc_feature (347)..(347): n is a, c, g, or t
  misc_feature (354)..(355): n is a, c, g, or t
  misc_feature (358)..(358): n is a, c, g, or t
  misc_feature (361)..(361): n is a, c, g, or t
  misc_feature (367)..(367): n is a, c, g, or t
  misc_feature (373)..(375): n is a, c, g, or t
  misc_feature (378)..(378): n is a, c, g, or t
  misc_feature (383)..(383): n is a, c, g, or t
  misc_feature (386)..(386): n is a, c, g, or t
  misc_feature (391)..(391): n is a, c, g, or t
  misc_feature (399)..(400): n is a, c, g, or t
  misc_feature (405)..(405): n is a, c, g, or t
  misc_feature (408)..(410): n is a, c, g, or t
  misc_feature (415)..(415): n is a, c, g, or t
  misc_feature (418)..(418): n is a, c, g, or t
  misc_feature (420)..(420): n is a, c, g, or t
  misc_feature (422)..(422): n is a, c, g, or t
  misc_feature (430)..(430): n is a, c, g, or t
  misc_feature (435)..(435): n is a, c, g, or t
  misc_feature (447)..(448): n is a, c, g, or t
  misc_feature (453)..(453): n is a, c, g, or t
  misc_feature (459)..(460): n is a, c, g, or t
  Genomic contig location: Contig_ID=SeqID_11644; Location=1..1388; Strand=+
  SCN-specific regions: Sequence locations=1-13,36-916,938-1240,1262 -1321,1350-1388

SEQ ID NO: 75096 - DNA, 1240 bp, Heterodera glycines
  Genomic contig location: Contig_ID=SeqID_11645; Location=231..1470; Strand=+
  SCN-specific regions: Sequence locations=1-444,466-943,965-1240
gctggccccacgagaatgtcagtgagccgcatcggctgcacacactgcgcggtctgtcccccgacacaacttacaccgtccgaatccgtgcccacgactcgatgggtcccggcaaactgtccaacccggtgtccgtccatacgcttccgcccgccaaacggccgcttctcgcaattccggaaggcaatgagttgcgcgtgccgccaaaagtgccatttgccatcaactgcaacctgagcaggggtgacccaatcccacaggtgggaatttgtggaggcgaggagggaaagaaataagaggcacataggacaaaagacacaaaatattgggggggggggacaaagtatcaaactgaaaaagacaaatgactcaaataatgtgtcacttgtccagatgcattgggagtccaacggacggccaattcgacctgcgcaagacagcaaacacattgcattgcaacacattgggctgttggtgagtagggcagccaatatgcaaaagcggacaattgatcaaataatggacaattgatcaaataatggaaaattgatcaactaatgacaattggactgaaattaactggcaaattgacgattccctttttagtcattttgattttttgtgtttagatgacaacagagtttcaatgtgtggcagagaatgaggcgggacgaacggtgcaaaaagtgttggttacggtcagtgagttactgtattgtatttgtgtaccatacgtaatatttgcgtttatttgaccaatgagtgcacagaaaatgtgtcatttttgtgcaggtgacaggcccatcccaacctgagcaaattcgttaccacgtggacggaataacggtcattttgcaatgggacgagccaaagtaagagcaaaaaaaaaaaatcccgaggtttggggtggggtcgagacgactcgagactctaattctcgaccgatctcggggaaaattttgtcgaaaaccgcaagattgccattaataaaggggctattgtcgggattttgactatactcggggcttcgagctaagagaggttacaaataagctgttatcttcctagtccataagaagtggtgatctgttcaatcactctcgagtgttttctccgcgtgatctcgaccaacccttttcccactccgtgtgctgattagcagcttttcgtatttgcacttaacgttttgttaaggatcaccaacggtccgatggccgactacgaagtgttttacactgat

SEQ ID NO: 75097 - DNA, 715 bp, Heterodera glycines
  Genomic contig location: Contig_ID=SeqID_11646; Location=1307..2021; Strand=+
  SCN-specific regions: Sequence locations=1-99,122-408,431-467,490-715
atgaacaccaatttggagttgtctatatggtcaaacaaaactgaggatgatcagcgaatttgggatgttttggcctgtcaaatttggccaatttttgcgaaaagcattcgtcattttggctttcacgatggcgattatttggacaaattgcgtcgccgcatttcaccgacacttctcactgatcttgatcaattgatttcaatcgattctggacttctattacccgatggaattgctgatgataggccaaatgcaactgctggccaagcgttgtccaaatggttgcacactccgagcaaaaatggccaaccgaagcaattgcatcgcaataattattttggtccaccaaagctggaatgggtcaacaacttcaaagaggtgtgtctcgccagaatttccgtcaaattatttttgtgtttaccaattttttatttagacatttcgccatgccaccacttctgtcacttacaaaatttgttttggtgttttcttgtcgctaatcgagccatttgaattggtgaacgaacggaccaaagagaagctgacactgacgaagggtggagatggcactggtgaattcaattggctgttggagagatgcccaattattggggagacggcggcggcggttcagaaacagcagcagaagaaggacggaaattcggatgccaatttgaacaaagtgttcttccgtctttacgatgacattgggtga

SEQ ID NO: 75098 - DNA, 671 bp, Heterodera glycines
  misc_feature (588)..(588): n is a, c, g, or t
  misc_feature (606)..(606): n is a, c, g, or t
  misc_feature (634)..(634): n is a, c, g, or t
  misc_feature (646)..(646): n is a, c, g, or t
  Genomic contig location: Contig_ID=SeqID_11646; Location=1..671; Strand=-
  SCN-specific regions: Sequence locations=1-671
tacacaccgtccgaaaaaacgagatgtgtaccaataaatagagagtgccagagaaaaacattatctttttttctctaattttttgtctccttttggcgtactatctaatatttctattattaggaataacaacattcacttcgctctatagaactttttttccgccttacagaatttttccctagactaaagacaataccgagtggcttccacaccgattggcagtgtgatttatgcatatttgatcaattgaaaaaacataacgacggttacaagtatttattggtctgcatcgacgtgctgagtcgaatgatctttagtgcaccagccaagtcaaagaagagtgaggacatgatcgaggcttttgatcgggttttcgaaaagtcgaaaattatcccgatgaagatatatagtgacagtgggcttgaattccaagcaggaaaaatgaaaaaatattttgaggaaaaatttattatcaaaaatgtgatgtatagccccgatcttcacgccggagtcgttgaaagggcaaatcggacaataaaggagcgtttgtacagatattttacaaagaaagacactctacgatgngtcgatgtaatagacaanataacaacaaacattaacaacagtgtanataggacactgngggtcaagccgtcttcaattacttt

SEQ ID NO: 75099 - DNA, 378 bp, Heterodera glycines
  Genomic contig location: Contig_ID=SeqID_11648; Location=356..733; Strand=+
  SCN-specific regions: Sequence locations=1-378
atgacggacacagcgctggtgacttccgtggaggatggcctggcaggaattgtgcgccaatttgcaagcgtcattttgtcctcaaaagtgcgcgccgttctcgttgtgcttggccgtgacgcactgctctcaggggagacgatggacacaatcaccgaatatgtcaaacgcatcaaaggactgtgccttcgttaccaagacattcaaattgtatgggccatcccgccatatgtccacacccaaaaagtggcatatgatcagtttttggaggcacttttgacattgactgaaaattgtcccattcaaatggcctttgtgacgcgaaaaggacgttcattggccgaaattttccgttacggcggtactcacaatggataa

SEQ ID NO: 75100 - DNA, 219 bp, Heterodera glycines
  Genomic contig location: Contig_ID=SeqID_11648; Location=906..1124; Strand=+
  SCN-specific regions: Sequence locations=1-219
atgccgaaaatgaggtgcctgggcgttctgagtcgcgccctgggagttcaaccggccgccgttctttcatggccaatcatcaccgccgtaatgatgctgggtgcaaccgccacgaccggattccgatccgcgatcgagtttcggcgtctaggcgacgcccggaattcggaaattcgcgttcgaatatcgccgttagcactcaccgccaccgatacctga

SEQ ID NO: 75101 - DNA, 1427 bp, Heterodera glycines
  Genomic contig location: Contig_ID=SeqID_11649; Location=1254..2680; Strand=+
  SCN-specific regions: Sequence locations=1-337,362-1156,1178 -1238,1260-1318,1340-1427
atggagtacgacgaaagcattgtcgacgacggagcggtgtcactcgtcggtgaagctgacgaaaacgaattgttgggcgtcagcgacgcacaccatgagcagaatgagcgggatttggcaggtttttaccattttccacggaacacaaatatgcaacagagcctagtcaggcagaaaagaactgtgggagacgaaaatagtggtcggcatgttaaccgcatgccaattttggaaaatttggaagcattcggtggccatgattttgagtactcttttcaacgccaccatagagaacaacagtccagacagagaccgaattttgaaggggactcaagggcttacccccctcctcctccttggtatgggtcctacccatggatgccaccgccatggttcaacgctgaaaaagcaccacccaaccaatgccaaaaccaaagggaagccaccgaaatgcaacaaagcgcttcccattcgacttataatcgactcgaagcaattcttatcttggataagctgcccgacatcaacggaagagagggctcggaccgaattcgagcattctttcgaaaattcgaaattggcaccgaaggctggaccaacgcagaaaaattaaaagcgttacaactaaaagtcacgggaaaggcggaaaggtctttgaatgccgcagtcgattttgagcgcactgcgtccaaaatagggatgcgtgaagtgaaattcgacctgattaaaaaggaaatgctacaaacgctggacgagttggatgcgcgcgagacctcagcttttgatgagctattcactggactgcaaagaaggtcgaacgagtcaattgaccaattggccgaccgcgttgggcgaacagttcaaagagcctatccaaatttgaactcaagagacatcgacgaattgtcgattaaacactttacgggccttagacagccatgagttggcattaacattggaagtgtctcgcagtccgtcgatgagctatgaccaatttgtgactttggcatcgcgagccgagtcaacaaaacgagcagtgcaaaaatcgatatcaaggcagcgccagtatgacaatcagaatgtgaaccgtagttcggttagcgcccattttccgcaaagtcgagcatctgttacgtgtttcaattgtgggaaagccggccacatttcaacattctgtactgaaccgagacagaataatcctttttcacgcgatgcgcgtaatcgagaccattttaatgcaggaatgcagacaaattcaaggacagcaaatgaaaaccgtgacagttggcaaaaccgtcagaattttccaccgagaacgggtggaaaccaacagccattaatgcatcaaactttcaaacgttcaccgaatcaatttggtggtaccaatgcagcaaattgcattcaaattgaggaaattccggcggaga

SEQ ID NO: 75102 - DNA, 531 bp, Heterodera glycines
  Genomic contig location: Contig_ID=SeqID_11649; Location=1538..2068; Strand=-
  SCN-specific regions: Sequence locations=1-454,479-531
gaccttctttgcagtccagtgaatagctcatcaaaagctgaggtctcgcgcgcatccaactcgtccagcgtttgtagcatttcctttttaatcaggtcgaatttcacttcacgcatccctattttggacgcagtgcgctcaaaatcgactgcggcattcaaagacctttccgcctttcccgtgacttttagttgtaacgcttttaatttttctgcgttggtccagccttcggtgccaatttcgaattttcgaaagaatgctcgaattcggtccgagccctctcttccgttgatgtcgggcagcttatccaagataagaattgcttcgagtcgattataagtcgaatgggaagcgctttgttgcatttcggtggcttccctttggttttggcattggttgggtggtgctttttcagcgttgaaccatggcggtggcatccatgggtaggacccataccaaggaggaggaggggggtaagcccttgagtccccttcaaaattcggtctctgtctggactgttgttctctatgg

SEQ ID NO: 75103 - DNA, 1938 bp, Heterodera glycines
  Genomic contig location: Contig_ID=SeqID_11650; Location=585..2522; Strand=-
  SCN-specific regions: Sequence locations=1-189,211-266,288-310,332 -836,858-1233,1255-1938
ttccgttgcccttttttggcttttgtctttctctttttcggcggatgggctcagttttctcttttttctcatcggcaccaatcagttcgaacgtcacacttttgagtttatggcacaggaatttgcgcgaagggctcacaaagtgatgacggtgaagcccattttggtgccggaggaaccgcgattggtacaaaaaagcagaggaaagggaagaaatgaaacaccggacaaatgcccgggggatttaaaaattcaatggttaaatctccgaccaatttgataaatggggaaaaacagcgaacatttgccatttggttccctccctttccctgaaaattattaaattttcggtttttttttgttaggtaaagcccattctgcacatggtcaatgagaaagtactcaaagatgtgttgccgaggtgaataaattggaaaatcgaattgaaaaacggacaaagggaaaaaagaattgcaaaatgtccaatgactaatgatacagtaaccaccaaaggagccgctgaagcaacaccatacactcagcagagagcataaaaacacgtgctaattaatcactgttcccttatcaaaaggcgtctctccgaacccctggcgcatgtcggacaaaatgtgccctggggcgaagaaacggacgcggaaaatgccctgagggtgccgtattgggcggcacacaatcattcatgtgggaaggtgcgcacggaagaaggcaaaagtggggaaagccaagtccacattatgtagatgctgaacagcaatctcatggaagtgatggcccggggtgacttcgacttggccattctctacgcgggaaacccgtgtttggtttgaggccatataaaggctgtaaatggctatatttgacgatgtgttaagatgggcttggtgcactccgtgggcattccttttgtgctgttcgacctcgagggaatcaccgaagagactttggtcgcctcgggggttcgtcattttcaacactttcgcaatatttcccatggaaaatttgtaaaggcgccttggaatttgcccgagttggccttggaaggcaatgccttcagcattttcggggttttatcattggtttattttcgaaatttgcctaacaaataaggcctttactctgcgtctgtctcgttctctttctctgctctccgagtctttcgcccaaagtgccgtcccgtggctggcccaacttttatcgaagagatttcgtcatttggatgccccaattgatgctttgttcgcttcagattttgaaattaatcgcaaattccgtggcaaatttcccaaagttgccgaggtgcagaattaaatgaccacaataaaggatgtttctttatttaagctcagaaggatggcacgtcttttccttgtcaactctgaccctttccttgaagctccgtcttcggcatttcccaataatttgttgcccgtcggcggagttcacatcgattccattcgacctcttttttcagtatgaaactgaatttaggggcacattcaaataagccaatcaatttaaagccgtggaatttctcaatggaagccaatggaaagggcgtcatcctttgctcttttggcactcaaatggacaccggcacaatgccaacagaggtggccaagccaagcgaaacagaaagtgtgtgattggagttacttggttcagtttatccgttctctgttggacactttcgcacttctcagtgactaccgaattttttggcgcatttctcccaaactttcgctccccggcctttccccttctcaaattgatggactttctgaacgcatgcctcacctgaacatcaccagctttttcccacaaaacgaattgcttggtgcgttcatacagtacaccccgtcaccatttccctttaattaagcgcatcatcggacgcgtttgttgatcacaaatggaggt

SEQ ID NO: 75104 - DNA, 879 bp, Heterodera glycines
  Genomic contig location: Contig_ID=SeqID_11650; Location=1537..2415; Strand=+
  SCN-specific regions: Sequence locations=1-129,151-519,541-655,677 -699,721-776,798-879
atgacgaacccccgaggcgaccaaagtctcttcggtgattccctcgaggtcgaacagcacaaaaggaatgcccacggagtgcaccaagcccatcttaacacatcgtcaaatatagccatttacagcctttatatggcctcaaaccaaacacgggtttcccgcgtagagaatggccaagtcgaagtcaccccgggccatcacttccatgagattgctgttcagcatctacataatgtggacttggctttccccacttttgccttcttccgtgcgcaccttcccacatgaatgattgtgtgccgcccaatacggcaccctcagggcattttccgcgtccgtttcttcgccccagggcacattttgtccgacatgcgccaggggttcggagagacgccttttgataagggaacagtgattaattagcacgtgtttttatgctctctgctgagtgtatggtgttgcttcagcggctcctttggtggttactgtatcattagtcattggacattttgcaattcttttttccctttgtccgtttttcaattcgattttccaatttattcacctcggcaacacatctttgagtactttctcattgaccatgtgcagaatgggctttacctaacaaaaaaaaaccgaaaatttaataattttcagggaaagggagggaaccaaatggcaaatgttcgctgtttttccccatttatcaaattggtcggagatttaaccattgaatttttaaatcccccgggcatttgtccggtgtttcatttcttccctttcctctgcttttttgtaccaatcgcggttcctccggcaccaaaatgggcttcaccgtcatcactttgtgagcccttcgcgcaaattcctgtgccataa

SEQ ID NO: 75105 - DNA, 1014 bp, Heterodera glycines
  misc_feature (264)..(264): n is a, c, g, or t
  Genomic contig location: Contig_ID=SeqID_11651; Location=1292..2305; Strand=+
  SCN-specific regions: Sequence locations=1-1014
atggcagatttaagaatggaggtaaaaataaatgatttcctttcatttattcctttcatcttaaggccggcaatgatgtgatcgttcccgtcaatgttgcaattcgcatattcggttttgttagtagagatgatttggaaaattgcaaactcacctgcaaatcatggaaagacgtgtaaggcattgaattttgttttttgcaataaaaccattggcaaataaaaccgattattttaagaattgattacgcagacaaccgaaagnaactcggagttgcaactgaggcacattgacgccatttgtctctcaactaattctgaattttctatcaaaatttactacaaccaaactattcgcgagttttactacaaaaaatatttcgctgatatgttaggcctttttttaaataaaatagaaacattttatcttcagggaaattgatgaaattgaagtgaaaaaagtcaggcatttaacgagtcaatttgacgagaaaaaatacgttttcccatgtggagagcatttgccaattcggcaaagtcattcctttgtttttccagcggttgatatttttcaccaacacaggtgtaaaagtaggtaatctttgggttaacggcagttcgtacaattttttaattttcattaaaaccgaattttttatcaaatgatttttttaaatttttgcgacacttttgctgtttaattttttgggtggtttcgagtctctgaattctaaagaactgcgatgacatcaattcttttgattaatttgtaagctaaaaataatttcaattttttcagtggtgaggccaaccgtttaccaggaccatgtcaattacacgcgaaaactcttcacacctccgctcagtttttatgaacgccttcaacaaatgctcaaaaaatgtaaaattcgtctggtgattttccacgcgttcactttcactgatttctttgttgaaaaaatgcgtgaatttgcgtccgatgcgtttacgagggtcgtttttctttcccttcact

SEQ ID NO: 75106 - DNA, 610 bp, Heterodera glycines
  misc_feature (562)..(562): n is a, c, g, or t
  misc_feature (568)..(568): n is a, c, g, or t
  Genomic contig location: Contig_ID=SeqID_11651; Location=1..610; Strand=-
  SCN-specific regions: Sequence locations=1-610
  Gene Ontology: Cellular component=mitochondrion
agagctttggaaggtaaaattgcagttgtgactggtgcttctcgtggtattggacgagggattgcgcttcaacttggtcaagctggtgctacggtttatgtcactggacgagctcctgccgcttcgtactctctgattgagaagggacttccatctttggaacaaacagcgaagggcgagtcactgattgaattttgtggtgttttatgtcaaattagaaatcaaaagtcgtggaggagaagctcatcctgtgtattgtgaccacgcgaactctgacgacgttcgccgtttgtttaagcgcgttgaggaggaacagaacggccgactgcacattttggtgaacaatgcctattccggagtgcctgtcagtttcttcgacactaaatttgcccgcacagtcattaaatccctctcccgttcaagagtctgattgaaaatgccgggaaaaagttttgggaatgcgaaccggagttttgggatgacatcaacgaggttgggctgcgcaacgtgtacttctgttcaacgcttgccgctcgtctgatggttccgcatggcaatcttntctatntctgagataatcattgctttgacggtcaattgttttagagga

SEQ ID NO: 75107 - DNA, 1275 bp, Heterodera glycines
  Genomic contig location: Contig_ID=SeqID_1654; Location=469..1743; Strand=+
  SCN-specific regions: Sequence locations=1-116,140-221,243-673,696 -781,808-1145,1172-1275
atgtgtcgtaattttcaggctgttgaagcgcatccaaaaattgaagacggacaaggaacagttggcccagaaatacgagcaggaggaggagtatctgatcaacgatttgatgcgaaaattgacacaggttcatatttttatttttcaaaaactcatgtttaacgggtggttggggctcggttcaactttttggcgaaacactccggttttttcaaaaaggaccattttgttcatgagtttctccatttctttggttttccaaattgaatgcatttattatctttcgatagagccccaaatgttctctatttatctgcaaaatttaaaaaaatctcgttaattatcaaaagagatatgatcaaaaacttcaataattggttttccgaataatttttgcctataacctcgacggaattctttgaaacatgtccaattcgaacaattatgaaaggagttattagaaaaatgcccgtttgaaatcgcccaattgatcctttacgggacgactacgtaacaggacaaaaagttgtcagccaaattgaattcttggacaataacttttttctctttggacccaatttgtcattgttcgaaagagtttgagttcttctggccattaaattttttttgaggtttgacagaataataatgaacaccttagactaatgaacaaacaaagaatacttaatttaattgacaattcatccgacgaaattttggggtgcaccggggcggctaaccccctccccaaattttagaaattgcaaaagtttttcaaaacttaattattatttataaaatttttaaggttttttttctaacatttagtgtattttcttcctttttttgcagttggaaggcgaacgggacgaattggccaatcggttgagcacggaccaaagctgggtggtggcaaatctgttgcagaaaatccgcaaattggaagccgaaatccagaacaaccacaaagtaacgaagggatatatttggcgaggacactccgtctcggtttagcactgacctcatttttcacgcaaatttttccataaggggggggggaggcaaaatcaggcccgtatccagaaaaaaatcacaaagtttgccattttgggctcaaattttaaaaaataatggttcaattggtcgcctggaaaaattttttggaaaatttaattcaatatgataagaaaatgtgcaaaattttcacaaaattctgtcaggttcaagtctgagttttttcaatccctgatagcctaaatagtattgaaaatgata

SEQ ID NO: 75108 - DNA, 212 bp, Heterodera glycines
  Genomic contig location: Contig_ID=SeqID_1655; Location=802..1013; Strand=+
  SCN-specific regions: Sequence locations=1-121,143-212
atggcagggacggaggaaccgcaatacacccgggaggggcgaggtattcgtaaaatgcaaatttctggcccaccccaaccaaacacacatttgggtgagattattgaggcccaatctccaaacacaaatcataaaatttgaaattcatttgcctttttccagtctttggagcagttgcgccgcgaaaaggtggacttggagaattcgcttga

SEQ ID NO: 75109 - DNA, 1210 bp, Heterodera glycines
  Genomic contig location: Contig_ID=SeqID_1656; Location=20..1229; Strand=+
  SCN-specific regions: Sequence locations=22-188,210-218,240-742,764 -1027,1049-1153,1177-1210
atggcgttggtggacaaacatttcaatggcaaaagcgaattgacaatttggagaccaatcgaaattcgcaaggacaaaggaccagaaccgaaactttatgtacaaatggatagaaaatttgacaaatttgtgccatttccattgcccgaccgtccgttgcccagcaaaattcgctttgattctattcagattgagtacttaaaagcagagctatgacattaaaagcattctttccattttcaggtacattgatcactccgtcatcgcttttcttcgttcaaatcaccaaattttcgacaaaagaggcatcgatttacatttgtggcttccttcacataccacgaatggccaactaatttgggacatttttggtcgtgaaatttggcccatttttgcgccaaacattggtcatttgaccatttcaaacgctgagcatttggacaatttgcgtcgtcgcatttcgccgacaattctcaccgatctcaaccaattgaattcaatctattccggtgctttgttgcccgctgcgtttggtgatgattttgatgggccaaattcaacaatttctgctggccaagcattgtccaaatggttgcacaatccgagaaaagatggccaacccaagcgattgcgttgcgataattactacgaacaaacggacttagattggatcaacaatttcaaggaggtgtggcccataatctcgacaaatcactgatttttgtttccaaattgtttagcattttcttcgtgccaatgccatttcttccgtcagttacgaaattcatttttatgttcatgtgccgtcaatacaaatggtgccatttgaattggtgaacgaatggacaaaggaaaagctgacattggccaaagcaaatgaaaatgaattggacaaccgatggataatgaaacgatgcaaaattggagagacagcggcggtcaattgggaagacggaaattgggacaacaattgtaacaatgtgttcttttggcttttcggtaccactaattgcattgggtgagcaataaaaaggggatttgtttttatacatatccaaatttgagatttgcgcttaatttaggcctttgtctccgccaccggcagaagaaacgggacaaagcatcacaaattggccgtcttttgctggcaattagtgatggacaaaagaacaaaaaacacaatgatgagcaaggttttcggggacgctga

SEQ ID NO: 75110 - DNA, 771 bp, Heterodera glycines
  Genomic contig location: Contig_ID=SeqID_1656; Location=5578..6348; Strand=-
  SCN-specific regions: Sequence locations=1-129,151-771
atggggaaaaagagacgcactaccccaaatctcaacgaatctgacgacattttggatcgtcttgatcgccttgaacagcaaataaattcaatccaaagcccacccttaaactcggtcctcgaacggctagaaaatttggaaaaactggtacaaaatttggtcaataaaaccaaaaatcaatgccagtgccatgctggtgacgaccaaatcaacaacagcgccactcagtggggtcaaccccctcactttgttcgtcaatcttctcatctccaaccggggtccatctcacagatggttaacaatgccatcctcgacgccgaccaaatcaaggcaaaatcaatgcgggcggtgctggagaaagtgcccgagggcatcaatgtcaatgaattggtgcaaaaagtgactgacgaatgcggaatcactgaacatttgaacgctggagatgtccatcgccatccatggaccgttgtgggttccgatcaatcgaacaaaaagccccgcattgtcaaaatcccattcactgaacgcaaataccgtgatattttcataaaaaattttcgcaaaacacttaaaaaacaccaaaattttccgcaaaatatcacggtccgtcgggatctgacccgttcggaactgcaagtcttataccagcttaggactcaagcatatgaaaggaataagtccgaaggactgttcaaatatattgtcgttgatctttccattatcacattgaaaaacccacaccctctcaaaacacgggaaaataatgcatag

SEQ ID NO: 75111 - DNA, 1240 bp, Heterodera glycines
  Genomic contig location: Contig_ID=SeqID_11653; Location=1812..3051; Strand=+
  SCN-specific regions: Sequence locations=1-97,119-128,150-420,443 -577,606-847,1005-1039,1072-1099,1122-1240
  Gene Ontology: Mol. function=protein binding; Cellular component =replication fork; Biological process=DNA replication
atggaggttaatcctgccgatttgaatttccctaaagcagtgatcgctcgtataatcaaagaagcgttgccagatggagttacagtttcgaaggtattttttacacactttcatgtaataaggaggttattttttaaattttgttttggatgctggacgtaattagctgattagattaaaattttgagattaatttcaggaagcaaaaaatgcgattgctagaagtgctgctatatttattcttcacgcaacttcactagctaatgacaatgcacaatcaaaaaagagaaaaaatctgatcgccgatgacgttttatatgcaattaatcaattggaatgcgatgagcttgagaacccggtcagttttgtgcaaatcgaattgtaagaatgaattatcgcacttgcatagtgtcaatttggaaaattagtaaaaatacaaaaagggaactttatccttggtttccaacgccataaattttctttcttggtcaatgcctgcatttttgtattcaaacgaaagctcagtttctcaataatttataaatgcaaaaagaaaacacgaaatttagcttttttcgggtggtaaaaataattttttgtctattatattatcccataatatagttaaaccaaaaatgctgtagacttaaaaatagacaattaccaagtaagataaaagttatggcctaagaaactgacaaatgagatggtcattgatttggacgcataaactgaattagaaccaattgggcttcaaactgactctgttttaccaaataaaacccctgacaggtaaaggaagcactcactctttacacgcaaaagaagaatcagcgacaacaacaccgaagagagagaagggcaaaacaaagagaggaaaaacggtttgaaaccaaaggaaaaggggagacagaagaaaaaggacagcaagaggatggacaaagcgactgcgaacagggaatggagaacggtgacgacgatggagaggaggaggaggagatggaagacgaagtggggcaatagtgcgcatttatttagactttaaactgcatttttgcataaattctttttactacctattttaaacggccgttttccgttcaaaaggctttattatacttctaattgtaaaaaggaatctgttttttgaatggtattagcttgtatggcgacgcatgattctgaaagttgttcagcagaacaggtggataaacacggatcaaagcactaaagttttgga

SEQ ID NO: 75112 - DNA, 48 bp, Heterodera glycines
  Genomic contig location: Contig_ID=SeqID_11653; Location=53..100; Strand=+
  SCN-specific regions: Sequence locations=1-48
ggtgactttggtggtaagaagttcaaccagggaaaaatcttcaagtga

SEQ ID NO: 75113 - DNA, 289 bp, Heterodera glycines
  Genomic contig location: Contig_ID=SeqID_11654; Location=272..560; Strand=-
  SCN-specific regions: Sequence locations=1-4,37-65,96-149,186-189,211- 289
tagtaaaaagaatttatgcaaaaatgcagtttaaagtctaaataaatgcgcactattccacttcgtcttccatctcctcctcctcctctccatcgtcgtcaccgttctccattccctgttcgcagtcgctttgtccatcctcttgctgtcctttttcttctgtctccccttttcctttggtttcaaaccgtttttcctctctctgttttgcccttctctctcttcggtgttgttgtcgctgattcttcttttgcgtgtaaagagtgagtgcttcctttacctgtcaggg

SEQ ID NO: 75114 - DNA, 937 bp, Heterodera glycines
  Genomic contig location: Contig_ID=SeqID_11654; Location=657..1593; Strand=+
  SCN-specific regions: Sequence locations=1-937
acgcatgattctgaaagttgttcagcagaacaggtggataaacacggatcaaagcactaaagttttggaataaataattatttcctccctataaaaggcttctactgccgatgaggttgagtcgtccagtaggaggtccagcacagataacttgggaggtgattccgactacggcgatgactcggtgtctgacacagattcggatgacgaaaatgaaaagagcaaaagttcgacgctgagagaacgcatgaaatatacggactcgaaaatacacgacggaaaaacaagtaataaacgttaattgtcaaatgggagagacacttcctatttgtgctcagatacacaaagtgacactgagacgaaaaatttgctggatgacatgggcgaggaaatggacgacgatttgtcgatattgcacgagatgaattgtcgtagtaaacagaatgggtcgtcagagttaggtatgtttggatgtaaaaatatcaattccccatttctattagactcaaaactctttgagctctccgatgaacagttgaattattacaccaattgctttctttttcttatgcagaaatcgcaggttggctttaactccctttttcatcttctaaacttaattttgaggggttcttttctctgcaaggggcgctccaaggtcgtattcttttccgagtccgaatttctgcttttttaaggcaatgacagaacaattcttgacttcttccgcaaaagttccctcgacgattcaattctttccaaaatttggtctctcagcgatgtgaacgaggacggatttttgaatttggcggagtttattttggccatgcatttggtcgttttgcacaccaaagtgaaacttcctcatgcccatattctctctctcatttctcttcttatttagggttctgttcctatcccaagtaggctcccttcc

SEQ ID NO: 75115 - DNA, 1424 bp, Heterodera glycines
  Genomic contig location: Contig_ID=SeqID_11655; Location=10..1433; Strand=-
  SCN-specific regions: Sequence locations=1-8,31-126,176-225,248 -532,588-706,728-816,859-1011,1137-1424
atgacaatggcatttttgccaaatatttgggacaacgatcagaacaaaccgctgattaaatggctttggatggatggaaatatggccgatgaatgtaaaattaccataaattgtttaataaaaaagtttttgtttttatttttattttaattttaaataaaataattttatttttcccattttctcccattttaaagtgttttacaatgatcctttgctgtctgcccaatattctgagcttctttccacattggtcagaaaaaatgctgtcagcagttggcttaatctcaaattgaaggtaaaaagcaatccgatcaattaaaattaatttagccaattaatttttgctaattttgatggcattttcagttggatttattcgttttcgtccgttggatggatgccaaaattttgcaacaaaaagagcaaaaaaatgcgctccgttgcgccaacttttgggcacgcaacaaatttctgcttgccattctctacgaccgattgtttgacgagcacagcgacgaaatgccaacatttgaaatttgccaaacaaatttattgaatgaattttatttatttttggacagtttattgagtgcaaaaaatgccaaaagtgaaaaagccatggaaaatggattaagaaaaatcattgagaagaccgaacaaatttatgagctgcttaaagtgacggccgaactgaaaattgtgaaatacagccaaatgggacagtacaaacactttgagggactaatgatggaaaagcacgtggagacaattaacgaattaatggccaaggatggacagttcaaagagcaattgcaatttggtgaggggaaggaaaagccaaaaaaggggaaaataaataatgaattcattcagtgtttgattgttctcaactcaataaactccaacaatttaacgatggatctgttggagcagaaaaatgtttgaatatattgaactcaattaaaatagatcattctgcgttaattggccaattgaaaaaaattggcgaaaaaattgaaaaaggaaacgaaattaaattcaaaagcaaaaagtcgaaaatgaaaaagcagaaaaatattaaggaaaaaaacagagaaggggaaaaagaaaaggaaaaagaaggagaaaaagaagcattgggtacggtagagacaataacggacaattggccaacagcagaaaaggatacggtagagacagtaatggacaaagggccgacggcggaagaaaaacacaaacagtcttcatcaccagcagcagtgatggaagagaaatctattcgggatacagtacaagcatcaccaatggtagcgaaatctgctgctgatcaggatacggtacagtcattgcttgcagcgaaatttgttggggctacagtacccgacgtaccatcaatgagggcaaaaagcaaaggggatacg

SEQ ID NO: 75116 - DNA, 1586 bp, Heterodera glycines
  Genomic contig location: Contig_ID=SeqID_11656; Location=257..1842; Strand=-
  SCN-specific regions: Sequence locations=1-596,618-793,841-1122,1144 -1351,1374-1399,1510-1586
atgaccaacgaaagtgcctttgtgcgcgttcgtcgctttttgttgcgccgaagcgatgctccgctggccgacaacgacaattttttgcagttcggcacggcccttctcattgactacatgataaaatttggcaaccatttgaggaatgattggcccaaaatgccgccgggcattgccactttggccacaaaaattgccgacgttcggcgggacgcttttcggcactttggctcggcccggcacttttgcgtgatgctcaaattgatacttttcggaacacgcatcaaacagacactggtggcaaagaaagagaaaacgctgctcaaattgaggacggacgaatgcgacgaacggaaagcgcgagaaaagctaattgaggggagcagcggtacggaattgggcgaactgatcgaatttgccatcgcgggaatggtcaaggcgtcacccgcccggttccgatcactgatcaaatgctcggggacaaagaggcgctttgcgcgactaatcggcaccccggaacggtttaaagcatttgcaaaacggttcaatttgacggcactttttgcggaaaacggtgaaggattgtcaaattatgtaaaataaatacagaaaaaattatcattttaattaaagcattaaagaagcattttttacgatttataaacaaaaatcaaaaaatttcttcaatttttaaaagaaatttgaatttttttgcgctttttgttttaattcagttcaatcgtttatatattttttttttactaaacatttctctaaccgttttaacaattcctaattaaataattaattaacgaattcaattaattcattaattaattatcattttccagcgtttacaagcgacgattctttgtgggatcattatttttgcgcattgcaaaagcccgacacattggcggccaaagcgcacaaaatcagtgccgatttggcggtgttcgtccgatgggtccaacgccaactgagcgccgccgggagagaccggcgtctgctgcccaaattttttgagtttgtggacgaattttatgaagaaattttcgacttggaccaaatgcaactgacagtaagagagcactttttgagacggaaattaatcgttgaaacgaaaaaatatgctgaagaaaatttgggggaaaaaggaagcgaaaagagtggagaaaaaagggggacaaaagtgatcagaaatgggaagaagcaatttgatggaggagagatgaagccaacggaggaggaaattggccaaattgggccatggatttggcaattgcacaacgcggaattgagaagcattttggaaagtgatcagaacaaaaatgctgcttttatgggttggaaaattagttaaattgaaaaacaatcaatttcattatccaattttcagaataatatttaaattatttaaaattgatgcaatttttcaaatattattatttttattaaatccgtcttccataaatttatgtaaaattaaaattttattttaaatttaaagttttgtatttcaccgacgaaaagaaaattaccgacgcattgcgccactttctggggaataataactttataataaa

SEQ ID NO: 75117 - DNA, 144 bp, Heterodera glycines
  Genomic contig location: Contig_ID=SeqID_11657; Location=856..999; Strand=+
  SCN-specific regions: Sequence locations=1-144
atgctcagggcggcatccgggccaacaattacgtcacgacgacagtccaactgcgcgagccgcacacaatccgacagccgaccagcgactgtctccgcgtggaaattttcagggacggcgaaagcgttgcggtcggaagaaaag

SEQ ID NO: 75118 - DNA, 457 bp, Heterodera glycines
  Genomic contig location: Contig_ID=SeqID_11658; Location=1205..1661; Strand=-
  SCN-specific regions: Sequence locations=1-457
  Gene Ontology: Mol. function=transmembrane receptor activity; Cellular component=plasma membrane; Biological process=receptor guanylyl cyclase signaling pathway
agggttggccatgccccgttactgtttgtttggggatacggtaaacaccgcctcgcgcatggaaagttcttcaagccgtacgcttgtttcactttgaattttgtcattgggtttttctgaattcacttttagcaaacaaaattcacatgtccagtgaaacgctcgaattgctgcacaaaaatttcaacggctcttatcacacggagagcagaggcgaagtgatcataaaggtcacccacttggggcaattaactaattaattccgctgcctaattaacgacaatgattcgattatttttttgccctttttgtgctttagggcaaaggcgtcatggagaccttttggctgttgggccaagtcgaaaatggaacaacaattaacgccgattatgcgcatagaatgcatctgccggtgatcaaatttggggaggagggaaatgaaaccggaaaaaatgcg

SEQ ID NO: 75119 - DNA, 56 bp, Heterodera glycines
  Genomic contig location: Contig_ID=SeqID_11659; Location=895..950; Strand=-
  SCN-specific regions: Sequence locations=1-56
atgcttgtgatcagcgggtggcagacgctggtacaagggcgacaggacggagagga

SEQ ID NO: 75120 - DNA, 103 bp, Heterodera glycines; identical to SEQ ID NO: 74247
  Genomic contig location: Contig_ID=SeqID_11659; Location=331..433; Strand=-
  SCN-specific regions: Sequence locations=1-103

SEQ ID NO: 75121 - DNA, 185 bp, Heterodera glycines
  Genomic contig location: Contig_ID=SeqID_11659; Location=1137..1321; Strand=-
  SCN-specific regions: Sequence locations=1-65,88-185
tcgcgactcacgtcacgagaaataaaatggaaaagataaattttaaagcatgatgcaatttcattaaaaatgggaaaaccttaatttaattggaaatgttccccctcttcgtcgttctattcaaaaaatatttgtttgtttacattcaattcttattcatttctcacacaaaaatgtattaatca

SEQ ID NO: 75122 - DNA, 1482 bp, Heterodera glycines
  Genomic contig location: Contig_ID=SeqID_11660; Location=193..1674; Strand=-
  SCN-specific regions: Sequence locations=1-10,32-375,397-1016,1038 -1482
aagggtggacaacaacaacctgcagcaacagttgctggagcagtcgctgcttctcgcgctattagccactcagcaacaaacgacggcggcgacacccatcaacagaatgccaacacagccaatgccaatgatgacgccggaaacaatggaaatgccaatgatgacgacgccgacaacggcaacaacccacggtgaaatgccggatatttacgaaattgcccccccccccccttgatgcacctatgactcgcagcctcttcctttttctctatcagtttattccgtggtgagtcgttccacaaaaaactcagtgattgattggtcattttccggaagcctatcgcaccactttcgggcaccaaaagtgcctgatccgcaacccggaccggcccggttaagaaaaattttttgttcagtttttcaagggctatctcccaggccgggtccggttctttatccattcacttggagcccgtcatggttcgggcaaatctgccggaggaccctcagcctcgcccccgaccctgtcgatggccaaccaaagctaagcttgccggtaccagcggcttttttgtacagctcgatgagctctacaaaacggtatcaatggcgtcaggttgtgtttactacaaatgtagaaaattggcgagaagtgatgccaaaaattgaaaaattaaaaaatttgaaaatgacttgcgaacgacctagcaccgtttattcatgaaaagccatttatctctcgctctatagaatggagccgcgacagcattgacatgtgtctttgcgcattgtttatcaatggcatctctaatgatgcaattcgggttgaattgatcaaaaagggcgacaaggacctaaaattcaaggacgcagttgaatcagccgttttgttggagcagtccaatttggatgcccaagcaattggctcaaatgcaatgcctgaggtcgcgaaagttggcaatcagcaaagaggaccaagaacgccgacgaaaagcacgagaagttgctttcggtgcggaaaaccgggacattttgcaaatgtgtgcccgaatcagaattcgacatgcagaaaatgcggaaaaattgggcattgggccgttggttgcaaaagcaaaaacagagacggtaatgccaattttggtcaacaatttggtcaaaagccaaggaccaacggacgacaaatcaagaacattgaatgttcaaatgtcagcgtcattcatgaaatcaagggaatttctgccgatcctggtttcattcaactcaacattcacaatggaaagttggagtttgagttggacagcggtgcggacgtcacagtgattgacgagatcgactggaaacgcattggaaagccaaaattggaaccatcccaaggattggttgcctatggcggaaaatccattgctggaattttaggaaaggcaaaagtgaaactgacgcacgaaggaagaacgattgagtccaatattcatgtcataagtg

SEQ ID NO: 75123 - DNA, 156 bp, Heterodera glycines
  Genomic contig location: Contig_ID=SeqID_11661; Location=1952..2107; Strand=-
  SCN-specific regions: Sequence locations=1-156
atgcacgctgaaaatatcgtttggctcgaaaaatacccgcgttactttcgcatcaactggaacggaatggaggaccgaagaattgaccgttatgaggcatttgttaagcaactgtccggggtggacgattgggcacgaattggaagtcttcctgtt

SEQ ID NO: 75124 - DNA, 1153 bp, Heterodera glycines
  Genomic contig location: Contig_ID=SeqID_11662; Location=1..1153; Strand=-
  SCN-specific regions: Sequence locations=1-1153
atggaagttgtgctcagtcgggtggactatgcccacgttgggacgacttcgaaaggttggcgaaagggaatgaaggcttaaaacaatggacaaagtgaagcaaagatcggatccaaacattggtccatcggtcgaattggcggcacaattgtgccgaattttacttttcaatttccaccaaatttttctcactatttcccctccccatttcccactgaaaaggctgtttgtgtgtaattcaaaatcagtcgccagtcggacgtgccgaagatcagccgattactttggcggaggatgggggagaaaaggcggagaaattgggaaggaggggacggcgggggagccgaaagggaatggcaattgcagcggaagacaaagtgaggggaaagatgggacaaatgcctatggaacaaaagggacaaaatttgggttcaaatttaaagtggttttgaagtgtttgggggggggggggaccgaccatcatcgaaccgccgggggccttttggcaaactttcacaataagctgacttataatcctccttatttggccatgacattgaaaggtggtcatcggaggacagaacggcgttttgctgtgcatggaaaggcgaaataacgacacaaatgtgagggaaagcgaaggctgcgccttttatgggctaatttcactgagaataattcccaggttctcttcaaaacccctccaggctctcccatttcgcgcatttatttgggcggtgcgctcggctccgtccaggacaaagcattcgtcgcctgtggcactgaggttggtcccccccatcctctgatgagggagttgtactattcttccaaatgccattttgaattggcacaggtccggggctacagccgcaagggcaaacagtttctgacctttgagagtaatttgacggaggacattcgctcgttgttcgtctacggcgtggacatgttcatcgggggcaccaattccctttaccatttccacgactgtgtggagaaaagtgtgagtcacccgaccgaagaacggacagcaaattgtattttaataattttggttttaagcacttttccagtgccgacccgatcaccgattgcgtgtgtttgccagtgacggagggcggatgggtggggcgcggactgacgcccgttt

SEQ ID NO: 75125 - DNA, 2314 bp, Heterodera glycines
  Genomic contig location: Contig_ID=SeqID_11662; Location=2055..4368; Strand=+
  SCN-specific regions: Sequence locations=1-1034,1056-1243,1265 -1416,1439-1600,1623-1734,1765-1802,1835-1850,1889-2143,2165-2314
atggagacactttccatttctttacaacaagggcaagaggtgcagcaaaacgaaaccaattcagtttccacgtcttccacagattccaatgatatcgatatccaagcattggttcggccatcggctcggcggcagggcgatgtgatttcgtaatcacgcagatttttaatgccatttaatttgttctcgtctattttaggcctcatcgtgcggttttgactctctccaaaagcatgttcaatgccggatgcttctcattgccttacgcttggatgctcggcggaaaatgggtgtgtgtctggtggcttccgattccctttctgtttatccgttcttcaggtgtcattggctctcacttttgtcattgccggctttaattggtacggcaaccacattctcgtccgttcgtctcaacatttggctaaaaagttaacctctttccaatttcttcacatttcaacaatttcaggtccggtgttgcctctctcgattatggacattttgcgaaaagagtgtgcgactacagcgaattgccatttttgcgacgtcacagcaagcgaataatgtgccgaattaaactgacattgttatgctttctcacattttcaggtacgtcgtcaacatcaccatcctcttctaccaacttggtccgttcccatgtccatctttctcatttactttctttaggaatgtgtgccgttgccattcttttcattgctgacaatatggtgcacatgcttggctcctggcttggcaattccaccactcttatggccaccattgccattgttttcattatctttacgaacatgtaaatccgttttcgtacttgcgtttgaaattgcttcattttctgtcttaaaaggttcaccgaaatgcgcgtgatcagtgtttttgccgccgtttcttccgttttctttttgcttggtgccggagtgattatgcaatttacgctgactcagcccagcaaatgggacgaattgccggcctacacaaatttcaccgatacggcatgccaatgtgccatttctccgatattaaatcctatattttcaggtgattttcattggaatgtcaatgtacgcgttcgaaggacagacaatgattttgcctattgaaaacaaattggcaacccctgaagattttcttgacaattttggtgttcttccaacgacgatgtgcctttgcacggtgaaaacaaaaacaattttgcgcaaataatgttccctatctttcccatcagttttttatgatagcgattggattctttgggtacaacggtttcgggacgaatgtcagagagacgatcactgtaaatgtgccgcacacggggttagtatgccgaaagataaatttaaatgaaaaatggttgaaggtaatcgaatgaatgcaaattccaagcctatttattaatgggtttttgtaattatgctagtaactcttgctgattcagtctctattccgccgtcaatggctttctgtgcattcagtccatgcttggccattccattgcgatgtacgtcgtgttcgacatgttctacaagggattccgcagaaagttcactgctcgttttccgaatgtcccttcccttgtgcgttttcctttgttaacagtttcattttatccaattgttcaggttgtcgacaaagggtttcgcgtcggttgggtttttctcacttatctgatggccattctcatcccccgtttggctgtgatgattcccttggttggtcgattttttaaaatcatttttgcatttgcttttaggtcggtgtcacttcgggtactttgtgcgctttagtttatccaccattttttcaaattgtcactttttggagcgattggaaagtaattatttaatatattattattattattttattttttgctctattccaatttacgagttcaatcagtgaccatccttaatttattggccacaactttttatttcttccttggtcaatgtctatatttttggtatccaacgaaagtttaagtctctggaattgattagcaaatgctgacattaagaaactgagtatggtcactgattgaatgcgtaaacattgattgactccttgtgaatgtatggagccaaaaattggtttttcgggtgaagccccgattccccagtattgccaatattactgctaattatgtttaatgtctctaattcagttgaatatgagtcccgttcgacgtgcctttctcattggacgtaattgtttcgtcatcgttctcggcttctttgcaattggtgccggcgttgcagcaaatgttctccaaattcttaacccgccgccttcttag

SEQ ID NO: 75126 - DNA, 317 bp, Heterodera glycines
  Genomic contig location: Contig_ID=SeqID_11662; Location=4746..5062; Strand=+
  SCN-specific regions: Sequence locations=1-31,59-244,266-317
atgccaaagaaaaaacctgcgaggctgttgaattttgaagaggaggaagatgaggaaatggagcccgaattggaccatgagctattcggaaaattgacggaagaattggacgaggccatcgaaaagtctatggaaaggacgtacagcgacacattgaacacattcaatgaaattctgagaaatccaagcaaatgttagttgagagatccctttttgccatcttcgggtaacatatgatcgaccattttttggactgaatttaaaattgatttaaaaccgatgggaaggagaatcactgcctattttcagataattga

SEQ ID NO: 75127 - DNA, 58 bp, Heterodera glycines
  Genomic contig location: Contig_ID=SeqID_11664; Location=110..167; Strand=+
  SCN-specific regions: Sequence locations=1-58
gggcttcgctttcggcttcggcttcgagtgcaaagccgagcttcgcccagccctgatc

SEQ ID NO: 75128 - DNA, 2533 bp, Heterodera glycines
  Genomic contig location: Contig_ID=SeqID_11664; Location=2429..4961; Strand=-
  SCN-specific regions: Sequence locations=1-49,77-174,197-259,289 -843,884-952,975-1197,1224-1491,1532-1537,1559-1676,1698-1863,1886 -1958,1984-2322,2352-2533
  Gene Ontology: Mol. function=transcription factor activity; Biological process=regulation of transcription, DNA-dependent
gtctctgccgggctcgcaatgggccaaacactgcaccaaattcagcgggttttattttatttattttttattatttccatttttatcgcattgacaattcaacatgtttttgcaataattcaaaatctaaatttatttatccaagcagagaattttgtctgtccatcttacatgaaaaaaaaaattttttttttttgggttttttaaacacttcttattattattttttacgctgaaaatttggaattgaaaaaaactcaaaaaaattagataattttttttattttactgatttttgtgtgcatgcatttgcagctgtacttgcgcttcaaagacatggtgttcgacaaccgtaggccgcacaacacgcaggtgctcgagaagttcattcgccaggagatgggggccgagacaatgttcagcgacctcaaatggccaaggttgcttcggtgttcccaaaatgtgtcagggacatagcatcgccgaaaaaaatctcggaaaaaaacccttggaattttttttttgaaaaatttgtgtcgttgaaagcaaaaaaattttttgtaaaatttcttgaaaatatcttcttttttttaaaatttcggggacgttgccgaaaaatatttatatgggaagataaaatttgaaaattgaaattatttcctcatttaaaaaaaaaatttccagacttatgttcaccaccacgcgggccgagttcttcccggttcagctggagctgatgcgcaactacaaactgccgacaaatgacgaggagaatgaggagctcggctaccggacgcccgacgatttgttgctgtggaaagtgttaaggcgttcatcggcgggtaaaaaaaaattttttttttaatttacaaaaaaattttaagcccctacctactttgccagtgtggacaacaaatacattgatggaggtgggtgaacagtggtgctttgattgttgttgttgttgttgttgtattaatcggtgggcaatcaaaatgcatttggtgacaagaaaaaagcggtttttcgaaatttaaatgaaattccatcccattagaatatgtgttttttctgtccataaccctcactcatttttgtcaggcattattgcgaacaacccgtcattggaactgctccaggaaatccaattttggaacagcttcaacaagtacaaggtaaaacaccaataacaacagcaaaataaattttttaaatttttttttcgttttttcagaattttcccaatgccgtgaacgttggatgctttctcagcattggcaccggtgtcattccgcccactccattgaaggtttttttaaaaacaaagtgtcattaattcgaatgcaatttccagcccacttatatcgaagtttcgcaaaactggatcgcccaaccgctcacctcaataaacgccttttggaccatcggtgaaattctggttgaccaggtactgtattgtatcaatacaaaaaaatgtttttaaaggaaaacttaaatttttcaaaaaaaaaattttttttttaatttattagtgtctttttccaaatataaaaatgaaaagtaaaaatgtttcatcgattttctccctacaaattaattacctttttccacaattttttggccaatttaaaaatggaaaataaattaaatttttcattgtttttttctgtttttgctattaaaaatttccctatttaaaaatggaaaattagattttttctctctaaaaagttgacattttccccccattttcccctcaaaaggttgctgccaccgaaggggtgccggtgctgcgggccggcgctttttgcatccaacaacgggcgccgttctttcgcctcagtgcgccgctgttccgcaacatttcaatggacgagaaaaatgacgcggacattgcgcgaatgatgtgggattgtatggtgggaacattttttgggattttcaaaaattgggcagacaaattattaattaattatttttattgcattttggtatggcattggcacttttcgggtttgaacggcaccggaaatttgaattaaaaacacaacaatagggggcatgattttttttcatctttaatgcatttttttaagaaaatttcaagcgaaagtggaacaattttcagcaattttttggaaaaatcaaaaaatccggaccacaaagcagaaaattaccatgacacccccccccccccataaatttcatggaggttttttcaaataaaaaggttaaattttttacaaaaaatttttctttcaaaagttaaacaaaaatctatgttttttctttataaaaaatgaaatttttttcaaacaatgcattaaaaaaaaattagaaaattaattaaagccgctcccattctgggaaaggcatgtgtctgtccatgccccggaactctattcattggttcttatcactgcccgcatttttcaaggagtacatatacaagcaccaagactatgtggaacggttgtgcactctgctgcgacgggttggccatgcggagcaccggcgccgtctgttccaaacg

SEQ ID NO: 75129 - DNA, 1058 bp, Heterodera glycines
  Genomic contig location: Contig_ID=SeqID_11665; Location=16..1073; Strand=-
  SCN-specific regions: Sequence locations=1-95,123-136,158-611,638 -738,760-1058
atgtcaaaatttttcagggttgatttgctgaaaagtctgatcatatgcgatgctcggcgttgtccactcaccaaggtaacaagcacagattttgctatatatatatataaaaaaaattttttctttgccttccaaaaattttttcatggtttcaaattgggtaaacacatccatctctcacgttttgtgaatccacaaatacgcatttttgtgtttaaaaaattctttttttccccgtattttaggttggctgtgtgtccggttgtgtcaacgagaagcagttgcacgagctgaagaggacgtccaccagttcaatgccatcatccgccaccggcaacaccacttcaacatcttcgacggcatcgtcatcgtcgtcaagcagttcaacaacatcggcagcggcgtcggccaccgcagctgctgctgctacggcaccaccagctcaaccagcaacctcctcacaaccagcagcaggagcatcaacaacggcaccaaagccggccagctacacgtcggtgacggtggaggattttgaaaaccgggcatttgacaaggaacatttccgcttcaacaaactgttggacattcagcacaatgtaaagagtttgttaagtcctcttttcttcttcttttttggtggttttgggaggggggggacggagttcgcggagttcattgtttgtagagctcgatattttgaagaaaaaaaaccgggacctgacatgggggtgcacctcatttccccgaaaaattttttgtataaaattttcaaccctagaagttttccaaaaaaaaaaaaaattttgtattaggaaattgcaagaaaaaattttttaaaacatttttcagcgatttttggaaaatttttgccatttaaatggccagaaataaatggagaattttcaattttgcgacaatatgttgttaaggacatatatgacgaggtgttggaaaagttgcccgaagtgtcctcagacgaagacagtccgcccgaccacaatttcatcaatgtcctttcgttggatggcggtggcatccgtgggctggtcatcattcag

SEQ ID NO: 75130 - DNA, 166 bp, Heterodera glycines
  Genomic contig location: Contig_ID=SeqID_11666; Location=1250..1415; Strand=+
  SCN-specific regions: Sequence locations=36-166
tttggttttattgcatttttgttaaggaattttccaaaaaatgtcgaaatagtgaaaaaatagtgataaaacgccaaaatagtgatttttaactattttagtgacgaagtcgccaaaatagtgatttctagtgacgaaaagtgacgtccaaatgaaaaaattttaa

SEQ ID NO: 75131 - DNA, 1351 bp, Heterodera glycines
  Genomic contig location: Contig_ID=SeqID_11667; Location=1389..2739; Strand=+
  SCN-specific regions: Sequence locations=1-1053,1233-1273,1297 -1306,1329-1351
atgtcaacgtccattgtgcttggagccggtgcgcacgcgtcggtggtgtaataaaattgaaatacgagaaataatgggagagggaagtgacaaaagagtgaaatcgcatcccttttatgtaaccacaaaacacctcaaacccagcaattcgaaaaagtgattgtaaatgaaaattttttttatataaaagcattctttttcctgaacgtccttcatttgggctcggtcggttattaaatgcctacattcttcgtatcgtcaaaatgcatctctcattttggcctactatttcttttgagtgttaatagacaaaaattgaatttaattcatgacgtttataactcgatatgtaaattagaacagagccaaaatgcctaacagaaaataatttttaaaggacaaacatcaaacatcggggcatctaaacagtgaaagtgccaaaaaaaatttcaaggagagtaaaacgggattctcgtatttttccctttcccgtaatgtcatcgttattcattttactattctttccagatgaagagcattagcgatctttgcaatgaaataaattacgtttaacgatcaacaatgggctgatgaatgctgggtggaaaatgatggagaatgccgtcatttatttgtggagtaattaaatactttaataggaagatgttttctaattacattggacgtcgttcagattgccaaatggacttttcacacttgaaaagatattgcaatcggaacacgaggcaaccatcggattattggctctgaaatcaacaaacttttgaagacgaacgctgttgaagtggtcgctgaaacaggtctattgctttttcaccgcaaatccgaaagtttccactcatcattttcccccatttcagtccaatcgaacagtttcaattcaaatgctcatcagaaattgctgcagcgtttgcgtcatgcgattgaggacaccaacgcggaggctgaccgtctggagaacgactacttcttgttgcaggaacaaatagcagcaatgagacaccaattggttgtgcatttacgccgtcaactggagcagcagaagaagataaagaagcacataaagaaggaacaacagggaggagggaaaagagtgggagaaagcgaaagaggaggggaagacggacaagagcaaagggaagcggatgaagagaaagatggaggagggggagagaaggaagaacggcagagaggaggggcagaaaaggaaggcgatctatcacatctattagattcatgctttcttatgtgctttttaatgtcagaaatgtgtaaatattgtctgaaaaagagtaaaaacaacaccaagtttgaaaaaaaagatggatga

SEQ ID NO: 75132 - DNA, 165 bp, Heterodera glycines
  Genomic contig location: Contig_ID=SeqID_11669; Location=9..173; Strand=-
  SCN-specific regions: Sequence locations=1-71,94-165
atgctttcttcttcctcctgctgtactctgttggtcgccctcatttcggcggcgtttgtctccgtggcaaatgcacaaaaggtgaagcagtgcctgtgctccaaaatacagccctgcacccaaaagtacatgaacacgtggaaaacgtgcatgcggcagtgtaag

SEQ ID NO: 75133 - DNA, 106 bp, Heterodera glycines
  Genomic contig location: Contig_ID=SeqID_11669; Location=3128..3233; Strand=-
  SCN-specific regions: Sequence locations=1-106
gattgcacgtaattgccgaaaaaattcgagaccaatttccgaatgttgaccgactaattgcaaaacgaaagccgtctttgtcaaagcgccttaccgagtcaaaaaa

SEQ ID NO: 75134 - DNA, 242 bp, Heterodera glycines
  Genomic contig location: Contig_ID=SeqID_1657; Location=401..642; Strand=+
  SCN-specific regions: Sequence locations=1-125,151-179,201-211,233-242
acccatcttatcgtacgaaggcacaaattgatcattcgggcaccaaaaaagtcgttaattctcgccactctcccgcgccggcgccgcacagccaacggaaggagaagcagggcaaaaaagagaaggccaaaagcagcagcagcagttcatcggcggaggaggaaggaaaaaaacacagaaaaaagggaaacgggcgacagatcgtaaagcattttggaaaggggaagaaaaaggacgactga

SEQ ID NO: 75135 - DNA, 2314 bp, Heterodera glycines
  misc_feature (2252)..(2252): n is a, c, g, or t
  Genomic contig location: Contig_ID=SeqID_1657; Location=1767..4080; Strand=+
  SCN-specific regions: Sequence locations=1-7,30-83,148-180,224 -238,261-293,330-390,412-433,455-754,796-989,1016-1226,1248-1257,1297- 1444,1474-1811,1842-1906,1928-2314
  Gene Ontology: Mol. function=cytochrome P450 activity; Cellular component=microsome; Biological process=electron transport
attgtactttttctgttcatctcttcactaatcgctttgtcattttacaatttttattataaacgacgcaattttccgccaggtaaaaaatacattaaattattatttaatgtaggaatataattttatgtaattagatattaaaaagcaaaaaaaaactgtttggaaaactaaagagtgatttttaattaatatttttgtatagttcaaaaatattaaaaatgttattctaagactaatttggcttttgtgtatttgtgcccatttctctcttttttaagaatttattgtccaaaaaatcaaataatattattttatttatatttttagaacatacatatttcggggtttttgtgcttaattcataaattttatcttctttttttttacatattttgcgacttttaataaatgaaatttgcattatcctaaattttaattgtttttaaatgcctaaacttccaactcatcaggcccaacccctttgccgatttttggcaatttgatcgcaattcatttgtcgggtgctggcgaattggcatttaaaaaatgggcgaaggaattcgggccaatttacacttattggataggcgaattgccagtaaaagttttaattatcatgctttaaatcaaatttatctttgaaggttatttgtgtggcggcctatgaacaaatggtgcaaattttccaaaaagacgccgaaaattatgccaaccgatatatttttcccattcaaagagtgatcaatggtgcaaaaaattaaagaaaatattaaatttaaaaattgaatatttcggacggacaacccgcctttggcattttgatttcaaatgggcaacgatggcgccaacaccgccgtttcgcacttcatgtgctgcgcgattttgggctgggaaagaatttgatgcagcagagagtgagcaaaaaaaaaggggggggggttatggccaaataatctacggataattacaaactttttggctcagtcaaaattaaaaaatataaattttaaatgccttttgccaatttccattcggtgattaatttttgatgactaaaccaactttgaatcgttcagatttttgaggaactcaaagcaatgtttgccaaaatcgacctgaacattgatcaatcggaaaacaatgagataaatttggccgaatttgtcgaacattcaatcgcttcaattgtcaaccaatttctttttggcgtcaaattagacgaggttttgtttgtttattgctgtttaattactgtaattatttaaatttaattttaattttaatgataaaattgtttaagaaaaatgcggcggacttttacgaaattaaacaaatgatggacgaacattcgggcgaagtcggcggtcattctctgttttggatatacattttgtggccagatttactgcgcaatgtgccatggttccgaggaaaacgttggatttaattttaatttcaattaattaatttggtattttaagggttacaattggaggaaagagtcgtcaatttccatcgatattttgagaagcgaatttttgaaagacagatgaaaatggaaaatcctatcaattttgagaagccttcctcagattacgtggaggcgtatctgaaggaaaaggcacggagagacgccgcgggggaaaagggacaccaattcgagtggggggggggggcgggagggcggaatgccaaacagtgccatttgaatttggcaccctttgaggagcacttatcagctggggatgatgtgcttcgacctgtggatcacgggacaagtcagttttgtaaaccgaaggaaatcccggtttaaaaaaataatattttaattaaaatttgaaactttggctttttttacaacctaaggaaacggttgtgtccgttttgagttggggcattgcccttctgctgaacaatggcgaaccgttggtaaaaatgtgcgaagagattgatcagctgatcagcagcgaaaccgtaacagaagggcggcggccgcggatgattactgtagcggacaaggcaaacctaccgtacacttgcgcagttacaaacgtaagtgcactggcgatacagtaagcccaagcaaagactttacggtagtttaaaatcaaagccaataaaaaaatcaatgcacttttgaggaaattctccgctgtgcgaacattgcgccacaaaatttcattcggacagtcgccagtgacgtccgattggccaatggttttgtcctcctcaagggcacttccattctnccccaaatttcggtcgttccagttaagaaacgggtgaaatcgcttcaaataaatatttaccg

SEQ ID NO: 75136 - DNA, 2415 bp, Heterodera glycines
  Genomic contig location: Contig_ID=SeqID_1659; Location=3238..5652; Strand=-
  SCN-specific regions: Sequence locations=1-193,215-220,242-409,434 -789,812-1291,1330-1334,1356-1418,1473-1638,1680-2105,2127-2415
  Gene Ontology: Mol. function=furin activity; Cellular component =plasma membrane; Biological process=cell-cell signaling
atgattgtcaccacggatctgcaccactcctgcaccaagtcgcacaccggcacttccgcgtccgccccgttggccgccggcatcgccgcactgacgctggaggccaacccgaacttgggatggcgtgacctgcaggtgagggggattcccattccctctttcgacgccttttgttcattctgtcacaaaattgaatttacaaccaaaaccctttttcacaaattttattaaaatttccaaaatttcgcgccattttgtcatactgttgaaatataactccaaaatgacacaagcaattaattgtcatttttcactgaaatggcttaagaagttctagtttttgctccccggtgctgcacatttttgaacataaacattggaggaaaaaaaacttttagccccaaagagcaaaataaataaataaaataaaattcgcctctctgaaatttccgtaacttttttctggcttcagttttgatttttttgtttttctgtaccaaatgtgcattcatttcccccctccattccagcacattgtcgtgcgaacggcgaagccggtgaatttgcgtgccggcgactggcgactgaacggcatcgggcgcaacgtgtcgcattcgtttggctacggactgttggacgcgggtgcgatggttcggctggccaaagtgtggcacaatgtgcccaaacagcgcaaatgccgtgccacctatcccaacccgtacaagtgagtgtgggtcggcaattactagtactattactatatctgcctagtgatcttttttttaactttgctatttgctccccccgccccttccgcccgaactattttttgtctgaaagtctgtatttttttttcaaaaatgctcctagaaccttgcagagggatttttgcaggaattctaggtgttcctatatttttcaaaattccggattctaatatttgttatcagcccctggcgcaatgaattttcgaaaaatttggggtagaaatttaaatttcaaaatttttttgaagcaccggtttttttaaattaatatttccatttgaatgcttttaattattcggataaattttcaaaaaatgaaaaataaaattttttcatgggcgcggaaagaaaaatttgtttgaatctgtaaattctaaaaagtgccattcccctcacaaaggagagtgttcgggtgatggtggaacttccaaatgaaactttgtaggtgggtagaccacccctgggttgtattgccaaattttttttctagctgcggaataagcttctgtgccgagatatgaggctttaaatatttaataattatattatattaaatttaaaaggagaagcaaaaagcgaccggttggcagggtggttgtgtgtcacgatttcatttttgtaatggaaagttcgagtcccccctacgcaaacatttttttttattgtttttaataaaattacatatttagataatttaattataatgcaagttaatccccaaaatattatttctttacttcaaaaacatttttcgaataattttaatgattcaactatttcgcctgtcgagattgaaatggctaataattttatttcaatcattgaacgatgccttaagaatgaagaagaaattgaaatcgttgaagatctcgcatttgatgagaatgcagataaaaagtttaaatttatgatgtgtaaataattaacaaggaaagtcactcaatttgttattgtttgtgaaattgatctacatttgcacactcttaacaatatcattaaattgctttcactgatacacaaacacactccaaacatgacgtgttattgttagaacaaatttttagtgtttaaaaatttcagaaaggattcgtcacccaaacggaagaaggaggcaagcagcggagataagtctgaactatccgaacatcaatgtgtgggggcgaaaagctaatattcaggcaaacaaaggccatcggcgggtttaaattttaaatcaccttttaatttcagccccatttccacggcgttaactttgccaaaaacaatttgaccacaaaaatcaccaacatggcttctgtggagatggtcgcccttcaataccgagccgaacggacactgttggggctgagcagcgacgagatgaagcagtatctgatcagagtgtccaagttcttcgagaagttcgttcaatcaattactataattgttttgatcatttttaactttcagcgaatttcgcagtgatttgatccatgtgatgagcataagccaaagttatgtcgaggcggagttcgtccgtgccagcttgtccatgctgccgtaccttggcttcggattcgccgtcatggctttctgtacggccattagcattcctttgtccgccgcgtattttcaacaggcgaccgtccacaaggcattcactcattag

SEQ ID NO: 75137 - DNA, 951 bp, Heterodera glycines
  Genomic contig location: Contig_ID=SeqID_11670; Location=729..1679; Strand=+
  SCN-specific regions: Sequence locations=1-476,510-837,859-951
atgttcaaacttttgactgcattcacttttgtgctcgttttgagcattgcatggtgtagccaatggaagagaccgtaaattttcattgaaaattgaaaaaaaaattttgactcaaattttttcttttcctttttttgatcatttttcagttatcagtcagagctcgacattttgaaaaaaacctttacctggacctgtattccatgtggacctggacttcctggacaaaaagccaggaaaaatccaggctcttcaagacctggatccaggcctggacctggattttttgattgttttaaaaagcaaacaaatgtttgaaaaaaacaaataattgctgaggaacatctaaatattcatttttcagttatcgatttaatgaaatggccatttaagcaaaatttttgttttcaaggacgactaattgtgagaacaaattctaggaattctgaaaacaatttatgtgtataatttcaggcaatttatatttttttatttttgaaaaatttttagcttctctaaaggcacttacataatccttttatggaaaatagccacttctcaaaatgccttaaagtttttttattagcttgcaaaattgcacaatgccatagaattttaattttaacgactttttcggcattttttaacttgtcacattcaatttttagcccagtttgctgtgacccgtgctccaaaaagtactgggactgcaaaacaaagtgcgaaacggacgacccggacaacatggcgtgcgagccgaactgcacttttgcgctggacaaatgtgcgaaagcgcactgcaacaacaaattatgcccacgcccgaggggcaaatattgggaaatcgatggatgatgggccaaggaaaagcgcaaattgtggaaaaaagggaattaaaaagtgtgataatgtgttaaaattcactcacactaattaaatggatggatttga

SEQ ID NO: 75138 - DNA, 692 bp, Heterodera glycines
  Genomic contig location: Contig_ID=SeqID_11671; Location=471..1162; Strand=-
  SCN-specific regions: Sequence locations=1-62,84-263,314-478,583-692
atgcaggcaattctaacagaaaagaaccgtacaaagcttcaacacaacggtcattcatacatttttcacaagccgagtgctgacggtgaagttcgctttggtcgtgtgaacacaatcacgcaaaagtagagttgagcgggaccgggaaatttgacaaaaaccgggaccgggacttgccgggagtagaaaagtcgggacatttaaattcgaactgataaaagatggatttatttttaggggccgggttatatgcatattcgctgtttttaaatttttataatattttcttgaaaattttcttaattttaaaattgcatttgatttttgctgtgatatgcaaaaaaatcttcaattgacactttgaaaacttaaatttttttgtatgccctgataaatgaacggagctaataaaatttaattttgcgcaaatgaaactttttggtctttaaattccttatcaaacaaatttgctgaaaactttattaaaataatattctaaatttatgcatataaataaaaaccattattattattatttaaatgaaatgaaataccatatattaaattgttaaataatattttctttttccagtttttgtccttacaatcatttttgggccactcttagccgttgcattagcgcttttgtgtggcatcgggatcaaagtcttagtgaaaagaggtacagttag

SEQ ID NO: 75139 - DNA, 749 bp, Heterodera glycines
  Genomic contig location: Contig_ID=SeqID_11672; Location=667..1415; Strand=+
  SCN-specific regions: Sequence locations=1-99,123-330,377-398,438 -454,476-749
atgaacaaagttattgtataaaaagcaggtattgtcaattgattggactcataaaatacctttggactcataaagtgcaatatagcaaaattaagtgccttttaattattataaattaatttgattttgtgcgcttttcagcaaattgccattacaacaaaagaatcattgcgagaatttaaacatctgctgacccaactgtacggcgagcaaatatttgagtgccgtgggacgttgtcccttatgttggatctcgtcgaaattttggtgagaaaaccgtttttggtcgattcctaaagtgcaaaaatcaaaaaaacgattttttctatgatttttttcaatttttaattataaataagtaaaatttacttaaattgtacaagtttttttagatctcgaataaaaataattaaaatttacctaatattaaaaaaaatcattaaccaaattactttgaattttgaaatattttaaagttcattacaaatggattaaaattaaaaaatgaactcaaattataatccgcttcaactataaaatttataggaattgaaactttaaaatatttaacaaattcaaagtaatctggttaatgatttttagggatgcaatttttaggctctaaaaactgcaaaaataggtaggctttaggctctaaaaaaccccaaaaataggcactaaaaaatgaaaaataggcactaaaaatcctcaaatttaggggtgtaaaatgacaaaatgtattcaaaaaa

SEQ ID NO: 75140 - DNA, 525 bp, Heterodera glycines
  Genomic contig location: Contig_ID=SeqID_11673; Location=73..597; Strand=+
  SCN-specific regions: Sequence locations=1-127,152-525
atgatgaagttgacactgacccttcacccgaagaagttgagaaatggacgccgaaacaagtgattaagtgggaccagcgttgctacgagaaaatgccagctgaagaagagctttggcaagaattcctcgacaaaggagaggcaaatgtcagtaaataaaaattttgatccattttttaaattatttaagccgcaaccaggcactagcgcaccagccccaagcacagggctgagcactagcaccgtgtccaaccgttcgccgcaaagtgtcaggccggaggccacaagccgcgaccaggcactagcacaccaaccccaagcacggggttgggcactagcaccgtatccaaccttcgtcttaatgcgtcaggccggaggccacaagccgcgaccaggcactagcacaccaaccccaagcacggggttgggcactagcgccgtgtccaaccgttcgccgcaaagcgtcaggccggaggccacaagccgcgaccaggcactagcgcaccagccccaagcacggggttga

SEQ ID NO: 75141 - DNA, 1375 bp, Heterodera glycines
  Genomic contig location: Contig_ID=SeqID_11673; Location=1306..2680; Strand=+
  SCN-specific regions: Sequence locations=1-216,261-502,524-606,636 -691,732-865,897-1011,1033-1101,1123-1127,1150-1375
atgttgtgcaaatgcggcgaatgcttcgagtgcgaagatgaaaagcgccgcctcaagcgcaatcgggagctcaatacccgcaaagagcaaattaagaactgcacaggcaatcatctagcaccggctatgatggacctcaaacgccggaatatggaactgtttaaaaaggcttataggccggtgaagggcgtcatcaataaaataaccgggggtgagtttaaaaaagaaattgaaaaaaaaaaaacaaaaaaaattttttaggcccttggaatgtagaatgtgaggtctgccatgagaccttcacatacttcatggtggagtgggaaaactcccggaccgacttctcgtggggtcccgggaggaccatggtcgaagcggataacatagtaaaaatttttgaaatttttttccagttaaaaaataattttagaatcagaaagaaattttggctcactatgtaggccaaaatgatctactccagaatgaggtggactattatcagaatcttggtaataatcctccgttgaatgtgtccccaatgggggaggatgctataattttgaccagggacgatggtatgccgattggtgcagaggtaaaatattaaaaaaaaaacaaaaaaaaacaaaacaaaaaattaaaggcaaatgatggggcacggtcggtggccggggaaagcatcgttagcaaaagagggggagggcagagaaagagagagagagagagaaagaagagggcggaagaagcgaagaaagcacaaagagatggagcggaagaagaagaagatgatgactttttcttctttgcgagaaatgggggagagaaacgaggggaaatggacatggaaagcatggtagtgaaaatgaaatataaatttaaaaattaaaattattaaacaaaggaggggtcagtcgccagcaccacaatgagcaagagcacgaatcgcaccaatcggagcagtggaaaaagaaagcgagagaaagcgagagaggcgaagaagcttagagggttggaggaggaggagagggaaaaaatgcaggagacgccaaaaacaagccgaccgaggcgcgggcgtgatggacagggaacgagcatggggacgggagggtgaagggggaagaattgcattttttgaaaagggggaattttcaaaaaaatgtttttgaaatcgatcaaaaatcatctgttaatttttttatttatgttgagtaaaaatttcaaaaattaaagtgcaaaaaaaaagagattaaaaaataagctatgaaaggattacataaaaatataaatcggctgggaattgaaaagaatttaaaatattattaagctgggaatgtaaaagttttttaaaaacggctggtaattgaaaagaattaaa

SEQ ID NO: 75142 - DNA, 1219 bp, Heterodera glycines
  Genomic contig location: Contig_ID=SeqID_11675; Location=788..2006; Strand=+
  SCN-specific regions: Sequence locations=1-559,583-637,659-960,982 -1187,1215-1219
atgcccaaaaaaagcgaaacgcgaaaagcgaaacttgcaacagccctggtaagtacgtatgtgtacggtatgcgtgccgttcgcagatttaaaaaatggacgcacagttgttacacatttataaatcaactttcttatcccaaaatttttattctggcgcatattttttagcgcatatttcagcacttcttggtacgtattttattacatatttcaggatttttagcatataaaatcccatttctctaattaggcatttttagagaaaaaaaaattccgtaatgaattatttggtccaaaaaatgacaaaaaaaaattttagccaagaaacccttaattgcgaaactcaagtggaaacattttttcagacccaaacaaaaccaacggcacgtttattttgaaaattgaaaaactttccgaatttgcgcaagagaaaaacggcaccaagcgtagcagtgaaattatgttcatcagaggaataccgtggcaaataatggcaattaaagaagaagatgctttatacttttacgtccaatgctccgatgataaaacaggtggctaattagggggaaaattttgaatgtattaattacctaattaagactccaaatggaaatgcccttattcggtaacatatcaaattgatgcacaaaataaaggaaacgagcactttgtcttcggaactggcgggcacattggcaccaattttgaatgccgatcttgccgtaacagacgcggattccaggtcattaataaatgccaaatttggtcaattaatgtgattagcggcattgtgactgggatcattaaaaagtcatatttagtatctgatgagcgagtacaacgattggtacaacagagcggaggacacgttgactttgcgtgccgatgtgcttattggcgaaccatataaagacactaaaaattaaaaaaaaacaatttgttgggttcgtggctgtcattcttggggtttgaaaaattcggggacacagacccgaaaaatgttcttatttgttaggggattcaggctaaactaaccacaaaacttttcgagagcgggggggggggaacccgacaatggggaagaatgagagacttattaacaaatagggctcagaaaagatgacacctgcgaaaattcgttaagtgtaggcaaattttaggaaagaagaaaatgcaaaacctgcattaaaattttaaaaaatatttttaaactgaa

SEQ ID NO: 75143 - DNA, 290 bp, Heterodera glycines
  Genomic contig location: Contig_ID=SeqID_11675; Location=29..318; Strand=+
  SCN-specific regions: Sequence locations=1-51,73-83,105-290
atttgtggccattcttgtaagaaaaaataggagtttcgggggcgcggcggtcccgataggcgccgccggggaaaaaattggaaatttcgatcatttataaacaggttttcactgaaaattagccaatttataggtaaaattttgaaagattttatgggaatttaatccaattcttaggggtgtaaaagtcgcgtttcgcgccaaaaagcgaaatgcgaaatgcgaaacgccaaaaaatgcgaataatgcgaaaggcgaaatgcgaaaagcgaaacctaggcacatccctg

SEQ ID NO: 75144 - DNA, 755 bp, Heterodera glycines
  Genomic contig location: Contig_ID=SeqID_11677; Location=536..1290; Strand=-
  SCN-specific regions: Sequence locations=1-626,672-755
atgaacttcatgattccgacatttttgaaaaaaaatgcaacgcgtgtgaccaaaggcattgtaagctcgacggttttggcaccgctgccggagggcaccaccactacgacgacgacgacgacggtttctacgactactacatccacggcttccaagacgatttcgacgccctctgcgaatttggtgaccgacatttcggatgaaatgtccgaaacaacggttgacggtaaaactgagtcccggccgtttcacccccaaagttttttgttcaattaatcattttattggggcggaggagcaataaaaaagccgagattaaaacgctgaccgaaccgaaatgtccatgccataattagcaaaaattgttcataataattgctcttttaatgttccagaaaacgtttccatttgtgccaacattccgaccgtgtcgattgcatttggtacattatgacaacaatggcacataaaaaatgattatttttgagcaaaaaatagtgcagataggaatcgggggaccgaccaaggataagcgatttagttctgactgatcccaattattcaaaaaaaaaaactcccgggctttattaagagacagacatacgaacgatagttctaattaatgcaaatattataaaaataatatttgaaatttaataaatatttttttagccattttggctctttttttcattccaatttgaattgaaagatggcgggcggctaaacacaaaaggaagaatttgcagaataaa

SEQ ID NO: 75145 - DNA, 551 bp, Heterodera glycines
  Genomic contig location: Contig_ID=SeqID_11678; Location=6..556; Strand=-
  SCN-specific regions: Sequence locations=1-395,447-450,473-551
atgaattcccagcagcgccaggcagaacgtgcccaactccgtgcaaggttaaacttacttgtcgacgaggtcgactttgtggtccaagggctgatcagcaattatcaggccgatggattgatcaacgaggtaagttttctttattttttatgctgtttttgctttttttgaattttaatcttgattgaacaggcgccgcatgagggacagctgatgggcatggaccatggacaaggtctacagcatgagcagcagcagcagcagccgtgggaactggacccaccaatgcctgcacagcaattggaaattgggccacagctcccggatgcgtgggaactggttccctaccagccgacaccacaatgggcccaagttgcacatgtggaacaacacccgcagcagcagcaacactaccaccaccagcaacaacaacaacagcagcagcaaggcgcgtgggatgaggaatgggaggggcagctttcgccaaatgcgcttgctcaaatccaggacgaagtgaaggggctgcgtcaggatttgagtaaggattttgg

SEQ ID NO: 75146 - DNA, 367 bp, Heterodera glycines
  Genomic contig location: Contig_ID=SeqID_11679; Location=1..367; Strand=-
  SCN-specific regions: Sequence locations=1-237,366-367
  Gene Ontology: Mol. function=protein binding; Cellular component =axoneme; Biological process=eye photoreceptor cell development
atggaaattaaatttgaaaaaaagaaaagttttgataatgaaaattttccgataaaaaaagaagcagcaataattaaagaagaacaattatcatttggagaagaacaaattatgatgggtgatcagaagcgattgaaaatggtaaaagaggaaaaaatgatcaaaaaagaggaaaatattgatgaaatggaaagaaaaataaaaatagaagaggaggaggagcaaacaatagtgaaggaagaacaagaggaagatgaagaatgggaagaggaagaggaagaacaaatggaagatgaagaatgggaggaggaagaagagggggaagaagaacaaatggaagatgaagaatgggaagaggaagaagagg

SEQ ID NO: 75147 - DNA, 742 bp, Heterodera glycines
  Genomic contig location: Contig_ID=SeqID_11679; Location=423..1164; Strand=+
  SCN-specific regions: Sequence locations=1-87,154-214,236-256,279-742
atgttagcgttttgttcacttttggtaccagcaattctcaaaatttggcaaaaaaaggcaaatgaaaataaaaatgttgtaaaaaggtaataataatttaaatttttcatatttgtaaaaatgtaaataataataatataaaataatttttttcttttggctttgttcgtttaaatgctaattcttttatccttcataataaatcaattattgaatttcattaaaacatttttaattgcaagaaaaaaaggcgcaacattttattacaaagatttgcaagaaacatatgtaaaaaagataaacaaatgcagctttattagatatgcaaaaaaacatttccggatttttaagatatgagaggattgtttttaaattgaatgggttaatttgtaagcgtactgtgccccccccccttgtcaaataaatattaatgggtttttcattttttttttaatttttagaaatcgagatttacattaaatgactttacctgtatttaacaaattttcaaaatgtaactattgctttgttcatgtattctgtttaaaacgctaggctgcttcaactttcgatgagagaggtcgcaatttgagtatggagaccgtttgagtgtgactcattaaatacatgcatttgataaattcatttttaattagagcaactctccaatggcattggtcattttttggtcaaaattcataaaaaatttgtatggaaacattaaatcgttggcggaaagtta

SEQ ID NO: 75148 - DNA, 656 bp, Heterodera glycines
  Genomic contig location: Contig_ID=SeqID_11679; Location=1951..2606; Strand=+
  SCN-specific regions: Sequence locations=1-29,55-139,188-307,330 -371,393-656
atggcctcgcttttgctttgtctgcttttaattctctgtttttccattttcaaaactgctgaacagcaacagcaacccgacgaaaaggaccatcgacaattgctttttgttcaggcaatttggcggcatggcgacagagtaattaaataattaattagataattcattaacaatttaaaatattaatcgactttttttggtaattctcaggcgcctggcaaattgccttaccccggggaccaatacgacgaaaaatattggccacgtggttggggtcaattgacaaatgtacaattgagcatttgtcgagtttgtgtgtttatgttttagcttggcatgacgcaaatgcgcgagttgggccaatttttaagacaacgttatgtgaccgaactgaactttctcgacccggcttatcatcgcgaggacgtaattgggggcttaagcaaagttcatagaaatttgcacttggataaaggtttttgtccaatcctccggctccgaccgggcattggtttccgcgcaggcactgctccaagggatgtacccaccggtggcggagttggagcagttcgaccccacactcaattggcagcccatccccgtgcactcgactgggccaaaccatgaagtgcacttttaaggggacggataaaaca

SEQ ID NO: 75149 - DNA, 1274 bp, Heterodera glycines
  Genomic contig location: Contig_ID=SeqID_11679; Location=2749..4022; Strand=+
  SCN-specific regions: Sequence locations=1-154,176-188,212-270,292 -330,352-398,438-946,970-1107,1136-1212,1234-1251,1273-1274
atgaaaaaggaagtgaagcagcagttggaacaaaacttgaccaacacgtacccggaattgttcacattcatccagcagaatgtgtacaaaagcgcacaaccaatctcactgcatcaggcggctaaactgagcaacatcaaaagggaggtgggaggagcaaaatgggaaaagcaaaatgaaaaacgcttattaattattccaatttaaaaaatcagcataatttaatgggttttcaaaactacttttccaaattctgattgaaatgatgagaaaatgggggagaaacaatctcacttcatttggaaaagacgagaaattgaaaacccaactgaacatacaattttatttaaattctgaacataatgccataatttgtccatttcagtccctctcatcgtccgtcccttcccttcccttcttttccttccccctttttttgttaggtgcttcacaatttgtcccagcccgagtgggtaaatcgccgttgggaccaatacggtgggcagacaacgcttgatttggtgacggaactgcgccgcttggaacgcagcgcggagtttgcccgttccgagctggccattctgaagggcggccttttgctcggcgattgggtccaacgggcagagacggttattaactaattggtttaaataattacgtaatttgaacggggttagatttcatttgtttaattaaggtgttgcaacgacaaacgccgaaagaggcaaacaaagccgtcctttattcagctcatgacggcacccttcaggcactaaaagcatttatttgcccaattagggatgattaattacgctaatgaaggccctgctttatgcgctcggagtcggcgatggccaaatggtcccttactccgcttgtgttatgatggaattgtacaacgcaacgggcggtgtcattcatttggatgtgagaagtttatttttgcttttcaaaattaaataatattttcaaagatttattatcgacacaacggaattttggacaaattaaaattggcggattgtggcgattcgttttgtgaagcggacaaaacactcaattcgtttgagaaaaatgcaattaatgggctgcaacaactttatgatgtttaaatttaattatcaaattttaaattgttgaaataatcctttttagcaatgcaaaaaagacggattttgcgaaatacccattgaaaagggtaaagaagatgattaattaccactcattcgttaattaaatttccacattcttattgtattttgatatttaaaata

SEQ ID NO: 75150 - DNA, 654 bp, Heterodera glycines
  Genomic contig location: Contig_ID=SeqID_11680; Location=795..1448; Strand=+
  SCN-specific regions: Sequence locations=1-40,75-446,469-484,530-654
atgttttccatcgcaattcatccaatttttctcgtcgccgttttgctcacttttttctccctctttttgtcctccaccgacggggccatcgcgcgacgccaacacaacacgcagaaaaaaggtggcacatataaatgggaaaattaataattggctgatcagaaggaaggattaggcgtaggtaaacggctaattaggaagcaattaggcgggtaatttgtcaaaatttgctgggagtcaatcagattcattgtccccaaattcggcacttaattatcacgttttcagcaactgatccaaacagcagtgacgagtacgattatcgtgtggacgatgattacagtatcggcgtttttgttgacgcggtgccaatcgccaaaaatggggacgaaagtgccaaaacaccacagacaaatgaggacggaaaggcgtacaaacggacgaataggtgaggaaaaagagaatgttggcaaagcgacggtcgaattttcgattttttaaaaaaggggggaaaattggcaaaatgacagtccaattttcaaaattttaaggtacccgacgaaaaagctgcgcagattttttgacgaatcaaaagcgcggagggaatggtacgaatcactgttcagcagaacggcggagagacggcgaagataa

SEQ ID NO: 75151 - DNA, 461 bp, Heterodera glycines
  Genomic contig location: Contig_ID=SeqID_11681; Location=352..812; Strand=+
  SCN-specific regions: Sequence locations=1-181,203-287,310-461
atggaaaaatgccttgacagaaaagatgtggaaatgtgccaagaactagcagaagaggcaaaacaatcaatagaattagcaaaaaattatagaaaggaaattggacaaacttatcggaccgcttactcgcagcccgatttaggcattggagacttggccaataaattaaaagaaacaatgcgagaaaaccaaatacggtttgaaaggctaagacctcaggaagaatttagggatgaatttattgcttataaaatttaagaaaaaaaaattcgagaaaatgaaactgcatgagaattaaaggttgtgggacataaaccaaaaacaggtgaaaaaggaaacaggtgaaaataggtgaaaaggaaacaggtgaaaacaggtgaaaataggtgaaatttcacctaaaaatattataggggtgtgcatttaatggggcatattagagaatgtctcaactagtatca

SEQ ID NO: 75152 - DNA, 456 bp, Heterodera glycines
  Genomic contig location: Contig_ID=SeqID_11681; Location=1176..1631; Strand=+
  SCN-specific regions: Sequence locations=1-397,419-456
atgaattctgaaaaatcagaaaaagctaattccatattattggaagctgcaaaaaaagagacagaaagagcatggcgggatgtagctacgctaacggatgaagtaagcgattttgccaaatcttctcgcgaaacacttaatcgtgcaataaaatctagagaaaaggctccttacgctaatggtattcgagaattatatcttaaaatgtccgattcaatttgggaaatcttcacaatcctggacaaaatcaatttggagtcagaaaaagccgaatctacgtggcgtgatttcgagagatgcaaaacttttgaccaggcaacaaagctcgaggaacaatcgcaaaattcattaatggaagcccgaagattacatttcgagtcccggagggtgcagagccaaatgttaaattatgaaaataggctccaaacaattgtttgggagcatatgggtatataa

SEQ ID NO: 75153 - DNA, 1084 bp, Heterodera glycines
  Genomic contig location: Contig_ID=SeqID_11681; Location=3968..5051; Strand=-
  SCN-specific regions: Sequence locations=1-489,513-882,904-1016,1038 -1084
atggcccatcccaccatttcctcccgatttcaaggccaagttcacggtcttcggactgcagatcttcccttgggacggggtggatcatggcccatcccaccatttcctcccgatttcaaggccaagttcacggtcttcggactgcagaacttcccttgggacgggttggatcgtggctcatcccaccattttcctcccgatttcaaacaaagttcacctatttggagatacagaaatttatttgattacttttctttaccagaaaaattggtctttacagttttattagcgtgtctttttcttgagtccaattttaccacggtcaaaatttttgtttatttgtagattatgcagagcgacagtggatattgagcgaagactgttacggtcttgagttatgtgtggatttcaccagacaagccgcgacagaagcgactctcgatgttttgagcggcaaaccagtgccagcggaacaccgcgcacttatggaaagcaaccaaaaatttaaaaaacgtaataatgaaaacgaggcaggaagtgccgacgatggctatgatattttgttttgtaactatttttgagctccgcgtgtactgaaacatccggaaatcgtgtttttctgcgttgagctagtttatgagttgttagaaaaaatttttgaaaaactattttcaattattttggcgtttaagacaataaatacgaaaaacacacacctaagaatcgcactcaaaatttttcaaaattgctcctttaataatttatctcattttgatttggattaattattcttgttggattaaaggttgaacaactatttatcaatttggcaccaacttttacgtattaactatttaggcagtttttagcaacaaaaaattatgtttctttaattaattaattcagtgcacaaaaaacttgcgctctccgctactcagcacacgaatgatggtattctgtggatgccaagggtgccaagggcgattaaaacggaggtgagcctctatgatttcttcactttttacaaatgtaaattcaggcatccaaatgcatcgatgcctttgttgatgaatttatgaaatga

SEQ ID NO: 75154 - DNA, 434 bp, Heterodera glycines
  Genomic contig location: Contig_ID=SeqID_11681; Location=2828..3261; Strand=+
  SCN-specific regions: Sequence locations=1-183,205-240,262-351,373 -373,409-434
atgtcgatgcaacaaaatcaagggtccgatgatgttttgccaatgtgggcggtaccggattttgatgaaatggaccaaatgccgcagcggcaaaaacaaaaaaaaatcccaacgttgaaggagtttcggcaccaatggaaggaacgaagacttctgtgggagagggagcaagcagaaaaaaaagacccaaaaacatggaagaagaggaccgatgagatgaagaaaatctgtgaggagagattggagcaatcaaaaggtgcaggcggcagcaacaaacgacaggagccggacacatacacttggaactgggacgaactactgcgccaagaaagagaatatttggacgggggtctatggggaaaatgatgagatacccccccccccccctccagctcccctccccctcccgcttctaaatatgttgttgtttttaa

SEQ ID NO: 75155 - DNA, 733 bp, Heterodera glycines
  Genomic contig location: Contig_ID=SeqID_11681; Location=5166..5898; Strand=-
  SCN-specific regions: Sequence locations=1-60,82-151,174-308,344 -469,495-540,570-733
atggctaaaattgttattgcgccctacaaaaaaattactccggtagttttaatgtttcataaatatttaaaataatttgaaataacaggagcagagtggtccaagcaaaaaaaccctccggcagaagcagaagcgcaagaacaaatcaatgaggaaaaaacaacccaaaaaagtaagttttttttgctcatgatcagggttaaatttttagcacaaatggtgtaaacccattttcttctaggaatttttatttttgtttttcttactattatgtttatgaactttttagaaaccaaccacccactttcttataaaattaattgtttgatttaaattaatttttcaaaatgttcttattttagacccataaaacttcactggttacttattgccaaaaatgaacattttttgccttttttcaattcaaaaaatggatgatagggtacaacatttccgctatatgccgtcgaaaaaattttttttaaatttaaattccaacgcaatatatctattcaaaatacattaaaagcggatgatgatcagcaccaacagcagcagcagcagcaacaaaatgctgggttccaagaatcgcaccttttggaccaaacagatggcacacacggaattgaagaggagaaatttgagctgaaagagattttcgcctgcttcacacatccgaccacacaccgcaagtcctactatgtctcgtggctaagttggttataaaaataaa

SEQ ID NO: 75156 - DNA, 950 bp, Heterodera glycines
  Genomic contig location: Contig_ID=SeqID_11682; Location=498..1447; Strand=-
  SCN-specific regions: Sequence locations=1-17,63-103,125-219,242 -279,302-328,350-526,548-608,630-728,753-842,864-950
atgagctgtgctatggcgttgttgctgctgatgctggtgcagctgcagttgttgcggttgctccggaggacaaaggcgaggacggccagcgaccgatggcaccggacgaaggcggcggcggcgacgatggccaacaacatgggcaggaggtaggacagggcggtgcaagggaaaccaaaatttcggaacaactcaagccgtttttgcgaaaaaatgtagaaaattataaaaattaatttttctatccaattgtaatgtagtaaaattctcaaaaattgttaaaacagagacataaattaatcggtaatttttgactgattttttcagcttttaaaagatttcataaattgccgatagacgccgccaagaaaactttttaaaattagagtgaattatgtaacagattttttcaaaaaaaaattgaggctttgttattttttgaattttccgcaaaattttgcgaaattttttgggaaagtcgggtgaggtaggacttagagaatgggcagggttcaacaggaaaagctttatgtttatatcacaatttccctcttcagcaaaattgctcatccgcttccgttgaccccagcaaaaagtcgtgcacaactgtcgctgctgttgatggcggcccgtcgttgttggtctcttctccgccagtgccggtgatcgccacggctgccgcgacttcttcggcgccgacttccgccgccgcgccggacacgcaaagcgtcgcctcctcctccgcctccactgagccgtggttttgcgagccgtgcctgttcggcgtgcgcgaggtgccccactgcgagctgtgcccgagccgttacggcgccttcaagcgcgctgctgctgctgccggtgaggcggtgcccgaaaaattgtgtcaaacagtacaaaaaactgattttgcaaaagccaatcccgggggccaattttcggcaccgaataaa

SEQ ID NO: 75157 - DNA, 1787 bp, Heterodera glycines
  Genomic contig location: Contig_ID=SeqID_11683; Location=227..2013; Strand=-
  SCN-specific regions: Sequence locations=1-47,69-84,106-191,213 -328,351-531,553-1046,1068-1134,1156-1205,1227-1234,1258-1328,1369 -1460,1482-1723,1745-1787
atggacaaagaacgacacaattttctatttggcgcaggtgttgtgcaatttttgaaatttaattaataatagagatgtacaaatttactggaaaacattttacttaaaaagatggagttttccatgccctgattttccagacattttcggcatcactgggccatccctcctcactgaaatggattttcatcattattgtttttattactgttattatgtatcatggaaaaatcaaaaaatatcccgacttttaaatctgcatttttgagattcaaaacagaaatttgctttctcaatttgaagaacattttaattaaaatcattccatttcatatttatctcatttttatccgcttttccaacacataaaatatctcaattcaattttaaattcctacttttttttatcaattaattgcacttattttagtaatttttaataaaatgattaaacatttttctttcagctgcgcgtgagcccggcaagcggcagtttaagccaaatgcggcattttttgaccagttgcaactgatcgcggcggacggcgcggatgacgacgaagaggacgatgacgtcatttttccatgttaggcaaaaaatggcattttttaaaataacgcattttctaaacccattgaattttgatagttaggtaattaatctccgcacattaattggatatgcggtattcataggtgcgcattttcgcaattttttcaaaagttttgtacgaatgattcgtgtctgtttcgcaaacaatcgcgcgaactttttgccaaaattggaattgggcgagggttggtaaaaaaattggcacaactaaggccatgattaatggaatctggcgcataatgatttatcatccgtcttgctcttttcatttgtaatttgaataattaaaattggcatcaaaatcgatggctcagcgggttttatttcgaaacttcagaaaacagcgaacatttaatcaaatttcacatttaaaagtacagtttgaaaagcgcaaaaagtttttttttgaaatttgtcttttttttttaaacaaaacattagttttaagaaagggtgaggttcgtaaaattttctaaatgtattggcgaagagtttttcaactatggccctattggagggccgtaattaaatcatcatggcattttttattcgattttgtacaaaaagaatgaattgttcagcgcccaatgtgtcgcgcagttcctccgacaacgaacagcaaaaggaggagggtgacgaggagggcgagcagtcctcgaccaacgacaatggcgaggacgacgaaacggggggcaattcgtcggatgacgaggacagcggcgacggggaggaggagcagcaacagcagcaggggaagccatggaaaagcaaaaggcaaaaaggagcggcgccaaatgctgcccaggttcggaacaaaatggggaaatgatggcaaaaagcggcactttgtaaaatgatggaaaaagggggcctttaaagtgggaagggggggggcgtcctttgaggttgttgatcacgaattttacatccatattcgactagttcgtagccctccccccggatgaaccgaacgaagtcgaaaaattattttcgaattttttcaaaaatggtttatcgagcagttattgcagtacttaaatgtctgtttgtccagggttcagaattttgtagaattgggtggatggatttgcgatcagcgatctcagtgaacttttttcttttacaactttcgaaaacaaaaataagcttacatatcaccggggggcttaataaa

SEQ ID NO: 75158 - DNA, 1291 bp, Heterodera glycines
  Genomic contig location: Contig_ID=SeqID_11684; Location=1357..2647; Strand=+
  SCN-specific regions: Sequence locations=1-350,376-1291
atggccaataaacttattctgctgccgtacgagcactacaaggggctggttgcagcgagggagacaaagaatgacgacgacgacgacattgctgagcggacaaacttgggctttgtcaaacgacaggtgaccgctgcagtacagaagcggaagggaaacgtcagcgaacggaacgcaatgtacaaccagcacctgcgccggtacctgaagatgcgcaaggaacataaggagcggcccgtccgggtacagctcagcaacggcgttcaactgctaaataaaacagtggagacgggtgtgcaggtacggcctggtccggacgaaccgaaggacaagtccgtgatggttaccgacgaagatgaagaggaagaagaaattgaagtgccaaaatttttaaccccaacaagccagacgcagggaagcagccgatcacccaggaccaataagaaagcagcaaaacagcaaaaattgatcgagaagaaggaccacctgttggccatcattatgtctgatccgcagagattcggcgcaactgaccgtgggaaaatcattaacccaaagacgggccgagagttcatcgactcggacctggcctggtcaattgaacgcctggtggaccctcgcccggagaatgccccttcgccacgcggaaccaaagagttgaagaggaaactcgcacagaatccgctcgccagtagcctactcaatcgactgtttgttgggtctgggttcgtcggacaagtcaaacaaacgagaggatttgttccctcaaaatggacaagaaaataaacaaaatatacaccgacccggccaatccgggcgggtatgcgggggcgagtgctctgtacgcggcggtgaaggagaagcacccgaagttgaagcgtgccgagtttgaggactttttgcaaaggaacaccacctacacgctgttcaagccaaagagagacaagttccgacgcctacgcactgtgcctgcgggtttcatgaccggtaagttgtactggggcttattgcgcacaattcagggttcagatgttcaggcggacttggcagatttccaggcactttcgcgcaagaacagcggctaccgttacttgctgttggcggtggatgttctatcgaggcgaatgttcggcgcgcccgtaaagagtaagcgccctgtggacatgaaaagggcttttgaggagctatttgagcaaatgccaagggtgccagacacaatgtacaccgatcgagggctggagtttgtggcaaaaccgttgaaggagttttacgcggagaagggcattcaaaa

SEQ ID NO: 75159 - DNA, 4748 bp, Heterodera glycines
  Genomic contig location: Contig_ID=SeqID_147; Location=1001..5748; Strand=+
  SCN-specific regions: Sequence locations=1-212,234-2363,2385 -2421,2443-2696,2718-3996,4018-4129,4151-4718,4740-4748
atgcctaatcttcggtcgcctccgcttactcgtcaaagagcactcaacctcggcattcgtctaaataacaacgcaaaccagcagggggggcaacaaattgtagaaccacagcacctagcagaccgacgtttggaaaacgaggctcgccataattctgtctcttcagttgcttcatcacttttggacccaactgaaattcgccgacgcctgctcatgtctggaattggagaaaatgctgctggagttgagaacggaccgcgagatgagcaacaattcgacgcactgctgaaccagcatggtaacgacttgtttcaaaatgaaaatcggggagaaaattttgagagggacgtttttcaaccggtggtcagagaaccgccgttgcaattttcggaaaattttgaaaatggtccgaggcaatatgagttagttggggtacggcctgttgtgacttcgacaccccatgcggtgcaaccacaaaggcgaccaaactctgaacccttaaacccgggcttagttcgtccccaagcgatgtttctgaatagttttcaacaaaatatcgccgcaaatccaaacggcaatcaacggcaaagagccgaacagcgtttcattgatgaagacgaacgacaagcggctctggttagacaccgccaagcaaatttgacccattatgtgaacaacgaccgcgattttaacgcgtttcatcctattgctggtgctcaacacgtttggcgcgcacaaattcagcatgtttcatacccaaacaacccgcaaatcggcgaggttaaccctcaacaaattccacgacaaaatcaaggatttgtagggaatcaacaaatttttcgtcccgttgcggtacgaaatgattttcaccctgaaaattatggcgacaatttcaacttcggacatcccgaacagcaaaattttggtcagcaaagaactgaacaaattcaaatcgcaaatttggaatatgttttgactttggaccgtctgccagagctaaaaggaaatgaaggagcggataaagtgaaaatttttttcaaaaaattttcaaacgcaacggaagaatggcccgagcataaaagggttaaggcattagaaacgaaagtctcaggccgtgcagaacgtgcttttaatgcagcaataagctctggaccacatcgcttcgattcaattcgacgtgcaatgcagaatcagttggaagagacggattgccgtgagatgggagcatttgatgagctgatgagcggcgtaaagcgtcgttcgaatgaaaatttggacgcattggcggatagaatccaaagcctcgtctcccgtgcctatccgggattgacacaaaatttatgcgacgattatgccattaaacatttcgtcagagctctagcaaatcctgagctatctctaactttggaaatgtcgcggaaatcgggaatgtccttcgatgaattcgtggcactagcagctcgtgccgaatcgattcagcgggcgaccagagtgtcatccaatgaaaacaaatactcggataatcggaaccgaggcttttatttttcgaataatttttcaagaccgcaaagttctgagtttcaaggaaactcacaacaacctcgaggaaggattgtttgctacaattgcaatgagccgggtcatctttctcgggattgtaatcagcagatcaaagggcagcgagtcaacagcaacgaaaatgagcgaattcgcaatcaatttgcgacgggttcgaattctgtagcgattcgtaacaacgaagagtcgccaagaaacaatcaaagaaattttcaacccaaatcacagaattttctcaaacaaaactgcatcgttatgcaggaggaccaaccacctgatgcattttgctgtggtgtgcaactgacatcggagttttcgaattttttggagaatgagttgcatgaggaaaatcagagtgaagagtccaaagaaaaggaccatgtaggaaaaattttggtgatcagagtggagacgaacaatgttagaacggatgcaatgttggatggaggggctcaaatttctttgattggagcagaatttctctacaaattgataaaggagcacggcctggacctgagaaaatccggtttttctcgtacgaaggcacgaattgctgacgtaaacggacaacaactgaaatgttttggaatggttacaataccaatttcaagaaaaggacgcgagaaaacgccaatttgtttccatataactacggcgcaatttggctacaatttgctgtttggcacgaactcaatgacgaaattgggctttcttctatacgactcggtgaacaaagaaatgattgaatttgaggaagggcagcaaaatgatgggaattcagctcgaattattttttctacaaaaatcgaacctcgaacgaccaaattaattgaaattggagtagacaaagaatggaatggtaaagatgtgatcatcttaccttcaaacatggaaagcggtgttaaagttgagccaacagttggaaaagttgaagatggcagagtgattgcacaaatcacaaattattcgaccctttcgcaacgcataaatgaaaaaacttatattggcatgattgaaaaggtggacgagatttttgacaccgaaaattcgattttgtcagctgaaatttcatcaacaatggcttacggcaaaaacgaaagtgggaaactcggacgcgctgatcttcacatcggagaaattttggggcatcataagaccgaactgttggaacttataagccaacacaccgaaattttcgctacttctgaacaggaattaagccaaactgacttaatccgtcacaagatcgaaacgggaaaggcgcttccaattaaatcgcaaattcgcccagtcccatatgcctaccgagaaaaggtatcggcaatgattcaagactacttaagccgcggaataattcgctcatcaaattcgccatgggcttccccgattgtgatcgtgccgaaaaaagacggaacgctgagattttgtgtcgattacagaaaacttaactctgtaacagtgaaagatgcatttccactgcccaacatcgacaacacacttttagccttgggcggaaagaaagttttttcgaccttggacttcatttcgggatattggcagattaaaatggatcgtaattcgattgagaagacggctttttcgacggagtttggtcttcacgaatttttggttctccctttcggcctttgcaatgcagtggcaacatttcagcggtttatgacccgactttttgcggaatgtcttaacaaattcgtctttatctacatagacgacgtcttaatcgcatctgaatcatgggacaaacacatcgaacatctgaaagaagtttttaaacggatagaaaatgccggactgaaattgaatgtaagcaaatgccattttgcttcaaacgaacttccgtttctgggccatattctctcccgtgaaggattgaaaatggacatggcaaaagtaaaacctgtcctggatttgcccattccgtccaccaaaaaacaacttcaatctcttctcggttttctcgcatattaccgcaaattcatctacgggtttggcggaattgctgctccactttattcacttttaaaaaaagacataaatttcaagatcggcgacttagaaaagaaagcgattaatacgttaaaaagcaaaatcgtcagtgatgttatgcttcattttccaaacttcgaagcagcgaaaaatgacacaacgagaaaatttattctcttaaccgacgcaagtaaaattggtattgccgcaatactttgtcaacccaatgaaaaaggcaacattcggcctatttactttgcatcacgacaatgtaaaaactatgaaagcagatactgcccaacagaattggaggctttggctgtgcgattcggtaccaagaaattcagccaatttatcaccatgatgcccacaaaaatttttacggaccatcgagcattgataccaatgttcaaaagcaaaaaggaaacgggaaacagccgtgtggacaaatggctgatggaaatgaatgcgaaattcattttggaagttgaataccatgccggaaagaaaaatgtgatcgcagatgtactctcacgctctctcgccttaaaatgtttggattcgccaagtgaagccgaaaaagtcatcatcggacaggttcgccgatttgaaaatggtcaaagacctcaagaaatcttatcgcaccaggaatgggtgaagaaaacgaaagagagtgagctcggatttctatatgatttcctgacaacaaaagtactcccaatagaaccgaaaagtcggcaaaaactggcatcttcacttcacaattcacaattataaatgaacttctttataaatgtggaaaagacgctgaacttcgccttttcgttccgtcttcttttcgacaaaagttgataagagaacgacattcgggtgtttgttctggacatatgagcggaaagaaaatctttcttcagttggcagagaagtatttttggccgaatatgtatttcgactgtgttaaatctgcatttccatgccgaatttgtgcgcatacaagaaacccgaggtcaaatgagcctcctctgaaaattgtagctacggcagaaccgctcgaattggtctgcctcgacattttatcgattgggcccgcgcactcgtgcaaaatatattttggtggctggaaaccacttctcaaaaaatttgggtggcaaccgcccattcca

SEQ ID NO: 75160 - DNA, 1839 bp, Heterodera glycines
  Genomic contig location: Contig_ID=SeqID_148; Location=423..2261; Strand=+
  SCN-specific regions: Sequence locations=1-394,416-480,504-968,1024 -1272,1348-1581,1603-1839
atggagacggacaacatcgactttgccttgacctgggatatgcagtgcggcggactcggaccggagcatcgaaattgtgtccaattgacaaccgctgatttggacccagttttggagagggccggattcggactcaaggtggccgaaagcagactgaagccacaaaatgcaaaattcgggcttaaggtcgtcggaactccgttgaaggctttgttggccacttttctgttaaaaaccaacgccatttcttcatctgcagccggcagaaagttggcacaatcagtgattggagcaccagtcgggtttgaactgatcactttcatcggaagccgcgaaaccaaatcaaaagtggccgaattccggtggaagaagatttggaggccatcctcgagaaatggaccgaatgctgtgcagttacacggacgaaattggcaaaatgtggatttggcgccatcaatgtgccaattccgcgctcaattgaagacctcccagaaggagaaggaaaaccgtggaccgaactgctcggaaaagccggatttgtgctggagaaagtgaaggccacgtcggtgctgcgcaaacaccaattcgttacgtcgccacgcataattattggagactcaagcgcaaagcaattggaggacttgtggccgacttctcagtttattcgcgccacccaaggaagtgttggagatgtaatgcctccgccgttcatccgcgatcaacaaattgaacacgacatgctgatcgaccgaatgaaggaccatttcgcgctgatcaggggaaacattcgctatgtgtcgacaacaccgtcaggccgatcgcttctcgaaatttggcgctatgggaacggctacaacaccgaacatgtttctgccgaaggaacgatgaaggagaagggactgtacatgctcaaggcatggttgatgacacaagtcaacgatttcccgggtgatcgagaattggggatcgagaagaaaagggcggagagcgaagagaagggaagagggaaaacggaagggaaaaacgtgagaacgggagaaccggaccgaaaacccagtcaccgccccattccatcgccatttcgtcacaccggccgtgcttttcatcgttcgaatcgtacgccgactcatcacccgtatgcgaatcccgtcgaccgacaccagccccagccttttcggatgccgaatcagcaaggcccgagccgccgacagttccagcgctgaggacatcgcttgtcggagggcgaggatgtcgtaattaataatgacctaattttatttttgattttatgatatttttggcattttgttttaatgtttgtgatttcgtttttgttttctttttggtcctcagactttaatttggaattgcctgatataaaaataataagactttattctgtgtgctgaactgttcgacgtgctgctgagtaaaattgaattatttgtacggtgcactcactcagggacattgcctggtggcatcggttaccagaggtcgtcaccattaatgatgtttgtcagatgggcgtcgtgcggacgacggaatgggccgagcacatcagaccgtttttttacgatttttggaaattggaaagtatcccgccgattccgccgttcatcaacgacagagcaccattttgccgccgtgtccgggttgaaaaaagaggcgaattgctaggattttttaatcagcaattttatttttcgaatttcaacgaagcgtatgaattcgtcatccacggaagaacctaccgatgtgttgagcagtattactgtgctcagaaagcgttgtatttgaaacgtttcgacgcggcggatgcgattatgctggggacaa

SEQ ID NO: 75161 - DNA, 135 bp, Heterodera glycines
  Genomic contig location: Contig_ID=SeqID_148; Location=1873..2007; Strand=-
  SCN-specific regions: Sequence locations=1-135
caaaaatcgtaaaaaaacggtctgatgtgctcggcccattccgtcgtccgcacgacgcccatctgacaaacatcattaatggtgacgacctctggtaaccgatgccaccaggcaatgtccctgagtgagtgcacc

SEQ ID NO: 75162 - DNA, 260 bp, Heterodera glycines
  Genomic contig location: Contig_ID=SeqID_148; Location=6839..7098; Strand=+
  SCN-specific regions: Sequence locations=1-181,241-260
atggctgttcactctccgtccggacaatgtgccaaaggtgttcaaatgccggattgacgaggatggtggcaatttggcgacgaagctattcaatcggtgcttattattaattatatgcgcgttaggactagtcagcttgggataactcagtttatggaaaatatgctttacgacaatttagaaaaattataaaaatagaaaaaacaattaaataaataaaataaaaatattttttaatttcagtaaacaatatacattaa

SEQ ID NO: 75163 - DNA, 372 bp, Heterodera glycines
  Genomic contig location: Contig_ID=SeqID_149; Location=1055..1426; Strand=+
  SCN-specific regions: Sequence locations=1-53,75-372
atgaaccgacggtaatgaattttttaaaagtcacttattcttgtttgcctaatttattttcattatttcagttggatttgcaacgacgtttggatggacattttcccctgttttgaccatactcaactcggcctcaaattggcattgctttcgccacgtttcaatgcgttggtggacaaacatttcgatggcaaaagcgaattgacaatttggagacgaatcgagattaacaagcgcattggaacaaaaccgaaactgtctgtacggatggatgacaaatttgtgccatttccattgcccgaccgtccgttgcccagcaaaatccgatttaaattccttatgattgagtaatttaaaatcagagatatggca

SEQ ID NO: 75164 - DNA, 1074 bp, Heterodera glycines
  Genomic contig location: Contig_ID=SeqID_150; Location=412..1485; Strand=+
  SCN-specific regions: Sequence locations=1-303,327-499,521-580,602 -719,795-834,856-1074
atgccgtttgaattggtgaacgaacgaacgcaagaaaagctgctgatgctgactaaaggaaacgaaaatggctttgacgattggttaatgaagcgatgcaaaattattgggaagaccgtggcatttcagcaacagaagaaagatgaaaattggaacaatgtgttcttttggttttttagtggaaccaattgcatcgggtgagcaattaaaaaaagcatttgattttgattaaataattaaaattgcgcttaatttaggccattgtctccgccaccggcagacagaagaagaagacgaagcggaaaaaagcagcagcgaaaaagggccgtcttctgctgacaatgattgagtgacggacaaaagaacaaaaaagggctgggaatttaagtcactaaaaatcttcaaaaagtcgactaaaaaagtcataaaaaatcgcaaaaaagtcataaaaaacccaaaaaagtcacggaaaatgaaaataagtcctgaaaaattaggcaaaagttaaaatcccatttttaataatttatagaataacattttgatcatatttttaggcacttaattttataaataggtacctaaaataggcataaaaaagagattcttccaacaattgagaaaaaatttatccaggttttttattgatcgaaattttatttttcggaattttctttgtatttttcgtcattttcttcgctaaaattcaaattttgcctcaaaaagtcaaaaaaaatcacaaaaaaagtcgcaaaaactcaaaaaaatcataaaaacaaaaacaagtgtaaaaagtcacaaaaaatgcatgtaagaggcttcagacaaagtttagaacactttttaagtcattttaaggccatttagagtcaacaaaaaaaagtcatttgacttaaattcccagccctaatgatcagccacagaagaaatggattaattaagaagaatgaccgatcgatcataattcatcagtgttaaaatgtattttatgaagaaaaaaaagcctggaagaagctttccaacttattatgccgaaaaatttttgcaaactaaaagggaccccatttgttttta

SEQ ID NO: 75165 - DNA, 631 bp, Heterodera glycines
  Genomic contig location: Contig_ID=SeqID_153; Location=1247..1877; Strand=-
  SCN-specific regions: Sequence locations=1-136,194-547,569-580,603-631
atgctcagctccgcaattatccaatggtggagatgccgacgaatacaaaagcaaaagaagtgagaggaaagtgcaaacggaaatttacaattcatcaatggagagaacggctcaggcacaattcggcccaatattcaaaatattatttaaaattaattagaaaataatatttcataattgtatttaatattaagttcacactttggcgaaggaggtgtgactgcaacaaatgaacttggaaatttgccacaaaacaaaaatcactcaattgcagcgaacggtaagaaattgggacagtacatttattttcacgtgagcaattttgtgtctacattatacatttctgtttttatgctaaaatgaagggttacagttgcacggaagcaggccgggatttctgcttttttcaagggtcggtcccgactttggaaaaagccagtctcagtggggaaaagcacccttttcctggtcatatttgtttttagctacaagacgaagctgattcgttttctcgacgcaaaacatattatgaactaatgtttcctctaagattttgttctttttgtaataatcttaacaaattttaaaaacattggtttaattgtgttggcgttgagaacaacgcattaaa

SEQ ID NO: 75166 - DNA, 557 bp, Heterodera glycines
  Genomic contig location: Contig_ID=SeqID_1660; Location=1596..2152; Strand=+
  SCN-specific regions: Sequence locations=1-63,85-103,125-215,253-557
atgttcatccccagcaacactcacgagctgttcatggccaatgcttggccttcaattccaaccacctctgcttctgctgctggttgtggaccaacagcagctgaacaatcagtcgctgctgatcctacagtagttgatccgcaatttcacatcgcaattttgtacggtaggataataatagtaagttttgaatggaaaaaaatttgccaaaaaacaaaaaaaaaaattagtttttttttgaattaaaaatttcctgaaaattttcccagatggacggcaaatcggtcctggttgtctacaaaatgttgccatgcacagcagatgccttccagaaaaacccgaattaccatcgttatgttgaaccaagcacaggcgaagtaagagcaatgaatgtgtccggccgaccctacaatttggcgttggccatttttggggtgccaacctaagccttggcattcttgaattttggccaagatcttgggtcggcggctcagggcgtggttccttttttggcgccaaagcccaagtttttggactttgacttttttctttgccaa

SEQ ID NO: 75167 - DNA, 5253 bp, Heterodera glycines
  Genomic contig location: Contig_ID=SeqID_1661; Location=1408..6660; Strand=+
  SCN-specific regions: Sequence locations=1-8,30-241,298-339,361 -470,498-498,520-627,651-768,790-797,819-955,977-1236,1271-1288,1310 -1428,1451-1478,1516-1537,1567-1691,1714-1989,2011-2177,2199 -2204,2226-2238,2261-2290,...
  SCN-specific regions: Sequence locations=...2313-2340,2389-2518,2578 -2643,2705-2815,2890-3193,3220-3579,3614-3671,3718-3793,3815 -3994,4052-4253,4275-4527,4549-4669,4698-4729,4752-4769,4796 -4851,4887-4943,4967-5193,5216-5253
  Gene Ontology: Mol. function=procollagen-proline,2-oxoglutarate-4 -dioxygenase activity; Cellular component=cell; Biological process =embryonic development
tggatgtgatataaaaatttaaaaaaaaagaatcgaaaatgggaattatcccttccattttaaatatttttctcttcctctaaaaaagacttcattcctaaatctgcaaattagctcattaattaattttgtcaatgaatttttgtaaagaaaacgaaaacccattcgaatttttccaaaaaaaaaatttttttttcctttaaaaaatctccattgaagctggctagattccccccacccgaaatttttttattgaaaaatttctaattgaaaattaaaaaattaaaaaaaaaaattcgggggagcgagaggggcaacgattcgtaggggtggggactactgacacatgaggagcagggttgttccgggacgagaaaaatatcgggccgtgattcgggtcgggtctgccgaaaaatcatcgggtcgggttttggaacgagaaatatgtcgggtttcgggtgacccgggacaaccctgaagggaaggagggaacggggagggggcgacagggaggtgggaaacgaactgctcccggagcgctagctagagctgcccacccacggggttgcgtggaggcgcgggttcgattcccacccggtgccgaacattttgccaatttgttattattataaaaaacattttaaattcaatcagtaaacactacattgatcgatgagcaacaacataggcggtatcttcagcagctgaacggagaaaaaaaaagaaaaagatgcgcacaatcggcacaaatgccgtcgtcaatgatgcaaaacaatggaatggagccaacagcaaaaatgccgaaacttcatgcaatggcggcacgaacgccagcagtagatgcacacgaagagagttaacagcgatttaaattgaagcgctggtgtggcatagtgcccaatttttgtgacaattggcaacggataactcatatgaacaaaaataatttttgaattaaattgattttcatgggcagtccttgagggattttgtactggattttgcatcacccggatttcggattttcacaagaaaattctcacccttgagcaaacattttcaagatatacactcataaagactgaaaaaactttggaaaaaatagaaaattgtcaaatttttcgcttttcgtctcaaaaatctaattcgtattcaatttttggtaaaatttgtttccatatttaggaatattttgtccatataaatcctggtcttcgttataactaaattttcgattcaaatttctcaaaaatttcaattaaaattttttcgaccacccctttgccaattgtcacaatggcacacataaatggcgcaaaattttttttttaactaatttgtataattcatttaccataatcatgaagcgttttttgattctcaattacggtaatcactactataattttcatacctatctctttctgtttaccaagtgatattgttttaacttttttttcttgttttcctgatttaggtatatatacattaattttttcaattatttaaataattcactgtgtaaaattactaatttttcaatttaatttaattttgtttaatttacatattaatagaactcagaagaattgtataaatgatattttttaatgaaacccaaattaaaaaaagaaataaagcgacttaaagttcaaaaaaatttattcattaactttcaaatttaaacctgactgggccagggccccgccgggaatttgccgttactcctctcggtcccgggttttttcgggaggtgggacggggggggggggggggggaaacgaccggggggaaaacgacctggtcccgaccgcgggacctaaagtctggtctttgtcctggaaatcccatccccattcattgaaaaatgccgttctctgatttcaactataatggcatattgttttaattctcaaaatatcgatggaattttcacccaggccccgcgcgacattttcgaaatggaaaactcaatttatgtatttgtcgaatttattattttaattatttccttggcagatggaccacccaaatcgttcatttttgtaaaacaaaatgacagccagcatataaggtacatacatctgtcacaacattaaagcatatgtaaacaaattatttttttttgaacgaacatacgaataaaaatgtttgagcaaatgaatgatgggataaattaaagaaaaaatccaataaaattatggccattaaaatttgaaaacataggcatccatggccatttttaattaaaaaagtgtaaaaataaatcgactcttaaagctccaatgaaagtagaattaaaatttttaagaattataaaactaatttggatgattaaccattttaaataaaagtttttaattagggttattaatatttataaaaaaagaaattgaggaattatttctaaatatttaaggtgaatttttttaaatgtctcatataagcaaattgatcaattttttggcaatttggtcaattattattgaagaaattaactgtgaacaaattaatgaggtaaaaattaataaaaaaaataatatttttaatttagtgtataattatttttattaatttgcagaatctttctgttgaaaatcaaaaagatgttgaaaaaatgaatcaagctgaaaggttccttccatataatacttaattaaattaaatgaattatttttatttttaaaataaataaaaaatttttcatttttcggatagatataattttcatattaagtttatgccgtggaaaattcacgatttctcctgaagcacaagcaaaattgcattgctatttaaagagggataaggtaactataaaaataaaaaataaaaaaaattatattatctaaacatatttaaataaattatcgattatttttttattaagccatttctgttgttggcaccgcataaagttgaagttgttcatttggaccctcttgtgctcatttttcgcgctgtgatttcggacacagaaatttttagcatcaaaactttggcctcgaaaaaggtaaattccggaaatgttttgggaaatttcagaaaaatttttcagctttgtcgtgccaaagtggttgatccaaactcgggcaaaactgcgcttgccaattacagagtcagcaaatcggcatggcttaaagatggagttcaccaagtggttgaacggatcacaaaacgagttcatgtgaggcattcagaaaaacaaacaaaatttttatgaattttccacgcaccaactaaattttagtcagtctgtattaccatatatattttcataaatgttactgtaataggcattggttgacctttacagtatacttctattacggtttcgaatgcataaaacaataaaattattcattttttgccaagattcgcgcgattatttctcattccccattacagtatcaataccttaaaatacagtaccgaaaaattctctacaggagcattttccacgcataagtttaggacatgactaacttggacacggaatctgctgaggacctgcaggtggccagctacggtattggaggtcattatgcaccacattttgactttttcagggtaaggggacaaaaaattcaaattgtttttcaaattttatttcgaattatgagtgaatgggtaacaattttttcattttcaaaagcatttttcgatttttcaaaattattttaatatataaataaccatacaatttatttataaatacttttttcagtaactttatttagtctaatgaagtggacaaacgaacttttgagctctatggcaaccgtatagccaccgttttgttttatgtgggtgaaggctaaaaatttttcaaaaatttcaaaaaaaatttcacagttaacccaaccccacgatggtggttttaccatttttacggacctaaacattggcattgaaccaactgaacatgacgcgttgttttggtacaatttgcgcagtgatggaagtgttgacccacgcacgagacatgttttgcaattttaaattaaatataatataatttatttaatagttttaaattatataatatttaggccgcttgtccagtgctcagcggcaacaaatgggtggccaacaaatggcttcatgaacgtggccaagaattcattaggccatgcccgctcaagatggcacaacaaattgatgaaaattgacatttatgaagcgagggacaacgggcagaaaaaaaacaaacaattttgcgtttaaatttgttttttttgaccaaacacaggttttcctcttctttttgtcgcgttagttaaaaaaccttttgtatcatgatacagaccaatttggtagctttttattcccctgaaatccgggaaaagcactttctttaccacagcagcgacactttgggaatggttggccagaaaaaggaagcagcaaaccgcgacagaaaagtgatcgtatgcatctctgaaaaaaaaaaatttaaccttgctggggtgctaggtcgttgtgtaaaatccaccattttagcgatttttcgacaaaacatatggtataacttttcttaaaagcaatcaaattttatattcttggacccctaaatcatgcaaatttaaattttcggaaaaaagatgaaagaaattctgaaaacactactttttcaaaatcccttcggagattaagtcaaaaaacattgaaaaattaaaacaaatttatttatttatgaaattcattttcatgctaaattattcatcaaactttctttttcagaaaaaattggttataatctaataaacaattagggttttaattattttttgctttcctaaatctggatccaggggtccaggtcgagctcaactaatcttacaataagacaaaaataaatttatttcttaatatttgaaaaaaatgaggttggaaaatgatgagattgcagggaaagaatgaccagcagctatttattagaacaatttgtaatttattttacattatttattacagttaaacgtgattaatgacatcatgacaaaattgggaaagcaaattccactcctaaaattggataatcaaataaatggctctcccctgttgaagcatttcatgccaattttggcaagcaattgccatcagggaattatgccgaaattgggcaagcaaacgttcccactatatcctcactttttcgttaaacaaagaaattccattacatgacataaatcaaaattggtaattcctgcaaagaaaagaaaatacaggacgaattttaaggacatatga

SEQ ID NO: 75168 - DNA, 3406 bp, Heterodera glycines
  Genomic contig location: Contig_ID=SeqID_11685; Location=123..3528; Strand=-
  SCN-specific regions: Sequence locations=1-437,460-460,482-542,577 -623,645-779,801-1604,1630-1818,1840-2646,2668-2710,2779-3142,3164 -3202,3225-3236,3258-3406
aagggtgccgccgacgacaatgaccgcaccggtggcagcgttgccgccatcatcaacagcgatcacaattgaaccgccgcaacaacagtcatcaacaacgacgacggcggcacaacatcaaaaacacctccaccagcaccaagcgcgagcagtatcagcaacatcatgcacatccgaggagtctgaagagagtgtgcccgattcgtggggtgcgcgatggggagcgggggcataggatttttggtcaataaaagacaccgctttttgcgacgggaccgtgaaacagttgtttcagtcgggatctcacatatccctcatccattcagctgggtgggatccggtccaagcttgagattctgctgctaaaaatcagcttatctttctattagctgtactatgccctctggggtcagttccccccaccatatcgttccctgatttttttttttaattttaaaacagaaaatcttcaaaaagaatatagatttttcaagaaaaaaatgtttgaataatttttctagcgattttttcatgatgaatatattgttatgaaattttttaaagaaaatttcaaagatttctaaaaatattttttacggctgcggaatgagtaaaacttttagttttaataaattttaatttttctctctctctcgctctctcattcatcccttctcttttcagaagagggacgtgccccgttattgaggcgatcgccccgctcgccgctggccgacgacgacgacgaatgggcggcgccgtccgccgatgacagaaccgccgggcacgaaggcgtcgcaggcggcacggcagtcgcggatgcggcagcagctgccgacgccgccgcttcaccaaaagggcggcgacgcattccacgcgagcgacgaaaagccggggtccgtccgctgttctacccacaatttagggggcttgggattccgaaaattagaattttaagtgcagggattccatgaaaaatttggaggattcgacagggtcttatggcctcgcttcagttagcttagtagttggttcggcgttaaaacatgaaaaaccctcagaaacgtgaaatctaaatcattttttaaatttttttgtttgtttatggcattttttcgggcttccaacaaccttagttctaaaattcggttaaaataaaaaaaaacacaattttttcccaaaacaaaatgaaaaaataaatgtaagagaaaaaacggtaaaatttacaacaaaaaaatggcaattcatcaaaacgcaaaaaataccaaagtgttgtgccagaaaatagtgtttgttgatgattgataacggataatgcccgttcagtacgccttcctcatgctcgttttttgcggcacactcaacgacattgtgctgtcctacatcacgagtggtcccggaaacgcacctttgccggacattgcgttcacttatctcccatattggccctgggcattggtcgtgtcggagtgcctgatgattacgtgagtttgttgttgtttccacggcactacggttttcggcattacggtacaaatttcgttagtcaataataaaatagggtatttgcactttttcgccaaaatcgctgccaaaaaacctcgaattttaatttttttttttttttttgccaaaatcgttaaaattttgactttgtatttaaagcagtaattttatgtgttttcagcatgttctttatcatgatgctcattgcagttctgcacaaacatcgttgggtggtgttaaggtgcaattttttaccgtttgtaaatatgtcgacgacacccatgataaattcctataatcgatctgatcatgatcattgacttaaaagttaattcgtagatctctatccgatctctttcccatttgttgatcactagaactttaaattttgatcggggcactattgtctttgatcacttcacatcctctaatcactcatcaactttctcggctgatcactcactaagacgcatttcctttttcaccctcccttgtcttggtcacttttatctctgatcacttcactctctaatcactaatcatcattcattgtgtccctccccagacgcattttcctgatcggctcgctgctttaccttggccgttgtgtgaccatgtttgtcacccaagtacccgttgcggacaccaactattactgctcgccacggttgaagcccgaacagcgcaccttttggaacattttggcccgtgcactgtccgtcgttgttggcctcgggttgaaaatcaacggacggcacacgctgtgcggtgactacatttacagcgggcacacaattgtgcacgtcacctgctgcctgttcatccgcgaatgtgcgtttatttttttgggtgccaaaattttgaaccgcaaattacccgttttgttggcaccctcagaggatggggtgtgggaaaacgcacccttcgcaaaagttataaaaattttcccgacggcgctgcttctcgacatggggacaattcccttccctcctcgcgcctcccccccccccccacattgtttcatcttgagaaattaaaaaaataattaccaaaacctaagatttttcacaaaaaatgcctacaaattttttctacctacgcaaaaaaaacttagaaaggttttggaaagaaaattgcaaacccgaaaaaatgatttcgcatattttcaataagtttcttggttttaacaatttctaggaatttctatttttcatttttttattcaattaaaaaatttcctagaaaaataattttatattaaaattttaaattccgcccccaattccatgcatttccattttttcagacagtccgcgccgttggcgtctgctccatttgggcgcactttgtctcgcctcggttggcgttctgtccctgctgttctcccgtggtcactattccatcgacgtgatcattgcctattgggtggccactcggctgttttggatttaccacactttggccgatttgcccgcgttgcgcaacgaattgcagggccgaaaccacctgacgaagacggtgtggtaccgactgttcctgtggatggagggcggcgtgcagcggccaatcccgcgaaagtgtgtgccaaaaacaaacaaaattactattgctaattagtctcattagggtgccgttgccgggatttttaaattaagaaaatcccaaatatgtgtgtagctaagtacataattgtggtcgaaaaactggcaaaaacaaacagtaggtataaattttttggtttattgcattttgttaataaatatttcaaaaaaagtccaacttaagtagctaaaaatccgcaccctgctaattattagagctaggaactttgaaaaagtcgggattccgattagtatcagaccgggcaatgataggattgaaatcaaatcccaattttgtc

SEQ ID NO: 75169 - DNA, 774 bp, Heterodera glycines
  Genomic contig location: Contig_ID=SeqID_11687; Location=1008..1781; Strand=+
  SCN-specific regions: Sequence locations=1-194,216-222,248-383,405 -423,449-472,495-586,612-712,744-774
atgagcaactacacaaagaaattcggattgacgaactatgatgctcgattatttttacgaagtatttaaataaaattggtagagattccgctttttaatctgtaaccgaaatgccatttttagattgaactaaaaaagcaataaattaaataatgaattcaaaaagtttctgaatatatattataagcaagtactaaaagtaaaaccatattgcaatagatgataaatttaaatatataaaaaataagataactttaatcatggaagaattggagaacctcagccatggcccgttggttccacttttaatataatcttcacagaaaacaaaaacaaaaatcaatttgagatttattgcataaggaaaagtttaattgtaatacaaaaaatttattttaaatttcggtcaaaacaaaaaagaataaattgtatactttaaaaatagaaacataaattgatcatagcagccattcccgaggaggaggcgctgatggagaatgagaggaatacgaaaacgaggacattgggggcgattacaggactgttattaccagtcgacaaaattaatttttttctatttggtgtcttataaatataattaataaattaaagatattgtagaaagggttccatctcgaaaagtccacttgggatcctatggaacacttgaaggagccaaagtgcttttagagaaggtaactaaaaaatagtgaaataaaataaaataatttattagaaaaaaaccaaaacaccttcaagactacaaaaataata

SEQ ID NO: 75170 - DNA, 177 bp, Heterodera glycines
  Genomic contig location: Contig_ID=SeqID_11687; Location=2078..2254; Strand=+
  SCN-specific regions: Sequence locations=1-36,87-177
atgcgcgtaaggaaaaagtgacgaaagaaggcatggttaaaaataaaaatataataaagttaaatttacaaatatattttaaatttgaaggccattgtgcttcgcaatctacataggattatgtgcaagattcttatggcaatgcgaaaaattgatcaatttttaacgataatttaa

SEQ ID NO: 75171 - DNA, 1065 bp, Heterodera glycines
  Genomic contig location: Contig_ID=SeqID_11688; Location=487..1551; Strand=+
  SCN-specific regions: Sequence locations=1-220,260-460,482-600,657 -874,901-1065
atgttcggaaatggaagtcggaaatcggaattccgtgccatccctgatgtgtacgttttcgcgacgcaaaaaaaaatttttttttccaatttcaaaaagtgtccctttttttgcttatgttcacaacagaccactgcttctccggctcgaaaagctatgccccgcctcaattgtctggtcgacaaaatttgcgcaaagttcgaattgtttattttttcgcattaaaataaaattgttaaattattatttgttttaaatagggttggtcgggaccgagaattttgggcaaaaccgggaccgggacttttcgagttgaaaaaacccgggactttttggcgctgggaaaccgggaatttcccggtctcggtcaaaaccgggacttcggtactcagttgtccgtgttttggtccgaccaatcctagttttaaataaacaattctgaaaatgcattcatttctcggaatttctaggattttttgttggtccttaatccggcacttatttcgacaaattttaaaaaaaccggattacaattccaacaaaaagtcaaaagaaagatatataacatgtttaaatacgtaaaaattacttaaaaacatcataataaaataataatttatatttttggacataaaaaattaattaattaaatttatgtttttgctcgaatttcggatatggattgttcggaactcatcgagatttaatcccttaattccgggaaaagtaataaaaaaaatttttgcaaattttcagaaaggatgagaaaggattattggtgcataagctgaagcgacgctttgcactgtttgccaaaatggatttgcaagaaatggaatgttgggaattgcacgaacgcttggccaagctaaaagtggccaaaaagaagaagaagccgaacaagttcgagcggtttgacgccgacttcggcaaggccatgatgaccgaaggcccagtgtttgtggaggatttcatcaaagcgatcctcctctgctgatcacttgctaatgaggggctaattaattgaggggggaggggacgaggaggcgataaaacgtacataaa

SEQ ID NO: 75172 - DNA, 394 bp, Heterodera glycines
  Genomic contig location: Contig_ID=SeqID_11690; Location=135..528; Strand=+
  SCN-specific regions: Sequence locations=1-7,33-214,236-394
atgttttgccgcttccccctccccctttccttcgcctcctcccttttaattctgctactttcttcgaatttggtgcttcttgttgggggtaagtaagctgcttacaaattaacaaatgaattggcattggcattgaaccgtttcaaaatgtttgtgcttttttaggtgtttttaaactgttggatggaaatgctaaactcgtgagcaaccctttggagaatgtggtgtatctgttccaattcccgagaacgtcgaccacgccgagccaagcgccatacaatctgatggtggagacatggctgcattggaagcacatcccattccatgtaccatattatctctaattatcccccggggtgattattgttcaacttcctcagaaagggggggatta

SEQ ID NO: 75173 - DNA, 455 bp, Heterodera glycines
  Genomic contig location: Contig_ID=SeqID_11690; Location=999..1453; Strand=+
  SCN-specific regions: Sequence locations=1-455
atggtcgatcgtgaggccggcttagaatggatgactaaagatgaggcccttgtggagatcattgtgccgcaaaccttcaccgatcgaccgcttactgtgcagcttggagaggacggtaacttcaatgtgagcgtgaaccaacagttttgggagcagtactttgacgcgtacaacgccaaaggacaaactgagaaagtggcatttgtgaatgcttttctgaagcctttaaatgggactgatcagaaagaggtgaccaaaaattgatcagcatttggcgaagctatcgcatttgtcggtttcaggaaaatggatcaactttgacggacggaaggctatgggtcgacttcagtgcgtggcttcgccagaatgtgatcaaacgcacaatggaaacggtactaatggtgacggtgaacggacagccgaatactgcgaatccagggaacagtcaagcgaag

SEQ ID NO: 75174 - DNA, 2237 bp, Heterodera glycines
  misc_feature (1713)..(1713): n is a, c, g, or t
  misc_feature (1739)..(1739): n is a, c, g, or t
  Genomic contig location: Contig_ID=SeqID_11692; Location=1665..3901; Strand=-
  SCN-specific regions: Sequence locations=1-104,175-193,215-237,259 -322,355-542,564-1020,1068-1152,1174-1391,1448-1647,1685-2086,2110 -2213,2235-2237
atggtttcagtgccaaaagattaccgagcatggaaagcggcgataaaagtcggaaccgacatgataatgtaggtgatcaaaatggaaaaatattaaatttggtgaataattttttaaattttaagaaagtttaaattttaagagaaattttataaaaatattttttgaaattttccaatcattgaaaaaaaatattcaattttttctttaaaggttttcctttatgaataagtaagattctaaaattttttcttttgtaaatcctaattttctctcaaaattctttcgttaaaaaaaattcaaaagtctctttataaaaacgcctaattttttaaaaaatctttgtcataaatttgtgctttttttgccgtgattgaaggagcattttgcgctaacaaagaatttttgacgtcaaatttgttgtgtaaaaattttcagggcattttgtttcgcttaataatttgtgccgttttttgaatttctaatttaaaatttgtttatcctttttaattttcaaaacaggcaacacacatgcgttcaattcaaaattgttaatgttgaagaaaaggacaattacagcgaaggcattttaattagagaaattgagtttgccgaagctcacaaagttttaaagacttgccgtaagttttaagaaatgatttttaaataaatcagaataaaaaaattgaaaattttggaaaaaattcttaaactcttgaaaaatagcgatttttttttgaaaatccgcgcgaattgcagagtttttttttagttcaaatatcttttgagattagggttgctccccgacccctcggggggtaaaatgccggggacctcggggggcgacatgtcgggggtcggggcggggaggagctcaattgtcgggggtcggggaccggggagcaaccctatttgagataatcaaaaatttagtctttggagaatcgaaggctggaaaagttggtggttggcaagaacttaagcttgcgatggaacacacttgtccacatgtgagttttcaattaaaaaaaaagaatttttttaataatattaaatttaaaaaaattgccattgacgctgatactgtaaatgaataataatgggtacggtattggcatggcaattaatgtttgttgttgatgaatttgaagtgtcaagaaaagtttaaaaatatcaatttaatatttccactggctaactatactgtaattcaatcaatgctatgttggtacggtattgtctgacaactattagtgatgatattaatttgcagttacaaccaaacatgtcgggggttgcttgtcatgaactgttgcacgcacttggcaatttgcacgagcaaagcaggagcgatgcgcgaagctttgtcattttgaggcaccaaaacagcgtaaaaataatttaaattaaaaattatacaaaaattaaatttttcaaaattttaatagcaatcggatataagccacgacgcagaaaattttggctttggttacgattttggctcggtgctccattacggtggacattatgacgaagaaaagtaataatcatttttagaaaatacgaatagaatccggaaccgggatttctaggctcccggacttttcgacaggacatacaaaaataatggacttttcgacattaaacataaaaacaaataaatcttattaaaataaattatattgcttgtcagttttactaaatttcttttanattaacatactaatatgtattgctanatcattattactaggtcattcatgatttaaaaaaaactatttatctcaatactgatttggcatcattttttataatatttctgtcgaaatgtcctttgctctaactagagttgcacgggaccggggaattttgacaaaaacccgggaccgggactggcaaaaccgggaccgggatttctgtttttccaaaaatcgggaccgggacctgaaaaaccgggatttcccgacccggtcccggtcccgtgcaactctagctctaacccagaatgttcaccaatgaaaaattttcgaaaataacacaaaaatgcttaagttttcggctcctgctaaataatgagactacttttaataattgttattaattattgtttgattgcagcgatcagtactctctgatcactctgccacggttttaccagcaaacgattggccaacgcggcagaatatctttcaaagacgcggcgataattaaccaaatttattgcaaaggcaaataaa

SEQ ID NO: 75175 - DNA, 318 bp, Heterodera glycines
  Genomic contig location: Contig_ID=SeqID_11693; Location=210..527; Strand=-
  SCN-specific regions: Sequence locations=1-168,190-240,268-318
atgttacggtctctgagcatcattttgttgattaacattggcggttatttgatcacgctggccctgtaccgatttatagacataattagctctatttttgggtaataaaaaatattccaaattttcaaataatatattttataggtctttaattcgaatttggcaaaatgaatgctttcttggcattctgttgaatttagcggcaggatcaaatgcaattgtgctttattttagcaggtcatttattattttttaaataatttttatgcattagaattttattgtttaagtactgaatatcgtcatctgtttaataaa

SEQ ID NO: 75176 - DNA, 771 bp, Heterodera glycines
  Genomic contig location: Contig_ID=SeqID_11696; Location=329..1099; Strand=-
  SCN-specific regions: Sequence locations=1-160,237-260,282-440,462 -574,596-609,654-665,687-742
atgctttcctattgggttcgacgatggcgtttcaaaattcctgagataaagaaaccaaaatgcgaacgaattagcaaagaacggcgtcaaacaatcaaatgtatcagtccgaacacaaaagtcagcttatatgagcggtgggtgatgtacgagaattttcaaattttttaataaaactattaaattattttattttttttatatataatttaatcaatttttttcttaattatttaggacaggactattcattgaatttggtttaccaacaatttttgtttgaagaagcacaacgatttcaaggacattttcctgttgagtgaacaaaataattctataagttgatggatcagtcacaaaaatttacctaaaaaaattacatgttttcatgttcctaaaattagaagccctggggggtttagcacctttgtttgcgctgatcaacaacatactggaaattcgtttgtattcattttgctccgctttgttatttcgttcaattttaggatgatttaatttcataagaaaaaaaacaaaaaattgacaaatacattttctctaacgggtacatccctccaagtcttgaaaattcgaattcctatggctgtcaaaaaattttaaaattttatcaaaattcttaattaaaattaattcagaaattacatggtttccttaaaattctctttttcatttcctaactctatcaaataattgattgatttcttttgaggttttttcacactaattttaaaagttttatttttaaataaa

SEQ ID NO: 75177 - DNA, 2769 bp, Heterodera glycines
  Genomic contig location: Contig_ID=SeqID_11697; Location=250..3018; Strand=-
  SCN-specific regions: Sequence locations=1-108,130-142,165-446,468 -911,935-1459,1481-1513,1537-1559,1581-2087,2111-2176,2228-2312,2348 -2693,2715-2769
  Gene Ontology: Mol. function=protein serine/threonine kinase activity; Cellular component=nucleus; Biological process=cell cycle
atggtcgtgtcggcgaaacaggtcttcaacgagctgttcatcacttcggaactaggaaaaagcattcctacgttcatcaagctagtcatggcgaaagtcgtctgtggtaggtatttattaaattcccatattttatttccttattttggcctttttccaaaaaacccttattagaacggtccccatcaactaattttgctttttttgaccactaaagaccgaaaaaattttcaaaaaacatttttaagcaaaattttgtcgaaaataatgattaaatttaattcttttgctaaaattggttaatttatgtaatttagcgaatttgaagaaactttgagaaattatacccctcatatcgtaaaatttatgtccatattttttgcaattttatgtccatatttcgcgatttttagtccatttaattttacaccctagatatgagcgttcaaacaaacatttttcttttaactcccaaaaaatggctggattattgaatgcattatatttttctctatcgatatgcaaaatttaaagaaagaaagtgaattcaatttttctcttaacagagataaagaaacaggacgccaaatttgtagccacttttaaattggaatttttcattaggaaagttccctggcccactgttggagcaattcaacaagttcaagtatttaaacgagagcgcgcaaaatctcccgccacttgacaacgacgccgcaaaatttgcgctcatgggaatggttgccagtggcgacaccctcgagtcttacctcaaaaaggaggtaaaaattgaccatgcttggacttttctggcacaaaaggccattttttataaataagcagaaaattttcggtccttcaaagggggtgaggttttttgtcccgcttagtgatcaaataaattttcgttgataatttttaaatatttttttttcaaaactgatcacttttttttatcagttttgggagtcaggaccaaaatgcaaaaaaaaaaacccaatcacaaatcggctatgctctacacaataaaagtttcacctattctcaacatgaaaggtgatttagaccatattgtgtagagcatagtcgatttgctattgtaatttttttattttttgtcttgcccctaaactgatcaaaaaatgatcaaattcaaaatacagcaaaaatggtatatataaaatttttcatttttagaagaccaaaaatgaacaacggtactccattttccttcaaatcgcctttgccctggcggttgctgaaaaaaaatatgattttgaacatcgagatctccataccggaaacgtacttgtggagcactgtcgggacaatgagaacattcggtaagctgaaaataggctcctagctaaacaaattttgggagggagaaacctgaagaaaaaatcatttaaattgttgttcctaggatccacaattttctgcacaattgaagcattattttacaccaaaataaatagttgttaaacgaattctaagcttttctccagaaaaatacatcacttggaaaaaagttccaactcttgttcgaattcgggcccagttgacagaattgagtaaatccgagttcaatttcataatcagcacccttgaaacctccttaaaactggtttcagcacaaaaaaaagaagttgaaattagggattgcaattatttacgattgccaaattttcaaaacttatgtaattttagtttcttgtacggaaatcagcaatttgatgtggcctcaaaaggggtgcgtgtgacgatcattgatttttcgttgtcgcattttcgaatcggtaaggccttaaatttttgacagtaattttgtgtgttcaaacaagatggacatttgttcttcgacgacctatccaaggatccggatcttttcacaggcaacggcgtcagctgcgaaaatggcgactaccaattcaacatatacaggatgatgcaggagaaagtcgggtagagagaaaagttttttttttcacacaaatattttttagccaaaattgggctcgtttttggccccaaacgaactgtttttggatgagctatttggctgtgaagctctttgacaacaccgtcaaggagaagaaagaaaagaaggcgatcaaaaaattgtttaagtttcacatacattttaaaaaaatcgaagattttatttttgaccctgattttaaaaatttatttgcttcaaaataaaataaaattttatttattttttgttgatattttaagtagtaatgtatttttgaaaaagcataattaataattgatatttatttatcgtaatatttgctgatttcaattccaaataaaattttattttttctttgtttctatttaagtttaatgcatttaattaaccgaaatttcctttcttcccccttcactacgcaaaaaatgcaaattttttgaggcgggacgattagctattgccaattttcggcttttattgcgataaattgatttattcccgaaaaagcgattaattgaccagttttgtaagaaattttcaaatggaattgggagccacagactttttttaatactaattttaattccttttattcagaaatgatgcacagcaacaacacattggcaaatggctgttctacgccctgttggtgctgttgttgctcttttccggctacacattgtacggcgaccggtgctttcggtttgccggcaacaaatggtggaggaagtggtgccacaaatccatggaaagaaatgcaatgggaaaagagaatggaaccaaattaa

SEQ ID NO: 75178 - DNA, 153 bp, Heterodera glycines
  Genomic contig location: Contig_ID=SeqID_11697; Location=1..153; Strand=-
  SCN-specific regions: Sequence locations=1-153
attttccttttcagccctttgactttctgtgtccctccctattccattttctgtgccgtcggctgtcagtgctgccaattcaaccacgcggatgaccacctcttctcaatgccagtgctcgagtttctgctatgaaaattggtatcgagcgca

SEQ ID NO: 75179 - DNA, 3153 bp, Heterodera glycines
  misc_feature (3065)..(3065): n is a, c, g, or t
  Genomic contig location: Contig_ID=SeqID_11698; Location=30..3182; Strand=-
  SCN-specific regions: Sequence locations=1-137,159-969,994-2263,2287 -3153
atgtgcaatgccgtaaacggaagcgacactcgcgcactgctgatgaccgcaacgtcaacggtcttcaatccagcacagccgcatctcagcatgactgcggcaattttcatcgatccaggcagccacagatcattcatttcggcaaaggcagcacagctactggacctcccggtggtccacaccgaagaatgccatttgaccagcttcggagaacgcgaaccgaagagatacatcagcgatctggtcaagctcggatttctctgcacaagcggggaaaagctcatcttcaacctcaacgccatgaaattcttggtcaacgacatgccaatgattcaactgtcagagttggacaagacagaattgagacaacaaaagctcaatcctccacatgagcaacgtcaaccagacatcatgctcggaattgatgtctggcacgaactgcaggttcaaccaatcgaaaagctgccaagcggcttcacactgtgccgttccaaaatcggcaaaatcctcagtggatcaggacgcatcgaaatgcaccaagcatcaaacgtcacatttgtcctgtcagtccacggcactgaacaagaagaagccaatcaatccgtcacgttcgaatcaaccaaagaagataaggaagtcttcacatccgaagatgatgtcaaaaaggacgagcagctcaacaacttcttcggattaaacctgatcggcatggatgacacatcaacaccaactgatcaagatcaagtgatggtctacttcaaaaagaacctcacattcgtcaacaaccgataccaagtcgccttgccttggaacgacagagtcgatgctcttccaagcaacatacatcaagccaaggccagactcgtttcattgatcaaaaagctgcgcagcctcaacctgattgacgaatatcagacaattttggacgagcaagttcgacagtcggtcatcgaatacatcggcccacctgagtcaccatcaagtgcatggccactgcattttttgccacacagagcagtcatcagagcggataaagcaacaaccaagatccgaatcgtcatggatgcgtcagcaaaaccaaagaattgcccatcagcaccatccttgaacgactgcttgcacaccggaccacaactgctgaaggatctcaccggcatcctcctgcgcttccgacgcatggaacatgtaatcctggcagacatcgaaaaggcatttctgcaacttggcatccgatacgtggacagagatgcctgcagattcatttggctcaacaaccccgagacagctgagctcaatccaatcgaccactccgaactgcgcatctaccgattctgccgtgtcagtttcggcctgacggtgtctccatttctactcaatgccacactacgggagcaccttgcgctattcgactccgacctagcaaggcggatcgaagagaatctgtacgtcgacaacatcatgttcgacgccaagccaacggaaaagcttcaagatttggtgacgcaagccaagactatcttcgaagcagcgggcatgaaactccgagaattctacggaagcaacatcgaagagctaaaaaagctgcaaccagacgacttggcaaaggacctcgaagacaacaaggtgctcggcattcgatggaaaccaaagcaaaatcggctcatcttcaagttgccgatcttcgaaggcaaaatcacaaagcggacaatcctatcgcaaattgccaaagtctacgacccgctcggactcatgtcaccggtcctactgccagccaagctcattcttcaagaagtgcaaaacatgaatccaaaatgggacgacgaattgccagcgaacatcagcaaagactggctcaaattgatggcacagtggctcgacagaggcgaagcaatcacaattgaatttccacggcacatccaagccatcgactcagtggaattccactgcttctgcgacgccagcaaatacggcatgggaattgccgtgtaccaaaaggcaaaaacgacgattatgaaggatgaatgcaacctcatctacgcaaaaagccttgtcaaaccaatcaaagtagccgcacacgacggcacaattccaaagctggaacttcaagcactgactctcggagtcaaggcagtcaaattcatccaagcgcaaatcaaatttgccgatcatcaagtcatcatgtggacagacagtcaatgctcagtcgaacgacttcgagaaaacaagcgccaagatcgatttgtggcaaatcgattacaaaaaatccgagaagcgaacttccaagtccgacacgtcagaaccgactcaaatccagcggacatggcatcaagaggagcggatcctcaatgccttcgatcatcactgctttggcgctttggccccgtttggctttcgaaagcagacaaatggccaaaatcaaacgtcatctaccggcccggagatgaattcaaagaagtagaagagccaccaatcatcgaactgacaacaacacctgttcatgtcgaagaacagttcaaaccatcaatccacttcgaacgattttcgaattggaacaggctgaaagccaccgcagcacacgctatgcgcttcatcaaaaagcttcgcacaatcgaaaacggcacaattagtgaaccgcatcaaaacaacaaaccactgaccatggcacaactgcaacaggccgaaaattggatcttgagagaagcacagcggcttcatccaccatccaacgaccaaatccgagaattgcaactcttccgacaagaaggaatttggagatgcggtggacgactcgaggaagcaccggatctgccatacgacagtaaacacccaatctttctgccgccacacgcatggataaccaagctcatcatccggcattatgacaaacagctcaaacattgcggtccgagaatactcctgtcaacattaagagagaaagtctggataccacgcggacgcaaaacagttcagcaactgctcaactccccgcaacacggatgtcttgaatgtcgtcgagaacgagtcaagccgtacacatatcctgaggcatcggatttgccaagggngaagagtcagcgaagcacgaccatcgacaaaaacggggagtggactactttcgtccactcaaggtcaaacaaagcaatgacgtggtga

SEQ ID NO: 75180 - DNA, 123 bp, Heterodera glycines
  Genomic contig location: Contig_ID=SeqID_11700; Location=362..484; Strand=+
  SCN-specific regions: Sequence locations=1-123
ggtaacctacacaccgtttcaaaaacgagaaatgaaccaataaatagagagtgcagagaaaaaaacatctctcattttggcgtactattttttttatctctgttaatagagaaaaactgaatt

SEQ ID NO: 75181 - DNA, 846 bp, Heterodera glycines
  Genomic contig location: Contig_ID=SeqID_11701; Location=853..1698; Strand=-
  SCN-specific regions: Sequence locations=1-631,675-846
atggatattattacacattgtcatgtatgttccggttaagcatcgattaaataaaaagcaagctaattgatttaatgatttcataaaaacaaagcaccccctacatatttgctctcatgcatcttaaacgcccacaaaccaaaaacatcagccaaaatttgtccatttataaggcagtgtgtgatttgacaaaaaatattattcaaacccaacatagattataaaattcacatgaattccaaattattagttgaataggaaggtaatcaaattttgttaaatgatttaataagacaaattttcttcgaatttttgtgactttgtctaatcttaatttaaaagaaattaaaaaaacctcggtattctggaaccctgactttaaaggttgtttttttctgaaatagttcattttagggggtattcttcgtatttttaatcaaaagttggcgtgatttcaaatagggttggccgggtccgggacccgaccgggtttcagatccggatacccggttttttcaagacccggacccggttttttgaaaatccaatacccggtacccgacccggtaggtccgggtccaaaagtacactggtaagaatgggtctgggtcaaattgttaagcaaatttggtaaaaaaaaattttaaaaaatgcgattaatatttatttaaaaacgggactatcaagtgcacctgtggcgtagtggttaatcttttggattcgcttctttctttcactggttcaatgctgtctcatagcaatctctttaaacattttttaaagatttttgttgaaaacttttattttatcattaagttaaaaaatgctcaaaatttttttaataaa

SEQ ID NO: 75182 - DNA, 1437 bp, Heterodera glycines
  Genomic contig location: Contig_ID=SeqID_11701; Location=2897..4333; Strand=-
  SCN-specific regions: Sequence locations=1-168,190-1437
atgtacataattaaacgattcgcacaccacgtaaaagtacctttttggttgagttatttctattcggcaagtgttccctccgggggttttgaagtcgttgatcacgattatggtctcagatcgtgatcagaaattccgaaaactcaaggacacgttttaccgaatcaaaatgccattcatttttaattttgtgtttcaattgctgtacacaaatccaactcttgtcagtttaaactagagtgccacgggaccgggaattttgggcaaacccgggaccgggaccttttcgggttgaaaaatcgggaatttttggctgggaaaaccgggaaaaagccgggactagtcccggtcccggtcaaaaccgggaccttggtactcagttgtccgctaccaggtcccggtcccgtggcactctaatatttactacgcaattttgtttttttcaaaaattcatttatttgtgacaaaacccgaacaatttgttgtgatcacaaatgttaaaattttgttgtcaccattgattagtaaagcaaaaataaacaaaaaaatttaacctccgtttgaaccgacaaatttggcataaatttcgctctagagtttttaattgtggattgcatatttcggaaatttttggttttatttcgggtttctacggttgaggatttttttccccctctgctgattaaggcatctttttgaaatatttctagccaacattaacggcgacggaacatgctcgacaacaacaagggaagccattatcagcggatcggcaacaacatgacattgatcagcaaaaggattttgatcagtgccaaaatggcgagattgaggaccagaatacaacgccggatattttggacctcagccttggtcaacttgatgcgatgaatgatcaacaaaaccttaaatttactggtctgaatcggtcgcaatccgatgctttctattaccacgatgatcagctgtgttttgctcaaaacaactgccaaaatacagcgcatcgatccggaaagcctaacggcgttgggcaggcgtcgatcacttgtgctgatcagcagcgcagtcgtgccaacactgtgaccgctgctgatcagcaaattttcatgcactacaaaaatcagtgcgaagaagctgaatgggcagactgtgagaccactttaccattgtcaacaaccgcagagaatgattgatgaatagcagaattaaaccgttaaatcaacaagaacacgataaaaaaagatcaattcataaatgagagacacacatctacaaaagcgtaattacagtaacaccagttgttggcggtgccaccccccttaattcttctgctgatcagcagaggatgacccgttcaagttcacggacgggaatgaaacaactaattaccatagttaatcaaatatttattttgacacttagggggtggaaaataaa

SEQ ID NO: 75183 - DNA, 960 bp, Heterodera glycines
  Genomic contig location: Contig_ID=SeqID_1662; Location=451..1410; Strand=+
  SCN-specific regions: Sequence locations=1-75,99-127,149-175,208 -291,334-350,372-434,456-575,598-769,792-796,818-960
  Gene Ontology: Mol. function=protein binding; Cellular component =nucleus; Biological process=negative regulation of cell proliferation
gccagcaaagagttcaaggagttccaccgcagtgcacaggcgcgggtgcaaaagttgcgcaacgagaaaattcgcatgatgaaactgatggaggaggacgacgtcggctaccgacagctgctggacgagaagaaggacaagcggctggtccacctgctcaagcaggtggaggaccaatttttaaaaaaaaaattttttacaaaaaatggaagaatgagttgtggagagtttgaccggcctggtgcgccagcatcagcagacggagaagaagcggaagcaggacgagcgcaaggaggccaagctggcggcgctcaggcagcaaatgcaccaaacagcacaatgccggcggcgatggtggcgccaacggaggcggcgatgactcattgcacatcattgttcggaacagtgccaccggcgaaacgctcaaaggcatgtgccggggggaccgggcggggaaggccagggacaaatgattgtacatgcgccaggagtggcttagggcaagggccatacaacggacgactgaacggtggggggggggtgtatctcgggaccaaaattttgaatgaaactccaaaaaaaataatttttttttttgcggcctgaggtactgatagccgtccccagataaaatttttttgaaaccaacgaggctcgtccgtatctgcaaaaaaccccgccggggaaaatttaaaaattttgattaattttgttaagaaaattgagaaaatttaggggaaaaagttgcccatttttatacatcccagcaaataaatgcctttaaaaaatttggacgaaaaaataaatttggttttttgccctttcacagatttggacgaggagcaacggaatcggcgcatcattgagaaggcgcgcaatgatgaggacgaatacgacaacaaaaatgcactggcccaaatggagtcgtattacgcgacggcacacagagtcaaagaaaag

SEQ ID NO: 75184 - DNA, 917 bp, Heterodera glycines
  Genomic contig location: Contig_ID=SeqID_1664; Location=76..992; Strand=+
  SCN-specific regions: Sequence locations=1-917
atgcccgtgtacatcacatcctccagaaaaagcacattgattttgtgagtttgggctaagatagccttgacagtttctggggttgccatataaccgccaccgatcacaaatggcgggaacattttcggcgcgtacatttcacgggagacgtacctgtggcaaagtgccagattttaattcaatgaaatttcaaaaattcttttgggatttatccgctaggaccgtataaagagctaaacaaatagtttttgaccgttatgatggattacgcggattaaagatttttaaaagaatccttcctaattacagattacgcagttaggtcccggccccagccgggtgaagtaattgaaaatctccgtaattacggggttttcgtaattcaaaacccagtaaggcacagctctaacattaaggcctccattaactgaccatttcttgtaagggccatttgggtctcgtacaggatcacgacgtcctccaacgccgacaaatagaagcggatgttttgtggcaatttgccgaaatttgttttcaatccaatgggccatccgggatagatggaccaccgtgtcgtcgtccatcttcagcatccacttggcattggcacagtgccgttttgtaataggattatccttatgaacaattaattaattaggaacatatttatataattaaggcggtcatttatttacctgttcaataccaattgtgaatgctcttttcactttaaaattgacgaaagtgtccaaatgagtgccacgttgaagcaatgccgggtaacagatcagcagtttaaaatggcaattaaagtatttattttgccagaaattataattggtaccggtaattgattgaaccgacactgatttaaaaagcattcatacaattggtttaatttttttacggaaactgaa

SEQ ID NO: 75185 - DNA, 290 bp, Heterodera glycines
  Genomic contig location: Contig_ID=SeqID_1665; Location=422..711; Strand=-
  SCN-specific regions: Sequence locations=1-95,117-290
atgcatcttttcatccttagcaattttatctcatttttcattgtgctttttcatttgttgtcctatggccaattgtcacccatcaaaccgtaaaaaataaatttggatttttatttgttaattaccgtaatttcaagtttttatttgacaaatggcaccgacggagtgaaacgcatcaaagttgaagcaccgtcttaatgtaagcccgaaaatgggacggaaaacccatatggaattgaatttcgacttccaaaagatggcggaaattgcgacgaagggttggaaataaa

SEQ ID NO: 75186 - DNA, 1000 bp, Heterodera glycines
  Genomic contig location: Contig_ID=SeqID_1665; Location=1527..2526; Strand=+
  SCN-specific regions: Sequence locations=1-12,34-174,199-334,367 -447,469-500,522-694,727-922,970-1000
atgaaagtgaataacaacaaacaacgaaaagcactccctcaggagcttgtctacgaattggtcaatgctctgccgttttgtgtccggtgggcggcggttcgggtggcatcaaattttgaccaatttgtcatggaacggcaacttgactggatcaagacagtcaatgttcgtggtagtggtggtggttgtggtgtgccactcatttgtcagggatgtcggcgattccgaatgcaaatttctcaaaatttagggccccacaaccccgatttatgaattttggcttaagaaattccgatttacagttttttttgcatcggttgacatttccgattgcttttaaaatttaatttaaaatgaattttttaaggcttgttacgctacttatctgacattcaaggaatcattggtaggtgtgttactatttagagctgtctggtagactctgggatttattttctttgaaaaatcgtgacaaaaattaccaaggattccgtaaatatcgggcttttttgggctgggggtagtctcgaaggtgggaatttcggccttttaacatcactataatctccatgccaatcattttactcacatattggaacagaatgcctacaaaaaatcaatatctgttcattacgacgagtggaccgcgtaccaagaaaagtggacaatttatcagcaaaaatggacaatatatcaacaccaccagcagcagcagcaggatggaagccaaggagaagaagtggatgaacaaaaaatggacgaatttatccaagaaatgaaaggcgtttttgaaaaaatcaaaaaaacatcgcaacaaatgaaagttgtgtttggcttaggatggaaagtttttcagaaaaacaaggaaatttttggtctcttattgaaggcctacccaaaaataaacaccgaattttggagtggaggagaaaatgatgacgaagatgaagatgttgaagaagaagaagagcattgaaaatgcattttatgattttttgta

SEQ ID NO: 75187 - DNA, 1702 bp, Heterodera glycines
  Genomic contig location: Contig_ID=SeqID_11702; Location=677..2378; Strand=+
  SCN-specific regions: Sequence locations=1-302,334-342,366-728,754 -909,932-1702
atggcgaaattccgtaccaaatggtacactaaacaagctatggttctgtactttttgagtcaggggtacaagaaatcaggaatttttggtcatccgggccaagatctgcggcgcatttacttataccgtcaagttacactcactcgtaagtctcgcgcattgcaagcagagccatgtgtatcgcgtccaccttctcaatgtcttcattgtaccgcttctccaacaatttcttggccaattggtcgtttttgccgatcgccgtgcttttccacccaaaataggaaccctgtggaatgaaggggaaaatattgcaaaattttaaattttcatgaaaaatgggaaagaaaataaatgcctaggaatttcggggtaatttttttttcattttgggcatttatttattatagaaaagacacttaacatgtaattttttaacgggggatacaaacagaaagtttcttttgaaaaattaccgccggatcggcttgaaaaagaagcgcccccttttcactgtcccatccgccaatgagcaatgaaacgccaaacggacgaacaccactaaaaaaatttaaattcctttttttaagttttttacaaatagaaatattttcaaattgtaggttagtttttctgaaaaatttctgttttatttttttttaaattcggggaaaaatgatacgagggggtggggtaaacgagcagcccccataaaaacagaactttaccccgactgtgtgtattcctgcatgaccgcagccacccgggaaacgagttgaggcacgggaatttcatagccgtacagcacttggtaatccatcgcaattttccgcgctttcttcacgagaagtctgtcgaggtgcaagaaatggattaattataacaattaatgattctttttttatgctcttgtgtagaattgttttaaattcaaacacccaaaaaaatttctatactttttatttattttttgaaaatcgaacccctgacgaaaaaatgacagacccattaacaaaaaactgtcatcaaccaggccatggaaatttttccttttttttttggtttcaatttctgaaaaaattgatgtaaattataggctagcggtgccaaaatatgcgcccttgagaacattttttgcttttcttggcaattatcaaattttaaaaaaccccagataattcctcccgtttaccccctctaaataattgagaagaaaataaacaggctggacggattaatgataaatccggatccaaattggcttttagaattaaaaaaaaaccaaaacgcactgtgcatccgggcccatcccactgtacacgcatgcaatatggtcggacaacttggagattttgctgacgggctgtgtgaggacggagtgtttgttttcggtggcgaacacaacgcaatcttttgctgcaaaaatgaaagaatttgttgggttaaaaatatgctgttttcaggagtatcgaagtcattgaacaggaaaatggcatcacttttcggcaaaactcttgaacccgaactcaatttggaaccaaaagttgtgttgaaaactcaacccgcgacataaaaaggaggtaaaattgaaaaaaatcatcatttgttttccggatgtcagataaacaattgtatattccaccagttgcggtttatgtttatttttgaaaaaagggatttgaaacttcaaaattggccgatttaa

SEQ ID NO: 75188 - DNA, 2210 bp, Heterodera glycines
  Genomic contig location: Contig_ID=SeqID_11702; Location=280..2489; Strand=-
  SCN-specific regions: Sequence locations=1-36,58-882,905-1060,1086 -1448,1472-1480,1512-2210
  Gene Ontology: Mol. function=endopeptidase activity; Cellular component=proteasome core complex (sensu Eukarya); Biological process=proteolysis and peptidolysis
aattcaggacattttgaggtctctgaccacgaatatggcgtctgttttgtcctatttcggcttgaatataacataaaataaatctaacgctctaaaaatatggcgctttatttaaatcggccaattttgaagtttcaaatcccttttttcaaaaataaacataaaccgcaactggtggaatatacaattgtttatctgacatccggaaaacaaatgatgatttttttcaattttacctcctttttatgtcgcgggttgagttttcaacacaacttttggttccaaattgagttcgggttcaagagttttgccgaaaagtgatgccattttcctgttcaatgacttcgatactcctgaaaacagcatatttttaacccaacaaattctttcatttttgcagcaaaagattgcgttgtgttcgccaccgaaaacaaacactccgtcctcacacagcccgtcagcaaaatctccaagttgtccgaccatattgcatgcgtgtacagtgggatgggcccggatgcacagtgcgttttggtttttttttaattctaaaagccaatttggatccggatttatcattaatccgtccagcctgtttattttcttctcaattatttagagggggtaaacgggaggaattatctggggttttttaaaatttgataattgccaagaaaagcaaaaaatgttctcaagggcgcatattttggcaccgctagcctataatttacatcaattttttcagaaattgaaaccaaaaaaaaaaggaaaaatttccatggcctggttgatgacagttttttgttaatgggtctgtcattttttcgtcaggggttcgattttcaaaaaataaataaaaagtatagaaatttttttgggtgtttgaatttaaaacaattctacacaagagcataaaaaaagaatcattaattgttataattaatccatttcttgcacctcgacagacttctcgtgaagaaagcgcggaaaattgcgatggattaccaagtgctgtacggctatgaaattcccgtgcctcaactcgtttcccgggtggctgcggtcatgcaggaatacacacagtcggggtaaagttctgtttttatgggggctgctcgtttaccccaccccctcgtatcatttttccccgaatttaaaaaaaaataaaacagaaatttttcagaaaaactaacctacaatttgaaaatatttctatttgtaaaaaacttaaaaaaaggaatttaaatttttttagtggtgttcgtccgtttggcgtttcattgctcattggcggatgggacagtgaaaagggggcgcttctttttcaagccgatccggcggtaatttttcaaaagaaactttctgtttgtatcccccgttaaaaaattacatgttaagtgtcttttctataataaataaatgcccaaaatgaaaaaaaaattaccccgaaattcctaggcatttattttctttcccatttttcatgaaaatttaaaattttgcaatattttccccttcattccacagggttcctattttgggtggaaaagcacggcgatcggcaaaaacgaccaattggccaagaaattgttggagaagcggtacaatgaagacattgagaaggtggacgcgatacacatggctctgcttgcaatgcgcgagacttacgagtgagtgtaacttgacggtataagtaaatgcgccgcagatcttggcccggatgaccaaaaattcctgatttcttgtacccctgactcaaaaagtacagaaccatagcttgtttagtgtaccatttggtacggaatttcgccatttttatggactcggaaaccaccatttgggagtcacggaattacaccatttttgttggagtctctaattcgccattttttgggggcccatcttttccaaactgtctaaaatctcttataattatcacaaaaaaacgattaaaaactcggtccatttttatgccgcctcctcaaaacggtaagccaaaatcctgttaccttcatcattccacctggcttttctttttcagaattatgcgaaaaattccaggaacttttgctttcaaattcggtttactacgaattcccattatttgtagcgttgccatgactgaggacaatgttgagttggtcgtgtgcacaaaggacggctttgaacggatgaccaaagaagcgctccgtgagcagatccaagccctc

SEQ ID NO: 75189 - DNA, 806 bp, Heterodera glycines
  Genomic contig location: Contig_ID=SeqID_11703; Location=643..1448; Strand=+
  SCN-specific regions: Sequence locations=1-278,301-332,354-806
atgtcaaagattaaaaaaccccaagcgatcctggaaatggcctgtgtttgtgaaaacccatcaatgcccaaagcgaaaagcaaaaaaaaaacaaaagaaaaattgaatcatcaaaatttaaatttagccctgaaagacaaaatgccaaaaatattcagctgctttttttcaaaccaaagaaaatctaaagcccagaattttggaaaactcgggatcgcgattcgagattggaatcacagttttgctggcattcgaatcctgaactcaatatccaaatccgattttgtattctgttttgtatttgatgaaaaattttgcgaaaattttctgctatttgaagataaacagaatttccacactgaaattgttccgaaaaaggatgcacaaacgaaaaattggtacgacgagggccgaaattgaaattgaagattgcaatgtgcccattcccgaacttgttcaaagtcatctgaaacttattcgacaaatacgcgagaatgtggtcgcccccgtggacacaattggctgccatgcgttggccgacaaatgcgcagacccaaaaacgtatcgtttccagattttggtggcacttatgctctccagtcaaaccaaagaccaagtgacggcagaggcgatggaggcaagtaaagtgccagctaataaatcgtataaaaatgaaaataaagacatttttgacaaaaaatttacacatttttcagttttttcctggaaaaattcggtgccaaaaaggatttttggtttcaaatccaaaggagatatgttgccaacaattcttgacattttcatga

SEQ ID NO: 75190 - DNA, 136 bp, Heterodera glycines
  Genomic contig location: Contig_ID=SeqID_11703; Location=125..260; Strand=-
  SCN-specific regions: Sequence locations=1-136
atggctaaattagctgcttttttcaaacagcatattaattttttccctctctcccacagtccctcggggaagttgatgcaaattgagtatgcgttgaatgccgtcaagggcagtgcgccatctgttggcacccgag

SEQ ID NO: 75191 - DNA, 71 bp, Heterodera glycines
  Genomic contig location: Contig_ID=SeqID_11704; Location=191..261; Strand=-
  SCN-specific regions: Sequence locations=1-71
atgaacaaaacttttatttcattacattctattttcctacagtatattttacccttacattataaattaca

SEQ ID NO: 75192 - DNA, 2599 bp, Heterodera glycines
  Genomic contig location: Contig_ID=SeqID_11704; Location=1057..3655; Strand=+
  SCN-specific regions: Sequence locations=1-227,250-330,421-506,547 -602,652-783,861-912,936-1017,1058-1136,1166-1178,1200-1437,1477 -1787,1830-1981,2018-2083,2105-2162,2184-2327,2358-2368,2404-2599
gttagtacaaatccatcaggcaaaccaatcagttttgaggaggcaaacaaagagtgccaacaacataatccaaatgccaaacttgcatcaattcacagtccgatggaagaagattttgtggccggtgagtggtcaatttttgctgattttttcccattttatgtgccccaattagcagaaattgtttacaaatagcgccaatttcggattaaattttttgaaatgccaaaaattaataaaatttaaaatccggaaaattcataaaaaatttttaaaagcaataaatgaagaagtcaaataaaagccgaaaaatcaaaacaaaattaaagcaaaaaaaaaaaattataaaaatttatctgtgtttttttatgtttttattttaaacttactgtacaataataattcataaaaattttttttgacttgttgaacacttacaaaatcgtaagtgatacagtacattttttgaaaacgagatacggtagtaaggccatctgaattattgcaattttttttgaatatttttaatttattttaaataaaattcacagtttttatgtaatgatatactcatagaaagagtgaattagggaggttttttgtaatttattttaataatttaaaattaattagcataattaaaaattaattgctttttagcttttaccaaaaatcgtcctttccgtagccaaaaacaaggacaatcattgtattggctggcacaaatcaaaagtgccgtggaacacgtaagcaaaacaatactgtagtcattcattatcatacaataattacaataattaatataataaaaatgaaaaagaaataattttaatattttcaaatttaaaatattaattataccaaaattaaatcttctttttttatttgtgaaaatttttttgtcaaaaaaccccacaaccgaacgaaacaatacagtcattcattatcatacaataattacaatttaatataataatgaaaaggaaaattgaacaaaaaatgatttaaaagaggtcaattaatgattttaacatttaaatatattaaaactctttaatttgcacattttcgatatttaaaattatatcactcaaattttaaagatttttttgtaacagttttgtcaaaaaaatgccataattaatttttttaatattttttatttctgaaataagggcaaaacttcaaaaatgaaatgctataatgtttgtaagttcttttctagaatttgcatttcttcttaaaaatatgaatttaaaaaaaaattgctacagttatgaatacagtatgttttacattacagccaaacaacgatatggatgggaactacgataatgagggtggcagcaacagcaacggaccttttgtatggtctgacggtactaatgtcggctacggtaatcccactgacaagaagtcgggcaaaaactttccatggtacacaaaaccaagcacaaaatatttggaaaaacatccgggtgtggtgatgtacggtaaaaaaaaggatggggaaaacaatccatggatggacgagaaacataccggcacgtggtcggccatctcaacacagagcgccacgcatggcgaatcggtgccagatgtgcatggctatgtgtgcaaaatgccgaccatgaaagcgacgaatacggtagggaatgcgaaaaaaaacgaaaatggacggtaattgtttacgatagttgttgcaattagtcatcatctgttttgtagctaagtattgtggtaaattttgtaagaattaaaaaaaattagggaaatttttgggtttgtatttaaaattatgaaaattttccaacaaatttaataaaaattttctcccattgaactcattggcgcttatctttgctattgtgccattaattcatttttacattgtttattgttcaaattttgccaaaaccattcaaatttggttatttttagtccaaatctgtaacaaaaaggcaaatttctttggagacacaaaaaatactttttattataaaataagaaaaaatttctgtatgaaaaataaaattagcaacaaaaaacttaatttaagaatattagcggagttcgatttgttcatttcttcatcaagaatgttaaaattgataagaagaggcaaaaacataatattgatatatttttgattgcataaattataaaataacaccagtaaaacgtctgtattttgacccaaaaaaactgattttttttttggcatttattttccggtttttgaaaaatttttttgataaaaaccctggattaggcgggagaaaatgtcacaaaaaacaacatttagaaagaaatcatttttgtattcgaagaaaatattcacaaaaacattaatattatgttgtttttgtttaaattttaatttaaacaaaaattctaattttagcaccatttgaacccccgggcgccacccaatgccgacgaacagcaacaattctcaacaaaaatggcacaaaatttcaattcgcccaaccccacggaaaacattgatgaaaaggatgaagagccacacttcagcagaaacaacggaaaccaatatggtcttgggtcggatgatgagcacagaagaagatggccataa

SEQ ID NO: 75193 - DNA, 806 bp, Heterodera glycines
  Genomic contig location: Contig_ID=SeqID_11704; Location=745..1550; Strand=-
  SCN-specific regions: Sequence locations=1-74,165-245,268-662,686-806
atggccttactaccgtatctcgttttcaaaaaatgtactgtatcacttacgattttgtaagtgttcaacaagtcaaaaaaaatttttatgaattattattgtacagtaagtttaaaataaaaacataaaaaaacacagataaatttttataattttttttttttgctttaattttgttttgatttttcggcttttatttgacttcttcatttattgcttttaaaaattttttatgaattttccggattttaaattttattaatttttggcatttcaaaaaatttaatccgaaattggcgctatttgtaaacaatttctgctaattggggcacataaaatgggaaaaaatcagcaaaaattgaccactcaccggccacaaaatcttcttccatcggactgtgaattgatgcaagtttggcatttggattatgttgttggcactctttgtttgcctcctcaaaactgattggtttgcctgatggatttgtactaaccttaaaatgggtggaggggggcttaaattggaaaatttcttaaattttaaataaactaaatttcggcttgtgtaaaaattttagtgaatttttaactttttagtatttgccatgggattaattaaaagtagacggagggaaggggtgaagtgaaaaatagaaaattccaaattttaaataaattaaaatttccaaattgtcggaagaattttaatacatatttttaggtttttgaattttcacttttctgaaatggaataatttacaggaaacgcggaagaaaattggaaaatttcttaaaatttaaataaa

SEQ ID NO: 75194 - DNA, 483 bp, Heterodera glycines
  Genomic contig location: Contig_ID=SeqID_11705; Location=1496..1978; Strand=-
  SCN-specific regions: Sequence locations=1-294,328-384,427-483
atgggggtaagagtcaaaaattaatgggggatttaaagaaaaatgaatcatttttcctctatgtatattaaatattattgggtttagttaaaggagagaaaattataggttttattgtttttttggagtttatttatttatgcaaaagagaaaaaattccacaaaagggagtaatccacttactctgcggacatgtcatagattaagtcgtcctcgagtaatatggatcaacaattaaacaaaattaaggaatcacaacaaaattaaataaaagaatgaggtcaatcgatcaataaaaccaaatcacatataaaattataaatagctttaattaattaatcaaaagagacaattcacttttcaggtcatttattcgttaaggagtttaattttagttttaaattgatttaaagaatttattttaatgatttctttatcaagttgattccacaattttgtagccctccccgcaaagggaataaa

SEQ ID NO: 75195 - DNA, 3867 bp, Heterodera glycines
  Genomic contig location: Contig_ID=SeqID_11706; Location=85..3951; Strand=+
  SCN-specific regions: Sequence locations=1-57,120-258,297-342,376 -636,666-856,896-960,982-1140,1185-1203,1225-1544,1600-1708,1731 -1980,2003-2058,2080-2136,2160-2250,2272-2351,2373-2453,2475 -2561,2584-2787,2880-2949,...
  SCN-specific regions: Sequence locations=...2971-3129,3153-3368,3408 -3412,3445-3797,3819-3867
  Gene Ontology: Mol. function=cytochrome P450 activity; Cellular component=microsome; Biological process=steroid metabolism
attaaatttccgcaatttttcttctttttcatcgcagttgttgctgcatggattttgtaaatattaaattgcatttaatatatttaatataatatttatttttaatataaaaaaaatttcacagttttcaatatcaccaaaaaaagcattggcaccgtttggacgtgccagggccaaatgtgaacattttctttggcaacacaataaagcaaattcgcaatggcagcattgatgtgcgaagcattaataagaaaatggaaatattattatttatttaaaatttttttttttaatttgcaggttgaccgagaaaatttctcaaaatatggaaattcatttgggtaaaattttgttattaattaatataaaatatttgtttaagttcttttttgtttgatcgtcgcgaattttgcaccaaagacccggatatgatccgacaaattttcatcaaagaatttgcgcacttccaaaatcgctttgtgagttttttcggggattgacttaattaatggatatgtgagtaattgttgtttcgagactcaaactcgatagccaaaaggcgagaaatcagtaataatttgggagagaattttgatttgaattttattttgatagaccataccttttctgaaaaacaattaaatatttaattaattaattaattatccaaaaggatttcatccccgggcgaaaagaggacgcgcccaaatcattgacgcgtaacatgatcaacatgttgcgcgacgatgattggaagcgggtgcgcaaccgcgtaacgcccgcattcaccacgggaaaactgaagaaagtgagtcatccagagcgcaacggcgagtgacacataaatagggaaaacaaatattttgatttttttttaaattaattttcaaaaaaaccataaaaaggtggaaggaatacacaaaacaaagacgaatcattaaagggattttagccagtggctaattagttaattaattattttgccattcgaatttagctcattccaattttatgcgaatgcactgaaagactttgcaaggtatttgaagatgaatatgcgtcgaaaaagaaggaaattctcttaaaagagtgagttaattattttttttattgagtaattaaagtcagcattaacggcgcaaaaaataattaaaaaattaaatgccaaaataaaattaataaatcaaaaagaaaagcataaagaaatgtatttattttttaattgcccagtctttacggccgatttctgttggatgtgatcggtcgctgtggattttcgttggatttgaacacttatgaggaggaaaatgtttttttagaacaatcaagattagtgttcaattttggccgtaaagcgcaacgcatcagaacgatactttgcggtaaatgtcgtgaaaaatggcacaatattaaaaaaaactgctcaaagggattgattatataaaaatcaaaaaatatttttcttctttaattacgaattacaaaaatatattagtaagtcactttatatggtttaatcaaaattttaatttgccccctaatggatttataattaaaattatatttttttaaaacttacagtaaaaaaaattaattaaagcagaacaaattttaaaaacagtacatctgttgaacctataattttgcatcaaatcgcaaataaaagcacaattttttcgtttattttttccactcactatgtttaaagaaaagagaaaatcatttaataaattttaatttccaatttcgcaatgtttaagtgttttttccacttactgctaagctaattgagaattttacgggcaaatcgctcgcttttgccgtggatgaacaatttttcaaggaaatgatgggggaattgtacgagaaacgccgcgccgacccggcggcaaaagaagtgcgattaattaattttaattgcttataaataatgagaaaaagggaacacgtcacaaattagtcaattgtaaaatttaaaccaaattattattgaaatttgtttgccagaagtactcggacatctttcaacttttgatgaatgccgttgaagaagacgacgaagaaattgtggctgaaaacagtgccatctcagcggaggatgcccaaataattcacagcgaaatgcgaagcgacgaaaagcagcaaaagcagggaaagcatttgaccaaaattgaactgttcgcgcagggattcatcattttggtggccgggtaattcttggcaaaattatttttaagagggatttcaggatttttgtgttttgtttaaatggatttgggataagatggaaagtagaagcaaagccaaaattaaaaaagaaaaaattaccgaatcttcaaaaagtgtacgatatgatttatttttgtaataatctgttcaaattattagctgattattgccatcaattttttgttgttatatagccaacgtaaagcaatttgtaactaacctttaaaattcacattttaacacaaaatgccttaaaattcaaatttatatcctagtcaaaaatatgatgacaaatataattttggctttcaaaatttgtaaattatcgtccctattttttaataaatataaaaacaattacaattgttcaattttgattttgattttgattttatggaaaaataattcacttaaattttcttaaatattcccgatttgacaccaccggcacgacattgaccttcgccacttatatgctggcaattgagtcagaagttcaagaaaaattacgaaaagaagtaaatgaagtgttaggggagaaagtaagtgaaaatggacaaatttaataaattaaagtttaattggcaaattaaaattttattttattattattattattaatttttaaatcatttactttaattatttaaggaagtgattacttacgaacatttgaaacaaatgcattatctttgtgctgttgttcaagaaacactgcgaatgttcccagtggcaccaaagtgaataatttgaaattattaagaaaatgaatcagtttaaaaaattggatttactttttggataaaggataaggatgctgcttaaatcatttcataaaatgcaaaaattgtccaatggctgcattttttcatattttatatgggatttgccattatttttgaaatggcaaaaataatttttgtacatttgcctcccgatttaccggtcggtttccagatctttgtttttttgtgcatgcgttttcctgtattttgttcagaaaaagtctaacagatcaattcgaaaaaacatagctgtaaggttccaatcactaactatattttgagctcccagtcactcactggttttatgcaatttttaaaatatggcaaatcccataatgataaaatggcattttgtttatttattattaatttttataattaagaaaattaaatgagctaattaaaaagcaaaataaaactcattatattaaattaaggaccaaccgcgaatgtaacactgactgcgttattaacggagttccgttccaaaagggcgacttggtcactctaccaatttatgtcattcagcatgatgaagcatattattcaaatccggacgcatttgacccggaaaggcattttaaaaccaaattattacatttcgcttcttttttaaagatttatgccagagcaaaaggcggcacttgacccattggcatttttgacttttggcattggtccccgaaattgcattggaatgcgttttgccgaatttcagatgtatgtgacattggcactgcttgtgcgacgcttccgcttctgtgccagctcaaacactccggtaaaacccaaaataaattcaaattagaaaaataagtttacgaatccgggcatcataggaaggaaattcgca

SEQ ID NO: 75196 - DNA, 543 bp, Heterodera glycines
  Genomic contig location: Contig_ID=SeqID_11707; Location=147..689; Strand=+
  SCN-specific regions: Sequence locations=1-212,243-277,309-426,463 -490,512-543
atgtccgactgtggtcgcgactccgtggtgatggtctccgaggagttctacgacaaacgcgtgctgatccgatccgggtcaccggttcggcactcaactataatggaagagatggaaagcagtgacgaaggtgcgaagaaaacggaaaactggcgggtgacgaagaatgataatttgctaactccaatttgaatatccacgaacggcttaatgagagaggaagagagagagagagagagagactaattgccaaaatcaaaaagctttaattgctgtgattattttttaaaaagttatattttttataagcaaaaaaaaaacagaaaaattcgcccatttattattggatttcgcagatccttccaacgtttcccctgctcctttatttgtattgccgttgtgcttctttctcattttgtgttgtgcatttttaattttgtgtataaatattaatttttttaagccgcacaattcgcacttttagcactgctttaaaataataatttaaaatcagaacggaatttaattgataaaagcattata

SEQ ID NO: 75197 - DNA, 970 bp, Heterodera glycines
  Genomic contig location: Contig_ID=SeqID_11708; Location=302..1271; Strand=+
  SCN-specific regions: Sequence locations=1-115,151-186,230-360,382 -407,494-807,899-970
atgaaatttcatcaggcgatggtaaattcgaacatgtggtgaacagggcaaaacactatctgatcattcacaacgcacagccggaagactcaggtcattcctttgaaatgaattgaaatattattttattatttcttttttaataaaaatctaaggaaattaggggtccgcggagaatttaaatgcaaaaataattaattaataaaaataatgttcatttattaaatttcaaaagtagaagaaaaatgcattgaaaaattattaattcttggggattaaactatttgtgatgcaagaaaagtcaaagtgcttttccatcaggctcgtaacaagaaaacaatcgaatggggttaatcggtttttgccaaattctgaaaaaatctaaggcaattagggacaagtggaggaaatttatatgaaaaataattaatttgaaaaaaaatatttaattaaattgtaaaacataaagaattaaaaatagaattaaatattacatgtgataaaaatttgcaggcgtttattcggtgcgaattggagacacaatgttcaaagtggcacagatcagcatcggcactgagttgggccagcagaatttgtccggaagccgaattcgacgcatttcgagccaatcgctgaaccaatcgaatgaaagagacgcacgacagaatgccaaacgaaaggaaaaaacactgccaaaatgaaaaacaaagcgaaattaacaacaacagaaaatgtgatggaatgaagcaaaacaaatgaaaattgaatttattatatttacaaatgaaaatgaagttttttcattggttaattattttttaagaaaattattaattattttatcataaatttttgcactgaatattttaaatatatatttaatgtcaaatattttaatctttgtacaaaatcggaaatgccattcgcttcctgccaaattgaaaaacattttgccgaatgttttccaaca

SEQ ID NO: 75198 - DNA, 313 bp, Heterodera glycines
  Genomic contig location: Contig_ID=SeqID_11709; Location=323..635; Strand=+
  SCN-specific regions: Sequence locations=1-105,130-313
atggtgaaggaacaatggcaaaacgatgcggacgcattaattgatttcgaactttttttcagaaaatacggcgtgacaaaaagcgaagaaaaatgtaataattaaattggttaattttaaataatttttgggaattatgaaaattcagtgagtttgctgcaagaagtttcacagcgcgcaattggggcgaaaagtcattgtgatgagcaaatttatttgagggattatggcaccgttgaaaagattgggcactcatttttcagtgttgaccgaagcataattatagaagaaaaaaacataaaggtgtgaataa

SEQ ID NO: 75199 - DNA, 1317 bp, Heterodera glycines
  Genomic contig location: Contig_ID=SeqID_11709; Location=1208..2524; Strand=+
  SCN-specific regions: Sequence locations=1-125,148-480,521-551,573 -709,741-857,879-955,977-1184,1206-1317
atgaatggctaccaaccatctagaaatgaacacaccggagatgaaagtagtaaaaaaacgaggcacaatacaaattattttagatatgtaagtgaccggccaaatttaggttgacaatcgagcaaataattttattttgaatttaaatatcgaacgaattaaatttaagaaacattaaaacgttttttcgtaaaaaatgattattatcactgacgaaatcacatattaccaaatacaaaatgacaaattaaggcatttgttaaagtttcactttttaaatgacagatttataacggaaactccgaacagtttggcttatgtgtcgcaattacggagtttaatacagaaaatatgccaaattacataacggaaaaactgaaaaacgaattcaaaatttacagaaaattgtcaaaagacagcaagcacatgcttaaagtgtttgaaaggtcattgaaaccaaaaagattcttttttaacttcataatttaaataaaaatttgaaaattttgattttttttttgtcaaaattaacgaaatgaatttttagcgagaaaaatggaaaaatatttaaattggtaagcgaagtcgtaaagtacgacttttgggaactttttcaatatggcgcaaaaaatatcaacgaaactcgcaacattttatacaacgaaatgttgaaggcattggaagaatttcataaaagtaaaaaaaataataattaaattaattaatgaattaattaattaggaaatattctatttaccaattaattaaggtggaatgcatttgagcataaatttaaccaaattttatttggtggagaaaaacaatggaaatgcaaaaagttatgataaaaatgatgatgacaatgacaacaatgagatggaaattgaaggcgaaaaatggaaaatgaacacaaaattggccgattttggggcggcaattttattcaatgaaaagccaccaaaaataaatgtaaatggatgagcatttaaaacagggcttctatcgaaaagttttcaaatcagcacacaaagggattaaaaaagtggttcaaatcagttatttatacaatttattcgtaccaaaaaatatcaaaattatttttttttacctcccattaaggatttgaacaattttgaggagtaaattatattgtccaaattttgtgtattaagccaattttgaagaatataaaggattttaatggtcaggtggtgccgataggcgccgtcaaaaatttttttttttgaaatttgactattttttaacagctttttgtctaaaaatgaccaaattttgcgcaaactttaaaatttctaa

SEQ ID NO: 75200 - DNA, 225 bp, Heterodera glycines; identical to SEQ ID NO: 59154
  Genomic contig location: Contig_ID=SeqID_11710; Location=2735..2959; Strand=-
  SCN-specific regions: Sequence locations=1-225

SEQ ID NO: 75201 - DNA, 778 bp, Heterodera glycines
  Genomic contig location: Contig_ID=SeqID_11711; Location=177..954; Strand=-
  SCN-specific regions: Sequence locations=1-567,590-778
atgttggaaatgaattgcaattggtaccgggcaatgtgggcaaattggttcaagaaaagtttaacacggttttgcgaaacaatccgggatttgacagaattttggttggatttagaaaaagttttaaactcatattttttctaggaaattggtatggttttgcgcggcgaacacgttcaaacgcatttgccgccggacgttattgcaatgttcaaataagcgcccattcagtcgtgtgaagtggagcgttccttttcagcatacaaaaatattctggcagacaatcggatgagctttactccggaaaatctcgaaaaatttctgatttgtaacacgcataaaaagaaatgaccatttttactgccctaaaatcgttgataaaaattttttatgcttatttttgtacttgtttgatgttattttggcatttttttttaacatattttggtacatatttgaagatttttgtacatatttcttacatattttggcattttttaatacatatttatgtacatattttgcgatttttcttacatataaatctaagccctaattatttataagaatttctaaacattgaggaatgttttcggcttccgttccttcatgttcagcagcgaaagaaaatagtgacactacttttgaagacgacgaagttcagaccattttctcggaaaaacgtcctagacaaagcattgcagaagcgttgcgagccaaaagtttttttagtcattaatgacaaacgcccgacaaaatcagaggcgaactaaataaa

SEQ ID NO: 75202 - DNA, 91 bp, Heterodera glycines
  Genomic contig location: Contig_ID=SeqID_11714; Location=1893..1983; Strand=-
  SCN-specific regions: Sequence locations=1-91
ctgaaccgatcggcgatttcgacgcgcaggaacacgcttttcatgggcgatttcacaatgtgatcgcaggaagtgcatctcatttcgtcat

SEQ ID NO: 75203 - DNA, 777 bp, Heterodera glycines
  misc_feature (403)..(403): n is a, c, g, or t
  Genomic contig location: Contig_ID=SeqID_11716; Location=1587..2363; Strand=-
  SCN-specific regions: Sequence locations=1-777
atgaatacaattagcagcagagacaatcttttgcaatttgcttcaccgtctttaaacatgctgtcaattttgatgtactccatgcttttgtttgctgcccttgttctgttgataagtccagccacagttgtggccaacgaagatgtggttgggttggccatgcgcggcactcagcaattctttagacgaaatgccaaatggattaatttgccatcgggcggcggatcattggtaaattttatgctatatttttcatcatatcgccaacagtaaatcaatgtgttttgaatgaatcgtaataccgtacattctttaattatcccccaatctccaattatcacccaatctaatgaggagtttgaaaataatccctttatcttaatcccccagtctccaattaccncccccccccctttctgaggaggttgaaaaataattccccatgggggataaaaagagcatatacggtataccatgaatctgtttttattaaaaaaatagattcaaatgtcttataggttagtggccgtggaaattttcggcccggcttccattctttgcatcgatcacgtactcagctggcggaacctctgtttatcacttttaaagtgagtaccatatatggcaatatagtaatttaaaaaaaaatcaaaacattcagagatctcccacaaatctcgcttcaatgatggttcgtttgcagaaaaacccgagacacaatgatggcacaaactgagaatttaagtgatctggataactcgaaaaatgtggaataaa

SEQ ID NO: 75204 - DNA, 1906 bp, Heterodera glycines
  Genomic contig location: Contig_ID=SeqID_11718; Location=26..1931; Strand=-
  SCN-specific regions: Sequence locations=1-179,201-215,262-286,308 -435,474-703,727-1414,1436-1465,1487-1520,1542-1571,1593-1860,1882 -1906
gctttacgacgtgtcatcggcggtcgacagtccgttgattcaatttgatttcaatgcgttgttgccagaccgaacgcctgacgacagtgaggcgagtggagacgaatttggacgaggacgtgcccattccacgcttggtttcatcactcaactgggtacatttctgatcaaataatttgccatattcccagatttctctcaattagagccccctgaaatttttttttaattttcaaaaaaaatttcatgaaaattttttttgtgatttttagtaaatttttacctcaaattaattaattcatttttcagtttcttttgactttggaccccctcaatcggtggatggcaatcggacagtgctcggctctcttctcgcgttggattcgaatggccaactttacgccacacttttcccctttgatgggattgggttggaaatttatttttttaaattaaaaaatttttaaatttaaggccctgtgcacctccaaagggcccactgtctttgtttggatttccggcttcgtctcagcaccgtttgctctgttctgcgctcgatttgctgcacattcgtcatccgttcggtgttcaacacttttcgttgtgggctatggcatcggaggacggactgttgacccatttcatacttcccatggttagaagttggcatttttcggtttcggcacccattttttagcgattttttcaagattttatatgaattattaatttaaaaaggaaattcaaattgtaagattttccaacatcattaaaattttgttcagctgtcatccttcgacactttgtccattggatggacgaagtgctgtaaatgccaaatattttgtcgcctgccatttgaactttttgcgattgattgtgtggaccattggcaaaaacaatttgtcgtcaatacgccgcgtgattcaaaaatcaacaacaatcgatgctgaaggccatcgagccgactgcaaaaaaatgggcacaatttttaaatttcgatgaaaaaaaattttttgaaaacttgcttagccttaggcttaaatttaggctttttgaaattttttattgtaagagttgcttgtgtactacgagttgccattaacacaaaaaaatcgctgttaatttttgaatttttttttcttggaaattttctaagtttctataaagaaaatttcggcggcgaacttttggtggtgtaacccattaattttaattgcaatattcgtttaaaaaaacattttcttttttttacagaattttgcgaccattgcgcatatttggtggttggtcaacgggacgtgttccgagtggagttgactgctttggcggaccatttgtggcatcagtgcacaatgaaatcaaatgccaacccaacaaaagcaatggacgaagtgaacaggagcagcagcaatgtgcaccaactgttgatgtttgcggacagtggagaagtgtgttttgcatgttaatttattggttataaatgttttacaaataattagtgatcggaaaatgggagattttccgggaaagggaaattttttatcggtttttttcaaatttgaccggctatggatgggaggtggaaattccccggggtcttccaatggtaattttttcacattcaaaacttttacttggcgttgtcaaaagactgaaacacaccaccaccagagaaaaatttaaaaatttacgcgaatttttttgtaaaatcttcctttctttagagcccttcaatcgggtcggttgtgtgcgttcaggcgccaattggaacggatgttgacgaagacgacgacggcggcacggatgagaatcggcaacaaagacgagatttattgattgctgcagaatgctcatttagcatcaaaatgggaagaaaaagcgctttcttggccaacgtggccag

SEQ ID NO: 75205 - DNA, 692 bp, Heterodera glycines
  Genomic contig location: Contig_ID=SeqID_11718; Location=1262..1953; Strand=+
  SCN-specific regions: Sequence locations=1-197,236-363,385-409,456 -470,492-692
atgccaacttctaaccatgggaagtatgaaatgggtcaacagtccgtcctccgatgccatagcccacaacgaaaagtgttgaacaccgaacggatgacgaatgtgcagcaaatcgagcgcagaacagagcaaacggtgctgagacgaagccggaaatccaaacaaagacagtgggccctttggaggtgcacagggccttaaatttaaaaattttttaatttaaaaaaataaatttccaacccaatcccatcaaaggggaaaagtgtggcgtaaagttggccattcgaatccaacgcgagaagagagccgagcactgtccgattgccatccaccgattgagggggtccaaagtcaaaagaaactgaaaaatgaattaattaatttgaggtaaaaatttactaaaaatcacaaaaaaaattttcatgaaattttttttgaaaattaaaaaaaaatttcagggggctctaattgagagaaatctgggaatatggcaaattatttgatcagaaatgtacccagttgagtgatgaaaccaagcgtggaatgggcacgtcctcgtccaaattcgtctccactcgcctcactgtcgtcaggcgttcggtctggcaacaacgcattgaaatcaaattgaatcaacggactgtcgaccgccgatgacacgtcgtaaagcctttaagacggaggatcgttta

SEQ ID NO: 75206 - DNA, 264 bp, Heterodera glycines
  Genomic contig location: Contig_ID=SeqID_11719; Location=534..797; Strand=-
  SCN-specific regions: Sequence locations=1-118,141-264
atggatttcttgcgcctttttccatcttcgtcatcttcaactttgtcggcaacaaatgaacagtcacaaattgcgccatcacaatcgttgctcttcagcgcttacagaaatttgggtcttctgtgttattcaaatggtgaaccgaacaaattgcacttggtcattagcgcatctgctggtccaccatcaacagcaaaaacattggaaaaatcatcgaattcatcgcaacccgtgaaaacttgtgtactcttcaaacgaataaca

SEQ ID NO: 75207 - DNA, 783 bp, Heterodera glycines
  Genomic contig location: Contig_ID=SeqID_11720; Location=143..925; Strand=+
  SCN-specific regions: Sequence locations=1-124,146-498,559-783
atgattgatgctatttgccaaaaaattgacactaaaacggcaccgatcagtcgggaggaatgtgcaaaatttgacaacaatctgttttcttccgctattcatatggttcttcaattgacaggagaggaagtcatgtgcaaactgattgctggaccttggttaattttcttttattcgattcggcttgattattgatatgaatttttttactagaactattcccatattaataatagttttttttctcaattgattccaaccttaaaacgtggaaaatttggttgtctcatcaaatagtatcttataaatttttattgaaggcaccaattaacaaacttatagaatcgaagggaaacaaagtttattcatatccattgtatattgattaatactttaaatatcttgtttagcaattcaacgaattcctcagcatcagccgggccagtgaaatgcgacttttgtctgctgttacacaaaaagtcggaaaacgtaaacccgatttatttttataaaaatcaaaaatagcaaattttaattaatttttcataaatattaaaacttttatcagataatcaacaatttcatcacactttttgaaagcttcaatatgatgtgcgaccgtttaagttctggagttgatgtgtgcaaaaaatatgttaaagccatgatgaatggcatatcgaacattgttggtattcacctcgaacagacccacgctcaatttttctgtaagaatattttcaaatgcacgtaatatcttcttgtacaattgaccatatttta

SEQ ID NO: 75208 - DNA, 1053 bp, Heterodera glycines
  Genomic contig location: Contig_ID=SeqID_1667; Location=1945..2997; Strand=+
  SCN-specific regions: Sequence locations=1-369,391-494,516-666,705 -890,925-1053
atgtctctgctgaatggaaagaatgccactggccattgtcaatctgacggcggtaattttggtgtttacaacacattttggaatcgttttcagattcatcgatcgctgtgaagcggggcgccgaagaattcgacttcggtgggagcgaagccgacggggcaattggccaagggtggtcaattgaattgagcatattaaattatttatgcaattttccagtggaaacgcaccgccggcagccaaatttcaaagggttcagcagttctcgtgctatgccgtttatagcagatcggcccagcccaaatcgaacgccattcgagggcaaattcagggtcagaaattataactacaatttattatacgtatttttctcaattcagattttaaacatgaattgcattacgttttgacgaccattttcgatgaaaaggctgctgaaaacttgaaaagtctcaggtaaaagggtcttttgttcctggtatgtaatgcctttttccagcttggtccaactcatcaaaaaggctattattccccaattccgcaactttttacgcacaaaaagtgtccaacttgaaaaactctttggcgtcttaaacgaactgtcctcgaactcgtcggtactcttttttcgataatgttccctttttattgcatttgattgttaggtcttttctctgtcctcctcctgccttttgtatttgttggctcgcgaccaaaagagtattccgccctctgaagtaacttcggcttctacttttgccctcttggtgcttttccctgctgttctctctctttcagaattgttttcgactcatttctgaacttctccggcaagactctcagcgtgccaaaatggacgaggaacacaaaaagcacacggaaacggtgccataatcattagggggaaaatgtgtacggggaaggaaatggaaaacatttttttgtgccgtcatttcagtgttttttcactaaattggcatttgtttttgtgttaagatttggctcataatgaaggattggcacgtcaattgccaaacactctcctctaagcaa

SEQ ID NO: 75209 - DNA, 1578 bp, Heterodera glycines
  Genomic contig location: Contig_ID=SeqID_1667; Location=136..1713; Strand=+
  SCN-specific regions: Sequence locations=1-169,191-425,464-1080,1102 -1178,1200-1416,1439-1578
  Gene Ontology: Mol. function=chloride channel activity; Cellular component=integral to membrane; Biological process=transport
ccaatcggtgtaaatccgaatgtgaatgaagtcaccaaggtactactctttcttgttccaacttttcctttccttggactctcttttcagctttggtgtcccaaaggcacttacagtgccgttgccaatttgttcttccaaaacccggaagagagtgtgaagagtctgttccattctccgtcctcctctttccgtccttttactcttttcgttttcgctgtcgaatatttcgtccttactttgtggacctacggactttcagttcccagtggagtgcgtttttgccgtcctttccatgccaattgttgttcattgtcccttaggtgttcattccgtcattgctcaccggcgccgcttggggtcgtctgtttggcatttgtgttcaaagtctttttccacaattggtttgtgcttttttgtgattgttttacgaaaataatttattttaattagggtcaaattgaccccgggaagtacgctttggttggtgcggctgcgcaactcggcggaattgttcggtaatttattcacgaccgactagtacatttgattcgaccttttattccgtcgttccctctttttacaggatgaccatttctttaaccgccatcattgtcgaagcgactaaaaacataaccttcggtcttccgattatgctcgttctgatgatcgccaaatgggtcggcgattggttcaccggagtcagtgtttctgttttccaatttggttggtttgtcaggtttttgctttaggggttgtatgacgaacacatcgatttggccgaagtgccccttctcggatgggaccctccaaaactttctcggaacattttggccaagaaagtgatgcgacgggatgtcgttgcactggagagagtggaaaatgttggccgaattgtggaaattctgcgctcgacgcgtcaccatgggtttccggtcgtaaatcgaatcgacgcgagcattggcgactcccaattccccaactacggaaatctgttgggcattgtgttcaggtcgcaactcattgtcatactgcagaaaaaggttagacggatgcattgagagataaacgtcaaagactaatcatcatttagcattttacgttggattacgagggaaagtatcccgcaaatggacatactccgataagtctcgaggatttcagtgagttctatccaaggtgggtgtgtttttctttttggcatttgagtaaacaactcccacactttgtttagggttgagtccaaaatatcccaactcggactgactgtggccgatgaacgctcttgggttgatcttaagccgtttatgcatccttcgccctatcgtgtgcccctcgactcttcccttgactccatccatcgtgtttttcggggacttggacttcgctttttgctcgtcgttgatcgggaaaatcgggtttttccttctttttatttactctaattctaagtgaattggattttgttttcagctgagagggatcataacgcgaaaagacattgcgcgcttcaaagaacggcgggtgaaaggtgcttatcttgtgcatgagattcacatctccccttacaacaattga

SEQ ID NO: 75210 - DNA, 690 bp, Heterodera glycines
  Genomic contig location: Contig_ID=SeqID_1670; Location=38..727; Strand=-
  SCN-specific regions: Sequence locations=1-139,172-403,427-486,508 -596,619-690
atggcatcaatttgtgacgaattgcgcaatttgaggggaaagagtggggaaaaggccggtgatttcatgggaaaggaatggaaaagagattgccaatttaaaggtattttaatcaaaattattggattaacatacaaaatggtgaatgaggaggaggagggcaaaaaagggagtataaaaggcacggatgcaaaacaaaacttacgcgcccaataaccacgcccccagttaaaatattcttggtattgtacgagagctctttttgttttctaaaaaaatctatggccaaaatggccagaaaaaaatcatttttttgagtgttttgatcttgactttttttacagtgccccaaaaaagtcttggcccaagctgatcaaattttcaaaaattaaaatttcgactgaaaattttaatttattattttttgtttgtgtgtttttatttactccaatatatgtgcttttcatgcaccacaaaattattttgattcattcattcattctcagggatgagtcgcttgatcacactttacccagaaatacagtgcaaaaaaaaagtcttggcccaaacatgaaaacccatcttgtatttcatctaaaaatctgaaataattcaggcgtttgcttaacttttgatgctgatcaaaaaggccttttacaccaacttgatcagatcactccttcatggtga

SEQ ID NO: 75211 - DNA, 1518 bp, Heterodera glycines
  Genomic contig location: Contig_ID=SeqID_11723; Location=1280..2797; Strand=+
  SCN-specific regions: Sequence locations=1-134,194-583,605-867,889 -889,956-965,990-1473,1498-1518
atggacattgggcactgcccaaactactcgtggctttgtaatgtgtgcagtaagtgaatttttctgttttgcattcaatttcgttcaaacatttcttttaagtctgtgcctaatttatttaatttactatcaaaaaccacaaaacggtcaaatttttctctattttttctgttatcaatttaatcaatgtttttgggctgatattccactaattaattcaatttactaccaaacaacaaaataatggtcaaaattttttttcttctcctctattttttcgtcaaaaaaacattgccgccaaaagttcaattctctatcgaaactaatacagtacaacaatgtgcggtgcggaaaacattgcactaatgggaaaagcgtcgctattaacaatctccattttcactaaaaagcatttcccactcattcatcaattcattcttcatccaaagcacatagtgctctcatctcaatcgtcaaacgctccgcaattcagagccttaagcttaagcaagcaaccgcgcgaaccctatcgcctattccctcatttgtttccaaatttaattgttacatctaattattctaattttatttccccgtttcattttgcttattatttgcctcatatttgaattttttaactcgcgctctcatttcaatcaatagaatagtcgtaagactaagagcaaaccaaaatttttttcttttcaaattgtccaccccaattttaaattgaactatcctttggatagtaagtcctgtcgaagttttactcaatatttttttccatcgaatgataggtcagaaataaataataatcagattttcggcattttatgtcttgtttgaattcgttaagttgagatcgactttatataataagttcatttgatttaatcaattgattttttctaaaattgaattcatttttaaaatatttatcttccatttccttatgttttattagtttatgaaaatattttaaaaaacgctttttaattatgtatacctttaaaaataattatttcgccattataatattattttcagagcatttaaattcactggaggaaaaagttttgtttctaggttattagttataacaattaaatttttagagaatttttttttgaattcgcagtgcttcgccctttttcaaccatccttataggtccatttaactttctatttttccgcattccttctttttttgcacaccattgttgactatatccactttttttatcgttttcctgttctgcataatgccacgaatttcagttggcaatgcaccatcactggcattcgctgtgttgggtccttgcgaggatatttctaaattatatagttttatatctttttaattgataacttatcaaccatcatttgtgttaccctatatcaattcactttgccagtttaaattaatcgaattttaaacattaaaaaaaattttggctttttaatgcccttctcttatttaaatatttattatattttcactcatattcttccagttaa

SEQ ID NO: 75212 - DNA, 637 bp, Heterodera glycines
  Genomic contig location: Contig_ID=SeqID_11725; Location=359..995; Strand=+
  SCN-specific regions: Sequence locations=1-230,253-592,622-637
atggaccggttgaagccgtacgaggacgaaattgtggatggacgaacttgtgccgaaatcattgcgggccgtgaaaacgcgaacggcaccagtcaaagcaggacaaacgccgccggggacggatggtcagttgtgatcaaccaatactgatcagaaattgatcaggatgatgatactttagggatgttcaaaaattactgggtgtgtgggaataggaattagtttgatgataaagaatgaagaaaggatcaatgatcattgatcaggccttatgatataaattttgatcgggcgcgcgaaaaacccaaatgttgacagagggatcaatcaatcaattttaagtgcttcctcttccactccgatcacgtccggctcttcatccgtcattgatgcggtgatcgacgcagtgatcgatgcatcgtcgtcaaattcagcaaatgcccaaggaacgacagtcacgaagctaagcacagcgaagcgtggaagccgtgccaagctgaccattgtgggcaaagaaactggtgctgatcagccgaagaagccgccggcatcgacaacaaagcgatcggagccaaaagaggaggtgggaaatggaaaagaaaagagagaaagattggcatcgagaattggaatctga

SEQ ID NO: 75213 - DNA, 754 bp, Heterodera glycines
  Genomic contig location: Contig_ID=SeqID_11727; Location=775..1528; Strand=-
  SCN-specific regions: Sequence locations=1-145,168-219,258-274,312 -447,481-650,686-754
atggaaaagtgattcttcattttccatttcgcctgctcgggggtgagagaaactcacgccattcccccacaattgctaatgtcccctcccttgggcgggggggggggggggaattaatttttgaatgcttcgcttatgttatgaataattaattaattgatcagtgttctagttcaatttagaagaattaatctgacgaattagtaaggaacagcttccaaataaaaatatatgcaataaataaaattaattaatttccaccactatccttcggaaatttaattttaaaaattcatttaaatattattattccagggttattaaatgccaatcagatcgcatgaatatggcattcattttcataattccaaaacccgaaaaacgaacacaaaaactgaaagctcaaattgttgaatgacatttttccccattatttcacctaaattattccaacaatcatttttaatacttagaacaatttccaattgatcactttctctgatcaccttaagaaatttgtcggaaaattccgatcactcactttggtaagcctccaaatttggcacaaatggttgcccaatgcgcggattccaccgcttcttcgtcacccatggaaaattcaccttccttggacgtaatcattgacgatgaccacaaccaccatcaccaccagcagcagcaaccatttgttttcggtcagtttttttttactaattttaaattggcaaaatatcattttgccaaaaaaaataaa

SEQ ID NO: 75214 - DNA, 63 bp, Heterodera glycines
  Genomic contig location: Contig_ID=SeqID_11728; Location=459..521; Strand=+
  SCN-specific regions: Sequence locations=1-63
atgatgatgattgattgggttgtcacctcaacaacaacaaacagcaggtcggagttggaaaat

SEQ ID NO: 75215 - DNA, 1489 bp, Heterodera glycines
  misc_feature (965)..(965): n is a, c, g, or t
  Genomic contig location: Contig_ID=SeqID_11730; Location=97..1585; Strand=-
  SCN-specific regions: Sequence locations=1-272,301-407,433-437,459 -539,561-654,702-975,1000-1346,1368-1489
atggagcagtgcagaatggacgtggatttcagcttgatggaccggctcagccctttgctctgtgtacagccctttttcaccaccaaaaatgccgtccaaaacaaattgtcgcccccgccggcgctgtttctgtcctcctccgagtcggtgtttgtcggcggactgaaggacgactttgaaatgggtggaggcggttgctgcggtcagggcggtgagcagccaatgccaaaaacattccatgccaagtgctacttcaacaaattgttgctgaacttgaggtgtgatttggggagagccaatgtgtttgggttgtgtggggaaaatgtataataattattagaagttttagcgtaattctgaatttattgaaatttattttcctgcgatcggcaccatcagtacccttaaattttcaaaattttgacccaaaaattatcaatttcaatgaaaaagggtgtctgggttattttgtaaaaactgccaacatgggcggtttgaaaactgccaattttacgagaaaaactgttcaaaaacttattaaatggaacctaatttaataattttcgtatcatacaatagctatttgatcattgttagcatgaaaaatgccagaaaatttcattcagttttcagaatatggcaatatttttgaacattttaaattacaattttttttttttgtaaattcaataaaaaaatttccggaatttttcatgctaatagattaatttttcagaattccaattgccaacccatcttcctccgtctcatcccctgccgatggcactgccgattatcggaagcgatgccttcatccggaatatttgcacctcgcattggacagtgccaacttggaattgcccaaattttcgctggccgatttgtccctgttttggacgctcagtttggagtgcaaaacggcaaaaggtttttataataattggcacagcaaatttattaaattntcccaacggcatttaaaaattaaattaatttttaggcacttttgtcggcgatccgacggtgctccaatgccccagggaagcgatgacatttttcttcgcggacacttcaaatgcggaaaaaacatttggaaacaaagggatgaagtgagtttttttaaacgagttggaatgaatgaatatggttgaaattattgtatatttactgctaatttttgtgggtttttttttgtctacgtgtattttgttgattgaaataggtaaatttaaaaagtctaatcaaatttttcaaaacataaaaattttttatgtttttacatcaaaaattcccaggaaatttagaaaactaaaaaatttcagtttttttttaaatttctttgaaagtgaaacaaactgctctccaaatcgtttgccttttaaaaaaaattgtgccaatagtcagtggattttttggtggaaacctcgaaaatcaatgtgttagtgtgtccttttattcccggaaaatttttcagaaatctgaaaataaa

SEQ ID NO: 75216 - DNA, 1843 bp, Heterodera glycines
  Genomic contig location: Contig_ID=SeqID_11731; Location=97..1939; Strand=-
  SCN-specific regions: Sequence locations=1-158,180-225,249-550,575 -606,628-788,812-1346,1368-1381,1405-1519,1541-1574,1596-1704,1726 -1843
gcacttcaattgcaacgcttgtcgaacgtcgtcccgacattttcgccgtctccgtccgtgcgcccgcgttggtcgccgtcatcactcatgacgacccgttgagtgccgatgccatccttcaacaacaacaaatcaacggtgacgaggagagactgtccttttcgtcctcctcgtcgtcggtgttgtcgcctcatcctcctcatccgtccccattgctcgtcgcttccgttgtccaacaaatgaatgagcgggcgcagaaattctttgccgccgccaaatgcattaaaattggcaaacagcgacggctggaggagcagcgagaacagtttggcgagctgtgcgacggcgactgtttgcggtccgtccgtccatttgcttttttattgttgccatgaaaaatgtggcagaaaaaatttccaaacggcaatagacaaaaacaggccaaaaaatagtattttcggctgtttttccaacaaaaaatgaccaattatgaacatttttttgttaattttcgaaaaaactaatggaactttcccgataggccccattggggaaaattttgtaaaattttaatacaaattgttattttctatttcgtgcccagcattttctttacatactttcttttgagcattattatgtcaaaatttttggacaatttaaatgcatttatttgttccgtgtggaaaatttagcaaattttaacaaaatgaaaaatcaaaaaattttcaagcaaaaatgggcaaattttctgaaaattttgcacattttcttatcatattgcatttaattttccaaaaatttttcccggcggcgcctatcggcatcgccgggccccaagtagaccattattttttgaaaatttgagcccaaaatggaaaattatgatttttcggcgcaaaatccgcgctgaagattttgaaaataacactagtacaaaaaaaaatttttggtccgaagagcaaaaaaaaatgccctccccgaaatttttttctggatacgggcatatgccctatggtctcggtgtgggtaaaataatcaacaattggaacacaattttcatacaaattgccatgggacggacttctccagaatttcctccatttttcttggtttatctttgcttttctaatttaagtcagcatttttcagtttcgtggccaacgatttcttcacatccttcacttttacgaccgatttgcagcgtgtgttgttcgagtcgaagagtcacctgaaagagtgtgacttcatcgagtgcttacagtcggcacaaaacggggtaaaataaaaccggagcaggacataactcagccgccgaaactcagccgagacataattcagccgtgaataaatttttaaaaaattttcaaacctagaaatttttcaagaaaaaattcttagaaaattctacgaaaaaaaaattcaggcgatttttcaaaatttaatgactaattctaagaaatttcaaaaaattttcaaaaaaatcgcggaaaattctttaaaattttttttctcatagaattttctaagaaaaaattttctaagatttttttcttgaaaaatttataggtttgaaaatttttaaaaaatttattcacggctgcattatgtctcggctgagttttgtcctgctcccaaaataaaacacccaaaaataaatttgtattacctaattgaaattggtttataatttaccaagatttatattatttttatgcaattttttcagatgccaccccaatgcattgacattttgaacattgctgcgcccgacgaacgacggacggtgctcaaaaatgacattttgaccttccaaatcaacaattcattcgagaaacaaaat

SEQ ID NO: 75217 - DNA, 178 bp, Heterodera glycines
  Genomic contig location: Contig_ID=SeqID_11733; Location=838..1015; Strand=-
  SCN-specific regions: Sequence locations=1-178
catgcttagttaatattagatcactttacaacaaaattgatgaaatagctttaaatttggtaaataaaaacatagacatttttctgttaactgaaacatggacaaaggaggaaaacccaatcctctttagtccatggataatcgaaaattataactttattttttgtcatagaaaatc

SEQ ID NO: 75218 - DNA, 1592 bp, Heterodera glycines
  Genomic contig location: Contig_ID=SeqID_11734; Location=1314..2905; Strand=-
  SCN-specific regions: Sequence locations=1-150,180-214,237-466,488 -551,573-1061,1083-1207,1230-1318,1340-1389,1411-1592
atgtatttacataaaattagcatccctagccatgacactctctcctattacgaagatttatacccatatgaccctagaaagctggatttttgctggggtcctgattcttgtgtcgaggcgagctgctcatttggtaagaccaataattagcaatataaatgatattttatcatttttcatcattaattatttaatcagttaatttgaacagaaattgctggaaaaagttggacaaaagtgtcaaaaggttgcactttcaacggcactaatctatgcgtttggcttaaacaaaaatgtttgtcattaattcaaatttgtcatgtttggaaagcgtccttcttcccatctttctcctctctcagacaacgcatcaaaaaagtccacctctgactacccatacaccgctcttagtgatcaacttgcggcaatttcccaacaaatggacaacaacagtgtcgaccccatcaccaaacaacttttgaaaatttgtgtcgaacttttacagcaggtccagcaacaacaggccgtcatctccgaacaagaccttcaactccaacatctcaaacaacagaaaatgatggaagaagccattcaagaccatgagcgtcggcgaagcgtcgtcgtaatgggtctccctgaatcgcagaaacaaaagccgtccgagcgagtcgctgaggaccgaactgccatctcaggcgttctcgatgagcttggcatcgagagcccaatcactgtgtacagaatgggttccccagaccaagcaaagacaggtcaaaaccgcccgaggttgatgaaagtaattttcgggtgctccaaacatcagaaacaaaccttggcacagtggaacaaagggcgcgcgcaaatcaatcagaaattggggatgagcaacatccgaattcgcccttcactcagccaagaggaactcaaggcccgacgtgtgctgcaagaagagtgtagcaggaaaagaaaggaagatggcggcgagtgggtggtgtacgcggacaaagtgatgctgaggtcagacattgcggcatttaaaaataacaccaattgacttgctgttttaccaaatcacactcacaaaacatttataaattcgcacttttccggtcttaagcatgttaagcccaataaccccaaaaccaaaataggggaagttaaagcatgcttagttaatattagatcactttacaacaaaattgatgaaatatctttaaatttagtaaataataacatagaaatttgtctgttaactgaaacgtggacaaaggagggaaacccaatcctctttagtccatggataatcgaaaattataactttgttttttgtcatagaaaatctcaaaaattaacacgtgggggtggttgcggtgttttaattaagaaagaaattgagttttttgttaaattttctgaaacaaaatataattgcgaaatcttggtttttcaattacaaaaactaaaatcaattagatttgtgcttgtttatcgaccacccaagacaacatatagacaaaccaaggaactttttaaatttttagaaacattctatagccataattgtgttgggtgattttaattttccgaataaa

SEQ ID NO: 75219 - DNA, 337 bp, Heterodera glycines
  Genomic contig location: Contig_ID=SeqID_11735; Location=834..1170; Strand=+
  SCN-specific regions: Sequence locations=1-337
atgatgagtgccaaattttttacgcatttgattaattcggcatcggtacgacccatctccacctcatgctgcagaaaggagttgcgtgaattgtggaaattggacaaacggaacccttttcaagaaattcccgaggcatgggtcacttctctggatgatgttgagcagaaaaattgtggactcattcaactccatccaggcatggcctcaatttggagcgaaaatggcaccatgataggacattggcaaaaaatttattccaaacacttcttaaatgttcataagcaacacaaacattgcctgatttctgtggatgagaagcgctaaattttctcta

SEQ ID NO: 75220 - DNA, 670 bp, Heterodera glycines
  Genomic contig location: Contig_ID=SeqID_11735; Location=1..670; Strand=+
  SCN-specific regions: Sequence locations=1-86,108-140,163-259,283 -286,311-447,469-498,523-598,620-670
cgttttgccgaagttgagttggaaccgtgctgacaaaaggttggattgttgtttttggaaaacagagaatattcgctccacatccctttgtttaaggttttcgtataatttttgtttcaatcaaaagcttcaactcatagacattttcaacagacaaaacaaagttcgaaaaactcagttttcatacttttacgggttaggaattcaaaattgggcaaaatgggtatggtattcgtgatcagcgacccctaaaacaactgaaaacaaattttcaagttttttggtcaaaaaaattattatttttttttttgcaaaaagagggttcccctttgattttgaaaaaactcaaaaaatgcaactttttcttttctccattggggtattccagggttttttttctacaaattgctgatttcgggctttcccgtgattggctctggaggcgttcatttttaatttacttcttttagcaaagcctccggcggtggctgacattgacgtttgtttgttggttgttttttgccgctcaatgtgatctcctccgacttttggacttcaaaatttttgccccgttttgtgggaaattggattatttacattgttttttctttgttgctttgccagtgactttttttgtttgatgcgcaaacgaccacattattttgcacaa

SEQ ID NO: 75221 - DNA, 158 bp, Heterodera glycines
  Genomic contig location: Contig_ID=SeqID_11736; Location=393..550; Strand=-
  SCN-specific regions: Sequence locations=1-158
cagtccctgtgactgccatcgttttcggcagggatttgctgttggtgctctgcagcattgtgctccgtttcaaaatggtcgatgctccgctgactgtgcggcgcttttttgaccccaccgtttcgcccatgcgaattcagcccacctcgctgagcaaa

SEQ ID NO: 75222 - DNA, 3041 bp, Heterodera glycines
  Genomic contig location: Contig_ID=SeqID_11737; Location=454..3494; Strand=+
  SCN-specific regions: Sequence locations=1-144,181-223,246-435,481 -967,990-1018,1042-1152,1180-1450,1472-1660,1683-1715,1740-2600,2622 -2821,2845-3041
  Gene Ontology: Mol. function=intracellular transporter activity; Cellular component=intracellular; Biological process=Golgi to endosome transport
tgcccgtccaatgcgaattggcaggcggtgatgggctggatattatgaatttggtcgctggattcccactcattttcacggtaaatgaaatttaattcagctgctaatggaagaaccccaaaatatcgacgcagaaattaaaatttttgaaacagtaatttaccataaaatttcaaaaatatagctgattgtgcgatttttcagatttgtttgctttaaatctcagtttcaaaatttttagaaaaaattctgcgtcgagattatgtctcggcgagatttttccgataatttgaacccatttgtttccctacaggtttatatcggggctgtagtatacgagttgcattacatagtgccaagcgttaaaaatccattggaaaccatccgaatgaaaggcaaaacgaacgccaatttggaattggttggacatacacctttataatttaacaataagtataaattgaaataaattttttttaagtgccttggtttgaattggagcaccgaattattacgtacaaatttgatgctttacgcgccgtattggatggtcaacgagactggcaaacaactcgcttattatgtgagacatggcaaacaaaaaatacattcatttagatttaaatttcctcaagttttaattcgagagtttttttatagtaataagctggttagcatttctgataataatcagtctttttccccgtcattcatttgtttcccccttctcttttagagtcttccgtcagtgaaatgtctttgttgttctgattgtttgtcatgtaaagctcaggtcagggacgtttttatgtaatatttggcggggatgaatgatacgaaagaacggagtgtcctatttatgtcaatcgctttgtatttatttataaaacaacggatttcgtgataaaaataagtttaacccggaaacccggttttggccattttaattcaaatcggttcaagaatatttttcttgtcttttgaaagttgctaaaaaaattttgatgccattgtgtagaggaaagaccagacttttaaaaagacctaaagcagcctttttctcatgccaagttttatagaatttttccaatttatccaaaaacgacaatgttttgcgacaacccaattgcctaatttcttttgcttgggcttgtgttggtctttgtctttgtgtgtgtttgcgtgtccttaattatatttaaacaccgacaacattaccctcaacttttttaccattttcagagcaaatccgtccaaatttcgcaccctcccggcaccaatccgatgattctgccgttgaaggaaagtgaatttatgtcggagaaaaaggcaaaggtgaaaatcgtggacgagtccaattggtctgccgaattccctttggacatggccggcagcagtgagcgtgtcacttgcaaaggcatcgccaaaaagaagcgcgcatttgaggcattgaaattaaaaacatttatttgttttactataaatgcctttctccgttcagatgactgtcgatgtccaattgggtcagtccggcctcacaaaagtggtgaccattttgcccttctttttgctccaaaatgacagcaaagttgacatcgaagtgcgcgagccgcacttgacgaaatggattgtggtgccggcggaatcagtcagtgactttttgaagaaagaaaaacctatttcaaccatttgcaggtaattggtttttggccagcggagaaaaagaaacacaaaaaattagtggcacgttatgccaagacgaaagaggaatcggtgcaattcccaatcacagaggcattcgaaggcttttgtcaaatccggaataatgtatatgtcttcgtcattccagtttcatttgtccctacttttagctgatcggcctttacgtgatcgtatctctgctggatgaatcgtccgtcattcacatggagatttttgtgcccggaatggtgccggcgattctgatgaacgacaccaaatacccaattcgctaccgacagacgggccacagacagtggcaaattgtcaagcccaaccaaatggcaccatttgcgtggaccgactcgctgaatggtgctgtttctgtcctttaaatggctttttatttttcatataatcctttagccctttttcagattgtaaattggaatgggagtcgggcgatgctgaaaattcggatgaattgttgcgcaaccgcgacatttcttatctgccagccaacaatgatggttaccattattgtgtgtcctttttggacgggcgccagcgcgttttgctcgtaatcatttttaatatttacgataattccttatttctttttgtttagttcactgctgacaaaaaagtttctttcattgctcaccaagcgtatgaagtgagtggacagaggggcagaaccatttatcttgttttcacattccatcggtttttcaatcattaaaatttcacagatggaacagccggacatcgaattggagctgcacttgcacgggttgggcatctccctggtcaacaacttgaaaagcattgaagtcctttatatggtcattgagattcaatttgcctgtttttaaatatgaaccactatttaggccatttctccaggaaaacagaagaaaagtgacgaaaagtcgcttaaaatggccaccggtttctggtgtcaatatcgtcagaccactcatcagcagacgcttcacgtgaaattgcacaatttccaaatggacaaccaattgccagcgtccaccttcccctcattactcgccatggtaccacagccgaaatatatggttaaaaatggttgtttatttaaaagtttttggcataaatgttacaagttttttatttcagatccaaagccattcctggagtgtgcatttgtgatgagtcaatcggaacatacgaacattgtccaaatcaaactgctggaggcgttggtgcaagaatttgcgattcgcattgaccgaacattgctcaacgaactattggacataataccgaaagggatcattcagacgggatacactgtgaacaaagatgactga

SEQ ID NO: 75223 - DNA, 84 bp, Heterodera glycines
  Genomic contig location: Contig_ID=SeqID_11739; Location=915..998; Strand=-
  SCN-specific regions: Sequence locations=1-50,72-84
gctttcaacatctccaccaaaccgtcgctgcccgttttggagaaccgaagacagaaattggaaaatggacccgattcgagcctc

SEQ ID NO: 75224 - DNA, 2483 bp, Heterodera glycines
  Genomic contig location: Contig_ID=SeqID_11740; Location=888..3370; Strand=+
  SCN-specific regions: Sequence locations=1-1160,1182-1704,1726 -1976,1999-2049,2071-2128,2155-2483
  Gene Ontology: Mol. function=metalloendopeptidase activity; Cellular component=membrane fraction; Biological process=reproduction
aatccaattaaggcgtattcgaatttcactgaacgattgaccaaatctctgaatcttagccaaagtccgtgcgacaatttctatgaatacgcatgcggcaacttcaaagggccgatcagtttcgaccaattgacagtgcaaaacgtaaaaacatttgtgggattggtcgaagatgaacgttacagtaaaaacccaaaggtaattaacccaaagagataaatatttaaattcgctaagttttagttgccactgcccgtcaaacagtcgattcaattctatcaaaaatgcgtcggagcaatgagcgattggagtgccgaagttggcgatgggagccgactgagaaagaaaatgataatgttggagaatctgttggatggagtgccattccccgcggtgtcggccaaaacccaactgaacgtgagcactgattgaagtgattggtccaattaattgagctgatcgcttaagatgatggaacggccatccgtcgacactttgtccatcgctttgggctatttgagcaacgacgaaggcgttaatacgtttgtgtctgttggagtgtccaccaattggcttgagccgcacggagagcatccgtacacgctgcactttgaccaagtactgcttggaaagtgacagcaccgtctgggccaatccgtccttttcacaggctcgccttctgttgcccaccaattattatttaaaagcgtgggaaaatgttcgcgcaatgcttcacgcaaatttggtctcctcgctgaaggcttataccaaatttgcgggtgccaatgtgacaaatgagcaaatcgacgcggacgcgagggaagtgatggacatggagctgaccatcgccacaaatttgctgaaagcaccggacgaaagacgcaaattcgccccccaaagcaacagttatcccaagggggggggaagtggccaatgggcaaaaaagaaacaattctaatgcccgttgaagcgtacacattcgagaaagcggacaaagagatgggcgagtatttggactttggactgttcgccttttgggctttgaaagtgccggagggcgtcgacccggcgcacattgagcctttttacatccacgagcccaaagtgatcaaaagcacaatgcaatttttggacacggcaagcattgatcactttttgtgaattatccattgttccatagatttccccgcgcactttgtacaattatttgtacatccgtttgctgtccgctaacctcaattatttgcccgtgtcccatcgacttggcaaaatcccgggccttctcagtgcccgtgggattggaattcccactctcgacgacggtggcattatcgaaaacccgtggccatatgaccaggatggcatcaattttggtggccccgaggggcgaaatcgcgcaatgtgtgcgtcgattaatgcccaatattttacgtatgcaaacgcacggatatttttggatgcgcagttacccgagaaggaacagcgaacgaagctgagggaaaatttgcggacgatggtggcgggggtggtcgactcgtttagggtaaatggacaaaagacggaaaaaagcaacaaaagaatgaatagagccaaatgatggcctaattaagccaaatgatggttaatcgtttctctagggaatggtggcacagttggattggatgagcagcgaggcaaaaagggcgtctttcctgaaaatggacaatttggtgaccaacttggcatggcccgacttcgtcgaagacgacgccgcactttcggaattttattcgctgttggcattcagagaagaggacacattcacgcaaatggtgaaatagcgagttaagcaatacaaaagttgcgaaatgacttcagaaagacaaactgcgcgacttttggacgaattcgcaggccgaaaggcttttctttgccaacgacaccgaccgattggactttggcattccgtccattgtcaatgcgtggtattcggtacgtttttaaccccctctcctttctccgatcagggctctgtttaagtcttcgcgcaattcgatcactttccccctgggcattctctccaagcccttctacgacccaaactttcccgcctccgtcaattacggcgccctcggcgtcatcgctggccatgagctgtcccatggctttggtttgctctttttttgtccgtccgttttccgatgctcccatcaattacaaaatagcttctgctgatcctttcattccatctttcatgctcatttctcatcagatgacgaaggtatccaatgggatggcacgggaactctccgcggatggatggacgccgcttcggaggcaaatttcgagcagatggcccaatgcgttgtggatgaatatgcccagttcgagcctttgtccggcatgcacatcgacgggacgatgacccaaggcgaaaatattgccgacaatggaggtcatcggtgggtaaaaacgagcaaatttcgcaaaattttcccgtttta

SEQ ID NO: 75225 - DNA, 1542 bp, Heterodera glycines
  Genomic contig location: Contig_ID=SeqID_11741; Location=1404..2945; Strand=+
  SCN-specific regions: Sequence locations=1-1246,1268-1411,1435-1542
atgacagcaacaattcctctgatccaaaatttggatttttacagcaattcagagtgggaaaagcggaacccggatgttttggaaaatcgtaaatttcgatttaaaaatgtgccaatttttattgtattacttactgcagttccttgtacttcaaatacctgcactgattttggtacatccacttcttcgtcatcgacccaccatgaccataatcaacaaatttgttgttcatcatcgtccttacgttgctcttcaacatccagcgggtaggcacttgaattgcaaggaatctcattcaacccatgatattacgataaaagacgacactttgtttttttacagttttggctcattcatcgatgacttggatgacttgccgttaagcccggcaaatagttcatgcactttgttggcctgcgacgacgaatacaaaaataataccgatgctgatgaccatctgaattttgccgacaaagcatcatcatccgctgcaagggatgagacggcttccacaacttcgactgtttcacattcgtacagaatggaaaaattagtgccaatgccatcatcgtcggcaacagcggcgagcagttcaaaacgaagacgaaaaatggtgcacagcaacagtcaacggcagcagaaaaagaaacagaatttgacgaagcaacaaatgtcaaagatcaacaagaaggatacgaaatcttccaagttggactacgagttggagttgaagagacgccaagaggaggaagaagaactaattgccatcaggtattaaaaatggtgtaaattttttgaaaaaaataaatcgttttcaacaaatcaatttttttttcttttttagttccatttctggccccaccaccagcagtcaccagcatcaacaatttgattttacgaaagtcaaaggcaaacgtggacgtaaatccaaggacaattgtaagtcaaaatttcaatttattacctttgaattagacataaaatatgatttttgaattagctcttctcaacgagcacgagctgccttactccgcggaatggttgactgcaatgccctacagtgtgtactccgaactgatgaatgactttcggttgagcgcgcagcaaaaagcactgatcaaaaaaatccggcgaagaggtggaatatgttttttttaaaattttacgcgggaagaggagccgcgggggggggggggtttgcctcccgctggttacggacctgacctgaaaagacacaaatctgattatgcagcacaatttttgtctcgtctaacttgttttgctccaaccaacacaggtcgtaataaacttgctgcacaaaaatgccgcgagagacgggttaaccagaagcaggagtgggagagcgagggatggtccgtcgaagcggacgaggatgaaatattcttcatgaaagaggaggacgatgacgatgaactcggagaaggcattcacacatttgacgacgttagcacacaacaaacggcagcagaagataagcatttacactaccatccaaactattacgcattttgcaacaattaa

SEQ ID NO: 75226 - DNA, 1105 bp, Heterodera glycines
  Genomic contig location: Contig_ID=SeqID_11742; Location=301..1405; Strand=+
  SCN-specific regions: Sequence locations=1-303,325-951,973-1105
atgccctcagcgatttctgtcggtctcggaaggatcgctggcggtttcgtccccgcactttttggcggatcatttggaccggtttccgcttggctaactcgcggttggtacggccaacatgcggtccctttgggaaaaagatttgataggtatgtcctctctgtcgaaaaacattgagcctaccctattcggccttccatatgcctctttgccgggccgcccctctttcacttggtccatccgttcctcctttgtttgacgccgaaacttgccataaaaatgttcaatgtcgctaagccggggaaggccaccatgtccatgctgctcattgtcgcttctttgaacaaaataaaattgtggcaccgccaacttctccccccgcccattccaactcattctcatcagccgaagattcttcgccattggacgacgcttttcccgcttcagacaattcgtcatcatcattatccacgtccatttcattgttttcgtcagtagctttttcaggcctccctcggtctttgtgatgcaacagtttcggattgatggtacggaacagcatgatcagtgcatgggcagccaacgacacatttttgttgtgcgtttttttgtactatacgcaaaaaaaagaaattgtaataaataaagatagaagatttactgggaaaactttaccgccgctaaatcccgaaccatctcttcagtggctgcctcagggcaacccttgtaaatttcacgaattgtattcaggccgacagtgattgcctccggtgtgttgcggtcggaaacaaaattttgtgcaaccactcgaatctgaaagtttttgaaaacccattaaaaaaattaaagtaaaaaataagactaatcttccggtttttagataaaagataaaacccattttagttgacaaattgaatttttttagcctgcaaaattccaaaaaaatatcgttatgttcagaattatattaaattcattcaattcggacaactatgaagagttctaccaaaaagaaaattgggttgtcgctcagttgtcttccctttccggcacccttttcaccaaaatcacacttgaaggaaagatgttaccaattgttcaatga

SEQ ID NO: 75227 - DNA, 1333 bp, Heterodera glycines
  Genomic contig location: Contig_ID=SeqID_1671; Location=78..1410; Strand=-
  SCN-specific regions: Sequence locations=1-428,450-679,713-750,773 -888,942-1283,1306-1309,1331-1333
atgccatccctgatagggaccgccggaccctctgttcctagttttttgaaaaattgcaccgcaaaaaaagtgggtttgaaaagaaaaaaatagtcaatttatgaaccgttaataatttgatttccgatcaactttttaccgtcggatccaatcgaaaaatcttagtcgacccatcagccccttttaatgcatcccgccagcccttaaaaatttatttttcagcattttttgatttttggaaattttttgaatttaattgaaattttttcgaattttccaaaatcccgcaatcccgcacgggatcccgcaaattttaaatgcgggattgcggaatttgcgggattaatcccgcgggatcccgtcccgcaaaaagttttgagttccagtcccgcagcgggatccgcaaatttgaaatttccgggctctagtaataatcataatttggcataatgtttttgaataatacaattttgaaatttttatttccgcttgtaaaataattaatttctttgataagtgatcgatagcattaagcatttgttgggagcttgggagtgcgtgcgactcatacttgtacattttttatttttgcccattctttaatatgacttttgccaattacctaaattaattaatagtgttttgggcgctatttgcaaagagtaaccttttgaaattatcaaaaagcaaaaacaaaaggggggacccttttgtttgcaaaattttttaatatttagtcatgaaaaattattccctggggttctttgggtccaagacctagaattacatgtcagattcgatgatcagcgacctctaaaaccctcggataacatatcttctaggatttatatcgcgacccttccttgacccggatgttttaaaccgaggtaaattaaaattagaaattaatttatcaaatttaaatgaaaaaaagtaattttcattttagatggtctaagcaatgcgtacacggacaatttgtacacttatgcgccaagaccatcatgctatggagccggtcaatgagcatcaccgtaaaaacaattatacattttaatcccattgaactgtattcccagcagtaggtggcttaattcttttttaacttggtactgtgctagattgattacagtcttagaactttacatgcactgatttgcaaaaaaaaactactgaatttcaccataaatattgttaacaacattacaattttcctaaaaaataactcattgaacaaaatttatgataaaacctaatttattggtcaaaatctataagttgaaaaattagcaaatttttgaaaaatcaactgggaaaactgttatttaataaa

SEQ ID NO: 75228 - DNA, 130 bp, Heterodera glycines
  Genomic contig location: Contig_ID=SeqID_1671; Location=1913..2042; Strand=-
  SCN-specific regions: Sequence locations=1-130
tatggcacggaaagacttccgatttccgacatttttggggtaggaattccgacttccgaaatttttgatgaaaagtcggaaatttttttaatttttcttttcaaaaaactagcaagttttgtacaatttc

SEQ ID NO: 75229 - DNA, 1830 bp, Heterodera glycines
  Genomic contig location: Contig_ID=SeqID_1672; Location=45..1874; Strand=-
  SCN-specific regions: Sequence locations=1-447,469-595,617-840,914 -953,975-1238,1261-1268,1295-1301,1325-1830
atgggcgaatttttcgcctgcaacttttcgttggccttagaggtggtgatgtcgccgatgcgagaattcttcgactcttacgggcatgtcaatgtcaatgttaatcccgatatcatcagcgattatctcgttggtacattatctcaaatttatgaaatgtgcccgtaatgatttttcaatgtatgttttagtattaaattaaacatttttcgaaaaaaaatctgattagaatccatatggcacaaaatcagcttgccagactaaaacgacccctcagactaaaccggccagactaaaacggccagactaaaccgacccctcccgtaatttattcgccttaaattgttgccaatgggctcgaggggagagaaaggcaaaatcaacatcatttttaaaatttcgataatttttgaaattttaaagcaatttttttcaaatgacttttggcggaaaaataaaatggggaaagagataacagaactcattttttcgttatctctctaaataaaattataagcagggaacggatttatatgtttttacatgttttttttgcgcatatgctatcgcatgaaaagctcaaaaataacatattttggactttttgggaataaaaacatattttggggtttcggcagtttttgtcataaattttagcgatttttcgaaaaaatgtcttttttggcaccaaaattcttggccaaatgcccaaaaaattttcagaattttttcaattttttgacgcttttcatgactttttttactttaaggtaaaatttgatttttagcgaagaaaattccgaaaattagaaaaaatttacgccaaaaagcattatatagtttttttttctgtcctccttctctttctctctctttctctctttttcctcttgtatttcctttttctcttactcgccaaaaaaatgtctaaccaaattctcaattttgattttgttcttctattccttcacatgcctaattttcaacattgatgagaaatcaaaccgacctaaattttgaaaagaaagggactgacacctaaacaaaatgaaatgaatgaatagtcatttattttagagttgagcgggaccgggacctgaacacggacaactgagtaccaaggtcccggttttgaccgggactagtcccggttttcccagccaaaaattcctgggttttcaacccgaaaaggtcccggtcccgggtttgcccaaaattcccggtcccgctcaactctaatttattttatttgtctttttattccctgtcatttattcaacaacaacaaaattcttttgaggaaatttaaaatccaagcttgttttatcggtatcaaactcaaaaatttcaatttcgaccaattcaataaattgtggagatgatttcacagcaacagaaaatggaggtatgtaaatgaaatgggagaaaaattgagtttgaaaactgaaattaaatgaatatttcaaccaaaagattaaattatggtatttttagaagtgaatggcgctgcaattaatttggaaaatgatggacaatttgatggaaacaatgaattgattgctgacaaacaacagcttaaggtgggcgaatgacataaacaatttggataaatttgaattttatgtgggacaaaaaaattttttggtactatgtggtttataccagggatggcacagaattccgatttccgaaaatttttagtgcctcggaactccatccctggttagaccccataagaaaaaaattaagaaaaatttttttttgaggcataaagatgcctccagaggttttcggggtcgctaagcacgaatctgaactcatatcaataaa

SEQ ID NO: 75230 - DNA, 983 bp, Heterodera glycines
  Genomic contig location: Contig_ID=SeqID_1672; Location=2379..3361; Strand=-
  SCN-specific regions: Sequence locations=1-425,447-916,941-983
atggacgagacggccgtttggttcgattgcccggacaaccgatgtgtggacaataaaggcgcaaaggatgtaagttttttttagataaaatgaacctattctaacaaattaggtgacagttgtgaccacaggacatgacaaaatgcgggtgacggtgtgtcttacagcacggaataacggacaaaaactcaagccgtacgtgttggtcaacagaaagcgaccggtgccgcaaattgtcaaacaatttgctggaaaattggttatcaatttcgctgggccgatatggatgaacgatgacacaacggaggactacctgcacaaaataatcggggcaaagctgttcgttggcgaacgcctcttggtttgggatgcgtttggcagccacaagagcgagagaacgacgaaggtggtgaaaggattgggagtggaaacggtttttgtccctggcggttgcaccaaattcattcaggtggagtgtcatctttctcagtaaagttaattccttctctaggctcccgatgtctcgtggaacaagccgttcaaggagcgaattcggcatttctacaacacttggatgtccaatgatgcagaaaaagagttcacaccggcaggcaacccgaaggcaccagcgcttcacatggtacttgactggatccacagatcgtggcaggaaatttccaaagccgtgatcatcaaatcattcgagggtcagtttaaaaaataaaaatgcctacgaaagacgccgaaacttttaagtctgtgggttgactacgccattcgacggaacaggagacgaaaaaattgcttgcttcaagccggaaggagcaattggaccgatagggacaaaatttttgcgcgagtttagagaaaatgaaacggtgaaagatggacgaaacgatcacgaagaagccggcttatctgatgatgatggtgatgtagagctggatggagtcggagatgacgatgaatttttcatttgttag

SEQ ID NO: 75231 - DNA, 1155 bp, Heterodera glycines
  Genomic contig location: Contig_ID=SeqID_1672; Location=4057..5211; Strand=+
  SCN-specific regions: Sequence locations=1-655,677-742,765-874,897 -1102,1124-1132,1154-1155
atggttgcacagtccgagaaaagatggcatgccgaagcaattgcatttctttttgaaggagccaccaaatatggaatgggccaacactctcaaaaaggtgtggccatattttcgttagccaactgattttgattgcatttaattaatgtccgtccgttttcccattgtttagcattttctccgtgccaatgccatttcttcggtcagctaccaaattcaatttactgttcagcaaccgtcaacgcaaattgtgccatttgaattagcgaacgaacagaccaaggaaaagctgacactgatcaaagcaagcgcaaatgtttgggaggatcgctgggtaatgaaacggtgccaatattgggagacggcggcggttcaatgggcagcccaaaatttggacggatttagcactgtcgagtttcattattacgtcgaagctggcattgggtgagcaacaaaaaagcatttgattttgtttaaaaattgtgccgaatttttaggcctttgtcgccacgtcgcaaatggtgtccaattatttgaaagtgatttaatgcatttgggaaatggtcgatcattttgaattatggcgatgaataagaggtgatctgaccattttttatgctcgtttttactctctgatttgttgttgttttccgttaaaatataaattttctctctcgtctcgatgcatcccatgggtatgtaccagggatggcatggaattccgacatttttggggtcggaattccgatttttgaaaatttttagggcctcggaatgccatccctggtatgtatcaattaacacgaaaaattcagggtgtgaagtttttcatacgcaatttatagttccaataacagtacagtgcttgtcattaaaatcaggacaccccccattttcagaatttaaccgcttcccgtgaactggtcgaattgattattaattcaataagttatttgtagacacgactaaaaaggcaccaaaaaatcgcgaaaaaaggactatttacatataataggcatcaaaaattgaaaaaaggcacgaaaatggaccgatgggttagacaatgtgccaatgggagacgaaaaattattgccaaaaatggaagggatggaaacatttcgacacaactttgtttttaaaataagaaaattttaa

SEQ ID NO: 75232 - DNA, 1450 bp, Heterodera glycines
  Genomic contig location: Contig_ID=SeqID_11743; Location=196..1645; Strand=-
  SCN-specific regions: Sequence locations=1-543,565-642,664-1450
ctttttcctctttcgctctgttttttgctcctttttccgtcttcaattagtgccactttttccgtgacctttcggcaatttctccgtgaacgttacggtgacgcggtggacaaagaactttcccgagaagacgttggcggcggcggaagtttcgggggcggcactcatcaaaagggacaacagacgaagttagtcctaattgaaagaaagtgaattcaaaacaatgccattcattcggctgaaggcgtcggccggtgattttcgtccacggcatcacaaataatgcgggcactttcggctcaatacagcactttttcctggcaagtgatgcaaatgtatcatgaaaaaattgctgcacacagaacaacgggtacggtgacgaagaagtgtacggtaccacatacggtgactcgggacgaacaaacgttgtgagggaccgtgtggaaattgttgttcaatggttcaccaaatgttaaggcatttgttacgatgtcgtgccactacgtgaaagtggtcagttgacagagagggcacattgccaatgggaaaaatatccattttcaaaatggcggtgtttgacgcccagctgaaaccctccaattttgagtgccaaatagaaatcaatcgctcatttccgtagggcataattggcatgccagaaagccttttattgctaaccaatggcacactgtgaacactttcccctcaatagattcgaatgattattgtggcagtgtccgcgtacaccgacaacaaagtgaacatcgtcgccttttccatgggttcgccggttgctcggaaggtataaaaagcgggggggggggagtcatttactgaggacattttgccactcttaggccattttgggcggaatgtgcgttgacacaaacgaagtacggtgagggagggcaaaacagcacaaactgtgccgtgcctttgtgtgcgttggcctcccattccgccgtccttatttaaggacgttggtcccccattgaccaatttggtgcgcgctttcgtcggcgtggcgggtgccaattggggctcctttctctgtgtgttgccctttggcagttgcaatttgctcaacggaatgtcctgcggctcgcgttttttgaaggacatcaattcaaagtctgagctttcacattggcaaattaggcgggaaatgcccaaattaaggaagcgatacgaaggcgaattcatttacacaatttattcgacgggagacgaaaaagtcggctaccaaacgtgcggacgaattgccagtgccattgacggagagaatgcggcatttcaagtagaaacccgaaataaaaaaacaccgaaaggaaaacaatttcagaaggagggactcaaccacgacggggtcattttcggcacggcgaatttgcagtacaatttagtaacgtacaacagaccatagtgaacatttgaaagaaattaaatttaa

SEQ ID NO: 75233 - DNA, 1001 bp, Heterodera glycines
  Genomic contig location: Contig_ID=SeqID_11743; Location=2213..3213; Strand=-
  SCN-specific regions: Sequence locations=1-141,163-184,208-676,698 -926,948-1001
atggtccaaatgtggtgcatggagacctacccgtgtggtgatccgcgtctgtaagtgccgtctttttctgatcattcggtgccatcaatcaatcggtgcccccgcccccctccctttccccgctcagtccgcaccactgtttcccaccaaaattggtgaatccggacgaattgaccaaacggacgggcgccctctattataaggtaattgttgtccgtctgttgatcggttttttttttttgattgttcgatcactgatcagatgggtcttaaatctgtgcctttaattttgccttcgtcagttggatttggaagaccaagtggcattatcaaaacgaattgcaattatgaaattggagcgcaacttcaccaaggaggacacgtacacattggacgcacagacaacgaacgattttaaggaaaaggcaaagcccattttggaaatgggaagaaaagcattcaaatggcactctgtttgaagatcgcagaacttttcgaagagacggaaagtgacgaggatcaagcacggatggttttggaagggtcggcgtattacgacgtcgaagccaaagtgatttacacatggatttagctttattgaatgcccaaatttaggacggagtttggatacgcatcttttggtgagcattagcaaattcaatcggtcaattgactaatttgaaatgtgtcagtgagtatggcgacttactcatcatccctaagggcatcgcacatcgaatgaccacaacgccgaaggcaaaacgagggcaaagcgggcggggggggggagggcacggcagctttagctggaaattaggatttgaaaagaaatggcattttagaggaacaactgaccgacgaggggggggggcaaagtgattagcaattggaaaatgagaggggtgggtgaggctgtggatttggccataataatttaataataattgccttttaagaattatgtgaaagtgcgccgctttttcaagtcgagcgatagcgac

SEQ ID NO: 75234 - DNA, 421 bp, Heterodera glycines
  Genomic contig location: Contig_ID=SeqID_11746; Location=2..422; Strand=+
  SCN-specific regions: Sequence locations=1-45,108-157,179-270,302-421
atggctggtattaccatgtgagtgggggagagaaggccaaaaaacattaaattttataaataaaattaataaattaatgtgtaaaattaaacaaattcaaaaaatttgagacggaaaatgtttttattctttttttccatggttcaatttgtgccgatttccttttttattggtcataatcaggctaccattgaatttttcagaaatcggcatttggccaacaaaaaatcaacattttgaaaaattttatgaattgaaagattttctcaaaaattcattcctccaaaaaagaattatttttgcttaattggctgaaaattatgtcactatccgtcattatttcagactttttgtcactcttttggcattgttcctcactgttttagttaactatttcgagatttttcgtaacttaaagtag

SEQ ID NO: 75235 - DNA, 111 bp, Heterodera glycines
  Genomic contig location: Contig_ID=SeqID_11746; Location=785..895; Strand=+
  SCN-specific regions: Sequence locations=1-69,92-111
atgcagcagatgagcgtaaagttcgcgcaggaaatgcaacggatgttcagcgcgacttttccgttcggtccgcccgcggcgccgccgccgcaatttcatttaccaccgcaa

SEQ ID NO: 75236 - DNA, 483 bp, Heterodera glycines
  Genomic contig location: Contig_ID=SeqID_11746; Location=1062..1544; Strand=-
  SCN-specific regions: Sequence locations=1-404,440-483
atgtggctatatggtaaagcccatctacagtagccagttttattatgccaaatcacattcattttcctccatcatttatttcatccgatttgccttttctctaaactttgaacacgacgacgatgagcagaagcacggcacctaaacgaaaagagcttaaaacggcctaaaaaatttttacaaaagagagttggcataattttgccagtatttaattaaccaaaatgatttttatataaaaaaacaatgtaatccaaatctcagttgatatcattcgacttttagcgccggattaagccggtttaaaaattcccatttgatagactttttgggtgccaaatctatgaaaaaataagaaaaatatccgtgtttttcttaatcgaaggaggagacaggcagaagagttaaactttatttttggcttttaattccatgttttcagtgcaatggccaatgtgtcaatcccaacccacaaatgattaa

SEQ ID NO: 75237 - DNA, 438 bp, Heterodera glycines
  Genomic contig location: Contig_ID=SeqID_11747; Location=49..486; Strand=-
  SCN-specific regions: Sequence locations=1-14,52-388
atgtcgtcaattgtctacatattttattgtttttgtttttctgttcttttcaatctaacagtaagtgccgtttctgaggatctttttggtgatctttggaaaaatggcggacttttggaaaaagggaacggcactcaaaattggccgaaattagaagtaaaaaaaatgaatgttgaaccaaaaatgtaggaaaagaatcccattgaatatggggaagaagcaaaattaaaaattgaacaaaaaataattggcaaaaacattggaaattttgtcaaaaaagagacgaaaagtgaaaatattcaggaaaataacaggaaaaagataaaaatggaagaaaaagatgaagaaatgtcgcaaaaatttggtcggccacaaataaaatgggaggaaaaattttttaaaataaattgaaatgcaaattaattattattaaataaa

SEQ ID NO: 75238 - DNA, 655 bp, Heterodera glycines
  Genomic contig location: Contig_ID=SeqID_11747; Location=602..1256; Strand=+
  SCN-specific regions: Sequence locations=1-29,51-101,124-229,252 -425,457-559,586-606,628-655
atggcaaatagcgcaaagaaaataacaataaaagtaaaaatttatatgaattcaatccatttaatcttcttttcgttagtgagaatagatcctttttctcaaatttaatcagttaaaatattacatttttgacaaaataaatttgtaaatgaatgacaaaggctagcatttgtaattttgcaaatttggattaactgaaaacgtcattattttacagagcactggaaagaatggaaatccgaataattgaaaatttgaacaaaatcgttgaattataaaattttgtccaaaaatttggacctcagaaaattatcgatttttctgataccagctgaaaatgttggtaccggtgccggtttttgcagtgtcggtcagtaccggccggtaccgatgaaagcgaaatttaccgatacctttctactctcatttaaataattgaaattttaaaattattaaggggattcatttttctaaattttctatttttcatttaattttctcctgacttactaaaagcacggaaaaagaagcaaatttgtataatttttaaaccactaaaatattcatttattcattcattaatttttgattatatcacaatttattcaaatatttgttatgcaattatttcttatttcaatgtaatcatttccaa

SEQ ID NO: 75239 - DNA, 313 bp, Heterodera glycines
  Genomic contig location: Contig_ID=SeqID_11747; Location=1593..1905; Strand=+
  SCN-specific regions: Sequence locations=1-54,85-87,136-289,311-313
atgaaagcgatgcttcaaacgacacaaagacagaacaaaatgcgcaagaccgtggtaagaacaaatgaataaataaaaacatagttgataatttaaaaatatttaatttttatattaaaatttcttttttattttcagcagttttttcgctacaaaaaaaatctgaggacgaatttaccattagagctgccttttcctgaaaatgacgtgacgaaaaacgaaagatgaacgatcgaacgactgatggatcacagtgatcaacacattcttaagaaaattattggtgactttgaggaaactgataaaaatgtta

SEQ ID NO: 75240 - DNA, 489 bp, Heterodera glycines
  Genomic contig location: Contig_ID=SeqID_11748; Location=659..1147; Strand=-
  SCN-specific regions: Sequence locations=1-106,143-489
atgaccactccagcaaacgcggcgagggcccggagtgccaaggcgaagctgcgcgatgccaagcggaggagggcggcagttggacgcgcaggatacgtaagttgaacaaaccccctccccaaaaaatggaattttcttaatttcagacaagaaaagcgcagcggggcgagcgatgtgccatctgcatgagaaacgtgggcgacatcacgcggacgacgctcggctgcacccatccgttccatcatcgctgcttgtaccgctggctccgctaccataccaattgccccgtgtgccgctacaacttcgtccgcaccataccgcgcagtgagcgtcgtcaaccgctgtaagatgccatgtgttgtgatcaccatacgatgtcatttgttgtgatcatatttgtatcccattgttcgattatgcgtatgtatttgtacaatggaatgtatgtttttatatgtacagtatgtataatattcgtcagtaaataaa

SEQ ID NO: 75241 - DNA, 472 bp, Heterodera glycines
  Genomic contig location: Contig_ID=SeqID_11748; Location=1680..2151; Strand=+
  SCN-specific regions: Sequence locations=1-401,424-472
atgctttcattgtacactatgctcgagttttccctgttggtgctgaacggcattgcaattataaaccgtgaacgagttttgaacaaggttaacaaacatattgctgttttttatccaatcgttttccccttatttgaagtatttgaagaatcggcagcacagtttcggagcagaaagtgagcaatcggttgtgtttaggctcgtcaatttaattcttgcagttcaaaccgtccttagaggttccgtttaattaacttttttgcttttttattaaaagtttgacccttttagtgcctctcatcgtcatgaatattattgttatcatcataaagctgttgtttggatgaaaatatgccttggccataatcacatatttatttccagtttatttgttccttctgttgtcattaaattttttcattttgcttatctgactgataaatctcttccgaattttcaacataccaacgaa

SEQ ID NO: 75242 - DNA, 543 bp, Heterodera glycines
  Genomic contig location: Contig_ID=SeqID_11749; Location=982..1524; Strand=+
  SCN-specific regions: Sequence locations=1-543
atggtagctgattcaggtgcgaacaacgcaattgaccagctacagccaaattgggcgacaacaatttgatgaccggcattttgggcccaaaagaacatcaccatggttgagcttcatcgctttatgatgctgagacgaaacgaaatcagattaagcgcctgatcaaggagaagccaaaaaagaaaccatgtcaactccgcgcacaaaattcggactgacggtcttcgaattgctcggcaccatgaagcgctcgaccaaatggcgaattcgttggtggtgtcaactgttacccatacctatgttcttttctaattcagtttaattttagctgttgtcagtgctagaacagaatgtcctctacagtttccgatctcgttttggaatgtgcaccccagggctcaaatgatcacatccgtggaaataaagaaagtgatgaaggaactgatgatgccaatggaaattgaattttaccattttcaacattttatttttattttttctttggaatttaataaatatctatttgcttacatgtacttttag

SEQ ID NO: 75243 - DNA, 1576 bp, Heterodera glycines
  Genomic contig location: Contig_ID=SeqID_11750; Location=42..1617; Strand=-
  SCN-specific regions: Sequence locations=1-194,217-451,490-553,578 -698,729-834,857-1191,1220-1244,1267-1310,1332-1576
atgcttctcatcattactgtcactaccatcatttatttttttattccgcctaatttttctattcaaatatgcgtaaggttattcaccaattgaatttgttaaccgccaaatgtctgaatttattaaagcctaaattctaaactgaatttgagtaatccccactataaatttaatttgtgggttccaaattagacaaaaaatatttggaaaaattccagtcaccgttgttaccctttcaaatttccagattccaaaattttcaatcttttttaaaattttttatactctaccgtagtccgaaaagacccgaaaaataaaaaatttccaaaaatttggagtccatattttttcaattgtcttaatttgcaaccaaaattgaatttagtttttcaagtttttttttaatttccattaaaaaaatgggcacgaaattattttcaaatctttatgcaattatttttttgtttgttttaaataatttaaaaaattgtggcaattaatttttcaaaaaaattcgagaattccgtgccaccctggtaagcaggtgttaaagaaaaaattattatttttaaaaaaagaacaataaggaaagaattggaatggagtcaaaatgtcgtgcaaatggcgcagttgttactgctgccgccctagttgagcgaatctttggttcgagtccgagtgcacgcaaaatttttttcttctttaaattgaaaaataaatcatcaaaagtgctccacaaatatttctttttgtgctcaaaagcagaaaataacaatttcattcaatcctacataataaagttgagtgtctgtatgtatgtacggatttttgaatttgtgtggcgttttgttattattttgcgttaaaaaatgatttgaaaatgaaaatgtttttgttttgttttgcgttaaaaaagcatttgaaaaatgaaaatgtttgtttttttttgcgttaaaaaatgatttgaaaaatggaaatgtttgatttttcattttgttttgcaaaaaacattcttagtcatttattcgcttttttgtgtatgttcaaatataacgccaaaatcgtccacacctccattcatcattttaattttttgtttttgtctttcattgtttaatttaaaggtttaatattgcttatttttttaaattcaaagtctgtttgtcgtaaaattttatggttatgtattggttagaaaaagtatttatttttgttgtatacacattatttcatatattactttaatttttgttttattttagaattgttaaacaattagagaattgtttttctgccgatggctcattttttctaccagtttggtcaaaaatctggtgactaaacaatttatcgttgtttttctgccgctacggctcattttttctaccggttaggctttttcaaatctggtgccagcctgttgccatgcttacgactctggaagagctcaaagccacaccatgtggcactcagcttgcgtaagtgcttgaattagtaatttgaaagcattagtggtttgttctgtgactttcgtgtgagacactaatgtgtgtcatgcttttgataaaacattaaa

SEQ ID NO: 75244 - DNA, 200 bp, Heterodera glycines
  Genomic contig location: Contig_ID=SeqID_11751; Location=125..324; Strand=-
  SCN-specific regions: Sequence locations=1-200
atgtgtggtttgctgagccaagttcttaatgattatggtgtgaacgctgaaaaagtgcaccttattgttcgtgacaacgaaagtgcaatgcaaaaagcgactcgtattgctggttttgaatcactgcattgcactgcccataattttaacttggttattttgattaatcaaaaatttcatgattatcttttcttaattta

SEQ ID NO: 75245 - DNA, 414 bp, Heterodera glycines
  Genomic contig location: Contig_ID=SeqID_11751; Location=749..1162; Strand=-
  SCN-specific regions: Sequence locations=1-15,41-335,357-414
atgccaccacaaagcaaatatattaaatattttaaaatttctcatggaacagcgaaatgtttgagctgtagttattcttacggctcaaagtctacaacttttccgaagacgtgtctacgagaacatttgcagcgacatcatccggacaaatatgaagaattgttgaaggaagaggaaaaagcaaaagtgaaaccaaatggccaacaatcaattcaaagtcttttgttggcaagtacaagtactggtcgcttgtgcttgagcccaacacctgccaaaatgccaagaaatgagtcgccgttctcttcttcacagccaaaaatcgtcaaaagcttttgtaattatttggatattttaaaatttcaaagtcgattaagcacaatggagttcggatggagaaatgacaaaaagggttga

SEQ ID NO: 75246 - DNA, 1048 bp, Heterodera glycines
  Genomic contig location: Contig_ID=SeqID_11752; Location=1047..2094; Strand=+
  SCN-specific regions: Sequence locations=1-35,57-74,113-155,221 -388,410-584,615-663,803-874,936-984,1031-1048
atgttaaaagtgattgctggaagatgtatgatagcatttgattgctaactgaaataaattttaagtgctttcagaaaaattaaaatttaacaaaaataaataaatttttattcttctttacatcttaattgatcaataaaaagtttatcgacacctaaaattatttatttaaaaacacattatttatttaagatttcatgtgttattataaataaataatgttaaagcaaatattaacaaagagataatccaaaagcaaaaaaatgaaataagagaatgctcctattgtacaatatattaatgtttctattgttaagatgataattgaaaataatacatagatcctttatataaggatttttatttatttttatagattttgttttggtaaagggaacataaaaacaaaaggactgggtagatttccgaacgggattcccgccttttttcgtttccctaaaatcacataaattttaacgagaatccagccggtaaacattaaaattgtacgaaagtttttttagtttgatttcaagcagatattataatattagacatctttaatttttcaatataatatctggtaaaaaattaattatttttatacttatttacaagcttgctcatatgcttcggccactttcgtagacagaaattatctaatattttaattttggcttttcttttttaattattatataaactgaatcattaacattttgttaaattaatttttgtatttctttttatatctttacagtttttattatggatatttttcgatttttttttatatttatttattttataatacatatgccatttattagagctatttcgaaagttcatttgacagatttgattttaatggatgttattataattaaacttttaagtataaatatttttgtttttttttgtatgtaattttaaatgaaatcactagtaaatatttctcacatcataatagtgtaataataggagttaattatttaattctttaatcaaaagttttttatatttttaatttggagttaataagatataa

SEQ ID NO: 75247 - DNA, 2997 bp, Heterodera glycines
  Genomic contig location: Contig_ID=SeqID_11753; Location=357..3353; Strand=+
  SCN-specific regions: Sequence locations=1-75,97-311,335-701,728 -887,913-1591,1613-1765,1796-2124,2153-2479,2517-2737,2760-2853,2875 -2926,2948-2968,2990-2997
  Gene Ontology: Mol. function=electron acceptor activity; Cellular component=mitochondrial inner membrane; Biological process=NADH catabolism
atggctcgtgtggaggacgagttcgacgtggtcattgtgggcggtggccccgctggactgtccgccgccattcgcctcaaacaattggcggcggagaaggcaaaaggtgagtgaaaaggccaatttcaaatgtaattcgagtctatgtctcaaagaattgcgcgtttgcttggttgaaaaagcacccgaaatcggtgcccatacgctctccggtgccatcattgagaccggcggattggaccgtctttttcccaattggcgagaactcgactcgcccatcaaacagccggtgaaggtcggtttatcaagtgattaaaaattaaatttaaaaaaacagtcaattcgcagaaagacgcattcgcaattctcaccaaaaatggacgaattccggtcccattggtatttgttttgctgcatttaatttcattttgtaaaatgttacactaatttgtataaatgaaaggtccccggcgtcccgctgaacaaccatggcaattacattgtccgccttggtcatttggtgcggtggttgggcgaacgtgcggaggagcacggggtcgagctgtactcgggcattgctgcgcaggaagtgctttttgacgaggctgggaaaacggtgtgcggagttgcgacgggcgatgttggaattcacaaggacggaagcccaaaggttggtaagggaatcatcaaagtttaaaaagaaagtacaaacataaaacaaaacaggagagctttgaacgcggcatggaactcaaagcaaagtgacttttgttcatttactttattatttctaatgaaattccaccgaaagggaaggaagtggatgcattttttagatttcgaaaaaattagaactccgtaatcatcataaaaattttgaaaagcgcaaaaataatttttttttttttttttgggaggaacgaactgctccggaagaaagtattccattttctctccataaacataacttcgctttcaatactttcccattctcgacagatgcacaatttttgctgagggctgtcgtggccatctgacaaagtcagtcattgaaaaattcggcctcagtgagggcagagacccgatgacttttggaattgggctgaaagagctgtgggaaattgacccgtcaaagcatcggccgggctttgccgagcacaccgttggatggccattggtgggcaaacggagggcaaaaaatgagtgaataatcaaaagtgcccaattagccgagggatcagtacggcggatcattcctttaccatttggaggacaacggacagccgctggtctccgtcggatttattgtgcgtttaaaggcttacaattaaacgaatcccttccttttcttcaggttgctctcgactacaaaaaccctttccttaatcctttcaaggcattttcataattaattacaatttaaaaattttctcccattagaccttccaaatgttcaaaacgcatccgtccattcgaaaacaattggaggacgggcggaggatagggtacggggcccgggcactcaatgagggcggcttccaatcggtgccgaaagtggtcttccccgggggctgtctggtgggctgcagcgcgtctcttttggttttaattctttttttgtaattttatttgctttacttggttagaatgttgccaaaatcaaaggcacacacaacgcaatgctcagcggatgcattgcggctgaaagcattttcgaacaattgcaaacggagggcgaaaaagcgcaaagtgcataataaagccgaaatttttttaataatctataattttatttcagcaattactccgcttaattatgccaccgctttggatgactccccggtgatgaaagagttgcagatgtgccgcaatgttcggccgtcgttcaattcgcgcctcggcttttggggtggcatggcgtacactggcactttcttcgtcatgggtttgtgtataaacatttcattgttataatttggtttttcagggcgtggcattgagccatggacaatgcaccatggacacccggacaatgagaagacggagctgaaggagaagcactcagaaatcgaatatccgaagccggacggggcattgacattcgatttgctttcatcggtccatttgaccggtaaaatccatgacttttcaatacggtggttccttccattcttcgttctttccaggcaccaaccatgaagaggatcagcccgcccatttgacgttgaaagatgactccattccggagacggtcaatttggcactgtacgccggcccagagagtcgttactgtccagcggcagtgtacgaattcgtgccgaaggaggagggctcggcagtgagtgcgcagcaacggttgcaaatcaacgcacaggtggcaaaagcaaattggcaatgctaaacagctgacaaatgggtgccatccctctcttaagaattgcatccattgcaaaacgtgtgacatcaaagacccgctgcaaaacatcaattgggtggccccggagggcggcggagggccaaagtacgacggaatgtgaacagattgggcaaaagaagaaactggtggagggatttgatggaaagaggagattgtttgtgtgccacaaccaaccagcagattctgtgcattagtttttgtcctttcatgtaaatcctcaaaccaatcgtgatgttcttaaactttctccagggctgagccaaattcgaaaaataagcagaaaaaatttgcacagccctgccaccttctgtgtttcttccaatcctttcatggtatattagactaagtgtcatcattagggcttccatttttaggcacaaaaaatcgcactaggcattaaataggcacaaaaataggcaaatacaattttttattaacgctttttaggtaacaaagcacgttaaaactttaaatatttcaattgtaaatgaaattattaaatgttttaaagttttttcgaatatgaacaaatttttaaaccaaaagatttttattaagaa

SEQ ID NO: 75248 - DNA, 1123 bp, Heterodera glycines
  Genomic contig location: Contig_ID=SeqID_11754; Location=1252..2374; Strand=-
  SCN-specific regions: Sequence locations=1-41,63-109,146-218,318 -354,376-448,528-540,562-601,636-726,748-1007,1030-1123
atgaaaaatgcaatggatgacgacgataaaacaaaagtcacacactttcaaaatgtgaaaaaggaatttctcattttttgttatcaaaaatttgtaagtttggaatttcaaattttgaaattaaaaaaatttcaaataaaaatttgtgattttgaaactctcggcaaaatccaactatttttttttttgagggagtgaaaggaatttcacattttgttgtcaaagatttaaaattttggaattttttaaataaatttttaaatgaattagaaatttgaaaattttttgatggaaaaaaatattttttttttaattttgtgtcaaaagaaattttcagtacaaacatttcttgacaaaaaaaattaaattaattttctttcaattcatatttgacaccacaaaattggttaaattttattagtgttgttgtcaaatggaaaaagtcacaaaacataaaaagaaaaagaaaaaataataataataattgaaaataaaattaaataaataatagtgcaaaagcataaaaaacggaggaaaaacgaatcaaaagcagaggaaaagcatgtgaaatggagccaaaaattggaaatgtttcgaatttaaatcaaaaattattattttttgagcatttttatgacagaaatagtgacctaagaaaattggcgattatagctgatcggaactgaaataattgcattgatcaaattttttcagctttaaccggccaaatcaatcaaaagcagatggatttgatcgttctggtctgaccaatttagaaaagctaaatcatgatgacctgctgatctgatcagtttgcatggccgtttttttaccgagcccttaccaccaaaaattgaaacaattaactctcagataatgtgtaatctgatcaggttcacctactggatttttgatcagcgtgtcaaaatgctaagagcaaaaactctgatcagagatcattaagccacgcacaccaaaatgatcggtcgatcaccgatgacacaaaattttaaaaatgaattttttcttaaattttcggctccatttcaaaaatgccattccgatcaaacagcagagaaaacctactggtggcgtgccgtgtgtatgtattgttcataataaa

SEQ ID NO: 75249 - DNA, 2450 bp, Heterodera glycines
  Genomic contig location: Contig_ID=SeqID_11754; Location=2694..5143; Strand=+
  SCN-specific regions: Sequence locations=1-76,153-234,256-734,785 -1152,1176-1363,1436-1450,1497-2017,2040-2054,2131-2204,2226-2450
  Gene Ontology: Cellular component=synaptic vesicle; Biological process=synaptic vesicle maturation
atggccaccaaacggacggcgttggcaactgcagccaaaacgacggtgcaagaccaaaatttggtgggcatttttgtaaaaatttattgtatttttaaattatttttattgaaaattacttttattgaaaattacttttattgtttttttttgagtaatttgctggtaatttctctgagttagaacaatatgatcaaatctgaacaaaatgtaatcatttccaaatagatttgattaggttaggtttaaaaagataaaggattgattaaatctatcaatgcgtcatgacgccatgcaataatttgatcaaacctaaaagaacagaacagacattgaattgatttgtgagtcattctttgatcaaaagagcagattagatcatcaaaacagcatgggtttatattattccgggcacaatttgatcaaatctaaaggacagaacggacaattttgaatatgatgagatttgaacaaattgggctgatcaagtgatgaaaatcgtcatgggtttatgtgatcggaatgtcctggcacaatttgatcaaatctcaaggacagaacagacaatttgaataagattagagggtctgtgattcactctgtttaatcatttgaacagctagctcaaatcagcaggagatggatgtccttatctatttttttgaatcaaggacaaaaaaaaaaccattgtccgaaatgaaggacatcatttttggaattattgaattatgaagaaaataaaaatacataaaaatattttaataattatttgaatttatttaatccagaaacaactcgtctacagaaagtgccttcaagcactgatctatccgatcagtgccacaacaccgcacaatttttgcacaacaaattttcaggtaagaatggcgccgagtggggtccaacttttggcatatatatatttttttttctaattttggcatatttttttttctaattttggcattaaatatttttatttttggcaattttttcagactcccacctggtgctatgagtgtgaaggccttttgtggggcttggccagacaaggtgggcaataaattttttcaatttgtacaataaaatcacactaccaaatgcctcggcaaaatttgttttcgttttggcattagattttttaatttttgtaaatttgtataaaaactacaaaatttcctcgagaaaagtgaggggagctaatgaatttttaagaaaacaaatcagatagaaaaatctatataccgtttttctagttagaattttctcggtttttgatttggttttggcattgcgttttttaatttttttttttgtttcgagctcatttctcgattctctttcagtaaaaatcatttctcacatatatttttttaaataaatgatttttttattttacattttgaggtaattaaatttaaaaaattcaaaaaatgtaagccatgcatagataatttttaatttaattgaatttatttaaaataagatattttttaccattttttgccaggccttcgctgttctgagtgcggcgtaaaagtgcatgaaaagtgccgagaattgctcagtgccgactgtctacaaagtgaaatatttttttaaagaactgatcggataacattaaaattttcaaggggctgccgagaaaagcaataagcatggggaaggtgatcgggcacagaatctgatcgcagtgatccgcgatcggatgaaggcccaggagcgcaacaagccggaagtgttccgccgcattgcggacgcgttcaccatggatgacagaacgcagcaggaggtggggccaaacgggggagggtcaaatagagtactggaaaagtactggaaaataaaaatttccgaaaattagacagttggaacttggaaaatcctgctaaataagccaatgttagcctggaaaatgttttcaaaaaaaaaaccaaaaaattgaaggaaattttgaagaaacatgcaccatttttttggctgaactaaatccagcaggaaagaatgccaattggcaatatatgtgtataataaatagggagcagcaggtcttgaaaaaaaaaactttgaaaatattattaatttaatttatttatttcataaataatttttaaaatattttttatttttcaggctcttcgtgtcgtcaaaaactcaattttggagggcagttcaaaatggagtgccaaaattcagctgacaggtggcatatttatgtgttaaatttggagggctgctcgtaatttcctttctcgattctcgagtcatgaaattccttgggtttttcattgtcttggcggtggcggcttcaaccggcttcaactggaaaccggcacggtacgggatcccgcgcgagattttgcgggatcccagtccgcaatccagcattttttttttttgaatttgcgggattaatcccgcggggtctcgtctcgcaaaaagcaatttga

SEQ ID NO: 75250 - DNA, 1326 bp, Heterodera glycines
  Genomic contig location: Contig_ID=SeqID_11755; Location=2262..3587; Strand=-
  SCN-specific regions: Sequence locations=1-143,165-217,240-760,788 -869,891-1326
atgtcttcaggacttctgtacgtttattatttctttttttttgacagttcgcatttaaagtttagcttaattagcctcaaaaattcccaaaaaagctaaaatttccctttggattccctcgctttgacctcctttcattggcttttcctttcccttcatttcccaatttatttttcagttggcgtgctgtgcttcttctgttggtcgattgtgcctccattcttttttggttctttttggacaatgtcaaaaagcgacgacgccctcacaaagaaatgtaaaaaaaataaacaaaaaatttagaaatcgaaaaagttcttcatttttttcagctttatctgcgccgattgttggcttttggtgttcgatttccttgcgccttctcaacttggcctcgaaattgcactgatcagccgtcgatttgacctccgagtggacgaacatttcaagacacgcaaatggacgttgaacaaacaattgctaatccaatgggacattgaagaaaatggcacgaagaaaatgcaaattgtcaaatctgatggaaatccattgccaatcccgcaaaaaccgttgccgaacaaagtgctcggattaagaggcattacgatcgcgtaaaattaaatgaaattggaatttgattcgtgtgatcatccacattttcagctacattgaccacaatgtcgtcacatttctccgtcgtttacagcgtcttttcgccgtttgttcaatatacttggacaataccacgggcaatgatcacattttggactttgttttgctccaaatttggccaatgttccgcgattccatgcatctgatgcttttggacaccatcacttttcgccgtttccgtcaattggccccgtcaatgctcagcaattgtctgtctcttcgctatgtcgctttcaatgacgacattgtgctcgcttttccgcccgatgacagtgccatggcgtcggatggccaagtagttgccaaatggttgttcacgtctcgtccggacggtgtgccgaagtggctcacttgccatattaattcttcactgatggaccaatggtcttcagctattgaacaactcaaaacggtggattattccccactttttaatggggtttttaatgatttttgttccatttttaggcattttccaatgcttcttcaccagtgacgttccgcatttattggaggctttcatccactttaattgactttgttatgccatttgatctgatcaacgaagtgactggggagcaattggtccttgatcaagatagcacaaacgatttttggctcacgcgttgtccaattgaatgggatgagaataaa

SEQ ID NO: 75251 - DNA, 972 bp, Heterodera glycines
  Genomic contig location: Contig_ID=SeqID_1673; Location=1398..2369; Strand=-
  SCN-specific regions: Sequence locations=1-184,206-414,441-491,514 -578,600-613,650-972
aatggaagatgagcatttattcgacagctattcatttgtcggattgtcagaattaggtaaaacaaaacgtgtggtggtaaataaatgtctctgtttcagacgacgaattggagaaatgtgcggatgacccggatgagcaagtgcgtcttatcgagagtcgaatgcgcgaactgagtgaaatttttcacaaatacaaaggaaaattggcggatttggagaaagagcataagaaacgatcacggcaagagaagtaagaaaagcatttgcattagaaataaatataacgaaaaattaaggaaacggaaaatgatgacggataaataattgaataacgacgagaaatcattttcttttcaattttattcacatgaaaattaatacactttgactttgcaatttatttgtccatcactctttttaaaaataattaaataaaaaatgatttccttattgtcattaaattgttcattatatgctctataataaacgcatttggattgtttttatgattctccccgtattattgtcatttatatttgagtggatgccatttgaataagagccattggatgatgaggttgaggagattagagaactggttagataaaatggaaaaatattgcttaaaattcattgaatttacagatttacgagattctgaaggagtttccgacaggaataacttccacttttcttgagcaaaagtacatggaaaggttaataattgcatttgagatgctcagaattgaagcgagtttattgttcagatacgtgacaaaaaggctggccaaaccattaccaagaaattggctttcgttaatgcggtcaactgaagaattcgagctgaaggacgtgtccactttcaccatgctggtgggtcagacaaatcaaatgtcatccgttgaagaggattttcgcggcactttcgatccttcgggccgttttccatccaaatcaattctcgagcattga

SEQ ID NO: 75252 - DNA, 944 bp, Heterodera glycines
  Genomic contig location: Contig_ID=SeqID_1675; Location=304..1247; Strand=-
  SCN-specific regions: Sequence locations=1-146,179-483,505-545,567 -692,714-944
atggagtatgaatcgaacgaattgccgcctatatatttacctgttggtactgaggttagcgccaaattcaaaggcgctttttgtgaggcgcgaatcactaaactcgtaaaatcagtgaaaatcaaggttagtctcttttttatccattaactcttatttatttatttttaggttcagctcaagaactctaatattattgcagttgacgagtccgcaatccaaaatgggcgaatggagattaaccaaaatgtcgaagtcatttacatgaaacaaatacataaagggcaaataatctgtataaaggtgactctttcacataaaacctctactaatcataacaatgaattgaattaaaattaggactgttcttcttacaccgttatcttcaatgatggcgatgaacgtattttaaagcggactcaactttgtcaaaaaggcgcaaagcattttaaggatgcagaaacacttgacaaattgccggtatgactattaaaataatttgtgtgtgacgacagcttttagctgtatcacccggacaaaaggtcgaaaaagaagaaggaagaagctgaaaagaattcctcaacgtttaatagtccaagctctcaacgttcgcctcgctatttccgcagctcttctgttacgccgctgaaaggaattgcttctacgcgttcggccaccagagcaattgcacatcttcaatttgaagtgaagaattaaaaaattaaagagttggagccaaaagcttactaaaaattttacaccgtaaactaaaattcaacctatcaattgcataacctttgtttttctgtaaatttttaggaatttgattgtgaacgtagtgcatcagcagctgcagattgttcttctagtggaattatgttaaatttaccaacaaaatcaaattcattgagccctcctcggggtgcaatttcaggtaaaataaa

SEQ ID NO: 75253 - DNA, 3311 bp, Heterodera glycines
  Genomic contig location: Contig_ID=SeqID_1675; Location=6075..9385; Strand=+
  SCN-specific regions: Sequence locations=1-328,350-932,959-1008,1030 -1160,1183-1188,1211-1323,1422-1561,1583-2969,2993-3232,3255-3311
atgcgctctcaacttttggctctccttcacggcgcttcgcttcccctgaacacagtttcccacgcgttcgcttacggttcgggtgcaatccctcaacgagaagaggacccaaatacgaaaatggtaacaaaatgcacatttaaaatgatgccattttcgattggtacaggtggattttctcattgtgtgcaacgattcattgctttttcaccagcaaaatttgcttcagtatgtgagcattgcgttgttgggattgtcctcacttcacccaattcaatttgcaaagaaacccaagccattactctcttcccttccgatggttcgatgcgaattgggtaaaccaaatgcagcgactctccggtgcacggctttactacaacacacgaatatctacccaaggtgaagtttattcgtatccatttccaaatctaagtacctttattacgaccttttaattcaaattgtttcaggacgtttaatcaaatatggtattatccaagaggacgacttggagacggacttgctcgactggacatggctgtacgcggccggtcgactgcaaaaacccgtgttggaggtgtacaatgggaggggtgaaacttccgatgttcaaagaacgggacgaaacattggtagggcgctctttgacaattaccgagcggctgctcacgccgcactgctccaactcgacgggtggtttacgatggatgtgagttagttgcatttctctcccaatttattgtctttacttttgtccctatttcagcaatttctcaacaaagttgtgtcaatttcatatggtggagacgtgagacggtatttcggagcggaagacccgcagaaggaggaaaaattggtggccggcgcgagcagacaattgagggcgttgtacaaaccaatcctcgaggcgttcgtattcccgtgattttggataagaaaatgttttattatttttatagtgatcgcgaagtgcacctacacgcggatgacaaaattgaacaggactggtaaataataatggggacaattgggcgattaattaggggacacactgagaagggttgacctaattaaggggggtgcaccccaaattttggcgcgccgaaatttcgccggacggaatttcgccggccgaaatttcgccgggacataatttcgccaaaatttttttttaaaaaatttggaaattttcaagaaaaaattcttagaatttttttatatggaaattccaatgaaaaatttttgaaaaaattttttagtgattttttggaaaatttttcgaaaaaacttattaatttatcataaatttcaaaaaaaatcccgaaaattttttctaatttttttttgaaattttcttataagaaattctatgattttttcttaaaaaatttcaaagtctaattttttgattttatttttttgcggcgaaattttgtcccggcgaaatttcggccggcgaaattacggcggcgaaattccgtccggcgaaatttcggcggcgtaatttcggcggcgaaattttgtcccgtccccattaagggaggataagaatggagggaattgggcagtcattggcatttttcatcaaccaaaatgttttttgaagctcaactccaattgtgttcttccgactgacacaaatgccacgggcggtcctcgaaagaataagcaaaacttactaccctcagaggaaagcggccgacacggaggttcggtgcaccccaaaacgtcgtcggccgaaacgtcgtcggaagactttttgaaccataactttgttcactgtcaatcaaattaagaattgttggtgttgttcgatagctctatgtgtttattattaatttgcaaaatctcaaaaattttcgttaagtttcaaaaaagttatgaccagaaggaactcaaaaacccagtaattcgaactttttttgctctgatttttttgtgcataaataaaaatttttgaaaatttgcaggctaatagcattttttgaatgctttcgaataataccaagaatggttaatttggttgagaaagaaaaaagttatggtcgaaaaattcgttcgacgacgtttcggctgacgacgttttgtcctactccgacggaggttattgcgtaatctgacgtacaatatttttctcctccagggacgggcctaggattcggcttggggtccccccccgggcgacgatctttaaatgacaaattttgcatatttttagcagactttcatcaaaattaataatgtttacggaaaaaagcgaatgacgaggtaggtcttggagatgtaacaacaaatcggtgtcgaattgaaataatattttgattttttggttataaactttttctggttatgggctaggtaccaagaagcactaccaaatagtaactttcatccatctgagttatcgaaattaacttgctaaaattttttgtacacaacagatagttttgttcctgtagtgtcccagttttccggaagtctcgaatttcctaccccctccacaaaaagactggtcctgctaattaaccccgtcctcccaacttaaggaattgctctaccccatcgcacatcgtcatgatctcaaccagcgtttctcgggtgttcttcaaagcatcgtttacgaagccagtttgcgccaaagtgccaaaaattttttgaccgcggggataacaaagtcgctacaatacgttgggcctaaactcaggaaaggattattgagaagattctgaacagccatttgcagatttgttttttgtttgtttttgcaaaaattatgccgcaaaataaaaaattatccgtgtctttcatttgcgattcccttttttaagttccgattcggttgtgattgaacgcctgggaaaagtgtcttccgcttggccatttactttttctgttggtgaatttgccaatttacttttggttcgctgtgatcaaatgcgaaattgtttcaccctttctgtccgaatcgaacggcgacgacagcagcagcaacggatggtcagccaaacattcggcgactgtcgtcggtcgctttcgttggcattttcgcagcatcggccctcagcaacagaacaattgctgcatgggcattcattctgctgatcagcgccgcagcagcaacattttttaggggaaggacaattaaagccggcggaacttttgtcgcagtcgcaacgactggcggcggtgctttgtgatttttgtgggcattgcccgcagggcattgggccgactgtcgctgttttcgttctcgtgccaatttcaaaagagtcgatcactgctaattttggaactgtcgtcgagaagacatt

SEQ ID NO: 75254 - DNA, 386 bp, Heterodera glycines
  Genomic contig location: Contig_ID=SeqID_1675; Location=7787..8172; Strand=-
  SCN-specific regions: Sequence locations=1-386
tcggagtaggacaaaacgtcgtcagccgaaacgtcgtcgaacgaatttttcgaccataacttttttctttctcaaccaaattaaccattcttggtattattcgaaagcattcaaaaaatgctattagcctgcaaattttcaaaaatttttatttatgcacaaaaaaatcagagcaaaaaaagttcgaattactgggtttttgagttccttctggtcataacttttttgaaacttaacgaaaatttttgagattttgcaaattaataataaacacatagagctatcgaacaacaccaacaattcttaatttgattgacagtgaacaaagttatggttcaaaaagtcttccgacgacgtttcggccgacgacgttttggggtgcaccg

SEQ ID NO: 75255 - DNA, 490 bp, Heterodera glycines
  Genomic contig location: Contig_ID=SeqID_11757; Location=1704..2193; Strand=-
  SCN-specific regions: Sequence locations=1-490
atgtgcctgtttagggagagccatgtgcgtgaccatttgcgcaaggtttacggcactttggcactgacaatgctttccgcaatccttggcattgtggtcaacgcggtgatggacttctcgtcgttgctgcccgtcttctcgctgatggaactcggcttcttgatcggtattccatttttcggttctactgtttacgtttctaaccaagttttacgcgtcgaataaatgactatccgcggttttttaggccatacattttttcttggttcgtaaatgccttagttcatggtatcaaattgaaagcttaaagtctagaagtttatgggattttctttagaaaaaaaggcatgccctaagaaactgagtatgggcatttattggacaagtaagttgtgccttggtaaacttactaagatgtcaaactattatttaagttggaggtatttccgagctaaaaatgtgtttttcatgcatttctcgtcgaaataaa

SEQ ID NO: 75256 - DNA, 341 bp, Heterodera glycines
  Genomic contig location: Contig_ID=SeqID_11757; Location=2702..3042; Strand=+
  SCN-specific regions: Sequence locations=1-131,153-244,266-341
atgcccacggtccgaattagttcgccaataggttttaaatcgactttttaatcatgaaaacctgagcccttcataaaaacgtttcaattattagtaaaatgatttaagtatatcgtggacaaaaaacattgaaagaatatgaaaaaacaataactttgggctacgaaaaaatgattggggtgtggttctctttgacaaaacgaatcttagcggaatatgtaacctgttatggcgacaaaatgggtgaagaaatattttttgaaatgactcttataaaaaaggcgtttgtttggcagagaaacattttgtgtgtaatatgtacaatcaccgtgtgatgaaaa

SEQ ID NO: 75257 - DNA, 804 bp, Heterodera glycines
  Genomic contig location: Contig_ID=SeqID_11760; Location=374..1177; Strand=+
  SCN-specific regions: Sequence locations=1-259,281-689,732-804
atgctcttcgtccgtccaacttttctcctccttttgctcttcttctgttccaccaatttctttccgattatttcggcttctgccgaccaaaatgtcgaaaattcggaggccgaacaaagtgaaaatattcttctccaaaggccgttgaacatcatagaagtgagaacaaagcagatcaaaaattgcacaaaatttcaatgttttaaaaaagtgaagttggctgacacggacggcgacggacggatcagtttggacggggaattgaagcagttcctggagtcgacaaagttcgaacgaatgttcaaggcgctgttcgaccaccagtctcggggcgaattgcgcctggagggcttcagaaagacactgacgaagcattttgagggacgaaagtacgcgccgaagttgccaactttggtgaacgaagttaacgtgaacaaaaacggtggcatcgactggcacgagttcaagctgttcatgtacgagctgggaaaacaggtggctgataaagggaggaaatttgatcattttgaaaagggttttcgaaaacaataaaactgaaacgcatttagttggtggatgccgaccatgatgggttcatcaccctcacagaatcacaagccttctattcctgggagtacacactggtggaaatgaatgaatctcaccaaaaggtttcataaaaagcatcgaatatttgttttaatttttattgtaatttaattattattttagtggttttccaccaacatattaccccaattttattattcattcgcttttcatttgtaaagtttattcaaaaga

SEQ ID NO: 75258 - DNA, 154 bp, Heterodera glycines
  Genomic contig location: Contig_ID=SeqID_11760; Location=2447..2600; Strand=-
  SCN-specific regions: Sequence locations=1-154
atgattgcacgtattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaacaaatttgaagaa

SEQ ID NO: 75259 - DNA, 392 bp, Heterodera glycines
  Genomic contig location: Contig_ID=SeqID_11760; Location=2320..2711; Strand=+
  SCN-specific regions: Sequence locations=1-121,143-307,329-392
atggccataaaatatggaccaaaaatcgcaaaatatggacataaaatggcaaaaatctcaaaatatggaaataaatggcaaaaatgtcaaaatatggacataaatttttcaaaattgagtgcaaaatttcttcaaatttgttggttgaaattgcatatgagatacatttccaaattttttgactcggtaaggcgctttgacaaagacggctttcgttttgcaattagtcggtcaacattcggaaattggtctcgaattttttcggcaatacgtgcaatcattttaaaagaaaaaaaacataaaagccaaaatttattaattttttttagcgcaaaatcaacaacaaaagcgaaattttcgcttttttgcttatttttgacataatttattaa

SEQ ID NO: 75260 - DNA, 236 bp, Heterodera glycines
  Genomic contig location: Contig_ID=SeqID_11763; Location=146..381; Strand=+
  SCN-specific regions: Sequence locations=22-236
atgaaggtggacgagctgttcattattgtaatgcgcagcctggtgcgtgagtgtttggattggggaccgaagggcgaagccgttcccttgatgtgtttactcacttttttcaaagggaactctaagaattctgatatgccttcaaatctatcaaaagagttgcatactttctttttatcatttctctttattctctattttacacttgtatttttcatttgaatgtttattcagaa

SEQ ID NO: 75261 - DNA, 623 bp, Heterodera glycines
  Genomic contig location: Contig_ID=SeqID_11763; Location=4199..4821; Strand=-
  SCN-specific regions: Sequence locations=1-460,487-623
aagttgatcaatttcatcctgaattgactgttttttctgttcatcagttaaaaattgttgttgctctcttaattcgcgaatttttttgtaatcgtcttgaagcccttcatattttttatgaatatgttcccagtaatctgttggatgactatcaaaaaatggctcaacgtaatccttattttgttcatagctcgtcctctcatattcttcagctgatatttgtaaatcttttttcaatacagccttgttaaaagcattcaaattttttcttctgtgtttcattgctgttctcattcttaatgcttcctcattcagagcctgaattgttctaccatctgttactccttggtattttttcatatggtcttgaatgttgaataaatctcttattaattctaatcgaacttcatttaatttctccctataattaacagaatacatttcgaggaattcttgaccagttctctcctccttttcctccttcccgtcatctctttgccttgctgcttcttcaagcgcctctattcttgctttcttagtcaatgattgattttggagagggtcaatttcctcatcctctatttttctcttcctatgcgtgtccgtctcatcatcacgttctc

SEQ ID NO: 75262 - DNA, 3825 bp, Heterodera glycines
  misc_feature (593)..(593): n is a, c, g, or t
  Genomic contig location: Contig_ID=SeqID_11763; Location=1103..4927; Strand=+
  SCN-specific regions: Sequence locations=1-414,436-554,576-807,830 -850,872-1008,1030-1338,1360-1461,1490-1797,1819-2011,2033-2616,2660 -2735,2758-2850,2874-3030,3052-3058,3080-3233,3260-3825
atgggtgtacatgtgcacaaaggacctcctagggatgaattgctgagctctctaaagaagcctctcttattaattctagatgaccttttaacaataattgatgagaaaagcctatctgaattattcattaaaaaagctcatcatcttaatatgggagtgattttcataacccaaaatttatttgaaaaaaaggtgaaggtagcccgaattaattcacaatatattgttttaatgtctgctccgaatgctgcacttcaaatacgtaatttgggcgttcaactgtttccaaaaaatcttgcatttttcctaagtgcttataaagatgccactttatcaccgtatggatatttatttttggatttacacccagcatcaaatccattgctgagaatacggacaaaaatatttaaagaagatgaagaaaaagcattgtatattcaaaatgattagtttacctaaaaatgttattcaaaacttggattttttaaagaaattgacaaaaacaaaagcttttaaaaagagacaacaaatatttaaagaggctactagtgaacaaattgcattattaattgaaattagttataatatattanaggggtacttcccgctcacgaagagacaaaaatatagacttttaccatacgcaaattttgtaagaaaattagcaagagttagaactgagaagggtgcaaagaaagtttttcaacaaaacggtggtgattttttcgttaatttggctccattattattgccagtattaattgccgcgctaaaatatggagaataaattattcttgttccttccgacttgtacaaaaatttattaaaacctgagtctggcgagattaacgttgaaaatgctaaaaataaattgtcatcacttttgaagcagagaaaattagacgctacttcaaaaaatttactttataaccaggaattgaggcgtttcttgaaacttaggaaggaagttgaagataaaccggtaaaagttgagctttcagatggatctttgatggtgtttaaaccaaagcagcgtgaaagagatagcaaaattcctactcaaattgttaatgacgaaggattggatgaaacaggctctattccaacacttgaagacccttacactactgctgaagagagtgatgctgagccaacaacatcaacaccaaagacgagaccattgataagaccaatgcgtgtaggaacaactaaatttcgtcaaaagcaaaagtcttttgtagtcaagaaacaacaaaaaattatgtcaattataaataatgaccctgagaaatttggggttggttctagaggacatatactgagagctgatggaacggcatatttaaaaagtaatgttaatcaagcattagagcgaatattgagacggtcacccgagaatgctccatcacccataggtacaaaagctttagagcaacgactgagaaacgacccgaggactagtggaatattaaaacaaaaatttaatgaacaatcgggatcgggcgttaaaagtaaacaacgaaaatttataattaaaaaatggaaaagttactgaacaaattgtataatgaccctaattcacctgcgtgttatgctggacaggaaagactttacgaagaggcaataaaacatgactcttcgatcacaagaaaagatgttgaacactttctcgagggagacagaacatatactttacataaacctaggcgtgttcgatttaagaggtcacgaacagtgccctctggattcatgactgatgttcaggttgacttggcagatttccaaaaattatcacgaaaaaataaaggattcaattatatattgttgggtattgatgtgttgagtaagcgggtctttgctgcacccgtaaagtcgaagaatttcaaacacatgagagaagcgtttgacaaattgataagtcaaatgcctatggttcctcatagaatattttcagatagaggaacagaatttgaaaatagagaaatacataaatatttccaagagaagaacatacaaaagcacaaggctcatactagtacggttaaggctgcgctagccgaacggtgcataagaacgcttaaacaacgactatatcgttattttagtcaaaaacatacaatcaaatgggttgacgttttgccaaaaattgtaaatgctttgaataactcaaaatcacgtattacaggtatgaaaccagttgatattaacccgggtaatgctcaaaaaatttggaaaagagtctatggagatgaattttcacgaaaagcatatagaaagccaaggttcaaggagggtgaccatgttagacttgcaaagtataagtccagttttgaaaagtcataccttcccaattactcggatgaaattttccaagtttacgatattaaaaaggctaaacctcatcggtatggaataaaggacgacaaagaagagccctttgatacacgtttttatgctgaagacttggccaaaaccagaaaggacgcggagacgacatatcgaattgagagagtgttgaagactaggacaaggagtggacagaaggaacatttggtaaaattttacgggtacaaagaaccggagtggattaaagacaatgctattgagagatgaatgtatttaagtatttattatttatgcttttaataaaaaataaaatgtcaaatttgttttacgttcttttacctagtgactctcctggttatgacaataagcctaataaatttagggttcatttgcctaggaccctaacttttggaggtcattggttgtgtgggttgcacagtataatttatacaaattcttggcccgccattggtaccacagagaaccaatggattaaggtgcatttaaaaaatggtgataaaataaaaattgatattcccgctgggtcataccaaaatgagcaagaattggaaaatgctataaatgagtcgataaaaaatggtataaaacaaccggctacaagagttaaaagacaattggaagatggagtggatttgttttttcattataatccagatgattactgggaaaaaattgaggaagaaaggcaaagatataaagaattgttaaaattgatagatacaaagtcaagagaacgtgatgatgagacggacacgcataggaagagaaaaatagaggatgaggaaattgaccctctccaaaatcaatcattgactaagaaagcaagaatagaggcgcttgaagaagcagcaaggcaaagagatgacgggaaggaggaaaaggaggagagaactggtcaagaattcctcgaaatgtattctgttaattatagggagaaattaaatgaagttcgattagaattaataagagatttattcaacattcaagaccatatgaaaaaataccaaggagtaacagatggtagaacaattcaggctctgaatgaggaagcattaagaatgagaacagcaatgaaacacagaagaaaaaatttgaatgcttttaacaaggctgtattgaaaaaagatttacaaatatcagctgaagaatatgagaggacgagctatgaacaaaataaggattacgttgagccattttttgatagtcatccaacagattactgggaacatattcataaaaaatatgaagggcttcaagacgattacaaaaaaattcgcgaattaagagagcaacaacaatttttaactgatgaacagaaaaaacagtcaattcaggatgaaattgatcaacttcgtcgtcttgtcgattataggaaaaaaagatttgcagcgttagagtatgaagctaaaaagagggacgcactccaacaacaaccaatggctttagccttgactcatg

SEQ ID NO: 75263 - DNA, 1233 bp, Heterodera glycines
  Genomic contig location: Contig_ID=SeqID_11764; Location=2069..3301; Strand=-
  SCN-specific regions: Sequence locations=1-148,170-278,300-319,347 -500,562-662,769-848,946-1005,1065-1083,1105-1122,1144-1212
atgatcagaatttctcggagggtttgtcgtgccaaaatcggccaagaaagtgaataaaatttgtgcacaaaacagacaaattatttccatttttgggcttgaaattcaaattttaagctgatgtaagacggcatcgggattaaaccacattaattttaattaaaaatttgccaattttttgatttatagcatttttttttggtcgaaataatttttaatggattgataaagctttatttttggtgaattaaaaatttggttttatctttaagccgtcatcaatttttacaatttattttccatggaatttcctaattcgatttttttttaaattaaaattttattagaaccaatcggctgcgaaattcgaccaaaaaagtgccaacaaattcactgctgccaattcaacggccaaagcgcaaaaaatcgagtgaaaaggagcgccaacgaaatttgcagatcaaacaatacatgaggacattgacaacactttgtgagcctaattaattagccttaattagttggccaatcaattaattaattccataattaattaattaagtgcccggcgtaaagtcggaaattccgcgcattcgaacgctgcgattggccaaccgatacattgtgcatttgggccgcattttgcgagaagagcaagtgggaaaaattatacttttttaattattttaatgagaattttatttcgcatttaaattaattatttaattgatttatttaattagaaattttttttaatactaattaaatgggaatgggaatttttctatgctttttttgtacattttgaaattaatttttaacatttttggggatttttatgcgaaatgaaattaattaaattttcttaaatttgtttaattaaattttaaatacatttttatatatttaattactttttatataattattaataatatttttaaagattttctgcgagcaaagccaaacgtggcgccgtttaaccattgaaggtgactttttggcaaaatttaaattttccaaaaaaaataattaaaattaaatcaattttaaaatttatttttcctattcctaaaattaccttttatgttttttcagattttgagcgcactgttagcgaagaaatgcaaacatcaaattcgtacaaagaacgtgccgagatggaaatgatcagcagcggtgccgaaatgacaacaacagcatgtgaatatgagaaaaataattaaaaataaa

SEQ ID NO: 75264 - DNA, 297 bp, Heterodera glycines
  Genomic contig location: Contig_ID=SeqID_11765; Location=421..717; Strand=-
  SCN-specific regions: Sequence locations=1-69,95-131,160-175,213-297
atggaaaattatgacaattttttgcttggtcaatttgtccatgacggtaaaaacaatgaattttcaatgttaaataaattttatttaatattttgctaattttagacgtcaaattttggtccgcttctcgagttccctcctcctcctcttcttcttctcagggtcattaaaaaaattaatttaatttaattaattaaatttaattttaattttgtcttttccaggcttttccgagtgccatgatcagaatttgtcggagggtttgtcgtgccaaaatcggccaagaaagtgaataaa

SEQ ID NO: 75265 - DNA, 1567 bp, Heterodera glycines
  Genomic contig location: Contig_ID=SeqID_11767; Location=39..1605; Strand=+
  SCN-specific regions: Sequence locations=1-259,282-627,650-682,704 -933,958-1085,1169-1409,1431-1567
atgttggttgcccattggttggtctgtggacgagccgagcaacgggctgacgaactgatcaggcgtagacaggtgggtcagttttagccgtggtttgtgcacaggattctgatcagacacatagacagacgcacctgagactgtttgaatagccgaacaaagaaacataacggggtaaagctgatcaatcgtctaaagttagacacgcgatcaacttgaaggggtctgcctgcatggtggcataagattactgatctggtgttgattgcattgcgcacaacaatgtgctcagatagtggggtctgctctgatcagtttcatatttgatatcgttaatcaagtgtccttgtcttgtaaataagcaaaatttgagttcaggaaaagaaaagtgtgcgccgaatgttgcatggtatgatgggcgatgtgagcaaagtttacggtgagaatggacaaaaaaaaaagctcgagatctcgaggatgttatgtcattatcacactttgcttgtcataaatatgctgccctgttctgtgtgcaggtgttgatccaactgcacagcatcgccgtgaactgcccgcacttgacatccctccgggcctttcctgcgccctattgctgctcgcttcggtcaccgccgtgctggcactgctcaattggttcgtcggtctctactttgccatcaagtgagaaacatgcaacaacaacaaacaaataactataattaccgtaactttctgaaattgagccccccgggggctttgtttctcaacccccctcaaaaggggggctctaattcaggggcggctatattataggtaaaaaaaaaacaaattctttctgtgttgcagttatgatttgatgatgccgtccgtgttggatgattttgtcgaatgtgttgcctctggctgtcagctgattttattcggaacggtcggtaaaaaaaaaaaaaaattttttttcgactaataggtatatgtgttacaaagagttgtccaagagtcatgaatggcattctcactgaagtgcctgttcccctgatctttttcttcacagcaaatctaaatttaaataaaatccaagtttttttacaagaaagtttttcaagaacaaaataaattggaaatcaatagttttttagaaaatttttgaaaaaatttagtaattcatcttaaaatttgactccttctgtgttttcagctttggtggtggacccgacgagtgatcactttcaagcgatgggacccgcaccacaaggccgagtcccggggcgatttggtgctgatcggcggcagtgccgcctttatgactgtcaaactttttctccaagtaaaaaaaaaagaagctatatccaattctttcctcccccccccattttttcaggtgcttgagctgaattttcaacgcattgacggctttttgccattgtctgaggccatcttgcgcactgcctccctggtgctcatccaatccgctgaatggctccaattttgcagtctacaacgtgtgatggcactccatttcgagtacagcttcggggaccagcagcagggctgcccatcacttaattag

SEQ ID NO: 75266 - DNA, 1162 bp, Heterodera glycines
  Genomic contig location: Contig_ID=SeqID_11769; Location=373..1534; Strand=-
  SCN-specific regions: Sequence locations=1-65,97-364,386-525,548 -642,668-672,694-731,760-772,807-852,899-1010,1032-1162
atgccatttaactttgccctcctccttccactgatcagtgtcatcctttttcaatttgtgcaccactcctcatcctcctcctcctcctcttcttcccagataccgacgacaattcccgatcaatttgagctaaatccggccaaaattgatatttttcttcgtcgtactgcactgatggctttgttgagggtaattaaagtacagtgttataaaattgttaggggccagtgagggattttttgtcgatacaaatttgacaaagtcggcttgtgggtctaatacctgaaatttttacggtgccaaaattccgcggcgaaaattttgcgccttaatttttaacgcaatttaaaaatcccaacagttcaataaagcattgatttttaaaggccaaggcaaatactctcatggacactgttccattggttgaacaagtgttgttcaagcagtgtgtggccgagtcaaaggaggcaatatgtccggtgaagttggccaaatgcttggccaaattgatacggtccagccgggaccaacaacagcttcacagacaaaacaaatgggcggaaagtgagttttatttagttgctggatgtggttaagaaaatagccaaaagcctttgtcggagcatgaccaaaaggaatcggaaaattttttaataataatttaattgccccaataattttatttattttttagtttttgaatttgctttctagtttcataaattttatttaatttaccatttcagttgttttattgaattccatcaaaaagtaaaaattatttatttacaatatatataaattttctctttttgatgtaaaattcgattcagtcacgggtcaaaattttggattttttttttgtataataaataattttttattagaaaaatttataggaaatgagtcgacaaaagcagcagaaaaagccagacaaatgttcatttctcaacattcgtcaaaggacaacaatagaaaactgaggcgaattcggcacttttttgccctgtggagacgaagggaaggacgaagaaaacggaaggaactgatggggatgaaacaacggaggcggaagagagcgatggaacgacggacgacggaatggagccggaaaatgaagcggatgggacgaatgggtgaagcagttcggacagcagcaggg

SEQ ID NO: 75267 - DNA, 589 bp, Heterodera glycines
  Genomic contig location: Contig_ID=SeqID_11771; Location=455..1043; Strand=+
  SCN-specific regions: Sequence locations=1-589
atggtctttatgatgtgtcggaatttgtttttgtttttagccattccgtacgatgaaacgccgccgcccaaatttgtgtacacattccaaggccctggccgcggtcggtggaccttctcgtgccaattcacttctgccgacgcgttggacctgttcaggaaggggcacggaatgtaccagacaaagaaggacggatgccgctatttcttctgctcagtgaagcgatgcccgtacaaaatgatcggcattgaaaatggttggtttattgtttttttcttttttgcaatttcaatttgctaattagtatttaataatcagcaagcaaagagcgtttcgtttacccttgggaatttaaaaaaatcagaaacataaaattttcagaaattttcgtataaattttaaggaaaaaaaattttgtacattttttttttgttgaaaagcctagtaattttttttacaaaaattttctaaaattttcctcaattttttcttgattttttcatgttttaaaaaaaaattctgttgtgtgaatagtgtcgaagaggtcaaaacattgtggatgttgcttggaccattttttctcaccaaa

SEQ ID NO: 75268 - DNA, 545 bp, Heterodera glycines
  Genomic contig location: Contig_ID=SeqID_11772; Location=65..609; Strand=+
  SCN-specific regions: Sequence locations=1-268,293-545
atgtgccgtgacgctttctcaaagtgcccccctactgacgccctcccaccaatttcggataaaatgcagaccaaatcgtcgtcgtcatcgcccaaaaagcaacaaaattcgcccaaggccaatcgtccgcgcattgtgctcaaacttcggtggaatgccggcggttttttgcccgaccattcgccgaacgattcaacagcagcgagttcttcgtcgtgtactgctactgcagatgattgtgccaacatgaaagtgccaaaaagcgaaacgcaaccgccgctgccgctgccccaggcaaaattgttcgagttggccatgtgtgtgcaggaaatgaggcaaattgcggccggatggaacctgttgttcagggagaagcggtaagatttttgaaaaactcaagaaataatatcagaaaattcaaaaaaaaattttcaactctttttgttttttttctggaaattcagcaaattgggttttcagtaacgggtgtacttacattttcccccgccggtcccccccccccgcatcgtttccgcaccggaaaa

SEQ ID NO: 75269 - DNA, 2325 bp, Heterodera glycines
  Genomic contig location: Contig_ID=SeqID_11774; Location=513..2837; Strand=-
  SCN-specific regions: Sequence locations=1-134,156-267,291-371,393 -1016,1038-1053,1087-1270,1301-1641,1671-1684,1709-1734,1757 -1766,1790-2325
atgttttgttacaccggtgcgacgatgaagctttgttgtgaacgctttgagaacgaaaagtcgcaacccattcagtcccatttaacaacgcaagtgagcggcgaagtgaccatttcaaacagcggggaaaagcagcgaaccgaaaagagcacaaaaagcggacaaaagggcgacggacaaagggtcaaaccgcagaaggaattggcaagaaaaagcagtgcacaaatacaatcagtcggaacggtgaaaaaggagtccaaaagcaattacccagcactgactcacaaaacaacagcagacccaaatgaaacagacattcctgtaagtagtggaaagatactgtaaaatatactgtagtgctctgagcttgaggggagaggggaatttttgttcaaaacgaaaggagtgctgtatccaagtggacttatctcaagggaaagcacttggggtgaaaccgcaatagcacaccaacaattcggttgtacagcagcaggaagaatccgtttctgccttttccgttgatgtaccaccgtcacaaataccgtcgactcaacaaatggtcaaaatggagaatataatggccaaaaatgagagggcgccaggaaaagattatgcggaaggaaaagcattgaaagaaacgattgagaaagagagggaagacgcggaagagagacgaagccaaaaggcctttcagcagtacttcctcgagaagatcaacgacggatggccatatgacgacaagttttatcgaccaacgaataatgagggtgggataatgtgacatgatgatggaacaaataaacaccaatttagacattttcgttgtaaagaaaagaaatcgcccaatggccattgtccattttccgaactgatctcatgtttttttgccattttaattttttatttgctgttttatttttcaatgcaattgtacatattactttttggttttatggagacagcgcgttactttgtccgattggctttggttttcgcacgcgaaaatattattaattggttaattatgtcaaaaataaaagtgtaaaatttcgatttaggttcttttttcgttaaaaataatttagaaaaattttgactgtattttgcagttcatatccatattcgaattaattcaaaacatcgatgaaaacattgtttggcgttccgaaaacctcgactaaaaagtaaatcttaaaaaacttatattgttgccatttcttcttatttctaagaatctgattaggtccttgaaataagagccaacgcctccataatttttaatattttatttgtttttttagaagcgtccaattaaaagttatatttacgaacaacaaacaacaatggggaacaccgaaacttcattgggtatgttgtggtatacaattattgttcaacaaatgcttcttcggaatttaaggagaatttggcaaaaccgtcgtcgaactaaccacgaagagttcgaccaccggagaggaattagactgggaaaaattgcttccaattaacacggcgaaggacctttttatggcgctacaaccctccggtattcgtgatctgcgagacggacaaccaaatgtctgttagatttattaatcaaaagattttgtaatactactaatcacccctacttatttttcgaaaatatttaaaaaaagatttatttttttcataaagtggagttttttggaatttaaatttactttttattcgaatccgttcagagttcccaatgaaataaattgggtgtcagggttattaccacaattttaatttaatttttgattttcaggcactttctattttgtgttataaagccgtgaaacttttggtccgagccactcagacgaatcccccgcaaaaagagcacagaaaagtcgtacttttcattaaaaattagggactgttaaatatgagtttcttcagatgctcaattgtattcggcttctcacccgtctgatgccatttttctttgagcaaaatgagtggcgcgaattcttttggacaaatcttccccaagatgaaaaagccggtctaaacgacagccaaaaagagttacctctttcgaaactgctcctcacggctctctccgaccttttgttttgtccaaattttaccattggtattttggacaaaaacattgtaagtgtcctcaagttgcaagtttcgttctcttcgccgattttgcattgtttagcacttggaaaacatctccaaagtcgacagttgtgagaacatttggcagtccggcgtcggatttgcaaataaaacaccgcaaagtgctgtttacgatgcgaacagaacggaaattctgaaattgctgct

SEQ ID NO: 75270 - DNA, 172 bp, Heterodera glycines
  Genomic contig location: Contig_ID=SeqID_11774; Location=4328..4499; Strand=-
  SCN-specific regions: Sequence locations=1-172
aaaatggaaaatgctcgacggatgggaaaatgaacacgaagcaatgcaaggtggggacagaagggtgggaaagggcacatttattggccaaattttatgtaaaaaaagaattttaggaattttcatggcaagaggaccgggtaaaattgccaataataatcagttggaattg

SEQ ID NO: 75271 - DNA, 1895 bp, Heterodera glycines
  Genomic contig location: Contig_ID=SeqID_11774; Location=2521..4415; Strand=+
  SCN-specific regions: Sequence locations=1-27,51-162,184-337,359 -570,592-870,892-1895
atgtctgtttcatttgggtctgctgttgttttgtgagtcagtgctgggtaattgcttttggactcctttttcaccgttccgactgattgtatttgtgcactgctttttcttgccaattccttctgcggtttgaccctttgtccgtcgcccttttgtccgctttttgtgctcttttcggttcgctgcttttccccgctgtttgaaatggtcacttcgccgctcacttgcgttgttaaatgggactgaatgggttgcgacttttcgttctcaaagcgttcacaacaaagcttcatcgtcgcaccggtgtaacaaaacattttcggcttaattggacaaattagccatttaaattaactcaaattaaacatttctttgtgcgggttgattggcttgccttacttcaaaacattcccttttggtgcccaattggccacaacccatcgccgtcccctcggagttcaacacactgaaagaaccctccgggcactcctcctcaatcatttggccttcttcactttccgtttctcgctttccgtcttcgtcgtcaattaattgttttatcatattatcaccgtcatcttcttcatcatccgatagacttggacagcactgataattaaagccggaaaagaaacacgcgtggccaaagccacaaatcgcagaagatgaacggcgtcctgcgcaagagaaggcaattcgacaaatgaattaccagatgaaattagttagtctgctatttgattcattaatttgcgagtctaaagagtcgccagcagggcattccccgccgaaagaattaatgaataaattaatgacccaattgacccggcaaacactgcaacggtttcccggtccgttcgtccatttttggctctcctccatttggacaattaaattggcctccgaattctgtgtaattaatgagtttttaatctgtttgcatgttcttttgtgattctcacccgccgaagaaattgtgaaagaaatgaaaggcaaaagaaaggcgaagaaaatgcaaagggataaaagggaaaaacgcatcgaaaaaagggacggggaaaggcaattagggataatttatcagcaattaaaatgtagcggctttttgaattcctcgcaatcatcagaaagcaacatacgaaagttgcttaaatatgctttcaatcagttaagttttgttccaaagaaatgtccgatcccttttaattgaagcgacggaagggcgggcttttgctgggatttgaccgcccaaaaagagaaacaatgcgcggcgcgcccaaattagagcagccaccaacggattagaagaagcaaagcttaaaaaagtgaaggcgaccgacggacgctcccgctgttatttcttttcacggaggttcaaatttggggggggggggcaaatgaagaaaatggttggattaacggaggaaccgaccgaatggaaagcggcgcctttgaaatataaaagggatttgtaaagcaaaaaaacattcagtgatgaaagtctatgggcaaaaggcaaaaagcggcgagagaaagtgaaacgaatgaaagcggacgaaaatgcctgagggcaaagctttggggctcatatcgccggtcctcccatccctcgctgagcacttccgccactctctcccaacttccgttgctttggtgggtcggctcaacgccaagaatgttcaggacgagctgaagcacaaatggaaaagcgatcatccgaccaaaggagggagggagggacctggtaaatgtccaccacctcaatcggttcgcttttgtagtccgctttgaatgcttaattaattagcaattccaactgattattattggcaattttacccggtcctcttgccatgaaaattcctaaaattctttttttacataaaatttggcca

SEQ ID NO: 75272 - DNA, 543 bp, Heterodera glycines
  Genomic contig location: Contig_ID=SeqID_11775; Location=111..653; Strand=-
  SCN-specific regions: Sequence locations=1-543
cttgtccttctacgatacaatggattggacaaggtaaatggcaaaaaaacaaaaattgaattctggcaaatatttttactcattggcattttcccaaaggcacttcgctcgggcggtcagtcgtcaagtcaaacacgacaagcactttccacggtcgacaattacctgcgaaagatccaagtgatttggcgaactcaactaatccaagcactcatcccccaaaaggaggagttggacacgatggaccttcaccagtcgaccaatttggtggtgctgtcagaccacggactgatggcggtggaggaggaggaccagttttacatcgacgagtgtttggcggacccctccatggtcagacgagtggccaattcgttggcatttgccatggtttggcccatcgacggggaagaggtccttcgtccaatgtccctttattgtataagtgccaccccttccttcaggacacaactttcttcgaacttaaagtgtgcgatcagtgggctttcgtcggcgattacgaaaatgaagagacggcacctttag

SEQ ID NO: 75273 - DNA, 58 bp, Heterodera glycines; identical to SEQ ID NO: 50987
  Genomic contig location: Contig_ID=SeqID_1678; Location=8041..8098; Strand=+
  SCN-specific regions: Sequence locations=1-58

SEQ ID NO: 75274 - DNA, 2056 bp, Heterodera glycines
  Genomic contig location: Contig_ID=SeqID_1678; Location=6743..8798; Strand=-
  SCN-specific regions: Sequence locations=1-52,89-121,153-334,391 -722,785-890,933-1078,1113-1256,1278-1291,1313-1329,1351-1367,1389 -1405,1427-1509,1532-1643,1666-1750,1853-2056
atgttttttatgcaaaaactcgttctgattgaaaagaaattggtaaaaaaagaagctatttttgagcttttcatgtgataaaatatttgcaaaaaaaaaaagttttaagaaatatgaatcagggccctaaatgattttttaattattaaattcattcattatgcataaatttccgaaatcgcgcagttgggcgcgcacggttgggcggcgccaccatgcttttccactataacttttttatttgtcaaccaaatccaacaatcttggtatcattcgaaagctcttcatatgctctatcagggcttacaaaaaaacaaaacaaaaaattccttgcatataaaaagtttttaagaaaaaatttcaaaatttttgatttttttttgtaattttcgaatataacttttttggtaattgtcaaatcacgaagcaatattttagaaaaatttttaaacatgataagctttcaaatgataccaactatgttggatttggatgacaatgaaaaaagttatagaaagttatagcgaaaaaaacatgctggagccaaaccgtgagcgcctaacttaggtaaatcgtaaatttcgcgttttaaatgcatattttagtgaattttttggcattttttcaaaaaatcctctattaaagcggcaactctaaagaccgaaaatttttcaaaaagcttgatttttatgtgcatctatgtagaacataaaaggtaactcgcccggtgggactcgaacccacgaccccagcaatccgtgccgtgctctaaccaactgagctacgggcgcctcttttagaggttctctcaggtcctttatcccactttctcccacactccgttccttctggcatcacatctaatatttattaccagccctaattaccagtttaaatatgtaatttttaaaaatatttttattttatttaaagattttcgacaaaaaccaacagtgctcatccccaaaaagtgctgatctaatgggcaccggtgaaaaagctgctgacgtaaaatgggtgggatctgattctgttgaaaaaaggaaacggactttgcacagacgaagcaaaagcattgtaaataagattttaaaaaaataataataataattgtgccaagtattactgtaatcacagtactctattagcactgtatgtcagaatatcttctcttccagccctttttatgaaaattttgaaaaaaatgcactaaaaaataaaatttgatcggactcttaaatttttaggccgaattattaaaattttgatttggacccttaaaattttacggactcttaaaatttgatttggacccttaaaattttacggactcttaaaatttgatttggacccttaaaattttacggactcttaaaatttgatttggacccttaaaattttacggactcttaaaatttgatttggacccttaaaattttggtcggactcttcgaatttttgattggactcattaagttaattgcactcattaagttgtaatagagttccaaaatttctattttgtgtatttagttagtgcatcagttaagcagtaaagaattcgaagccattcaagacctccattacatccaagaaaatcttccagcacttaaaattacggaggtctgctgtttttttatgggaaattttttattttatttttttcagaaaaatctcagcgatgaaaataagccgcaccttccacaaacgctacagacccaggaacgttatgtaattaaaagaatgccatttaatttattaattataccattaaaaattaattaattaattatgacattaaaagttatgaatttatttatttataaattatgccattaaaaattaattaattggtgccttttttaagcgtgccgaaattagtcgtcaaatggcggaggagcattgagaatttatttgcatgtcgttgagatatagtagaaagaaaacgatagagatggtgtttagtcatgtgttatgtttatattttatttatgagggggataaattatggctgtttttttttgtaaaaattgaaaattttctccgttggaataaa

SEQ ID NO: 75275 - DNA, 315 bp, Heterodera glycines
  Genomic contig location: Contig_ID=SeqID_11776; Location=360..674; Strand=+
  SCN-specific regions: Sequence locations=1-117,139-235,272-315
atgatgcccaatattttagaagcacaactgccaaatgactattttttctatattttacgtctttttgccgttaaacttgaccaaaatgcgaaagaaaggcatgaattgaaaaccagaaatttgcttattaatgaaattttagtctcaagactagtcgccctgggtgcaaaattatcacagaggcaggaacttctttcctgaatgcctataatgaaagtgggtttttttaacaatgaataataattttaaattttaataattaattttaaaagaactgggattttatgttgcggtttttacttgttcaatttcaaa

SEQ ID NO: 75276 - DNA, 1703 bp, Heterodera glycines
  Genomic contig location: Contig_ID=SeqID_11778; Location=243..1945; Strand=+
  SCN-specific regions: Sequence locations=1-3,25-462,484-1035,1057 -1303,1366-1703
  Gene Ontology: Mol. function=polypeptide N -acetylgalactosaminyltransferase activity; Cellular component =integral to membrane; Biological process=O-linked glycosylation
atgtcattcattcatccattcttcctccctgaaagatggtttatgaatgtccatgccagcgacaaaatttccttagaccgttcgctgcccgactttcgcttgtccgagtgcaaaggcattgcctatgagctgagtttactcccccggtaaatatatttagggtatttgcactccccaattcatttaattgaagtgcttcggtggtgatcatcttcaccgacgaagcctggtcaccgctgatgagaacggtgcactccgtcgtcaatcggtcgccgcccgaactgctcgaggaagtgctattggttgacgacgcaagtcaaaggggcgagttgcaggaccaacacgcaaatggacacgctttgagttctcttcagacgaactcaaggacaatttggacgcgtacatccgacgatttggaggcaaagtaaagcttttgcgcaagacggaacgccagggactgatccgcgcgaaattgtttggcgctttgcattccaaaggcgaagttgtggtttttttggactcgcattgcgaagcaaccgacggatggtgcgcttttcatttaatatgccaaatttgacgaattctgctcaaattcaccctttccctgtgccatcatttgccattcgcaggttggagccgttgttggcccgaataaaggaaaagcggtcggccattgtctgtccgtcaatcgatcacatcgatgccgaaacactttccttcagcggctcgtccgaactcggctccattgggggcttttggtacgttgtgcactttctgtttgcctcatttgccccccccccttttcaggtggagtttgcattttcggtgggatcgaatccccggccgaattctcagcgtgcgaaagtcgagaaccgatcccattccgttggccaacttctgtctgtttgcttttatcatcttttcttcacttttagctcaccgacaatggccggcggactattggcagccgatcgcaattatttcctggaaattggcggatacgacccgggaatggacatttggggaggcgagaacttggaaatctcatttcgagtaaattcccgtcctttggctataaacagttgcatatcgttcttacaattagaataattctggtcatatgcaaaatacaaaatcaatgttttcaacataatcggaattatttatattgaaagatatgagaggaaattggcaaggcctccattcttcgttcacatctttttacttcccctgccatctctttccatctaaattttcaattcacaatcagcatcatacttaatgcaaatgagccaatttacaaaaaataaaattaaaaatgcacaaaaattaaatgaaataaattaaatataataaaaataaatatttttgaggtgtggatgtgcggtgggtccatcgaattcgtcccctgctcccacgtcgggcacattttccgtgccggccacccgtacaacatgacgggccctggcggcaacaaggacgtgcacggcaccaactccaagcgactggccgaagtttggatggacgactacaaacggttgtactatttgcaccggagcgacctcaagcacaaagacgtgggcaacctcgagggacgaaaagcgttgagggacaaattgcgatgcaaaagcttcaaatggtacctggacaatgtgatccccgagaaattcgtacccgacgaaaatgtgaaggaatacggagcg

SEQ ID NO: 75277 - DNA, 170 bp, Heterodera glycines
  Genomic contig location: Contig_ID=SeqID_11778; Location=1615..1784; Strand=-
  SCN-specific regions: Sequence locations=1-170
  Gene Ontology: Mol. function=polypeptide N -acetylgalactosaminyltransferase activity; Cellular component =integral to membrane; Biological process=O-linked glycosylation
acaaccgtttgtagtcgtccatccaaacttcggccagtcgcttggagttggtgccgtgcacgtccttgttgccgccagggcccgtcatgttgtacgggtggccggcacggaaaatgtgcccgacgtgggagcaggggacgaattcgatggacccaccgcacatccacacc

SEQ ID NO: 75278 - DNA, 436 bp, Heterodera glycines
  misc_feature (31)..(31): n is a, c, g, or t
  Genomic contig location: Contig_ID=SeqID_11779; Location=59..494; Strand=+
  SCN-specific regions: Sequence locations=1-436
gcaaaaacaaagcggtgaccgtcgttaaagncctcaccacttgcggtcagtcgcccgggcgaacaaatcgatggacaattacaacaacggttttgattgacaaaaggtgtcgacttgaaaaccgcctccaaattcttcgcaaatcgtttcgcctgcggctgttccgtcaccgttggctcagccgacgaattggtcattcagggcgactttaaggtgaaagtgtgcagcccttcccacacattgccattttgttgattgaaggacaaactcttcgtagaaatcccgaagaaatggggcgtcgatgaggaagtcattgaggatttggacgaccaaaagaagtgaccactcccctttcacactgcttgtttttactttaatttatatactaattcattgctttgttgtcgtgccgaaaagataaattttaattcattta

SEQ ID NO: 75279 - DNA, 1788 bp, Heterodera glycines
  Genomic contig location: Contig_ID=SeqID_11779; Location=667..2454; Strand=+
  SCN-specific regions: Sequence locations=1-85,107-357,389-550,604 -848,870-909,942-1275,1457-1788
  Gene Ontology: Mol. function=polypeptide N -acetylgalactosaminyltransferase activity; Cellular component =integral to membrane; Biological process=O-linked glycosylation
cgacaacgccgccggcggaaaagcgaaaggtgccgatggcttctcgctttgttcctttccgtcgtattttttgccatttacgtccttttctatgcctttctgagtgggcggcagcattttggcactgattatttttccgatgggtaatcgtaaattcaaattttgttgagtctttggcataatgttccttctcttttcccctaagtcaccctttgcctgccgaatttgccctcatcgcttttcctgttgacgaacattctctggttggccccgatggcgagtcgcctctgttcacccaccgaatcggcaaatcggcgccggagggccaaccgggcgaaaatggcgcggcagtgacactgacgggggaggaggcggctgaagggcggcgccaaatgagctactggttcatgaacgtcaaggcaagcgacaaaatgtcgctggaccgcgcagtgccggacgtgcggccgtaagttgacggagtcgtgccaaaaacgcaattttcggcaattttgaagtttaggtggccggtaaaaagccaaaaaagtgaaccattttaattttataatttttttgtaaaaaaacatagttgattaaaataaataacacgtcattgttcaacgactctaaaaatagcaagttgaaagggttcctctttgggttttcactgggccacatgaactgaaaaagtgccgaattctcttttcggccaatacgattatagcaatgcccctgatcagcagcagttgatcacttctctttttccaattcccccccccccccaaaggaacgcctgtcgctcgctttcctacgatttggccaatctcccttccgcctcggtggtcattgtgttcactgatgagcccacttccgtccttttgcgcaccgtccattcggtaaggtccccattattttgtccaaatttcttttccattttaggttttcaatcgttcgccaatgtctctgctgcgcgaagttgtcctcgtggacgacttcagtcagagaggtctcccaaatttgattcttttcagaaactcattctttctttcttccagaggagctcaaagctccgcttgtcgcccatttgcgtcgcttcggttcgcgcgttcggctctttcgagcgaacgaacgtttgggattgataagggcgaagatagtgggagcgaaatacgcccgcggtgatgtcgtcgtatttttggactcgcattgtgaaacatcgccgggatggtcagttgggggagatggagaaagaagagataatgaaaccacagagacaccagcgagagaaaatgacgacagttagagagtgagacagacaaaggggaggacagagtggagtgggagacaaaggggaggacagagtggagagagagagataaagaggaagacacagtggagagagagagagttgagggaggagaggtgtatgggagagagagagagggaggggagcgacagatgcgtatgggagagcgcaaaaggaaaaagtgaccaaaattaaaaaaaggctcgagcctctcctccatcggatcaaagacaaacggtcggctgtcgtttgccccgtcatcgacatgatttctgactcttcgatgcaatactcgggcggatcagccgctggcattggcactttttggtcagtgtcaaaaagatgggccagggagcattttctatagtaacaatcttcaggtggagtttgcatttcaaaatggaccccatcccggagagagtggcaaagatgcggaaacacgcggaccatttggacagcccgacaatggccggcggactgtttgc

SEQ ID NO: 75280 - DNA, 2606 bp, Heterodera glycines
  misc_feature (2452)..(2452): n is a, c, g, or t
  misc_feature (2562)..(2562): n is a, c, g, or t
  Genomic contig location: Contig_ID=SeqID_11780; Location=1488..4093; Strand=+
  SCN-specific regions: Sequence locations=1-733,756-2109,2131-2606
atggcggcccccgaatgttacgagaaattcttcgaatgtttacaagtcagaattggtcaactgaacgaagcgaacgacaaagaagtggggaaaatgatttgcacttttcctgaaattttcgctttaagcgatgatgactggaagcagacaaatttagtcgaacaccaaataaataccgcggaaaattcgccagtaaaaatgaaaatgcgcctggtcccatacgcttatcgcgaaaaaatagcagaaatgctccaaaattatttggcaagaggcatcattcgtccgtctatgtctccatgggcaagtcccattgtgattgtcccaaaacgtgatggaacgttacgtttttgtgtggactaccggggcttaaattcaatcacccgcaaagatagttttccactcccaaacatcgacaatactcttttaatgcttggaggacaaaaattcttcagcactttagactttatgtctggatattggcagataagaatggatgaaaattccattgaaaaaactgccttttcgactgagtacggtctttacgaatttacagtaatgccatttggtctaaccaatgcagtggcaactttccagcgatttatgtcgcgtctctttgagggaatgattaatgactttctgttcgtttacattgacgatattttaatcgcatctaaatcctttgatgagcatctgaaacaccttgaagcggtcttttctcgagttaaagcagcagaattaaaactaaaatttgaaaagtgtaatttttgcacaaccgaattaccatttttgggccacatcctcacaagggaagggattaaaatggatgcggataagctaaagcctgtgatggatttgcctatgccaacgaccaaaaaacaactccattctctgcttggttttctgacttattatagaaaatttatccattcattcggcacgattgctgctccgcttttcaaattgataagcgaaaaagctgaattcaaaatcggagaacaggaaaaacaagcaatcgaagaattaaagtcaaaaatcattcgagatgttgtgcttcattttccggatttcgatgcagcacagaatgacctaactaggcagtttataatcatgactgatgcgtgtaagaccggcattgcagcaattttatgtcagcctgatccggagaaacagattaggccaatttattttgcctcaagacaatgcaatgtccatgagtcacgctacagtgctaccgaattagaggctttagccgtcagatttggtgtaaaaaagttcgcacaattcatcactatgattccgactcgggtcattactgaccataaagcactaatttggatgttccggagtaaaaatgagacaggaaattcacgtgttgaccgttggcttcttgagttaagctctcgtttcatcctaaaggtggaattccaaccaggaaagaaaaacataattgctgatgttctatctcgttcgggaaaatcaaatgagagcgtcactgaatccttacaggaggaagacattgcctttattgggaaagttcgagtttttgaactcagtaataatgtcgaagatttcaatgaacaccgggaaaaatggatcgaggagaccaaaaacagcgaaatgcggccaatttatgagtttttggagaaaaaaattatgcctgctgatccgcgaattcgacagagcacaatggacaaatgccatagatttgtgttaattgagaagtttttgcatctttgtgaaaatgacggaaaacttagactctttgttccattatcatttcgtgaaaatttggttaaagaacggcatgaaggaaagtgttcgggccacatgagcgccaaaaaattgtataaacaattggcagagttatatttttggccaaacatgttttctgattgcattcatgcacataatgcatgcagaatttgtgcacatacccgaaatgcacgttcaaatgaacctcccttaaaagtagttcactcatcagaaccattggaattggtctgtatggacattttggacgttgggccaagtcagtcaaacttcaaatatatttgtgttatcatcgatcatttcaccaagtacttggtcgctgaaccaatcccgaataaatcagcagattctgtagcaaaagtatttgtcgaaaaatttttgttaatctttggaacgccgaaaaaaattcattccgacaaaggaaaggaatttatgaacactatttttaaaaaaataagtgaaattcttgggtttgagagatcctttacggctggatatgacccacaggcaaacggtttggcggaaagagtaaatggagttttgattcaaatattaaaaaagtctacagcaagtaattggacgtgggacgaacgattaccatactcagtttttgcttacaatataacgccatccgagtcaacgggtttttcaccatttcttttaatgtttggcacatcagcgnacattccgatggataagatcaccgaaatgaaatttaaccccttatacacaattgattatgaaaattattttcaatttgtttttggaaacctccttaatattcaaaatganggccaacaaaatttggatgagtatcggaaaagaagtaaagattg

SEQ ID NO: 75281 - DNA, 981 bp, Heterodera glycines
  Genomic contig location: Contig_ID=SeqID_11781; Location=1373..2353; Strand=-
  SCN-specific regions: Sequence locations=1-182,207-232,254-254,278 -395,417-594,649-738,786-981
aagaagtattcacggccaaccaggacgggcagggcccgtgcggctacagcaccagccaagtggcactggagacggcgggtgccgcgtcgtccacgccccagcagcaagtgccaaccgccgggggcccgcctggcgctgctggttcaccgtaccctccaaacaccgtcggctgcccgcccgtcggcccgggcaaccaattccccccatacacaaagacgccccagcattcgttgtttccacactatttcggcaacggcgccagcagcacactgccaagaccgctgttctcctcctcattgtggggcgcaagcacgtaaggccggtggcagtgcagaaaacccattacacttaacttagcatgggttgatgggagttcaccagggcttgacaaaattttggattttgctttttaagggtttcgaaaatctttttaggttccattttcgggcttttgttcataattttggctggcatttattctttgtttaatttgcctacctcaatcatcatttacagtttctacgtttgcttgctgatcagtctttttgtgccacaaattccgaactctctgatgctccgtatgtcgcccaaatcaaattttatttttatataaattttttttcaatttatttttaaaattgaatttatccacgctaaatttcagatcacaatgatcaaattgtggaaattgactccaaatatttgtcctgtgatccgatcaacaataaagtgccagtcgaagatgatgaacaagaagaagaggaagacgaagaagaagaggaagagcaaggcgggtactactgtaaatttagtgtatgcctggagcagcaggaggggaacaaatgtgtcagcaaagcgctggattttggagaaatgggaggagcacgagataaagacaaaagcggaccgattgatgagcgaaacgataatgccaaaaagagaatcactgatcaggagtacagtggactcactgatcagtga

SEQ ID NO: 75282 - DNA, 1072 bp, Heterodera glycines
  misc_feature (619)..(620): n is a, c, g, or t
  misc_feature (622)..(622): n is a, c, g, or t
  Genomic contig location: Contig_ID=SeqID_11783; Location=85..1156; Strand=-
  SCN-specific regions: Sequence locations=1-295,336-481,551-999,1021 -1072
atggttgcagaattggaaaagaagtcgaacaatgaatgcaaaggcaagcccatttattgcgcatgtgatccactgcattttgatcacattatgactgggatgtgctgtgacaaaacaacaagctgcgaatgctgttccaaagtatattaagtgaataaatagttaggatttattaattaccgtgcaggaaaacatatttcgggattttatacatttttggtaaatattttggacattttagtaatttttcctacattttttgaggagttaaggaaattttttattaaatgccccaaaaaatcaaaattttgaatttttctttatttattttcataggagaatttctaagaatttgtagaaatttcacgtgaaaattaagttttttattgaaaatctacccctaaaaatttgttttttttcttcaaaaaagagttaccaaaaattctttttaaatactaaaatgtgattctaacaataaggcaaaaaaataaaataaaattttcatctaaaatatttaattataaaataaacattttactatttattatatgcttcaaaattttcatcttctcacccgacaattaatatttcacattagcagtaaatgttcatatgcatnntnaattgaatcaatttaaattactgcaaattatattgcccctcattccaggacattttttgatccatttatttaaaaacagcctataaactagagatcggatcgggcaggggggactaggtcgggtcgttttggcgccgacgttttggtgccagcctcagtttattgatttaaatattcaaatctttgtcttatagtttttttcaaaaacaattcattgattcgctattgaatataatgaaaaatacttttatttaagaaattctaatttaatttcttacgaatataattttggtttttataatgcatttattaatcattaaatttttcagctttttctcgatacaacaactaaaacgaggaaaacggtaaagcatatgtatgtaaattaaaatttacaaatttaaagctggtgctcaacccagcgtcgggaacaaaatgtcaaaaaataaa

SEQ ID NO: 75283 - DNA, 906 bp, Heterodera glycines
  Genomic contig location: Contig_ID=SeqID_11784; Location=172..1077; Strand=-
  SCN-specific regions: Sequence locations=1-190,219-247,290-752,804 -854,896-906
atgaacagagaaatgtttgcacgggtaacagaatttattcatcttacggtgaatatcagtgttattgtgatatcatggcggactcaatggtgcgtgatacatgctgcgaatatttctaccgaagcactgggtcgaaagaacatccatgcaactgttgcacaacggtggttttttacataaaaacagaaacttaaattttaatacattttaattttttagaacaagagaattgcaaaattaccagaggtataaaattgaaattcatttaatataaaactatttttattttgacaattttagcttttcaaatttacaaaatggagtgaagacgacgagtgcaaattggagaccacaaagcataatactgaaagaaatggtaaattttttttttcagtttatctatgtttgaattttcaaaaaataaattaactaaaggaaatcttaaaaaattaaaaaagaaatttattggttaaagattaacgatgtttttttttcaaaatcagaaaaaatttgatgagataaatttaattttttcataaagtataatacaaaagaaattgtttttttaaacagaagactataacctcgcatgctatttcaaagaaggagaaaaggcgtcaaaatgttgcgatgaaaattatgcgctttcaactattaaatccattatctggagaaaagcaagcccgctggaatatgttggttctgctgtaagttacacaggcaaattatttattagggcaggccgagttttcataaaataattaatttaaactgtaatttaaaattatttaaaaatatatattcaatagattcgcagcaaatcgaaaattttgtaaaaaacttcaaaaataccgaaaatttcaataattaaatttttattaaatataaaatatttgcagattataa

SEQ ID NO: 75284 - DNA, 1174 bp, Heterodera glycines
  Genomic contig location: Contig_ID=SeqID_11784; Location=1593..2766; Strand=-
  SCN-specific regions: Sequence locations=1-90,126-135,157-159,265 -788,832-1008,1042-1174
atgattggctttttacggcttatcatttcattgtgcgctatgcgcaacgttttgtccattaagcggatatctgctgtgggcaaagtaatgaatttaatttaaaatatagctattataaaataattcatttgtttcttatttgtatttcttttgtgatagaatttttaaattttttaaaattattttttcgttaatcaaaaataattttttttttaatttgtaggaaatattctagtatatgaatttatttatttatttttaattcaaaaaagatctaattcatcgataaaaaaagaatttttgggattttcgacgcgctaaagacaacaattaattataaatttttcacactgtagccgatgccttggcatttgtttgtgagccaagaatgcaaagaagaagcgcaagttgtgtgcacggaatgtggctgggcaaattgtgtgccaagtgaatataataatgagccaaatgatgtcacttgctgcccacatgttcgaaagagaccgggctcaattaataggcacggtaaagtaaaaaccgtgaataaattctcatccaaagtatttatgtttttcaagaaactaaacaaaaaaattttctgctttgaatgcataatgaaaaaatactatcattgttgaattcgcatttcttgttttaagctaaccttagcatttttagaatatcttcagccttttttttatccgcctgatttggaattgagagatcaaagtgatcttgggttttgctgcccgactaactacgttttcaagtgctgcacattggtacatattaaaacagtatttgcctatgaaagatgattttttattttaagttatctgaacagaaatatacatggcgcggggagcacatggtgagaattcaataggtttttttattaatgaagcagggaaattgttgaaaagccgggacctgcactaccatggactagaaaaagtccgggtctcagttttcaattggaatctggaaaaaagcgacattttttcgtggaaaattttaattttatttttcaaatttaaaattgatattcaaaatgagcattttcttcttttttgcaatagagatttatttataaaaagggtttgaaatatcgaaaattttaaaggattatctgagaaattttgatcaaaaacaatatcaaaaaccctaaaataaa

SEQ ID NO: 75285 - DNA, 638 bp, Heterodera glycines
  Genomic contig location: Contig_ID=SeqID_11787; Location=237..874; Strand=-
  SCN-specific regions: Sequence locations=1-254,276-356,378-612,634-638
atggccaaaatcggaaaggcgtacggaaatgacattagccgagagattacgacagcggaggaattcgcagtgcgaatcgccaaggacaggcgggatcagctgtgctttcggaggggaatccaattgaaaatggaagcggaggaatcgaaggcgggagacggtgggtctaattaccccccccccccgctcaattaacctcaatttgtatttattaggccccaaatcaacgagcaaaaatgcgttttctatgttggcctggtggtttaacgatcagaagttcactttcggttactttggcttcaaattggccaatttggccgttgtcctccttcagctccatttgttgaattcggtgaatttaatggaatttccattttgaatgacctcatatttagtattttgggcccgacgatggccaattgtcgtccccttgggcactgaatgccctagccaatctttcggccgggcgcgagtcgccacattttccgagagtgattttatttgctcagtttcgcccaaatgcgttggcttttcaggtgactttctgcgatttgctcgtccgtcctccccagcgcgacttaaagccgcttcgcctcactttccaatgtttgctgaacatgaacactctcaacgagaag

SEQ ID NO: 75286 - DNA, 790 bp, Heterodera glycines
  Genomic contig location: Contig_ID=SeqID_11787; Location=1018..1807; Strand=+
  SCN-specific regions: Sequence locations=1-270,292-480,502-634,656 -681,739-790
atgaaagggacccatctaagaagaaaaaaggtcagcggaaaagcgattaatggcccactggtaaaaatgcaattggcgatggtcgcggtcgacccgacggatgggaaagcgttcgttgaagccgacgaagtaagtgttctccacgaagcaaaagccgtggatgtaattcagccaatgctcacgcgccatctccgccgggggccaacacttaacaaatcaatcaatgccattattgggtcattggtttttaatggtctcagtgattaatctccccgccgccccttttcttttgcccgatcacctccaccggtcggccgaagtactgcttgagcccgtgaagcccggccatggacagaagcacagccggtgccaaaaggtaatggagacggtcggcacaatcgtcgtcatttcgggaaaggatgcgcaattggagcgcactaagcacttttaaagcggtggaagcgggcatttgggaggaatgaaaataaccaaattaaatgaaaaagattaagcatccaactcaaattaatatcgtatggttattttgtgcgtttttattcatagaaatgtcccttcattcccttacaaaatcagacaaaaatgggttgaaaatgacaataatttgaagaattaatataattgttttttataattaccaacattttaatttacttttgcatgtatttaaaatcattaataataaattaaataattttaatattatttaaaaatattttagccttttccctttaaataaccgaaaatttttttttgtgtaaaaattgaatga

SEQ ID NO: 75287 - DNA, 885 bp, Heterodera glycines
  Genomic contig location: Contig_ID=SeqID_11788; Location=520..1404; Strand=+
  SCN-specific regions: Sequence locations=1-197,229-885
  Gene Ontology: Mol. function=translation initiation factor activity; Cellular component=eukaryotic translation initiation factor 2 complex; Biological process=embryonic development
atgcaacaaatgatgcaatctgccacaacgccggtcctttcgaccggaggcggaggtttgggcaatacgcagtttctttatgagcgccaaagtgcgttggggagtggcacgatgggaagagggacgggcggagaggtagcagtagcgagccaattcaccactacactacaacagccgcaacagcagcgctcactcgtccaaccccaacaacagcagcagctgcaacaagcagtcacaagcggtacaccgctgcaaggtgtgaccgaatgcaattcggacaaaaaatgaaacggaagcaagacgattagccttgggccaacatttacattgttaaaaagcaattcttatccacttttttcaagggtcccaattccaatgccctcgtcgacccaatcacggcactgaggggagagcaatacttttacgtgcaaatcatttcaaagtcaaaattcccggtggatttattcattactacaatgttgacattcagtgagttttgttgttgtttaaatgccattttaacatttttagacctgacaaatgcccaaggaaggtaaacaggtaaatacaatataaatgaacttcatttaaaagctaattttagagaaattgtgaatcggatggtggagtcgttcggtaaaatattcaacggaatcaatccagtttttgacggaaagaaaagtatgtactcgaaggatccgcttcctattggccacgacagagtcgaattggagggtaaactatttttcatctttgattatccctcatgaacaaatttcagttgtcatgcccggtgattcggcggttgataggaaattcaaagtcgctatcaaggtcatcatcattcattatggctgctctatttatttattatgcgcttgctag

SEQ ID NO: 75288 - DNA, 937 bp, Heterodera glycines
  Genomic contig location: Contig_ID=SeqID_11789; Location=512..1448; Strand=-
  SCN-specific regions: Sequence locations=1-761,783-937
atgaagcgaaccaacgcatcaaacatcactccacctcgcgccaaacgtgcaatgccacctgcactggacctggaccaaaacactgccacactcgaagagcaagaacgccaacgcaccctggtcttcattggcctcccggaaagcaatgccatccgcccatcggagcgtgttcaggaagacagggaagccatcacaaaaatcctggaccatcttgaagttgaggcccaaccaacggccgtctttcgactcggacgatacgacccgcagcgaacaacaccacgcccgctcaaggtggtcatgccaacgcccacacaccaacatgtggtactcggaggatggaagcgcgagcgtgctcggctccgttcccaacagaacctgaaccgtctgttcgtccgtccggcgctgtccaaagaacaactcaaagaggaatacgaagcgcgtctccgaaaacgtcaacaaaacccagctccaccggcacctccaacccagctcccaaaaacgacaaatgaccagacacccgatgttgctaaaggaccaaaccagaacgaggccagtgaagacgtttccaaaccaccggatgtttttgaccaaacaatcctcgcatgttatgaagcattaatatcattgccacccaccgacaaaattattcaccaaattcaatcgctcaaaaaacaataccctcatctttttaataaatagttctgtcagacctccaaaatatttcctctaatcaaaaaaaaacattttcttccagtacttccaatttctcaacaaaattttttcctcaaaaaaaatttttttttttctaactggaagtctgactatatgcttctcgaaattcaattgtattttttcatctatgcatttatctttcctcattttcatcaaaagtgtaagtgcatatgcctttcttttggttattttatttttgaataaa

SEQ ID NO: 75289 - DNA, 604 bp, Heterodera glycines
  Genomic contig location: Contig_ID=SeqID_11789; Location=845..1448; Strand=-
  SCN-specific regions: Sequence locations=1-604
atgaagcgaaccaacgcatcaaacatcactccacctcgcgccaaacgtgcaatgccacctgcactggacctggaccaaaacactgccacactcgaagagcaagaacgccaacgcaccctggtcttcattggcctcccggaaagcaatgccatccgcccatcggagcgtgttcaggaagacagggaagccatcacaaaaatcctggaccatcttgaagttgaggcccaaccaacggccgtctttcgactcggacgatacgacccgcagcgaacaacaccacgcccgctcaaggtggtcatgccaacgcccacacaccaacatgtggtactcggaggatggaagcgcgagcgtgctcggctccgttcccaacagaacctgaaccgtctgttcgtccgtccggcgctgtccaaagaacaactcaaagaggaatacgaagcgcgtctccgaaaacgtcaacaaaacccagctccaccggcacctccaacccagctcccaaaaacgacaaatgaccagacacccgatgttgctaaaggaccaaaccagaacgaggccagtgaagacgtttccaaaccaccggatgtttttgaccaaacaatcctcgcat

SEQ ID NO: 75290 - DNA, 235 bp, Heterodera glycines
  Genomic contig location: Contig_ID=SeqID_11789; Location=1740..1974; Strand=-
  SCN-specific regions: Sequence locations=1-106,128-235
aaattcacttttatgttcgtagctgtacagaatgaccattctttgatattccaatggtttgtgaccaaatttagcatgttttaatcaatttaggaactaaagtgagaatttttaaaattttgagttttagactttttgttcgaattcgggtccgggattcgaaattggtccaatgaaggtcatattcgtgatcagcgaccctgaaaacccccataaacatgtttccaatactttc

SEQ ID NO: 75291 - DNA, 2138 bp, Heterodera glycines
  Genomic contig location: Contig_ID=SeqID_11790; Location=301..2438; Strand=-
  SCN-specific regions: Sequence locations=1-49,93-276,318-399,421 -576,598-598,624-1193,1215-1303,1336-1403,1425-1469,1494-1547,1569 -1915,1937-2018,2041-2138
atggtcgtcggacggcacacttttgtggcggatgggcaaaacgcaacggcacaacaacaacatcatcatcatcagcaacatcaacaaaagccaattaataatatgccaacgggcaaaaatgttattcttcaatcggcggacgaatcggcagcagacaccgcctttctccaggaattgtttatgaaggtaaaattgggaaaataaatcggaagcttttaagcctcgaaaacatcaacaaaaaaaattcaaaattagttttatattttgtatttaaattgaaaaacccaatttgggaaaataaaaatattttccaaagaaggaaaaatttttttctagtctgagaaattcggaggcttcggcctcgtaaacattaaaaaaataaaatttccaattttacataggacaaaaaagaagaagaaattttttaatgtatctttaagataatgaatttttttatgtaccatcatattttcagcatgtacctgctgcacaaccatcgccgccaatgccaaatgccgtcgtcgctgtgtgtcaaaatgaaatgccaaaaatggcggtgatggtcaaacaggaggagccagaggttgtggaaatggatcagcaacaccaccaacagcagcagctcaagtggaaggcgaacaacaccaacaaccagaacaacaacaatggcacaacgacgggcaacgaactgagcaatggcactagccaagtttacctgtcgtacaaccaagtgagtgccgtcgtgggaggtgagagagttaagcctggggcaattttataaaaatcagtgatcaatcaatgtgaagttttttcgtggtattatgtcccctattgctgctgctggaccgaaaatttcctaaaactcgaggagacgacgaaaaaaaaacccgcgacttttttttgagtctagactcgagaccgagattcttaagtatctctaatgtatccaaatcccttgcagatcaactgcctggagaatgtgcaccgtctgctgaagagtcagtcctcaaatgggtcggctgcagacggcgaaccgtgcggcggtggcaaaatgccggccgactcagcgccaccatctcaaccactgccgccgtcgcaacttgtgccctctgcgtcgccgccttatgcgacgactgtcgccgctgcggcgacgacaccgtcggcgggcggcggtgtcggcacagcattgacgcgtgaattgctccaactgcatgaccagcgttgggaggagcggtgccgtgcgcactggcgacgccggctcagccaacagacgacgacagtcgtggcggcatcgccgcggtgccatcaaacgcagcagcagcagaagcagaagcgaccgttaagtcaggaacaggtgtgtttgtggaatggtatgacatgcttttactgcttgaaaatgatggcaatttccatttttgggccaatttgtccattttttcacgcaaaattgacgtttaaattaattcattgcaattttaaattttccatttttagcctggcaatttcgcgagtcggtctccgcctggtgtcgccgattggcaccatcacccacaacagcatcaccatcatgttgctaagttggcacggtgccgaagtgagcagcggcgcagtgcatggccaatgcaggcagcggttgcccaatttgaggacgaagtgagattttgatgccacaaaaagtcgcacatttggagaatttctgcttatcggatttccgcatacacttaaattttggcttcatctctctaatttcggattaacataaaaaccccgttttttagcctcctctttcggcatttaaaaagaaatttctccaaattttccatttttcccaaattttctattttcctcaaatttttgtttttccccaattttccgcgtatattttagctttctcccctccacgctgtgccaccttctgctgctggtgccgttgttgcccacaatgagcagccgccatgcggcggtgcgttaccacccactgaactgatcgcactgatcgctgccgtgctgcaaaatgtgccaccgccgtcgccgcccgcggaaaccgccaaaattggcattgttgcttccccaccgataatgaatgacagcaacggcacaccgctgggactgcacccgcaactgctggaccaactgct

SEQ ID NO: 75292 - DNA, 149 bp, Heterodera glycines
  Genomic contig location: Contig_ID=SeqID_11791; Location=1165..1313; Strand=-
  SCN-specific regions: Sequence locations=1-149
gtcagaagatgcaaagataaagaagatgtctcataatcgtgatctgtattatttgatgtattgtacatttgtatgcatatatcatttgctgtgtattatcactttatttccatctgtgttccgaaataaattgaattgatggtcattaa

SEQ ID NO: 75293 - DNA, 585 bp, Heterodera glycines
  Genomic contig location: Contig_ID=SeqID_11792; Location=758..1342; Strand=-
  SCN-specific regions: Sequence locations=1-585
agtgccagccagccttcaactcaacgcaacatcaacaccagtgcgcgccaagctcatctacacatttcgtcgcgacaactcatcacttcatcatgagcgacatgagcgcctacatgggatccggccccgccgagcctgcaccgtcgtccggcgccgcggaagcctcttcatcgtcaggagtcgcgagcgcctacatgggatccggccccgccgagcctgcaccgtcgtccggcgccgcggaagcctctccatcgtcaggagtcgcgagcgcctacatgggagcctcgcccgcgtacgagccgccagcggttggtttaagggggacacgggagcaaacgcatcactaatcttttgtttttgcagccggagaagtccccggatcagagcgcctacatgtgagaagatgcaacaacgaccggcggatggatggacgaaacctgaagagcgagcgacctgtcagaagatgcaaagataaagaagatgtctcataatcgtgatctgtatttattgatgtattgtacatttgtatgcatatatcatttgctgtgtattatcactttatttccatctgtgttccgaaataaa

SEQ ID NO: 75294 - DNA, 1078 bp, Heterodera glycines
  Genomic contig location: Contig_ID=SeqID_11793; Location=1659..2736; Strand=+
  SCN-specific regions: Sequence locations=1-376,398-681,703-705,746 -1078
atgccgttcgcgactcttcccgaacagaaccaaccaaatttcggcggttgtgaaaacgcattcattcagcagcaacaattgacggaaaatgtattgaatcatgttgtgtccgagcaacagttaaagggaatattgatttattccaaataaataaagcacagaaaattgggaggtcaaaggacaaataataaatgcagataaattaaatgacaaatgaatggtggaaaaagcaaaggaaggggaaacaattccatatttatgggcagtaaaatgggcgggaaatgtgggcatttaaaattcaaaatatccacttaaacactacaaatcaggtagaggaaagagtagcagaattcactttcaaatgtgaaaaaaggggaagtcacagtgatcccaaaacacaataaaattttcaaaaaatgactcaaaccacgggaaacgtggcctcggataattttttgcttgtccgggaacaccccttgccgataatttattggaaaataacacttaaaacatttcttcaggccgatctttcttccattccgccaccaactccccaatcgcaccagaaattcggtagcggtagcggcggcactctctcggaaaccggcaaccaattaccgcgttccaccgggcacaagcggatcaaaaaaaccaaaccaaagggcgaagaactcgcgaagaaggctaaagaaaatgtaagtggagtttagttgctctccaagtctttttggtgttttttaaagaattataaaaaacgaaaaaatttcctataaattttttgtcacaggtgccgccgccttttggtcctccgaatcagctaccacagcagacaattggctacgttcctccggccacagaaccaaacaatttttttccaaacccgaacctcgcgtggcttcaagctttggcttacgctcggatgaaccccggtgctggcacgtcgacttcggcgtacattggaggaacgatgccaacgactgtttggcagcagatgccgtactctgctgccgacggtatgccttcatcgaccgcagcgaatcaccatccgatgacgaacattcaatcggccagcaattag

SEQ ID NO: 75295 - DNA, 1683 bp, Heterodera glycines
  Genomic contig location: Contig_ID=SeqID_11793; Location=2790..4472; Strand=-
  SCN-specific regions: Sequence locations=1-987,1009-1240,1262-1683
atgcagcaaatgcggaagagtcggacattgggcgatcgtgtgcaggacaaatggaggcaacaaaaattcgtcaagacggaaagtcgaccatggaaaggtagcaacagggtgaagcaaatacagctgcagtgcggtgctaagccactagcaatttcgagtttggagcagaagtcggccaaaactgtgactgttccgccgagcttcatccaactcaaagtgcatgaaggaaatgccgattttgaattggacagtggtgcagatgtatcaatcatcagcagccaagattggagccacattggaaagcccgaattgaagcaatgccaaggattaatggcttctgggggcataccgatagaaggcgtcctcggcatggccaatgtaaatgtggaatacaatggcatgtaaatcaacacggatatttatgtgttaaaggaaataagagtaatttgtgcggtcgtgatttgattcgcggactgcgcattgatttgaacaaagcattcggcattaacgcaatccaaatcggatccacgaataatgatcagaaagaggtggacaaaattctcggaaaattgaagtatttcgagacgaattgggccgatgcacccgtcaaatttcattgaaattcaagcctggagtgcaaccaaaaaggtgtaaggctcgtcctgtaccatttgcgctcaaagccgaagtggagaagattttggatcagtgggtacagcagggagtgctggagccgatgaacaacagtgattgggccacacctttggtcattgtaccaaaaccgaacggaaaaattcggctctgctgtgattacaaagtgaccgtcaaccaatggttggacgtgcaccaatatccactaccaagaccggacgacctattcagtgtgctaaatggcggtcagaaattttcaaaagtggatttgaaagacgcctatctgcagctgatgttggatgatgaagcaaaaaagtgtttggcagtatgcacgcacaaaggattgttccaatttacgagacttccttttggcgtagcgtcagcaccggcgattttccagcaggtcatggacgaaattttgcaaggaattgaaggagtggcagtgtatctcgacgatatactgatcacagcaccaacacaggcagaacatctttgccgaattacgcaggtgcttcagcggctcaaggcaaatggacctgagagttaaacgggacaaatgcgaatttatgcgtgaaagcatagaatatttgggacaccgagtggacaaaaacggagtacatgcttcagaggaaaagctggaagcaattcgcaaaatgccaccgccccaaaatttaaaggagcttcaatcctttttaggtatggttaattattatggcaaattcgtgcccgcaatggctaccgtttccgagccattaaaccaattgcggagaatggaagaaaagtggcattggggaagtgaacagcagaaagcatttcaaaggattaaagaaattttgtcatcaaccgaagtgctcgttcattatgatcccgaaggtatccgttaacgatggttaaatgaatgtgagaaaaaatagtattgagtgcgattaaaagtttaagattaaatgaaacatcaaacatcaaaaaaccagcataattaattgtccgcgaaatgtgcgccagctccgttcccgttggattccttaaaataaa

SEQ ID NO: 75296 - DNA, 562 bp, Heterodera glycines
  Genomic contig location: Contig_ID=SeqID_1679; Location=1441..2002; Strand=-
  SCN-specific regions: Sequence locations=1-562
atgggaagagagggaaaggggaaggcactttattactccccagggacgccgacgagttcatacgccgaagggcaaaagtcgcgcgacggcggcgaagcgacgagcgaagccccgacaatgctcggtaattaggggaggaaactgattgactggaccattggcactaattaattagtacaataacacgtcatgcaatttgttagacactctgtgcacattaatcggcgaaattggcaaattgcgacgagaaaatcggcgcctccgtcgccgattcgaagtgcaacaaacagtcagtcattagcagtttcaattaatgttttgagtttttctgattcatttgtaatttttgcccaatttttaggaggaaaaccaaacgcagccgaaaaatgcgcgcggagtcagctcattgccgcgcccttcccgttcattggaggaaatgcatctggggtgacgacacttctcattaaggaagtttggacgcttgggactagttgaagacatttttttaattttggaaaaattataatttctgaaaaaagttcgaaaaaatttaggaaataaa

SEQ ID NO: 75297 - DNA, 1796 bp, Heterodera glycines
  Genomic contig location: Contig_ID=SeqID_1680; Location=307..2102; Strand=+
  SCN-specific regions: Sequence locations=1-47,75-550,572-697,722 -1567,1589-1796
ctacgaatcgaagcaaattgaacggatcgaaatgctaccacagtctattaccgaaatgatttttgataaagttggcaaagatggatcatcaaaaatagacaaagatggattgcaaactattctttcaaacggcacaggccgtgcttttaatccggacacgtgtaggcttctcattgccctgtttgacttcaaccgcaacggcgtgattgatcggaatgaatttggtccgctttggaaggtaggttattcttatagtttttacctttggcttatcgtgtagcttactgctaacacatttctttatctgttcattttagtacgttgaggaatggaaggcctcttttaaaaaaatagcaggcgataatgagctgtcaattggcgttgaacgacttgaaattgctctaagggaatacggtaggtatttgtcaccgatattattatttcagatgttagtttataggctaccgattttctgccgacgtttattgtgaattgttgcgcaagtatgatcgcacaatttcaggtaaaagaccagagctgctgtttttaaaataatcttgtatttaaattaagctcggttgcactttgacgattttatacatctttgtattgtactgcagcaattgactacaccctttcgtgatcgggactttggccaaaaaggacggattagtgttggtaagtattattcatcaaaaaataatttttctaattttttctttaaggttttggagactacatcgctatgtttttatccacaatattataagatttttgcatttgatattaaaatttgctcccatctgtatttttattgttcattggcgtgacattacgcatcattctttactctcggttcagctgtcgctataatcgactttgagctcattttcagcatcccagtccgcttttccctgtcgctattctttccactcagtgtacgaagatgaacagaaacaacctgaaacgattccaaatcaagcctctttcggcagagtccaaaggctccgaggagcagccaacttcacgcacgaaaacgcttagcgaagtcaaggagttcgactcggctggcactttttttctgcgtgcaaagcttgtaagcgtgttgttttgcatttacaaggtgagatggacaataaatccctgcgaatatactcttacatcattatgcttcgaatttagtcctgcccaatgagaagtaagggtattccatgtcgtaagaaactcgacagtgaagacttttgtgtttcgtgcgtccaccgtgcgaaaaagcccagccgcaatttgtacctccgtgttgtactccaagattgtgatgacgaggaatgcgagcaggaaacaacagcattttcctatgcagccatcaactttttgagcattgccagcgtggaagctttttacaacctgtcagagaacgcacctaataagttggaatcgattttgcagtcaaaaatagatcaacccgtgctcgtcaaagtcaacatcaaggtgggttcattttttttttgctatgtgtttatcccaccttagctagtccattgtgttccatgcaaaaattatgtcagctaaaagaggcatattttaaggaaaataatgatacggcgaagcttgactggattatttcctccatatctgtggaaaaaccggtgtcggtgaagcttttggatgacaaaaacaacgatgatggagttgaggaagaggcatcttcaagcgagccgcctaagaagcgaaccaaaaacaatcaagtcgagcgtgctattgatgaagatgctgacgacatccatacgattgaatga

SEQ ID NO: 75298 - DNA, 368 bp, Heterodera glycines
  Genomic contig location: Contig_ID=SeqID_1680; Location=2447..2814; Strand=+
  SCN-specific regions: Sequence locations=1-48,72-317,339-368
atgaagaggactgcatctgttactgcatcaaaggagatggaaagttgtaaaaaggaagagtcgattgggactggatgccgcaaaggggtgaaacgacgatacccttatccgttgctgtcagctcgatctcaggatgcctggtaagtttgcagacccaaaaaaaaaatcacgtgacaataactcaggtctgcaaaacttgatcagttggaggagaaatattcaaaaatgcaagaagaactttcggaagacagcgatgatgcaattaatttcttcgaagatagcattgaggatattgtggaaaagtgagtaaacctttcaacactttaaatactgcttttattttaaggataaattgttctgaagctaaa

SEQ ID NO: 75299 - DNA, 4582 bp, Heterodera glycines
  Genomic contig location: Contig_ID=SeqID_1681; Location=264..4845; Strand=+
  SCN-specific regions: Sequence locations=1-235,258-802,824-1282,1304 -1310,1333-2521,2544-2942,2964-3937,3967-4532,4554-4582
tgacatgtcatccaatagaaaaagaacagcagcggaaaacaattgcaagcaaagcaagcctaaacagccaaaatgggatttccgctcaatggtgtacttcgaacagtacccaactgaaccacaattggaagaggagactacccagcaacaacaatcatcatcagaagcgacaaatcaaactggaatgggcgatcgatcatcggattccgatggtggacagcaacagctaccgttgtacaaagaaatcaccaatcattcacataccatcgagcggttctctgtgcagcgccatgtcacggaatttgtgctcaacgcccagcatgagcaacctgatgaagcactacgtcaagccttcgatgaactcatcgccagagctatacaaaatgcggaaaaaggaagtgggcgcactgtttcaaaattgggcataatggtaaccggaaaaggcttaaacgatccggtagttcttcctatacggtctcctctgcaaaacaatgtcgacgttgtgatggccgagcttgacaagctgggtcagagcgagggcgacgaaggaggggctaacaaaaaaacgttactactaagcgagccagtggagatcgtcgtcacatgcttgactcctccggcagggtccgccccacgcttgcacaaataccaaaattggggatacgacgaagcgcaaagaatacgtatacacaacgtggacaactactgcttatttcatgcacttgctgcaggccgggcatatcacgaccacgatattttttgttccaatcccaattcgacaaattctccatttttttcaaacataaagaaaagaagggatttttgcaaaaactacgaagcgttcaatcgcctggtatcaaacaatgaacgaatgcgaactgtagctgaagagttgatgaatgcatctggcatccagattggtcaaacttcttatggaattgaacatctacagcatgttcaacaatactgggtaagtgttatacgattttagtcataaattgctgaaaatatgtttcaggataatgtttttcctgggacgtatcgcattgtgttgtttgaagaccggccagaagagctacctcggcctatatggaaaggagcgggaggacatcgttttaacgtcacgctttttctgtccgacaatcattatgatgcgatcaaaaaaattcattgcttcttcaaacttggtcggaaatattgcgtagactgcgagtgtacgtacactcttgacgctaaacatacatttcattgtaagagcagatgtccgcaatgtgctaaaggttttaaaatttgttaaaattttgctatactgaaatttttcagttgggccagaacaaccatgctcaaaacagcaaggcatccaaattttgtgcccggaatgtaaccgatactttttttcacaaacgtgttatgaaaaccaccgtgggtcaacatgcagagtgattaaacgttgttctctctgtaatcgtactcattggtcagataccggcgagatacacaaatgctatacaagctattgcaaacgatgcaaggtagaatattctatttgaaaaatagaaacacgcgcatcatttcaggtttatcacgcggaaaagacgagttgtttcatcaaaaggatccagataccaaaagaaaaacagcgctatcgtatcatcgtctgggatactgaaacacgacttgaacaacttgaggacgaatgccagcgtatacatcgggtcaattttctttcggcacgtattacgtgcaccgattgctgtgaatcgtcagagtcaaacaatgactgtgaaatttgctgtcaaaacaatagagtgctggagcgagaaaaagaatggtgggatgtgattgagaaaataaacttaaattcagataataggagtgaagcctatggcaatgagcagcctgttgcagcgtttgttgagtggattctgagagcgtggaacaaaaaattcaaaacatacatatgggtaagcgattcatgaacaaatttgtcttacaataaaatttataggctcacaacgcatcgagatttgacgggcattttgctctcaaccatctttgcaaaaccgcaagacgccctgatgtcgtgatgaacggactaaaaattttcgaatttcgcgtccaatatagccgaaagcattcaatgctcatatggcgtgactcctgtctgattatgccgattgcgctcgctgaattaaagaagactttcaatcttgactgcgaggacaagccgttcttcccttatgcatttaacagaagggagaactacaccataagactggaaaatcttccggacgaaagcgagtatgagcccggcacgatgaaggctgacaagtacgaaaagtttaaaaaatggtacaacgacaacaaagagacgccattcttcttgcccgatgagctaagggcatactgtctgaatgacaccgaaattctgctcaaagctttggttaaattccgccagattttgatgaatgaaattacggacggatttgacgtgctgccaattagctgtaccatagcgaggtttaaaacataaattgctcttttatcattttcattttacagcgcttgcatgaacatcttcaaggttcaattcatgcaagaggatcaaattgcaatggtccccgagctgggctatgaacgaaacgacagagccagcgtcatcgcaatcaaatatttagactggcgggcaaaaagtgaaggcattgaaatccagcatgcgggcaatggacgcgaaaaacgatggaaacaattcaaacttgatggatggattgagagacaacaacggtgcatcgaagtgttaggatgttattggcatggatgtgagaaatgtttcaaacctaatgaggagctcgtcgatggaaaaacgtgtcgtgagctgaatgaaacaacacatgaccgtcttcgccaacttcgcgagcctgacgataatgggatctgtttacaagttgaagaagtctgggaatgtgaaataaatgaccagctaaagaaaaacgacgagatgaaagagttttttgatgacttggggaatgaacgtggacctcttgaccctcgacttgcatattgcggcggacgaactggcccattgcgactatttgctgaaccagcagaggatgagaagatatccgtcttcgacattgtctcactatatccatgggtcaactatgacaccgattatcccgttggcgttcctaccgttgttcatcctagcgcagaggagatgattgtcaattggacaaaacctgagcatttaagctaccgaggtctttaccgtgttcgcgtcatccctcctcgtggactacaaataccagtacttccgatgaagattgacgaaagattgctattcagctgctgtcatcgatgtgcagctttgttccgtaaaagtttgacacggtgttcacacaagtgcaaccacacagatcagcagagggccttcactggcaacttcactcacattgaactcgaaaaagcgttagagatgggttatattgtcgaccgattttggagggcctggcattacacagaatggagtgatcagattttcaaaggatatgtgcggcaatttatcaggctcaaggtagtataattaaaaaaaatttgtatccaacttttttttcataggtggaatcaagcggctttccggaggggatcgaaacattggaacaaaaacaggagtacattgatgaatatcgacgaatttatggagttgacttggattttgggcatatcaaaaaaaatccaggactccgattcatcgccaaattgatgctcaacagcctatggtttgttcaattaagcgctcttgttagtctgtatgattcttttttcaggggaaaattcagcatgaggaatcagtttgggtcgaataaagtgatgacgagaccacaggagttttacgatctcgttttcgaccacaaaacggtattgagttttgggtatgagaataattttttcttttaaggaaatctcttcaataataccaatctctgacgcagctattcgtgtgatgtataagccaaagaaaaacttcataaccgagcatacatccagcaacattgtgctcagcttgtggacgaccagtcgagctagactgaaattgtttgactacatgcaacaatgctacaacacacctggcgccgagttgctgtacactgacacagacagtgtaattgtgcggcacaagcgcgaccttgttccggtacagacgggcgaatttttgggccagatgagcgaggaatacgcggattacgacatcttgacttttgcatgtggtggagcaaagcagtatgcgctgaagatggtccataaacaaacgaaggagataacatatgtgcagaagattcgaggcatcaccttcgacgtcaacaactctcaagcgctacagtttgaacgatttgtgcacaaagtgctcaactatggaaaagaggatgaacagaatgatgccgcagtgttcaactacaaaaaaatccagcctacaaaggacagtcggataattacaaggaagcaaaataaaagatatttgcctgtttgccaaaaaggaattatcactgaaaatctcgatgttttaccttttggatatgaatga

SEQ ID NO: 75300 - DNA, 441 bp, Heterodera glycines
  Genomic contig location: Contig_ID=SeqID_11796; Location=554..994; Strand=-
  SCN-specific regions: Sequence locations=1-441
atgtctttgctctccgctctccgtgtcccatacaattgcgcaattgtccgtcccgcaactcgcaaaccgttcgctttcggatgcttcgcagacggccaaccccgtgacaatgcctttgtggccacagaaaatgcgcaaaagctgtgcacgcgtttcgcccaacgcaaagagtttgatggttttgtcgtcggaaccgctcagcaatttgcaatggtcagtgagaaaagttaagcagcgcactttcatcgaatgggctgaacgggaaagaacaacaatacgaccatttccgacttggctgaacaccttcgatgctgtaaagggattggagggcgggcgaagtgagcaacgaaatgacaccgtgggaattgccaatggcgacgaattgagtgccctaattgtaagccatttgaaatgccgagattggataaaagttcaaataaa

SEQ ID NO: 75301 - DNA, 468 bp, Heterodera glycines
  Genomic contig location: Contig_ID=SeqID_11800; Location=533..1000; Strand=-
  SCN-specific regions: Sequence locations=1-167,189-204,226-353,375-468
atggcgaccaatgacagcgtattgccgcagaggccgaacagcacgatgaatggcaacacgagcaaatggtactcttggcccgagttgtcggggggagccatttgctcggaaatgtttggctgcgtgggattcatgggcaacaatcaaatgtacggtttagtttaaaattttgccaaagtttaactaaatttataaaaattgtaattgtcatttgagtaatgtattcaaaatgccaatgcccacattggagtaacaaaaaaagaatttgcataatttatgttccatttaaagcccacaattcaataaatattggactgacacatatacactcacctctaatggacagcgaagaaaaatggaaattattggcaaattagcgaaaatttttcacaaatccgtggggaacgcattcggttaagcgttaattcaaagtcttgtcaatttttgcatttgacaagagacaataaa

SEQ ID NO: 75302 - DNA, 1343 bp, Heterodera glycines
  misc_feature (1154)..(1154): n is a, c, g, or t
  Genomic contig location: Contig_ID=SeqID_11801; Location=598..1940; Strand=+
  SCN-specific regions: Sequence locations=1-96,118-628,650-682,744 -1175,1197-1205,1227-1343
atgatcactgagttcgctgacgtgctgttgtgctatttgttcccgtgctgtgtggtggttgtgctcaattcggtgattgcttccaaagtgcgccgttctgagaaatgctttcacatcggtccgtcgccgactccgtccgccaccaaaaagtcctactgtacgctgcccacctcggccagcactggttcaacgacggcggcggcagcggtcgcctcggcttccgccattgcaccgccgcgtcgccagcactacgcgtcgccgaaagcgatgacgacggtggtgggcggaggggcgtcgccatctgcggacgcagacgagcggccggcaatgcgtaaactgtccacgcgcaccgcacccggcaacgtgccagtcggcgcccgaacagccggcggtgagtggactaattgattaggctattaattaatagagatgagatatttgggcacaaaaatgggccaagaaaaataaatttagagaattaattttttgagaaattatgtattcattttatagtagattttttgaaattttggaaaggccaaacaatcccttttttattttattgaatttttaaaatcctaaaaatagtcgcaaaaatggctaaaagtattacacaaagtgatttcacattctttttaataattatgctttatttccattgccacattaaatgatcaattcgttttatatttaattgattttaaaataattattttttaaaatgtatttcttattttttaaatggagttttaggctcctcctctggaaatccggcgggaacaacgcgcattctgttggttgtaccggtggtgtacattctgctcaacactccgttctacatgtttcgcattttggatacggtggcgttgaacgtgttcaactccacgatgtttcagtacgacggactgaaccgtaaccccgtgctggcatggtgttacaatgtcgcacactatttgtactacgtgaactttgcctgtgacgtgattgtctacgcattttccaggtagaaaagcacgtgtttgaatttgggagggtttaattgggagaattttttgtaattagctccaaattatttgaaattttgacaaataaattttaacttttcttactcaaaattccatgcttattcataaaattaaaataaaagcaattanattgaattaattaaccccaagttttcaaaaagtttttgaaaagcgcaccactaaaattgtcaaattttttaggttaaaattgagcctcggaattcgatttctgaaaattttggggcctgggatgccttgtataaaatgccaaattggacgcacgtttactggcgccaacgaatgaattggatcagatga

SEQ ID NO: 75303 - DNA, 1017 bp, Heterodera glycines
  Genomic contig location: Contig_ID=SeqID_11803; Location=62..1078; Strand=+
  SCN-specific regions: Sequence locations=1-151,173-544,566-896,929 -1017
agcatcgaattggagaccattgtggtggaggcggtgaccggccgcggcgttcactctccgcacgttttctgcttctgctacgactgcagccaaaagccgaacaattacatcattcggattgggctgaacgagtgagtttttcaactctctcttcttttccatccaaattatcgaaacaaaaccatttttttaaattggttttaattttattgcaccaatcccaaaatgtcctaatcgtttatatatcactaatagaaagattgctgttttaagaaatggaatgataggggtacggcagtgccgaaatgattcaattagttcatcgtaaatactgaaccaagtatttcctggactgaaaacgacagtttcgtttcaccgaattaagcctaaatcaaaaaatctgtaattttatgtagtaaagcttcagactgataacctaaagataacacgtaatctgagaaacatgacccgaattgttgaaaagagcccgatcgcttaatgtgcatcaatcatttcattgcagttttttgggacaatagtctcccttttttgtcccctttttagggtcgacgaattgcccacccccgggcaatgggttcgcgttgtgatgaagcaggaagtgcacgggaagcgggtggactacagcttgtgggaggcgcagaacatgagcaaggccaagcacgagacggactttaccattgacaacggaatccgtaccgttttggtgggttcaatcgaagacaatcccatccaacttttcctaactcaaaaacatttttcccgcttctcaggtccgtgttcccctgaaagtgtccggcgatggcttctacaaccaattcttgggcccagtttcggacatcaaacgaaggtcacgacatcccctcccctctttctaattttatttggatttttaaaaatttcaaaatttagacttaaaatcccaaccggcaaagaacgccgatttgtcagcgcgtggtgccgcaaagtgatgccgttgagcatatgcacaatggatgg

SEQ ID NO: 75304 - DNA, 1224 bp, Heterodera glycines
  Genomic contig location: Contig_ID=SeqID_11804; Location=990..2213; Strand=+
  SCN-specific regions: Sequence locations=1-599,630-1203
tttgtgggttctcgttatcgatcgcagccaacgacgaccgagggacaattagcgaagggaacgacgccgccaatgccccaaacgtcacaacagcagcaaatacagcaggtggagggggtgaggaaagacaagaatggaacgaagtgggcaatgcttaaattcgtttcccacccttttagccaatgaccatcagcaaaccgaaccagcatcacaacgccaacaccggtggacaccgtgccaacgccagcttgtcgccggcgctgggatcctccggtttcggctcgtccgcctccagcaacgcttccgcccaggtcgagcgcgacctgatcgacctcttcgacgagaagtgttcgattgggccgccgctcaaatggacgccttcccctcctccgcttcaacagcaccaggtgtttatcagattataaagatgacaacatgacgtcaaagatatttgacgacaagaaaaatgctttgaccttttgctttattttaattctcatacttttttatatttgtttcgtttggaatgttttatttgtttcatatgataatccaaacctattagcataatgagtataaaattaaaattgcgagagggattgacaaaataaataaataaattacaattcccattcactcccgttttctgtcagcttatcatttttgtaatgttgcaacttgcaatctgttccagttctccggtgtgatgtacccacacaccggcgtaatagcctccatggacctcaaatccagaggctactacgtctacagcaacgagttcgacaacgaactctacctgttaacggaggagttgctggagaagggaagctggattaaatttaacatcctgtaagatagggaatttgggaaacaaaaaatgcaaaatttccctcgattcagcgacgattattaccgcttgacgattggacagtacgccctgctcaaaaaatcccccttcgacgtaagagtcgaaagaaacacaatttatgtgggttttttcactgggtcttgggttaagtttgtcttgatatattgatttttccagatgtgtgtcagcgcgtacattacccccgaggcactgacgcaacgtacaatcgacacttcctacgtcaaaaatgtaaaaaaaaatcgattttttttaaatgtaatgaaatgatttttaaggtctacgacagatgccgcttgcttcagcatgcgcatgttgggaaggagctgaagctggag

SEQ ID NO: 75305 - DNA, 311 bp, Heterodera glycines
  misc_feature (82)..(82): n is a, c, g, or t
  Genomic contig location: Contig_ID=SeqID_11804; Location=43..353; Strand=+
  SCN-specific regions: Sequence locations=1-235,258-259,305-311
catgatgaacccccgattgagctgccgcacgagagcaaaacgaccttcaaaatccccgtatgttttctctcttcttttcctnttctcccaatcgatcgaaattcgagtttaaataatcccacatttaacggagcgcaacactgtgccgtttgaaattaatttctaatcggaatgctaacaataagcattttactaatgttgtttttaatggtatccgttatccattcctctaagcatacatatgtatatgtatttgtttttaaatttaatttaattttttattttactttattttcgtttaactgtaaatt

SEQ ID NO: 75306 - DNA, 385 bp, Heterodera glycines
  Genomic contig location: Contig_ID=SeqID_11805; Location=400..784; Strand=+
  SCN-specific regions: Sequence locations=1-349,373-385
atggcggaccctccggcactgtcgcgtgaccgtccgcgcagcgtagtctctaacattgagcacggcgtcgtgttgcaccaccgccttccccacgcgacgaacacagcgggggtaaaagcatcgccaaagattgtgctaattttagaaatttgataaatgttcaccatttgtcctattccagcagccttctccactccatcatgctcaagcagtcgctgcaacaccaccaccgccgtcgtcgtcggcggtagcgtcggcgttgttccaccaccatcggtcgccacaaaatgttaccagcagcaacagtgcatcttcactgatgacaatggcggcgatgatgcaccaccagcaacaacgacaacaacagcaacagaacagcgggtga

SEQ ID NO: 75307 - DNA, 965 bp, Heterodera glycines
  Genomic contig location: Contig_ID=SeqID_11806; Location=181..1145; Strand=-
  SCN-specific regions: Sequence locations=1-373,395-451,489-522,544 -568,617-618,647-965
atggctaataactcatcattatcatctcctttaccgcccgccgacaaaagttgtattgatattgagacagctttgttcggttctaattaccttgtcattcatattcaactgtttttgcttggcgttgtgctaattgcaatttgttcattgatccacaaatacaacaaaaattgcatcccaattcataagaatttaaaggtgaaagtttcttttatttctatggattatacggtaaaacccaactcgtactgttattcgacaaaaaaatcgtcaattttctcatgtttcaaaaaaaaagatgaccaaaaattgtaaaaaaaaatttcgtctttatcttttttgaaacaagatcaattttttttgaaaaagcaatgaaagattaacattaatggctatcgaaagatgcaaaaaaaaatgtttgaaatttttcatgaaaaattgtttttaacccaaatttttgaatatttaaatacataattattttttaagcttctacttgtcaacaccatcattctttacattattaattcactggtttggattgtcttctttttacgatatcgggtaatcccaaagcttttttaaaaatttaaatgaatgcttattaaaaatgcagggattttaaaaataattttaatttttaaatgcttattcagattcaaatgttcacgtataaacatccttgtgactttctgagccccgtttggatggttccgatgtttttgggaccgccaaaattgtactccatcgcttacccatgttttcattttgcaattgcatttgaacgaatacgttcaacctttttggccaaaagatatgagcgaatgggcacacaatcgactgtaataataatttggataattgtgagttaaatacaataataagtagagcacgactaaaaagtcaccaaaaatgcgaaaaaggcactataataggcaccaaaaatttgaaaaaaaggcattaaa

SEQ ID NO: 75308 - DNA, 269 bp, Heterodera glycines
  Genomic contig location: Contig_ID=SeqID_11807; Location=190..458; Strand=-
  SCN-specific regions: Sequence locations=1-269
atgaatattaaattctttttcaaaatccatactaagattaaatcatttttgaatttcaactatttgacaaatgatcgttttactgttttgccttgtggcgctcctcttcagtacgatggccatgacaatcgacaatggccgagacggaaacggcactttggaaaacggtaccacctctggactagagatcggaatcagaacagatttacaaaagccaacatggacaaaactcaagaatccattatttcaattgctttaagcttgcccag

SEQ ID NO: 75309 - DNA, 228 bp, Heterodera glycines
  misc_feature (185)..(185): n is a, c, g, or t
  Genomic contig location: Contig_ID=SeqID_11807; Location=1568..1795; Strand=+
  SCN-specific regions: Sequence locations=1-84,106-136,159-185,210-228
atgcaagagactcacattgttctcggcattgcctcgctttgctctctgctggcgattattgtcaccgtagtcactttgccatcgctgtactcggagatgagccaactgaacaacaaagtgcgcgacggcgttcaagtaaaaacaattttaaaaaataccgtaatttattaccgtattccccaggncttccgcgtcaacaccgactcggcttggactgacctgatggac

SEQ ID NO: 75310 - DNA, 580 bp, Heterodera glycines
  Genomic contig location: Contig_ID=SeqID_11809; Location=1154..1733; Strand=-
  SCN-specific regions: Sequence locations=1-332,355-356,378-580
atgcttctttatttagttgccttggcattgctttgccatcgtaaggaatgttcggatgcttttgcctgtgccttcggttgggacatttgcgagggttccttttgctacattcgtaataattagccaaatatttgcccattatctattgttttgttcacttttcgccagttcgacttcaaaatgtgactaacagtggtcactttttgctccgtcgcggctgtttcggcagtgaatccccgcagattcggtacaacaacgagttgaagccgttcacttcgctgaacgaatgccgaaagatgcaagtcaattaaacatataatggaagtgatttctttttcagtttgtggaaagacatcgaatatttattgggcatttgtgcggacagcgatttttgcaatgtttgcaattattggagcgaattggcagccgaaaagtcggcggccgttggcattatgcgggcgggtggagagaacactttgaggggaaaaaagttgctgatgggcacggcggcacttttgccacttttggcactttattttattgacaaaatcatttaacaaaaaccaatttagataataaa

SEQ ID NO: 75311 - DNA, 131 bp, Heterodera glycines
  Genomic contig location: Contig_ID=SeqID_11809; Location=37..167; Strand=-
  SCN-specific regions: Sequence locations=1-131
gtggtggacgtccaaaattatgtgatggaaaagcacccgttcagtgggcaattccacgaacatgctcaaaaggtggtaattccgaacattcggcgactgattgaaactgcgcgccaattgaaaattgaagt

SEQ ID NO: 75312 - DNA, 1112 bp, Heterodera glycines
  Genomic contig location: Contig_ID=SeqID_11810; Location=468..1579; Strand=+
  SCN-specific regions: Sequence locations=1-169,192-292,316-475,504 -1112
atgacagaaagtcgttgtcgcatttgtatcagtgcggcacatgacaaagagatgctggacagagtgttggatgccatcgacgaagttggcgacatcagtgccaccaaacattcgcacagaacgcaccgttaccgccaattggacgtgaaatggtgaacaaagaaaggggagaacggacacacgagaagagaagagacaatgacgggaaataaacaaaaggaccgacttttgccttattttatgttttttgttagatcatccgttgagttttgctacgcatttctttcacgcgaacttttgccattgccttttcttgccgaccctttcctccctaattttgctcatcactttgcttcttctaatgccctccctccccctttcgtctgctgattgtttccctccgccgttcttcgccctcgctttttcccactcgtcgaccttttttaattgattaattgcttagaaaataaaggagatgaaagcaaaaataaataaatttgttagtccttcggatgaacgaacatatggcacttttggtgctctttgggcgggagcgtggaaccgattcattcctgatcactttgacaaaataaaatgcgcctcctccgtttcgctgttctgttgatcctttccctccaaattgcggagatcattgccaaaaagcccaaatattgtggtgaacgctttgccaaaatgcgggataaggtgggcgacacggcacaaaaggggagacgtacactttttgccttcccccacttttcgctaggtttgtcgctggcccggcgaacagcagccgtgtcttcaactgcaccacagcatcagtaaaacattttacgcacagcaattcttccccccccccctaaaaacactaatggaattcccctttttcgagccttggaaatgctagtgaatttcgtcttttcgggggcacaaatgcctttattaaccaaaatcagcttaaaatccccgcgacagaagagcgtgttcgtacgaagtgctgtgcggagggctgctccctggaggaaatgaaggaggaaatgtgctgcatgacggacgcatgcctacggaggtgctacccgggaaaaggctaccgactgggctccgtttactga

SEQ ID NO: 75313 - DNA, 467 bp, Heterodera glycines
  Genomic contig location: Contig_ID=SeqID_11812; Location=98..564; Strand=-
  SCN-specific regions: Sequence locations=1-90,132-297,319-379,401-467
atgtttttcattgatatacggtaaaaaattaatatcacgagcaatagaacttaaaccaaagccaaagaaattcgaaaatctggaaaatggaattgaaaaatcttcaatgcttttttagaattttagttttgattgttgaataaatagtgaaaataatacattttttgacaaatcaaataaaaagggattattaattttggaaatatcacctccgaattccaaatacaaaaaaaagggaagagctcttggtcaaatggcaaatttttctagcaatatcctaacattttagccagtttgaggaaaaaatggtttatttggttatacaatagattaaaaacaaaacatacttcaaaaaaataggtgctgatcgaatttgctgtatgaattggattttgaatttgtcaaatttttgttgtgcatgagtttcaaaataattacctatccaatttggactaggatttaataaa

SEQ ID NO: 75314 - DNA, 859 bp, Heterodera glycines
  Genomic contig location: Contig_ID=SeqID_11812; Location=1705..2563; Strand=+
  SCN-specific regions: Sequence locations=1-122,145-158,180-603,626 -651,677-824,846-859
atgcttgagaatagagttggccgagtccgggtatttgggcaaaaatcgggtccagaaaagcggggtccgagtccaagtttttcaactgggtatccgggtatgggaccaggtcaggtacccgaacccggccaacccttgtattttaacaagaaatttgctttctgctgcacaaaaatgcaatttccacaacgcaaaactgagtctgagtccgtcgatgtcgggctggtgttgacggaagctctgagcaacggtgcggaaccgttcaaggtgcgtataaactaggaatggcataaacccatctcatcataaccatacccaacttagccattgtccaaatttgtggccggaggagtgactgcaattgcgcctaaggctgtggatggaggagtgagtactattgcgtctaagttaattgatttgacttataaatgcatttaggtgccaattgtgccgttctatgcgctccgtgacaccaagcctggcgaggaagaattgtctatggactacggtacatacaatatattggggtcccagggacgtagttccgaagaacgaaattggaagtcggaaacggaaacgacccaaaattatcggaagattgagaattaaggaatttcttttttccagtgcaataatgctagctagacttctgaaatttatttttaaaattttgtataactgaattgcgaattctagatggaggagtgattgcgcccaaatctgtggacggaggatcgataatactgttaccagtggtcgccataaaaacggtggagggataaagcgataaatttgatgggctattagctatgattgctatctaatttgttccttttgtcattttctggtggaacatcca

SEQ ID NO: 75315 - DNA, 295 bp, Heterodera glycines
  Genomic contig location: Contig_ID=SeqID_11813; Location=355..649; Strand=+
  SCN-specific regions: Sequence locations=1-140,165-214,237-260,283-295
atgtgtagcgataaacagttacctgaacataaatcgaaaaaatacgagtatattattcaggcaatgtatggtatatttattgataatataaaaggttagggatgtatgaagtattttttattataagaagtaaaaaggttaattgaaaatttaatcaaaagttttttgaccctaccctttttaataaaatttacgtactaagtatatagcttggattttgatttatttaaactttattgcttacctatcagttcgtcactgagacataatttttaaaaaatattgacaaatttca

SEQ ID NO: 75316 - DNA, 474 bp, Heterodera glycines
  Genomic contig location: Contig_ID=SeqID_1688; Location=74..547; Strand=-
  SCN-specific regions: Sequence locations=1-27,57-193,223-360,390-474
ttcgcaaaaaatctcgaatgaattctcatttttaaattttttatagatttttaaatgtttggattttttttaggcttaccaaaacttcatcgaacctggctctttctattctcattcaaatcgccccaaattttttttacagcttaactaggcccaattaagcttatttccagaaaatctcgcatgaattctcatttttaaattttttatagatttttaaatgtttggattttttttagtcttaccaaaacttcatcgaacctggttctttctattctctttcaaatcgccccaaatttttttttacagcttaactaggccctattaagcttatttccagaaaatctcgcatgaattctcatttttaaattttttatagatttttaaatgtttggattttttttaggcttaccaaaacttcatcgaacctggctctttctattctcattcaaatcgccccaaattttttttaca

SEQ ID NO: 75317 - DNA, 369 bp, Heterodera glycines
  Genomic contig location: Contig_ID=SeqID_11814; Location=1831..2199; Strand=-
  SCN-specific regions: Sequence locations=1-14,88-116,143-183,209-369
atgaatgtgatagaaaaggaagaaaaaaagaaggtgagagacaaaagagagagagagagatttaaaaaaaagaaaaaattagagaaattggtagaaaattcaaaaagcggggaagcattatatttttatttattaatttatagcatttaaaacattgttttttcaacatatgtattaccaaccaaaaaaaaaaaaaattttttttaaagtggcgccggtcgcctcatcaatgttttgagaggtgtataagagcaccaacaagtaaaaatgacgatgagttgtggtgtggaagtgtggtgactgatcagtcgggggaccgctaatgaggggggctaatgagattttttgtttgactaacgcgctaataaa

SEQ ID NO: 75318 - DNA, 306 bp, Heterodera glycines
  Genomic contig location: Contig_ID=SeqID_11815; Location=2182..2487; Strand=-
  SCN-specific regions: Sequence locations=1-137,161-306
atggccgccactgatgcgtcattattatcatttgcatcgacggctggcacaaaagcatttgtcgcagccgccggtaagggcatcgatggcattggaaatggtggcatttgggccaacgatggacaaacggtggcacctgtacaaaattttattttgacaatgcttggcaatttcgttgaatttaaaaaaattaaaacccattctgtggtcaatctgcgctgatcagagaccaatcaaagataatttcagtgctaaagaaagcatttagaccaaaattataaatgatcacttttaccgacaaataaa

SEQ ID NO: 75319 - DNA, 1214 bp, Heterodera glycines
  Genomic contig location: Contig_ID=SeqID_11816; Location=1028..2241; Strand=+
  SCN-specific regions: Sequence locations=1-923,945-1006,1028 -1095,1117-1123,1146-1214
atggaggacgttgatcgggacgaactcagcgcagctgcttcacaaactggtgctgctgatcaacatgcttcgacagcagtgacaggtgattttttgaataagtttgggtttacaataattaatcccttctgatcaatcactaataaaatgatcatctgatcagtcctttgaaatatgcattcaaaaaagagtaacatgagtccattaaaaatgtatgccttgatcacttcctaccaaaattgagtcctctgataatcagtcccctcaaaggcgagcccctgatcagtcccttcaaaaatacatcccctattcaatcccctcaaaaatcaatccctccgatcaatcagattactcatccacccacgatgatcatctgttgactgcgtcctccgcttcgcccactatttccaccgcttcttccgtgccggaagatgataatgatagtggtgctgataatgttcctcctccgccacctccgattcatccatctgctgcttctccactggatgatgatcactcgccgccgttgttgtcctccttgtccggctctcagttagccccatcgcctatttcaccgccacccatcgtcattctgtcaccatccgaaggcaccgtcgaattggttggtggctgatgggctggcctagagtcgaaattttccgagactcttgagaccccaaaaaaccgcgaaattaattgagcccgagagtcgagaccgagaagctcgagcagccctagtgggtgaagacggtgtttgttggattacacaacgctctctcacttcctaccacaattgcccataatcatcaataaatagatgtagcaaaaaaatgatcaaaaatgctttttcaccaggaaaatccgactaccgtcgtgccgcaaccgtcgtactccgttggcactacggccgcaacggcggcaacaaccgctgatgctgccgccggggacaattcgtcgtcgtcgccattctcgccagttgctgttgagttgacggcatcacaacctaaattgccagaggcggcggaaccatttccaagcagtagcagtgacaatgcgccgcgagtcgcggcggctgcgcaacggtcgccgagtgccgcggcggcggacagcgacggcaacatcaacatgaacaacgaggcgaagaacacgcacgcggtgggcgagctggacctgaagtcggaccgcgaattggccaagctgatgcgacgcacaac

SEQ ID NO: 75320 - DNA, 817 bp, Heterodera glycines
  Genomic contig location: Contig_ID=SeqID_11819; Location=229..1045; Strand=-
  SCN-specific regions: Sequence locations=1-46,68-170,192-313,337 -777,802-817
atgctaaaccaaaaggacaatttcacattgaaggagcttaaaaatcagacagatgaagagaaacagctttttcagctcatcaatgaaggtttttgctcctgaatagtttatgtattttttatttgtttgttttcgttttatagacaaaattgaggaaaccgaggaattggttaagagtggcaaagtgcgtgtgaattcgctggacaacagcgggatgaacgcgttggaccacgcgtgtttcaagggcaacgaagcgttggtcgagtttttgcttgaaaatgggtcggactcggacaaccgagcgcactcggacggatacacggcactgatgttcgcagcactcgcaggtgtggccacaagctattaataagcatttggtttgggtcattttactttcaaaatttccctatgggatacatttaaaacacaaaaaaattttaaattttcaaacaaaattatggagcatttaagcacttaccctaaaaccgatccattttaagaactgtccatttattcttgaaccttcttaatctataatccatataaatataatgccaatcattaattgctgaaggtaacggccgaatatgtcaactattgttggatgctggggcaaatgcgcatgcgcagaacaacattggtaaaacagcagccgaactcgcagcttttgtaggtcggaactttttaaaccgattaattccaaagtcattttattttcgatttcatatcctttcaaatttcagtcggaaatattccggtttgtctatcttcctcgagaaattttgggattttttaaaataatttacctgacaataaa

SEQ ID NO: 75321 - DNA, 533 bp, Heterodera glycines
  Genomic contig location: Contig_ID=SeqID_11821; Location=232..764; Strand=+
  SCN-specific regions: Sequence locations=1-105,149-533
atgggaatcgtacttgaattgcaagtacgtacttgaaaatcggccctaatgcaggaaaatatgaaatttgcttattttcaagattgtacttgaaaaagagaattcaaaaaaaaaatacattcaaaaatttattattttttgaaatttacaccaatttttttattaatgccaaaaaataaatttaccaaaaaatgtgtcggaaacaaaaaagaaaatgttggataaactttttttttaaagcgtgccgaaaaaagtgcacatgcagcgaaatgggattggaaaaaccccattctggcgcaaaacacaaacaaccatctgaataaacagttacccctttttcacatgttattttttgcgtacttgaattttatgaaattttccagttgtgtacttggaaatcagtatgaccgtacttgagaagagtgtttggacgatcccaaccagggctgtgcgaaaatcacaaaaaaattttttcgtatacgaaagcgaaacgaaaagctcattcgatacgaaaatgaaacacgaaacgaaaa

SEQ ID NO: 75322 - DNA, 4450 bp, Heterodera glycines
  Genomic contig location: Contig_ID=SeqID_11821; Location=1..4450; Strand=-
  SCN-specific regions: Sequence locations=1-109,141-196,265-407,429 -463,485-489,511-864,886-1128,1150-2042,2064-2179,2201-2793,2816 -3005,3027-3299,3341-4071,4115-4284
  Gene Ontology: Mol. function=guanylate kinase activity; Cellular component=membrane; Biological process=signal transduction
ttttgcgcctcgaaagtagctgccggcgcagatcaccaccgggggagaagcagtaaaacttgggggtttcgaaaataattttttggaaattccgaaaaaatttcctggcataatttttaacattttaaatttattttattgccatttttgtttttaaggttttttcttaaacgaattttttggaaatttcgaaaaatttcctggcaaagtttttaaacattataaattttatttatttttattcctatttttaattttattttttcaaccattattcaattcatatattattccgtcatcattcaaaaaggtgaaaaaaaaattcttcgtcaatttttcccacgctccgaagaccccaaaaaaagggaaagaaaaaaccaatgtttgaacagcgaattaattctcgaaaatttattcatttttattgtctgaaaattaaaaaaaaattgtttttttccgtcacagaaaatcgctttaaaaaattatgcattttttgatttgaaaaattatgttccccggccggcccatctgtggccagtgcgggtgcccccgctcctccagcacggcatcattcagaaacggcagcgaactgcttgaccaagtggtctatttgtaaggaaggcatttgctaacctaaaagaaatgtcaaacttcttacaatgtgtaagactcaaagggtacaaagtcgagaattgaattgtcgaaaatttttgaattagtttctcgagtgaccgaaaatttttcaagattcgagatccaaaaaaacacacgagtttttctcgggttgagcaagactcgagaccgagatttaacccctgagacttagacgggactcacaaatccctggaaatcaccaattagagttagtgaagggagagagagagggttttgcctcgaattaaaaaaaaatccaattttaaaagtggaagacactgaagggaacgccaaagagcgttggaaattttaaaatgttggtattcaaattgcttagaaagcaggcaattcccgagagaacttttaaattcgtgcagtaaaagaccaggaatcagacaaagatttttttttttcggaaattctttgaaagttataaaaattttgtttttaattttttggcaattcatgtcggagggtgggcgagggcggagggggacgggctgctctccccagttctgaaggcattactgtatctaactgaaaacagcggcatactgtatctaatttataaaattgcataattgctttttctccagccacatcaacaagcggactcagtatgagcggccaacttcgctggtcatggtgccgtccaccaagcagcccatctacgagccgtaccagcaccaacagcagacggcaaccacctccacggcgccgccgccgccgaatctccaccacaaccaccacgagcgattggtgtccatggcatcgacggcaggtggcggcattccattgaacagtggtgccaataatggtagagcacatgccaattattacataaatgcacatttgtagagatagatagatatttgacctggacctgggtagtagagtctggaattttcaaaaaacccgagccggattaggggtcacgaaattccgagatggactcggacagatattctgggtttgagaatttacccggattttttggtgtcgtagctttaggcttggcctaagctttaggctaggcttaggctttatttgtaaattttttaattgtatgaattgtcttttgtacgagttgccattgactcgatttcaatgggcctgggtttgtcttaggctaaatatgaaagccatttgaccagccattgtattgtccatcatgtttttttccaaaatgccaaccgattgctcaagaattggtatttttttactcgagacttgagattttttcctaatatatttatttactttttttttacattggcaggaatttatggcaccgccgtttttcacaacaacggcaccggcgccgccaattattatcagcctcatcagcaggatcattatgatagtggcggtggtgctgggcttggttatcagcgtcagcagcagcagcgaattcatttcacgcgaaatcccggcgaactttgtggtcagttcaaaaagcgcgggaatttttggcgaagtgttttaatccccaccccaaaaaaaggcgacattttaaatgcccgtgtccaaaaggggcccaaagggctcggcttcacactgatcggcaacgatggcacaaatttgcacgacgagttcatccaggtgtggtgggagaagctggttttattgcattacaacaaattaaggacggggtgggcgtgtccttcctttcaaggacagaaggccaattatccttatttgtagggccacaaatccgtttattgaattgtcagtccttttcaaacactttaaactcacataggcaattaaggaccgggtggtgaagtgcccttcctttcatggacaaatgacccgcttctcctttttgaagagccacaaatccgtttaattacccttccttttattaatgttttaagccgcctctcaaaaatttatgaatttgttttaagacttgcataaaccaaaaattgataaatgtcccagaaactttttgaaaatggttgagtgtgcggcattcaattgccattagtgttgtattgtaattaatcaattaattatgtcggttcaaattgccaaattattttggatcaaaacaatcattgccaatgggccggccgctgcggagggcacactgcgctcgggcgacgtgctggtgatggtcaacgaccggtgcatgctcggcgccagccaggacgacgcgtgccaagtgttccgtgccatcaatgtgcgggcgggcgggcacattttttttgagggggggtaattaggcattaattagtgctgctaattgattgattgattgcccctgacccataaattacactcaatgggcatattttgtttggcatcaattaaaaaaaaattctttcatattttcgaaattctaatctaatacaaaagtatatccttttgtaccttattaacagtacgttacagtacactgtccataaggcctacagtattcgggaatgagacctttgtgaaaaaaaatcactagagaactaaatatttaattgtacggtcttgtgtggtcactgtagaataccgtaatacgcttggaaataaacggtacttactcgctttaggttggtgaatttgtccgaatccaagtgtgccgtggctatccccttcaaatggacccgacaaacagggtaaaacacacaacggcattttttttgcaattgatttaaattttaaaaaaaaaattaaaaatttgaattttaaagattttcactgaaaatgtttacgccgccgcttcctccgtccaacagcagcaaaactgtagcaacagtaaccagcagcagcaatacaacaaccatcagaatcaccaccgtttccgtgagcaacacgtggtcgagctgtgcaagggccaaaagggatttggctttacggtgtacgatgacgcattcggtgggtacggtactgcccaagaggcggggatcagggatggacgaaatttcgtttcgttttcgtttcgtcctacattttcagcactttttgagtttcgttttcgtgtttcgttttcgtccgccaaaattttttcgtttcgttttcggttttcaaaattttatttttcgtttcgtgtttcattttcgtatcgaatgagcttttcgtttcgctttcgtatacgaaaaaatttttttgtgattttcgcacagccctggttgggatcgtccaaacactcttctcaagtacggtcatactgatttccaagtacacaactggaaaatttcataaaattcaagtacgcaaaaaataacatgtgaaaaaggggtaactgtttattcagatggttgtttgtgttttgcgccagaatggggtttttccaatcccatttcgctgcatgtgcacttttttcggcacgctttaaaaaaaaagtttatccaacattttcttttttgtttccgacacattttttggtaaatttattttttggcattaataaaaaaattggtgtaaatttcaaaaaataataaatttttgaatgtattttttttttgaattctctttttcaagtacaatcttgaaaataagcaaatttcatattttcctgcattagggccgattttcaagtacgtacttgcaattcaagtacgattcccatccctgtattagaacaatattttagaatttgatttgtaaatagagaaaattatagaattcaaaaacaataaaagtaatattaaatattaatgcgtaaatttaaattatttaattaataataacaaaaatttagatatttaaaatattgtacttatacttaaatttattttatatttttattcaattattttttaataattataaattaaattcatttaatttaaaaattatt

SEQ ID NO: 75323 - DNA, 1131 bp, Heterodera glycines
  Genomic contig location: Contig_ID=SeqID_11822; Location=390..1520; Strand=-
  SCN-specific regions: Sequence locations=1-870,927-1096
atggaagcatttaaccctgatacaaaaatttgctttaaaattgaccaattttcaacatttttccaacaacgaactgacaccaaaaagcgttaccccaacactttgaataatggccaatttgaaataaagtgccatctttcttctgttgacatccgcgacgaagcgcatggtgcgctttcaccgataggaattcgaaaggcattccgaattgcactggaatgtcggggacatgtaaattaattttatttgccaaattatattttgcataattaatagagaccgcaaaaaaaggcaccaaaaatcgcgaaaaaggtactataataggcaccaaaaaattgaaaaaaaggcatgaaaaggcacgaaaatcccgaaaaaggcatttaaaaaaattttctaaggtttttagtgagcaaaacacgtaaagctaaccaaataacttaattttggtcatttttaaagatttttataatgtttttcgaaaagaacaaatttgaaaaccaaaaatttttaaagaaaaaagatgaaattttggcgaacaatttttgagaaaattttaaattcttatgggtctattttctgaaaatttttcaattcttaggggtgaattttcccgattttattgtattttttatggactttttcgaaagaaaacggcaaaaaaacaccaaatcggaaaaaaagccaaaaaggcaccaaaacggcaaaatgccaaaaaaggcatttaaggcacgaaaatcccgaaaaaggcaaaaaaaggcataataaaagtcaacgtagaagcctcaaaccaagtggagaatgcgttatttatgcttaatatatcgaaactagtgcgcataaaaaaaggcatttgcctcaaaatgcggtctctaataattaaattaatgtttgtgaataatttatttatcttttttctaaaatttaatgaaaacaatttagtattgtcaatggtctttccctgtggaagtggccagcaccaccgacgactttggaaatggcccatataactcaaccgaaacaaggcccgtgacaattcggttaagcattccaatcctgaaattccgtacccggagggattgcatcgaaacgcttttggtaatttaaatttaaaaaaattaaagtttaaataaa

SEQ ID NO: 75324 - DNA, 1554 bp, Heterodera glycines
  Genomic contig location: Contig_ID=SeqID_11824; Location=721..2274; Strand=-
  SCN-specific regions: Sequence locations=1-158,180-744,788-789,831 -855,877-1277,1299-1554
  Gene Ontology: Mol. function=GTPase activity; Cellular component =mitochondrial inner membrane; Biological process=ribosome assembly
agtcaattagctatttattctttttgtatttgctggtgacctttctttttcatgttcccaaaacacatgggcgttcaactgaaagtaatggagggaaaacttcgaaccgtcgatttggtcattgaagtgcatgacggtcagaagaaattaaatttagtgtaacaaaatataattttaatacggaatttcagcccgggttgccctgaccggaaggaatccttcgttcggtgccaaattatattcagtgcgaccgcacattctcgtctttaacaagatggatttaatcaacatgaaacgctacaagtgaggcaccaaaattggttttagtttagtataacaacatgatcgagaaaattaaaatttgtaaaggccagtattgtctttttcgaggctttgtttaccggtgattattcgacgtttttcgcatttaagggaacccatcgaagagtactaccggaatgagcagaacattaccaatatttgctggacaaattgcaagaatttgacaaacaaaacgcagttcaaaatttgatggacaaaatgttggatttgttgcgaaatgaacatcgcttcaacagaaacagtgaagacggaatacccagtgatggttgttggtattccgaatgtaagtgaaacgggggggggggctttgagttgtccttcaccccgtccgaacaaaaaatgtcacaatttactttgctctacaaaacttttctgtcttagatagctagagaaaaattttccaaattttttttttataagattgatttttatataattttaaattcgtaacttttttataattgtttagaaaaattgtccaacttgtttggcaaaaccttcaaaaagattgaattatattttgtttttagacaggcaaatcctcgttgataaacgcattacgcaatgtgaatttggactttggaaaagctgtgaaagagggcgcgaggcccggcgtgaccattcgggtgcaaaaccgtgttcgaattctgtgagcaagaaaaacaatagggattaacctttaatttggctttcccagcgatcgtccgcccacctatctgatggacaccccaggagtgcttaacccatggtaattatgacattataccatttaaacatccccaaacatttttcggggctaacaacattgacgcggcgatgaaattggccatttgcaatttggtgttggatacgaccacacggcccaatttcgtggccgattatttactctattttatgaataagttcgactatttttcttttttgtctatcaatacaacctttgctttaaattttcttaagatatcgcgacttttcctacgtcgactttctaagaatcagagagccatccgacgacatcaaacaagtgctcatcgctgtttctaaactgagaaactgtatgtccaactcatacaaagtgcccggcattgaagtgacttgggacttacattcggcagcattacaatttctgaatttgtttcgcaaatatgcaaaggacccctttttggacagggacttactgtgcgttacaatactttttgactaaaaaattta

SEQ ID NO: 75325 - DNA, 1241 bp, Heterodera glycines
  Genomic contig location: Contig_ID=SeqID_11824; Location=2660..3900; Strand=-
  SCN-specific regions: Sequence locations=1-17,39-126,150-352,383 -429,459-624,646-1078,1100-1185,1208-1241
  Gene Ontology: Biological process=mesoderm development
ttttcaaaaaatttctatatattatgaaaatcaaaattcgggcattttgttcggatggcattttccgttgtgtgccaatgccaaaccaccggggggtccaactttgagcagttacgcttttgcatttgctttctcctcccattccttcaaagtgtcccccggggtctgctgatcagtcgctcctcgctttccgtgcactgactgtctttttgcttctgtttgcactttcggtccttttgatgggaagaagccgattaattttttgtcggtttgctttaacttttttttttgaagaggatgactttgattgagttgaaagccgaatcaatggatcaatggggtcattataagcaatttcaacaaatttttaatttaaaaaatgattccaattttgaccaacaattaatcatcattttgttgtttttcccctaattatttattaattgttaataaattttgtgctcattttcaaagcgaacatctgctgctccgggatggtttcaatcagtagaaaagtttgtttaaaataagccgagttccactccatgagcaattttacggctcgataccacattgttgatcctaacttcttattcctgggggggggggtcgcgtatgcataggtttttcttatattaattcatatcagtttgttgcttatgctcaacccacacatagatgtaagaaaatctctttaaaaattttttttgaaaaatgttagaatccgggttcggggttcagaatcggtcaaaaataaggtcggattcgtgctcagctcagtaaaatagccctagaaaaatttttccatgatttttaaagaaaaaaaaacgggaccagtaaactccatgattgccaaaaaaatggggaactctttcaattatccatccatttctaggtatactggtcattactttctctcggcacttctttattccattttccttggaccttttgcggttgatcgcttctatttgggttattcggcgattgcggtgggcaaattgatgacattgggaggattgggtaagttatcatttatcagcaatgtcatttcaaaacgaaaatattttccggaacttcctttgttttgatctttcaatttttctcccaaaatgcttaatattgtataatttttccttcaaaagtttgtttttgcaggtgtttggtggttagttgatattttcttgctgctttttggtcatttgaagcccgctgacgagtctgagtggcagccattttga

SEQ ID NO: 75326 - DNA, 650 bp, Heterodera glycines
  Genomic contig location: Contig_ID=SeqID_11825; Location=355..1004; Strand=-
  SCN-specific regions: Sequence locations=1-650
  Gene Ontology: Mol. function=zinc ion binding; Cellular component =integral to membrane; Biological process=microtubule cytoskeleton organization and biogenesis
atgaatgacggctcctgcaatcacatgcaatgcgttctgtgccatgccgagttttgttggctttgtctgaaacagatcaacgaattgcattatctcaggtcgtttcattcctccattccaacaatttaaaatgcttcttttcagtccaaccggttgcacattttggggcaaaaagccatggactcgcaaaaagaagttgctctggcagatcgggacactgatcggtgcaccgttgggcatcgcattgatcgccggattggccgtgcccggtatgcaattggattggttaacccatcattttttcgttttttgcaggaataatttgcggagtgcccatttttgtcggaaggtttcccattttttatctacaaaactgcaattgctttttttccacccgcaggaaagtctaccaacgctttgaaaatctgtccaaaatgcggcggcgttttgtcactgcgttggccgtgttcggttcgctcattgtttcgccggtgctcgccgttctgtccgttggtgagtgccattaattagttcatcaattggaccaccaatccaagtttttgattggttggatgaatatttcttctgcatttttcaggtgttggtgtgccggtcatgttagcctatgtgtacggagtggtcccattgtc

SEQ ID NO: 75327 - DNA, 363 bp, Heterodera glycines
  Genomic contig location: Contig_ID=SeqID_11826; Location=381..743; Strand=-
  SCN-specific regions: Sequence locations=1-154,176-272,295-363
atggagtcggacaagcagaaaatggtgccgctgacggacagtgggactgaaaaggacggcggcggatgctccgccagtggccatcggctgacgaaaagcctttgcggcaaagcggcggatgagttgcgccatgcgcacaccgatggcacagatgggggcggtggtggtggtgccgaccgtgaccatggcaccacgtcgtattgcgcggtaaatatcgagaaaggcgatagcagcagtagtggcacgggttgttgtggtggtggcggcatggcgtcaattggcaaggccaatggctgcgttggcaatgtgatggtggctgaccgtctgtccatcaaaagtggggccagcagcacttcgtcttcg

SEQ ID NO: 75328 - DNA, 136 bp, Heterodera glycines
  Genomic contig location: Contig_ID=SeqID_11826; Location=1..136; Strand=-
  SCN-specific regions: Sequence locations=1-136
cccattccgagtcccagtgcaatttgagtgtgggcaaacagatgaaggcccgggaatgccccgtctgttacattcgacagcaccccaccaatttccacaagctccaaacctgctcgcatttgacgtgcaaagcctg

SEQ ID NO: 75329 - DNA, 267 bp, Heterodera glycines
  Genomic contig location: Contig_ID=SeqID_11827; Location=86..352; Strand=-
  SCN-specific regions: Sequence locations=1-106,129-224,246-267
atgatttcctccagcaacagcagtgttggcgctggtggctcaaaatgcttgaaaaatttggacattgtaatggaaagtgcggacgaaggccaggcactgcttcaagacaaccccaacaacaccacaaccatcacttccgtttctgctgctgatggcattccggacggtgaagggacatcatcatcatctgctgaacagcaacagccaaatcgaacggacagtgcccaagcgcaacatgcacaaccgtcgacgacaatgctcaaaatg

SEQ ID NO: 75330 - DNA, 1384 bp, Heterodera glycines
  Genomic contig location: Contig_ID=SeqID_11828; Location=987..2370; Strand=+
  SCN-specific regions: Sequence locations=1-277,301-447,469-556,579 -588,610-1242,1264-1359,1381-1384
atgtaccataagaaaatgccaatagaagagtgcgaggccgcgaagcagccgagtcacagtaggttttatcattcataattttattaaaaaaatcgcactgcctagcttgggatgcgccgaaggcgctaaatgaggacaaatcttcaatttcggagcttatatgtttctactttaaagaattttttgcattaactaatagaataaaataactaacgtgacggaagcggtcgcgacagtgcttcaacttccacattagtgtgccgtggccggcttcgtgccccgagactcgcgctcggccttgttcttcttgccctgtttgtagaacggccgctttaaattctcttctttttaccagaaattctttgcaactttttaattgctaaaattacttccgagcaattggatagtattagaggtcaatttggtcggattttttcgcgttttctattagaatatttatccaaaaaaccggtcgaagaatttttcgattttttggtgtttttcgactttcttaccagacataaaataaattcacattagactagtaattttttttattgcaaatgaccatatttccacatttcaaacaatttatatatgtacatattaccattttttgataatgcttgtttttcaaattttttcttttttcacaaattttctttattatttcgtcttaatacacatccaaaaaatgccaaagaattcgttgagattgtccccaacttataagcgatggcatttccaaccattgggaccaagccgggtcaaatgccgaaaccagcacagtttttaattattttttgatgcagaaattcggtgaaaattctggggcaacgaaactcaagaataattttttttcaaaaatatctgcaacaaaatactatgcaatttagaattcgttcagcaagaaccagccaaggaatcagaatcgatttgacttatttagaattcgttcagcaagaaccagccaaggaatcagaatcgatttgacttaaatttattatttacaaaaccgtgacaataattttttttcagaaatatctgcaaaaaaatatcatgcaatttagaattcgttcagcaatgagaaccagccaaggaatcagaatcgatttcactgaaatttattatttataaaaccgtggcaataattttttttcaaaaatatctgcaacaaaatattatgcaatttagaattcgttcagcaatgagaaccagccaaggaatcagaatagatttgacttaaatttattatttataaaaccgtggcaataattttttttcagaaatatctgcaacaaatactatgcaatttagaattcgttcagcaatgagaaccagccaaggaatcagaatcgatttgactgaaatttattatttataa

SEQ ID NO: 75331 - DNA, 944 bp, Heterodera glycines
  Genomic contig location: Contig_ID=SeqID_11829; Location=777..1720; Strand=+
  SCN-specific regions: Sequence locations=1-451,599-609,639-741,800 -887,916-944
atgaaaattgtgggagaagcattaattttttcacattggaagtgccatttttgggcaatggcactattatgcctttcattgcttggccaactgtgttccgaaacagaagctgctgatgacagtgccaaaagtgagttttttaaaaaaatttcgcgcttttccatgtccaaaaatttcaaaaaaaattcctaaatttctcctagccccaaaattatttttttgtgacaattttatggtttttctgagcttaaaagtccattctctaacaatagaccctttctcccatgggtggccattccgtcacaaattagcagctaaatgatgctaatttgattagcgtattatgtgcattattttatttatcggcgatcgaacggtccattgatcacacgcattaattaatgatcgcaaattaataaaaatagaaaagaaaaaataatagaaattgtgcaaataatagaaaatattttataattgtgaaaatatataaaatcttattaaaaaattaattaatattttccatttaatttttaaatttcatccaaaaatgtaatttttaaatattttcaatattattttattttttacatatattatacctacataattaaaatcaaaacaatttttcaaatttgttagtgccatttgcgcaatcagttcggcgccattttcacccaattggtagtggacgtccgacaattattcaacatggccacaacaattttcgtgatgaaacggtggaataaaaataattaatttataaaaaatttaaaaattttggaatttttaaaatatttaacaagaaaaaaatagaatgttgttgccgcttctccgattcaagctcctcatcagcagcagcagagttttgcggtagccgcgcctcaggcaaaaaaaaaataatagaaattttaaattgaaaaatgtagaaagatttaaactgagaa

SEQ ID NO: 75332 - DNA, 64 bp, Heterodera glycines
  Genomic contig location: Contig_ID=SeqID_11829; Location=1792..1855; Strand=+
  SCN-specific regions: Sequence locations=1-64
cccctcattcgtaggcttctcctcatgtggcgttcgattatggggcgacaaagcttgctgcagc

SEQ ID NO: 75333 - DNA, 701 bp, Heterodera glycines
  Genomic contig location: Contig_ID=SeqID_11832; Location=535..1235; Strand=-
  SCN-specific regions: Sequence locations=1-361,383-441,471-701
atgttgccaaagtcttctcattttgcctctctcagctattgcaccaatgatgtggaaatcttgatgcccgctctcgtcgcgtttcgccgggaattcttcgacatttcgcggcgccaagaatacgttgatgggattgacgacaaggagaaccacgacggaatcgatgttctgcgagaatgcatgaccatcgcgggcgcatgcatgcgtcacttccgcacaaaccaaatgcccgacgcgcatctggccattgtccctgagcgcggctatgacaacgcgcagaaccaaagcctgctcgccttacgcttcttccactggtacgcggagcagcacggagtggaagtgcaaactgcccactcagccggaggagagaagagaatcggagcgtattcgctggatggatggattgaggcggaggggtgcgccattgaagtcaacggtgcctaatttatatatttaaaaaaaaattttatgcgtataattttaggctgcacttggcacgggtgcaaaaggtgctatcccaacgacaacatgctgctccccagtgggaagacagagggggaggtgcgcgagcgggacgccaaacgcctggacttcctgctgcggcaagtgaaccgagtggacgtctactgggagtgcgaaatccatcggatgctggagcagagcagagaaatgcgcaagtcgttttcggactatgtggatga

SEQ ID NO: 75334 - DNA, 1019 bp, Heterodera glycines
  misc_feature (996)..(996): n is a, c, g, or t
  Genomic contig location: Contig_ID=SeqID_11833; Location=64..1082; Strand=-
  SCN-specific regions: Sequence locations=1-447,469-689,711-1019
atggtggccaaaacgcgtggttggcctcgttggaaattctacgactatttgcacagtcggaggggacagcagggatgtctgcagcgggatgctttacaactgatgcagcaaattcgtgtacgggcaggactgaatgcatatgatgcggagatttgtgtgccgtgtgtgatgccaccaacaccatttggcatcacatttttgtgccaaatcgaagcagtgcaaagaatgcggggtaatttggaatgtgcgagacaacaatcgaaatgggcgaaaggtcaaaaaaatggttgaaaacgcaatttcttaacgtttttagggccataagtgctttgaatccttctgtcaattgtgcaacacttttcacaatcccgagcgggggtgcttcatccaacccaacctggcgcagcagaacaacagcaggctgtcgaatttgtgggccgcatcgaactgttgccttttgtcaacgccgctttgtggacacgcacgtgaaccatcaggtggtggtggccgacaatccattggtggcatttgtgcattggctcgtcttcgaactgccgatgagctacgacacatacgcctactcacactttggcggacggttcgacatggtgctcgtttttcgcgagctcttcagaattggctttaacccagagatgctgagacgagtaaaagcaaaacattttttatggtgatataatttcaaatctttagggcaacaaaatgtatgagatgaaagtgcgtaagcagaagaagcgcaaccccaacgtcgtcttccgggactccttcaacctaatgccttgctcactggccgcgctcgtcccttcatatgggctggaggttgaggacaagccgttcttcccccacatggccaatcgaccggaaaactacggcagggaaatccatccgacgcccgacgactacctggccagcggtatgatgcccagcaaaaggcggcaattcgatgcgtggtacgccgagaaccgtcaccaccacttncagctggatgaggcattagcaag

SEQ ID NO: 75335 - DNA, 1491 bp, Heterodera glycines
  Genomic contig location: Contig_ID=SeqID_1689; Location=294..1784; Strand=-
  SCN-specific regions: Sequence locations=1-103,127-224,248-456,478 -884,914-1089,1111-1136,1158-1491
atgccatgtgtctcgaaaaatgcagacatgacccaaaacgaactcaaaattttatattcctttcggcaacaagcctatcaggccaatattgctgctggtgaatataaatattttgtggttgatttggaaatcaggtccctgaaaaacccccacccgctcagaactcgctagggacacgcgaacaaaccaaccgaaaaaaatagaaaaacggtcaatccctggatttcttgccttttaataaatgcccgatcaatatcaaataaaatagctgatttagaacatttagctaaaaaatacaatccgtctatactcctaatcagtgagacctggttaaactccagaaatacggtagaagcggaacttacaataaattgtctgtatatcaaaagttaatgaaattcctacgttaattgatagtgctggaaatatgttttccagtaatgagcaaaaatgcgaaatattagcagaaatattccaaaaatcttttttagaaaattcagttgtcaatggttcactgactcaatcagcacagaataagactaaactttcggatattgaattaaatgctggcataatttggaatatattaagaaagcttcccaggcgaaattccacttcaccggataacattccttacattttattaaaaaattgtgcagagccaattacaaaaatattagctgacatatttcgacttgctttggattccggtcaaattccggaaatatggcgaacatcattagtggtaccaattttcaaaaaaggcgaaaaaactgatccattaaattacaggccggtgtcattaaccagcactgtctatagaatttttgaacgaattttaagtagcaaaattttagaatttctgaacggtataagattttttgataaagaacaatttgggtttttaaaaaataggtcgactacaacccaaatattaaaaacaatggacgatatatataattctctacaaaaggatcaacaaattgacattatctatattgattttgtcaaggcgtttgattctgttccaattgatttattacttcaaaaaatcaaaaagattggaattgaaggaaaaattcaaaattttttaactaactttttaaaaaatcggagttttaaagttaaaattggcgaagtattgtcagaaagtttcagcatattttcgggagtgccccagggaagtgtcttagggccattactctttttaatttttataaatgatctgccgtcctttattgcaaatgaagcatcatcagttggcataaaaatgtatgccgatgatgttaaattatattatgcccatgaaaatgatgataaaacagaatattttattaactcaaaaatgattttcagaatctgataatgtacgtgacttgggaattataattgactcaaaacttaatttttcagaacatattagcaaaattgtacgaaatgcatatcttagaatttccaaattttgagagtgttaaaaagcagggaaataaa

SEQ ID NO: 75336 - DNA, 517 bp, Heterodera glycines
  Genomic contig location: Contig_ID=SeqID_1689; Location=2498..3014; Strand=-
  SCN-specific regions: Sequence locations=1-67,89-160,212-270,292 -334,372-425,447-517
atgctaaatttgtctaatgtaagaaatcatatgaaatcattaaaaaatattcatctttttatcatggaataattatatttttatattagcctataaaatttcaaaaagcttaactaaaggttttaaaattcgttttttcaatgtttttgaatcatggatgaattttaatttttattataataattttttgcatatacaattaaaatatattgacctccatttcagcgaaatgaaaaaaagtggtcaactacatattttttcaatataaaatttgaaaaataaagtgatcagcagataaaaactaaaaaatattctgttttctttgaagtatatcaaaaataatatgatattataatttcaaatttaaaaatcatgacaagagaacctgtttgttaaaaaaagtgaaggttattaagaaaagtgcgactaaaaatttatttgaaaaacatatgaattacctttcacattcatttaaaatttcattgaaacgataaaatagtcccatttatataataaa

SEQ ID NO: 75337 - DNA, 738 bp, Heterodera glycines
  Genomic contig location: Contig_ID=SeqID_1690; Location=492..1229; Strand=-
  SCN-specific regions: Sequence locations=1-1,23-342,364-433,455 -459,488-595,627-675,697-738
atgaaaatttttaaatcatactacggtatgaaattgaatggtatattcgattgtgctttattcatatttgagtttattgttaattataaattttctagatcagtcggcaccgaatcgtcagcgtgctatctcaccgatccgatcatcgctggtaattttcatgttttaattaatactgttttttcaatgtttttaacaaatggtcttaaatttctagatcactcggcattgaatcgtcagtgtgctatctcaccgatccgatcaaaaattgtcgctggtaattttcatgttttcattcagatcattgtgcaccattacgtagttgtaagaagagatgtcctacaccacacccattttcactatttactggtgaaaatttggaaacgatttccggtagggaaaaaaggaggggggggggggtagataaatgcaaattaattgaaaaataactgatctttgtaaattaaaaataaaatgaattaaatttcggaaaattttctcaacagtaagttaaattaagatgctggcagcccgatttcaccaaactgtcccatatctccgtacgtgtcgcctacaatacaataattttttgtctgaattgaaaaaataactaatttagttttatttttgataatctcattataatatcgataaatagaaaaaaatggaaatttattatatttaattcttttttagtcaaatcacgacctgactgtccgctggattagaacaagatga

SEQ ID NO: 75338 - DNA, 1596 bp, Heterodera glycines
  Genomic contig location: Contig_ID=SeqID_1692; Location=392..1987; Strand=-
  SCN-specific regions: Sequence locations=1-6,29-147,202-324,374 -700,722-847,870-901,923-1272,1294-1298,1332-1392,1414-1438,1487 -1540,1578-1596
atggcttggcaaacatttacggacaaaatgaagtctttagaaaagcaatccgagctttaccgagtcttgcttttttactcgaagaagaatgataccggctttaatgtttttaatgagattgccccaccggaagcggaaccgatttacaattattttaaaaagtatattaattaatattaattttaaaatcaataattttaagcacttatttatttcggatcgtgaatggtgaacagcgatttccattgtttcgtccagatcggtggaaccaacataattctgtgttgcttgaagaacaacgcacaaataatggcatcgagtggcaaataaaaatattaatttaaaataaatttaatgatttaatgtaaaaaatctcaggtggcacagcagtttccgaaaaagatttacgcccctcacccagctttttcaaagtaatcgacattttcgaaaaagtttccattcttaaaaaattctattgtcaggggtgtgcgaaatttcatgtcattttcgtgtcgtcccctttcttcgtcactttatgagtttcgttttcgtctgtcaaaaaattttcgcttcgttttcattttcgagttttaaaattttaattttcgtttcattttctaaaattattattttttggttttcgcacacgcctagttggggctcaatttattaaaaattttgacataaataggttcatcaaagagatgaaaaatgaagaagaataccaagtcaacagactgagaccgtatgaaattgatcacactcgcggattttctgaccgtccacggctcaaaaaatacctggaaaacgatcaggcaataaggagacttgttgtcgcatatgatgccaaagaaaacaaaaatgacgaagatttgataagtcacatacatgcactccagtaccgtcttggcatgaaaggcttcgaagaatggaattagtaatgcttgtcaaagtatgttaaattagaaattgatggatcaatcacataaattttttaaataagcggcgtaatttacatttttcgcttttgcggcgcaaatgtcgtttttattaagcggcgcaagtgtcgcggcgcaaatggcacggcgcaaatgtccgcggcgcaagagtctttattgctgagcggcgcaaatgtcgcggcgcaaatggcgcggcgcaaatgtccgcggcgcaaaagtcggctaaccattggtttgattttgttttctctagcaccaaattagtattagattaaggctttctttttttcatttttaacgagaaaatacaattaatatgtttttaagcttactatttcacatttattgatttttattatttagaattaatttaagttatagcggaatcgtcaaggttacaattttcaaggtcacttttcaaaactttttattcctttatgcattttattactttttactggagcttagtaagaaatttgttaatattatttaaattttcttttttattataaattatgaataattttgtttttcattcttttctggataactgaaagattcaatttttttcctttatttttcttagtaacattatctatgaaatatatataaataataggtatattcacaaaataaa

SEQ ID NO: 75339 - DNA, 187 bp, Heterodera glycines
  Genomic contig location: Contig_ID=SeqID_1693; Location=2836..3022; Strand=+
  SCN-specific regions: Sequence locations=1-40,65-187
ataaacaggttttcactgaaaattagccaatttataggtaaaattttgaaaaattttatgggaatttaatccaattcttaggggtgtaaaagtcgcgtttcgcgccaaaaagcgaaatgcgaaacgccaaaaaatgcgaataatgcgaaaggcgaaatgcgaaaagcgaaacctaggcacatccctg

SEQ ID NO: 75340 - DNA, 327 bp, Heterodera glycines
  Genomic contig location: Contig_ID=SeqID_1694; Location=155..481; Strand=-
  SCN-specific regions: Sequence locations=1-59,81-140,162-327
atgaacggggcaaaataccacgaggatccactccaggggcgacatgaagtttgggcaccgggaagcttgggagcaggaagttcgccgcaccagagatttgggcgccggttaagcttgagatccacacggggggattgcggaactggagatggagataaatatatagcgggtaatgtgactcatgagggacgaggaagtatcgcaagagaggagatcttgaatttctatgaggacggaacatcgcctaaagaggcggaatgccgtgggagttggaaatggtattggacgtcgatagcagatgacatttcatatctagatatgggttga

SEQ ID NO: 75341 - DNA, 1253 bp, Heterodera glycines
  misc_feature (1149)..(1149): n is a, c, g, or t
  Genomic contig location: Contig_ID=SeqID_11834; Location=126..1378; Strand=+
  SCN-specific regions: Sequence locations=1-174,196-415,447-456,551 -596,710-840,925-1253
  Gene Ontology: Mol. function=phenylalanine 4-monooxygenase activity; Biological process=phenylalanine catabolism
ggtttcaccgacccaacatacagagcgcggcgcaaatattttgccgacattgcagcaaactacagacatggcgaaaaaattccacgcgtcgagtacaccgcggaagagattggcacatggcggacaatttacaacgaggtgaggctgggaaggggggccgcatggaaaaaaaaattgaaaaattcaatagaaaaaccaaggtccaaggcccgtagtcccaggggtttgggaatttcgcttccccgtgaaacgaaaaaatcggaaattttttcattcagttttcaaaaaaattcattaaaaatttccaaaaagggctaaattttcaaatttgacaattccggcgagggggcggggattttttgggtggcgggggagggggggagggaagaatggaaaacctcaccaagaaagtttcgagaaatttatttttgtaaaaaattagaaaaccggaaaaccataaaaaaatttctattataattttaattaacttacaactttaaaaatttttttaattagaattataattaatttaaaataaaaaatttattttggaacaaaaaaggtattccttaacggtgaacttaattaaaccatttaaaaaaggcaaaaaaaaaaaagaaaaagaaaataaattaaaaaaacaaaacaaaaaataatttaagaaaataatcaatatgaaataaaactaattatttaataaaaaaaaatactttttggtcaaaatgtttcaaaatttgctaaacgttttttcatttttaactttagatttggaaaaaaaaataccaaaaaaaaagcgcagcgtttttgggaacacaaaaaaaatatatgaaaattaaagcctaaaaaatatatttaaaaaattaataaattagttaactctccattaaaatttcaaaaaagtttttataataaatataaatttttgtatcgatgtgccgttgttttccccccattcagctgatcaatttgtatcccatccacgcgtgccgtgagttcaactacattttcccgctgcttcagcagaactgcggttatgcgcctgatcggattccgcagctgcaagtgagtgccatctttttttggcattatttaatggaataattagaattaattttaggatgtttccgacttcctcaaaggtaattttgngggcagcattttttcaaaaatcccggcaccggcttgaaaatcttgcattttttatgcccacaaaaagtgtcaatttgaagattctaggcattaaaaattttttt

SEQ ID NO: 75342 - DNA, 77 bp, Heterodera glycines
  Genomic contig location: Contig_ID=SeqID_11835; Location=750..826; Strand=+
  SCN-specific regions: Sequence locations=1-77
actgtaccggcttcacacttcgaccggtggccggccttctaagttcccgcgattttctggccgggctggcattcagg

SEQ ID NO: 75343 - DNA, 891 bp, Heterodera glycines
  Genomic contig location: Contig_ID=SeqID_11840; Location=1253..2143; Strand=-
  SCN-specific regions: Sequence locations=1-296,324-763,785-891
atggcaagatcaagacaaagtatcatttgcacattttatgtccgcaacccaatcacaaacgatggacgcgtacaatggcgaaaaacacaaattggacttgtccgacctgaaggtctcaaaaattttggacgaaatgccgccgctgcccgaagagcggggggcttcatcctcgagaggaaaagtattgaaaagccattcaatttcattgccaccaagtctggccaatttcaatccattcaaagcgtcgccatcaccaaagtcaaagctgtcgaaaagcctaagtgcttccctaaatgcttcttcttcttcatctctgagtggtccattgaaaacgcccaaacacaaggaaacgctgaaaaagaatggcaaatcaaacaaagtgccgaaaagttgtggaaaatcaaacgaattttcgaaaaatggtggaaaatcaaacaaagtgccgaaaagtggtggaaaatcaaatgaattgcccaaaaggaatggcaaatcaaaaagaattgccgaaaaatgatggcaaaaagaaaggcaaaaacatttgaatacaaattgatgcgagaaaagaagtaattttgagaaaatcggagaatttggtggtttttttatattgtcaaaaaatgttttctgtcatgtcaaagtgttgtaatgattatgattaaaaagatttttcgtgcatttttagtgccgtttttcgtccaaatttggttttcaaaacaattcattggcacgctttttacacataatttgacaaaaaaatcggtttaaaatcaaaaaatttttgggggtgtatcaccttaccaaattgtatcggcatacaaagagcatctacaaaacactgaatggtggtgcttttggatagcgcataaaaaatgctacaaattacaaaataaa

SEQ ID NO: 75344 - DNA, 583 bp, Heterodera glycines
  Genomic contig location: Contig_ID=SeqID_11842; Location=1150..1732; Strand=+
  SCN-specific regions: Sequence locations=1-49,71-85,107-191,213 -413,435-448,470-583
atgtccgatggaagagaatctgctaaaactttggtacgaatacaaggaatgaaattagttttctttatttgttaaataaagttaaaaaatattttcagaagattcaatatggcttattgctaaattcatgtgaattttaaacctatacttagagatcggcctgtacctggatccaggcctgtatttttcctggatccaggtacaggtacaggccatttttcggcaacctgtatttttcctgtacttttgtacagaaaatacaggtacaggccatttttggaatacaggtacaggtacaggccttaagaacctgtacatatttcctgtattaatttttaatcactattttttggcgaaatgtctgaaaaattaggaaaaattcaaaaaaatatcattttattcagtgaaactgtcaaatttgaaaaattaataatgttttggcgaaatgtcataaatagttcaaggtggacttggtcgttttggcgccaacccattgtgctatacctttttttattttcaacaaaatctaacgatcttggtagcattcgaacgcccttcacatttcaatttggcgcatgcttta

SEQ ID NO: 75345 - DNA, 1506 bp, Heterodera glycines
  Genomic contig location: Contig_ID=SeqID_11843; Location=1173..2678; Strand=+
  SCN-specific regions: Sequence locations=1-159,183-245,375-458,651 -697,776-786,815-901,959-1127,1199-1339,1385-1506
atgccgttttcgctcaagtgcatgtccacccgcaaattggttaagcaaaacaatcatttgtgacatttgccactacaaattcggcgaacacccaacagtttgctggcatcccatcaaggcgaaccagcaacgagggcgatgccaatggcgtaatgccccatatttttatttttgaattttatggcaaaaaaaatattgttaaatcatctcttaaataatatatatttggcgacccgattatatggttaaaaaaattatacatttaataaataatcaatagctataaaatttattttaaaataatggactaattatttttattttttaattgattctaaaaaaaattatgaaacaatataatttgaaataattaagttacaattaatgacacggttcatatgtataataaaattaaaaaagccaaaaatctaaatataaatttttcagcagtcaggatgaaatttttttttaatttctttcattttataaatttttagtaaaaaagtgaaaaattcatcttaattagattaaaattttataaaattacataattcgaagccttattaagaaagaaatgttatttatataaaaaaaattttttttaataaaattcgtataattgtaattttttgaaaaatatatcattttttgcatttttcaattaaaacacaaaaatgtttgctacgagtttagaaagaaaataaattaaatagataaaatttgtttttttaactttttatataattgcatttaaaaataaaattgttaaaaataagcattaaaccgaataattttaacttttttttttatttttcatttcagcactttatttttctgatttttggtgccgcaattacttttgccatctccgtacttttcacatgcattttgcgaaggtgtgtttattataaaataatatattatatattttttaatttataatttaatttcatttttagacgatgctttttgtttaaagcctttttacggcacaacaaaaaacatcatcaaaaacgtggtccatcagtgtccgaaaaatcgcatcaaaagcaccgtggagctgaaagcacttcgctggttcaacgcggcacgagaggtaaattaattaaagaaaaacaacgcggcactaaaaattaattaagtaaaaacaaaaaattaatcaaaaatattattttacagtaaaaaaataaattattttggcaaaattccgaaatagacaatttcttcattctttaatttttttttaacaatttcaaaaaaaaacacttaaaaccttttcgttcaataatatataatgagtgtatttttgcatttatttacatcaattgaaatcaaagcgattaaaaattcttacaaattttaaaattattattattttttttttgaaaaaccgattcaacctctaaattttcaaccaattgaacgataatgaacccaataccaaaatcccgaaaaaacccgaagctttcctttcgtcgaactcgagaccaccgagattatttgaaa

SEQ ID NO: 75346 - DNA, 339 bp, Heterodera glycines
  Genomic contig location: Contig_ID=SeqID_11843; Location=4160..4498; Strand=+
  SCN-specific regions: Sequence locations=1-167,200-339
  Gene Ontology: Mol. function=protein tyrosine phosphatase activity; Cellular component=adherens junction; Biological process=neurogenesis
atgaagctatgtggatgtaaatgcattgcctcggaagagcagaattcaactggtggaccccagaacgggatgtcttcaacattacattaatgcaaattatgtagactcatgtgacgagaagcgggcatacagtaatccaaataattcctatcattactgtattactgtatttatttaataaataatatttttatattttcagtagcaactcaagcaccgttgccacacacatttgccgacttttgggcaatggtttggcaagagcggagcagtgttttggttgcattgaccaacattgtggagagtgggctcaaaaaatgcgatcagtaatatttaaaa

SEQ ID NO: 75347 - DNA, 1210 bp, Heterodera glycines
  Genomic contig location: Contig_ID=SeqID_11844; Location=475..1684; Strand=+
  SCN-specific regions: Sequence locations=1-178,316-467,489-509,536 -941,977-1034,1067-1122,1149-1210
atggatttcattttgttagaattttttgtttggattcaaaataaaactgttggttgtactgctataactctatgcatgaagacgaagcagtacaagaaaagtgagaagccaacacataatgccttttggtaaatgttggcttaaaaattctattctaacaaaattaacgaattctaggaaaattttaaaatttaattttatcacttgttaaaaaaatgtgaaaataaattatatattttgagaaagatttttatttttgtttttttttattcgaaaattaagtcaattaaaatactttgttaaattaaattttttgcttttttggagaaagccatgttttttccgggcacaattgaaacacaaatccatgcccgatcattccgtaaaaaaagctccaaaaaattttgtgtaattattagataaataaaattctcatatcgtctcgtctcgtatttttttcctttttgcaacatccctgatgtacaatttccttgccttgttaattggagaaaaattttaaaaataattttttattgcttttaagtgatggtcaacgtgttccggtcatgaaaaggacagcttcactcaacgaacaaaacaatgaaatttgccaaattttgcccaacaattatctggccgccattgataaacagcgcaacaaaaaagcaatgctcaatgaggataaaaatgcttttctaaaagctcacggggttcggatatgctccaagccaattgaagcggaagcgcgacgcctgtacccaccggcaatagcctgcttattagccgaagaagacaaggaccaaaagaatagagagcatttggagccaaatcaaaatggaggtcggcaaatcatttgaattagggatgatattattatgcactaaaaaccatcaaaatagtaaccaaaaatgggagcatatgtattaaaagtcccccaaaaatttgatttatttcaaaaaattgtttaattagttgttaagatggtagacttaaactaaaaaacacagttatttttaagaatttcctacaaatcctaaaaatatatgtttttaaatttttttttttagatttgaatttttgttttactgaatattacgaaagtttacaatacacaaagccatcaaattttcccgaaaaattaaaatgggtaattgtcatcattggagaatcccaacaaatgtgcaagtgagtttttataataatatcacaa

SEQ ID NO: 75348 - DNA, 59 bp, Heterodera glycines
  Genomic contig location: Contig_ID=SeqID_11844; Location=1925..1983; Strand=+
  SCN-specific regions: Sequence locations=1-59
atgaaaaaagttatagtccaaaacatggctggggcacaaccgttcaggccccaactgag

SEQ ID NO: 75349 - DNA, 712 bp, Heterodera glycines
  Genomic contig location: Contig_ID=SeqID_11845; Location=255..966; Strand=+
  SCN-specific regions: Sequence locations=1-256,278-455,477-712
gaatttttatgatctattgaaagattgtgcaaaacatcgtggtgttgtttttacaactccagtggttcaaaatatttctcataaagaagccaattcattgtaagttgatcttttaatagcttgggcaatgttgctagtttgctttttcaattaactttcagagagctcgttcgaaaaagttttgaagcgcacaagaaaaataacgtgcgctttttactattgttagcgcccggaaaggattcggccaattctattgatgtgcattactttttcaaattgatggaacagcagactggtgagagtttattgaattttaatgtgtttttcaattcaaaaaattaatttctcgatacgaaaattgaaaaaaaaatgtgtatagtggggaaataataacaataatacagaataatcaaccaggaaacacggggctttacttaaaaaaattatgaatagggatgggattcttagttttttaactattttttctgcggctttaactcgacgagaaatgcacgaaaaacacattctttttcgaaaatttttcatttttagtgccacaattcatcactaggaatcactattttggagctttgccactaaaaaaaactatttcggaagttggccactaaaataattttttgccactattttggcgtttcgtcattatttttgccactattttggcatttttgaaaaacttcccaaaattgca

SEQ ID NO: 75350 - DNA, 421 bp, Heterodera glycines
  misc_feature (207)..(207): n is a, c, g, or t
  Genomic contig location: Contig_ID=SeqID_11845; Location=1504..1924; Strand=+
  SCN-specific regions: Sequence locations=1-264,305-334,357-421
atgaacctcaaacttggtggcattaattacggaatatgtgcttcgcaagcttttatgaatgccagacgaagcactgaagacattgtgtaagtgattatctatgggaaaaatttaagaaacctccatattggacgcttaaaaacatttttgatgataattcatttacagctaaatgataactcaaaataagcaagaaatccatttcgnatttttaataaacgcgaggcgtggactcttgagccttacaagaccaacacggaattctatttttaattttaaaatactttattaaatttttaaaaatccaaaatcttttagtttgtgaatcaaagcctttaaaattaaaaaaaaaaaaacaaaattcccttatttttttagggggccaaatccaatttaaaacccctttttttccgggttaaaa

SEQ ID NO: 75351 - DNA, 3728 bp, Heterodera glycines
  Genomic contig location: Contig_ID=SeqID_11849; Location=121..3848; Strand=-
  SCN-specific regions: Sequence locations=1-51,73-139,170-341,366 -392,443-486,560-697,729-772,797-864,929-1081,1122-1282,1305 -1408,1466-1603,1625-1673,1695-1796,1824-1832,1864-1902,1924 -2133,2162-2288,2363-2363,2419-2474,...
  SCN-specific regions: Sequence locations=...2496-2669,2804-2821,2964 -3011,3127-3268,3368-3438,3519-3554,3578-3728
  Gene Ontology: Mol. function=membrane-associated guanylate kinase; Cellular component=actin cytoskeleton; Biological process=adult walking behavior
cggcgatgatgacgacttgctgctgtgcgcggtcagccgtgtccggctcgtccagttcagcaaggacacggaagagccgatgggcatcacgctcaaggtggtcgggcactcggattgacttaacacaaatttttaaaggaatttttcaaaaaaaaaaaaaaaaatttatgtgaaaagttcaataaaaaaatttttgaaattttctagcgattttttcaaaaatttattagttttttatttctgagttttttttcaaaacagatcacggaggatggccgatgttatgtgggccgaataatgcacggcggactgatccatcggcagggcacgctgcacgtggacgacgaaatcctggagatcaacggagtatcggtagggggaaagaaaaatggaataattataataaaaaataataattattaataatattatttaaaaaaatggtcttatttacgggagcaggtcttccccccccctcccttcgagatttttaaaaaaaatttaaaaaaatttttttgaagaaaatttcaaaaaaaaaaaaaaatttgaaaaattttttctagcgattttttttcgagttttatgctatttattagatttgctcattttttcaaaaatttttacaaaaagctgaaaaaattttaaaaattttaccaatgaaattttcttcaaaaaatagatttttttgaagaatttcttaatttgaaaatttttatttcaaatatttcgggggttagggaatatttaattaattattgtttccatattttatatgaaaaagaaaaagaaataacaattaaactcattgtcaaaaagagtgacatttcttcaacatttaattttacaaaaatttaaagcgaaatcaaaaaatttaatttaaaaattttttaaataaatttctttaatttcaaaaaattaaaaatataaacggttaaaggtggccaatcggaatgttgaacagctccagcggctgttgcgtgacgcgcgcggggcggtcaccttcaaaattgtgccttcctaccgctccgcgccgccggcctgcgaaattttctgcaaggcccagtgcgtaaaacaaacactcaattttttaaatttagtattttaaaattaaaaaaaaattagccaactattttaacgttaaaattgttggccgttacattcgttttctcacaatacaaaaaaacaatttttgctcgggtgaaaaattctataaaaatttgtataacatttatactgttccattacgtatctctgcaaaatttggtgagcttctgatcatttttaaaaataataattctgagttttccattattttaattttttttgcaatttttttgaaaatttttgaaaaaacttagtagtttattaaaaatcgctaaaagtttaaaaaaaaattgttttttcttgaaattttcttattaagaaatttcctaacaattttggaaaatttctgtttgaaaattttaattttttatggggaggaaacgacgacggaaaacgaactgctccccgttttttctaaaatttcttagaaaatttttctaaaatttcttctttttttttaaattcaaattttaatgcaaatgatgcgagatggtgggcttgaaaacatttttacaatttatgttattatatttgcattgaaggttgttgaattttgtgccatttttgagcaaaattttcacaatttcaaaaacgatcaaagatttgactacgacccggcccaggatgacctgatcccgtgcccaagtgcgggcgtgccgttccgaactggcgacattctgcaagtgatctccaaggatgaccacaactggtggcagggtgagaaattgttaattttaatttaaatttttatttttaattgaatccaaaaatcgggctttttccaattctttggcatttaattttttaaaattcttttcattgaaattagagcccggagcggaacgagatcccgcgcaggattttgcgggattttcagtccaaaatccctccatttagggaaatgcgggattaatccctgcgggatcccgtcccgcaaatttttgaattccaatcccgcagcggaacccgcaaatttgaaatttactggctatggtcctttgtttttttcaattccttggtattttatccattttttaaaattatgtttaaattatttgttagcccgctttgtgtgccatttccctgcgcttggcggctcctcaaaatggcactcttcttctgctggccgatgtacaagcagtgcttccgggtgcggagtggcaaatgcggtgaatttaaaatgcaaattttttaattaaaataaaaatatttatatatttttaaaatgttttatgtttacagatatatttaattttaacattaattaattatctaattaattaattacctagttaattgattatttaattagtttgattgattcacatcccccccccttaaattaggtggcctccacttcggctgcggcattggccaaccatacgggtgccgtcatgccccaaaggcatgccaaaaagggtggaacaatgccaacagcgtcggcactaattggcaacaatgtcggcgccggtgccgccacggccaccggcaacgtcaacatggccggactgattccttcgccggaattacaggcaaaaaaaacaaatatgaaaaaaatacacttcaaaaattaattacattttaaatgaatttgagaataatttaattattaaaaaaatatattttaaaaattttgatgaaaaccgagtataattagttaacaaaaatatatttttaataaattttaaatgaaaaaaatcatgaaaaaaggtatattaattaaattaaaatgcaacttgaacaataattatcaaaaatatttatttaaattaaattttaaataaaattcgagtataattaaatattaaaaaaaaaattttgaattaaatcttacgtggaattcgagtaaaattaaattattaaaaacaatctaaatttgaaagcattgaatttttaattcgtttatcttaaaattaattatgacattttttttgtttaaaaaaatataatttcgtatataaattaatttatatttcgtcatttaatgtttttttattatttattttaccaaaattattttttggatttgttcaattttttttaattatacaggaatggcggacagcttgtttggcgatggagcgagcacgggaaaattcgcattgcttcatgtttagcaagaaaaaaagtggcaacaaatattacacgacgaaggcaaaagcggaaaaattaattattattttaaattattaaaaattaattttagaattttaaaaattctaaaatcattttaaataacaaattcttatttagtataatttttcttcatttttaagtatttgcgtaaacattccgagctgtttgacggcatggaaatgatcagctacgaagaggttaaatttttttaaatttatttttttgtaaatttaattaaattttttatcaaattcgaaatttaattaaaattatttattccagcaattcatttaattttgtccgataaatttcgcaatttttaatattattaaaaaatgcattgattaatttctaggtggtcaggttagcctcgttccgccgcaaaacgcttgtactgctcggcgcccacggggttggtcgacggcacatcaaaaacacgctgatcaagctgcacccgcaccgatttgcctacccaattccgcgtaaat

SEQ ID NO: 75352 - DNA, 378 bp, Heterodera glycines
  Genomic contig location: Contig_ID=SeqID_11853; Location=551..928; Strand=+
  SCN-specific regions: Sequence locations=1-378
atggtatgtagagtaatgtttaaaattaaaacaggactttttgtcaaggatcctgtcgggttcacctggaattcggattctggtccgggttttaacattccgcgttcaacttatccttatcaataaaatgaccaggttttccgcccgaaattcatttgctgtcgaaatcaggcacagatagtaagaaaagatgaaataacttactgtcgaaatcactcattcgaaaccaatcactgtcgaaaagacatagcaccggcgggggtgggatcccaaggattttcaaccccatcccctgttttcctatacgcgaaaaatgggattgcagaagcagcaaaccaagttaaaaatatatttttcgttcgttccaggccattttaa

SEQ ID NO: 75353 - DNA, 759 bp, Heterodera glycines
  Genomic contig location: Contig_ID=SeqID_11854; Location=538..1296; Strand=+
  SCN-specific regions: Sequence locations=1-140,162-475,498-534,556 -633,663-759
atggcgtcggatggacaagcgatggccaaatggcttttcactccacttcaaaacaatgtgccaaagatgttcaactgctcgttgcacttgaatgatgggattttgccgtcgaatattgaaccgttcaaagcggtgcttcatttcgtatttctttaatcaattttcccaaatttcaggcttttgccagtgcttcttcctccgtcaatttcattgtcgtcatttgttttcagttgtcttttgctgattccgttgtgccatttgatctgacaaatgaattgactcgggaacaattggcgttgaaaaggattaacaatagccatcgttttcttctaatccgttgtccaattgcgcgagacgaaagcaaatggacaaaatgggaaaaggaagcgattgtctggcgattttgtgatcaatgggatcgaattagcactaatacttattatgagaatgccatcggggatgggtcagtgaatgatttttaataaaaattcaatttttgcgtttatgtttagacttcttaacgcaactcccggcccaagtgatcagcagaaatgaatgaatgatttgctgagaaatggtcgatcaattttaattgctgtgtaggacatgatttgacgtttataaaattgttctttttgttacaatgatcactgatcacaaattatgttatacaatatatgtgcatattgcctttaggatatttagtgattttctgaaacagcgtttgttgttttcttaaaaactggctcaaaatcacaa

SEQ ID NO: 75354 - DNA, 589 bp, Heterodera glycines
  Genomic contig location: Contig_ID=SeqID_11854; Location=2191..2779; Strand=+
  SCN-specific regions: Sequence locations=1-274,296-589
atggtcttttccacacttttggcattctgtttggtgtcctcatttgactccgcttctgccaaagcccaatccgttaacaattcggtgcgaaatgatgaaatcatagaaaaaggtccaaccagcagcaaaaatgggctgttgaacatgtgcatggacagcggactgatcagcaacggaaaggccggagatgaggcggagatggatggtttggttgagctgttgactgagctggacgagcatgacagcgtaatccaagcagcattggccaacccgacaaaggtggtttctgtgaccagaaaattcgtggtgatagcaataccgtaattagtgagtgataaataatgacatggtctaatagcatatgagcagggtgcagctttttagttgtatatttatgcagcttgttttgatgagaaacacacgaaaaaacatgtgtttatccgggaattcattttaacatcactattcggcacacggaataattatcactttttttgctattttccccattatttagttaactctcatgtttttgaatttgtaactaaaaatctgcacccaaacttacctattcgtcattggaaagata

SEQ ID NO: 75355 - DNA, 1070 bp, Heterodera glycines
  Genomic contig location: Contig_ID=SeqID_11856; Location=569..1638; Strand=+
  SCN-specific regions: Sequence locations=1-478,502-535,558-631,653 -777,799-1070
atgtccgacgaaatcaaagaactgaaggccattacgctgcaaattctgaagaatcagacgttgatgatcgctcatttagtcaatcaggcacgccaaaataaaccgcagcaacacgtccaaccgccgctgatgttgaagcaggtcaagacggagccgtgtgagcctccgtcgacggtgtcaaagcgaaaggcgccgtcggccgtggagcagccattgaaggaaatcagtttcatcaacaaaaacaacggcggatgcgctacggtcaataaacgtcgcaggatgagcgcaccgaacaccgctgggatggccaccaaacagaacaacaccaaagttagtcgactgacaaatggtcgcaatgtgtcacgttttacactgactaagtgaaaagattacaaaataacgatttgagttttaagttctgcaaaatttgcgatgccgtggtggacgagaatagtctcgtgagtcacatttggtgcgtctttgaattgtcaatgtttaaaatgttaattagttctattcagggagcacattctgaaaaagatgatgaaagagaaggcggacttgtccaatgcgtacagtttcgtttgcgacgtcaacggatgcgtcttccgtaccaacaagtaattcaaacgggcaaaaacaatgagggagaagaggaaagggtgcaaaaactattcaataggagatacacaatcaaaaaagaatcgagttggtatttgggttatcgaaatttttgttgatgcgactgtttgccttcgtcctatttccgccccaattcagaagggtgtgtgtattatgagaatccatttggtttatgttcgtaataatttgcttgacttaggttggaagcggccggtggccatgccatcaaacacccggaagtggagcgtaacaaggtacaataagcacttctcactggttgtgttcggtgtcttcatctgtcgttgtttttgccttctttacgtctcatttttcaggttgtgttggacaatcgtgaaaattcggagccgctctttctcgccactctcgcgcaatgctacgacagaatgagcgactcggagaaggacgag

SEQ ID NO: 75356 - DNA, 2292 bp, Heterodera glycines
  Genomic contig location: Contig_ID=SeqID_11856; Location=435..2726; Strand=-
  SCN-specific regions: Sequence locations=1-516,548-995,1017-1360,1382- 1506,1528-1601,1624-1657,1681-2157,2179-2185,2208-2292
  Gene Ontology: Mol. function=receptor activity; Cellular component =integral to plasma membrane; Biological process=transport
agtggcccattaagtagaaagcataattcatttgggcgaattatggcatggaattaccgaatgttttttgtcagtttttgttcgactacgaaattccgcacagaccgggccaacatttgcactgccgctgggggttcaactcgggcagtgtttttacgggtaaacaaacaaattctttgattttaacttccaaattcgtggcccaaaaatgggacccggaattgtttctcttgccaggaatcaaccccattctttttcaatccgaacaaacatttcgttttgggtgtcgtcggcatcaccgcccctcgttactgtgtgttcggttcgaccgttactttggccgccaaaatggagaactcgggacagcaggaccgcattcagatggcactgaaaagctaccaacttctgtcggaacagtttccagagtttcggtgcattccgaggggaggagtgagaattgaagtaaaatgggggggggggacggtagaacagaggaaacctcggagggaatacggtaccgtggagggaaaatttgtggcggaaaacagaaaattgcctctattcttcccacagggagtcggcacccttttgacctattggttggagggcattgactctggcggaatgataagcgaccgctcagccagcgacgacccaatgcaacggtcggaccaatgacatcaaaaaagaaaccctaacaacgaaataaccattctttttttaatcattttttaaactcgctcaattatttgttgcacttcctcagtttcaaatgtacagacatataatttaacacaaacagaaattggagcacaattgatgacaattaaatgggaaaatagccaaatatgaggaaaaacaagtagacagtgttaaaatcaaaaatcatcgcaatatcgaattccacttcggatgtgcttcttcaatcatagcgcttgcgaaacaccttcaaacatttttagagaaaattgctgttccaacaacttttcgtccaatttttaaatattgtaatatagggtttttttatttgtggatagatgaaaacaaagtcccttttcgtcgtcacagacacaaagcattggactcacctcgtccttctccgagtcgctcattctgtcgtagcattgcgcgagagtggcgagaaagagcggctccgaattttcacgattgtccaacacaacctgaaaaatgagacgtaaagaaggcaaaaacaacgacagatgaagacaccgaacacaaccagtgagaagtgcttattgtaccttgttacgctccacttccgggtgtttgatggcatggccaccggccgcttccaacctaagtcaagcaaattattacgaacataaaccaaatggattctcataatacacacacccttctgaattggggcggaaataggacgaaggcaaacagtcgcatcaacaaaaatttcgataacccaaataccaactcgattcttttttgattgtgtatctcctattgaatagtttttgcaccctttcctcttctccctcattgtttttgcccgtttgaattacttgttggtacggaagacgcatccgttgacgtcgcaaacgaaactgtacgcattggacaagtccgccttctctttcatcatctttttcagaatgtgctccctgaatagaactaattaacattttaaacattgacaattcaaagacgcaccaaatgtgactcacgagactattctcgtccaccacggcatcgcaaattttgcagaacttaaaactcaaatcgttattttgtaatcttttcacttagtcagtgtaaaacgtgacacattgcgaccatttgtcagtcgactaactttggtgttgttctgtttggtggccatcccagcggtgttcggtgcgctcatcctgcgacgtttattgaccgtagcgcatccgccgttgtttttgttgatgaaactgatttccttcaatggctgctccacggccgacggcgcctttcgctttgacaccgtcgacggaggctcacacggctccgtcttgacctgcttcaacatcagcggcggttggacgtgttgctgcggtttattttggcgtgcctgattgactaaatgagcgatcatcaacgtctgattcttcagaatttgcagcgtaatggccttcagttctttgatttcgtcggacattttaaagtaaacaatgctctaagatttatagttttaatttggagagctgaatctgtaatactagtaaaataagaaaccttttctacgatttgtacacctttttctacttggactcaaaaaaaaaaccaaaatgg

SEQ ID NO: 75357 - DNA, 1681 bp, Heterodera glycines
  Genomic contig location: Contig_ID=SeqID_11859; Location=249..1929; Strand=-
  SCN-specific regions: Sequence locations=1-1169,1191-1247,1270 -1520,1542-1629,1651-1681
atgacttccgatttgggcacccaagtcaaccgtgacctaaagcgtcgaattcgcgtcagcggtgactttgtcccatccgtcgccactctctcagcgttcacttctcccattgactctcaccgtccaattgcgtccaatacgcttcgccaagctgctcggcttgtctttttgttggatgtgcgggagggactttaccgggaagaggcggaggatggtgaagacgaaggcggacggagcttcgacatgggcgaatttaacggagtcgatggtaagttctgggcagagattaaatcacagaacaaattgccaggcttggacgaagctgtgctgaaaagccgcaaccccattttggcagggattgccgattatatggtggaggaagcgagtgttgaagaagtgaatgacatttaaaaaacaatccaaaacgtgattctatttaaggaagtcctcttggaaagggctgcttccgtcgatgggccaattgtgtcgtcggagatttctttgcaatttgaggaagaccggtcgcttcttaaggtgcattttgctttggtgttctactcaaaattggacattttgtttgcttttagattctcgaccgtctcctgttttatttgcggattgtccattctgtggacttttacggtgccgtccattacccgcaagaggaccgaatgccgagtcggtaagcaactacaaaacggactgtccatttgtttctattggccaccagtaactttgagttcttgttctcagtctcggtttgttccacgttcgtcgcattccaccggcaaatgaaagtaccaaaagggctcctcaattgtcaaaaagtgcggtggatggacatattgaaggcttcaacgctcgtcttgagaacggactttttaagcggtgcactccactgagtgaacgggacttgcagaaacttgacaaaaaggacgcagacaagtgaaagactggcaaataagttgtggaaaactaagcttctttcacagagcggttgagctgttcgttaatgcgaatacgcaacaattgggtcccgagaaatggctttgtcctctctccgggaagaaatttaaagggcccgactttgtgcacaaacacatccattccaagtacaatgaggaggtggacaaagtgcgaaatgaggtgagccataccattgcgttcgtttaacttttcttctttctttttgcaggctctttattacaacaatttcattactgacccaaatcgtccccacagtccgcagctttttgaacagccaaaaacgcgtgccgagtcgcgccaactgatcgaaagcggcacagactcacaacatgtttctcctcacatggaatcaacgaatgagaggattcgtgagttgtaatattagtgattctttatgtttatttttcaccagcatttcaacgcggtacttcttcatggggtggaggaaattacggagccgaccgagttggtgggccttctcgctactgtatgttaatgttcaattgtatactagtgtaattttgatcagacccattaattaatatattttaattgtacagctggcgtttctcgccctccgatgaacactggaggatggcgacgcatggaaccaatgaatgaaacaacggtccggggtgtcaatggtggaggtggtggtgggatgcgggacccgcgagcgccgccgtcgtatagg

SEQ ID NO: 75358 - DNA, 1412 bp, Heterodera glycines
  Genomic contig location: Contig_ID=SeqID_11859; Location=2442..3853; Strand=-
  SCN-specific regions: Sequence locations=1-440,462-707,729-747,770 -1412
atgcctccacggatggcgccgccggacacaatgatgcgttttaatacgcctcgtcctgctccgatgtctcttcgtctggaaccgtggcaaatgttcccatctgctactccaccgcaacggatgatggcgcctacggttccctctcatccacaaatccaaccaatggtaccagcaacaactggtggcaccatgtcacaattcagcaacaaggaattgttggaagataacaggtgtgaggagggagatgggatcggcttttacaaattccaagcttgtttcattgtcaatttttccaagggttggttgctcgtcagcaggcggcggacgcggcggtggtacgggtcgaaaaggcggcggacgcggcggtggtgcgggtagtaaacgtaaagccggtgaattctttgaggtgattcttttattagtagttaacagaccaacaaagagattgttataggaattaactacttctccaatgcctccacggatggcgccgccggacacaatgatgcgttttaatacgcctcgtcctgctccgatgtctcttcgtatggcaccgcggcaaatgttcccatctgctactccaccgcaacggatgatggcgcctacggttccctctcatccacaaatccaaccaatggtactcggcggtggtccggatagtaaacgctttgaggtgattcttttattagtagttaacagaccaacaaagagattgttataggaattaaccattttatgcactgttcccatgacctttctttatttctccccttggttgtaatcaaatttcatttataatgagaaagtccatctcatttctctattcgctctttttagttcaaaaatgaatcctaaaaagcgtaaaattccacccgagttgcttttcgagcttgtttcttttcttccgtttgacattctttgggccatcataagggtttcctatgcttttgatggttttctatggcacagacaattttggtggattcgaaatgagataattcgccgggaggcagtaaggcgaaaagctgtaaaaaaatttttgtaaattaacaattatttaagcaaatgtcattccgcggcatttgtcaacgacttggtacattatcaaaagatgctcccgaaatggttatcgattgggcgaaaaacggtatattatttaaccatttagttattgaacatattttgaaaattcagaaatatgtgcccatttttccattcccatcagaattttcgacaacgtagaattcacagaaaaaataaaaattctgtatccaatgttcaaggatgtcaatactgacgaactatcgaccgattgcaaatgtaatttttgtagttttttatcttttcactttgaatttttagttgtgtctgacatttgcgatgaaatagaaagacgcaaacgaatggcttga

SEQ ID NO: 75359 - DNA, 1718 bp, Heterodera glycines
  Genomic contig location: Contig_ID=SeqID_11860; Location=333..2050; Strand=-
  SCN-specific regions: Sequence locations=1-307,329-665,687-964,986 -1105,1128-1250,1279-1339,1363-1502,1524-1718
  Gene Ontology: Mol. function=organic cation transporter activity; Cellular component=integral to plasma membrane; Biological process =organic cation transport
gttctacgaccaggacgtgatgcggtccaccatcgtgacggagtggaatttggtgtgcgacgacaacttcaagcgtgcccatgcccacctgttctactcgttcggcttcctgttcggctgtctgctgggcggcttcgcctccgaccgtttcgggcgcaagccgacggtgatcggcttcggcattctgtcctccatgttcggtctgctgctgccctactccacctacttccccatgttcctgttcatccgcttctgcggcgcggtgtgcaacgagggtcagtcctttcagttaggatggaaatttcctgaaaaatacaaattcaccgaatttccaaaaatatttttagcattgtattgtaatttgtttttctaaaatttgaatcattcgaaatccgacgcattttaaaagaatgttcggagttagacaaaatttagccacagaaattttgccggaaaaaaatatttaaaaagtccaaaaaacaaatttttgcggttttctgaagaattcaaattttttaataaaatgcattttttcaaaatgtatcaaaaaggattttttcaacttttcttggaattgtctaaagcaaaattaatgaaaaggctaggaactaaaaattttagaaatttttttttggacttttcttgcggccttttggtccctcggatttaccaatttccataaaaaataagtgtgattacaataattaaacaaaccatcgctactgtccccttttcagctgctgacctggccgcgtatgtgctgtgcatggaaatcacgggtaattaagtattaattatttccattttattactatttttcatttgtttcattttttccaacccatccccatgattctcccagggactcgctatcgtgcaatggtcggcagtttgctgcaggcgccgtgggcggtcggctacgcaacgttggcactgatcgcctacttttgcaactcgtggcagaacattcaggtaaaaacaacagtgtttgagggagaagggatgctcatggcgatgtttttctgctaaaaatttttttgtgacaatcccaatgttttttttttgaaaaaactcctaaaaaagttagaaaaccaaaaattttcagttttttaataaaaaaaaattaaggaaaaacaatgcggaacaggtcgtcttaggaattttcttagtacgaaaatttcaaggaaaaaaaatttttaagaaatttttcagcgattttttagaaaatttttgaaaaaacttggtagttcattataaaatttctaaaaaaatttttttcttgaaattttcgtactaagaaaattcctaagaatttttttatgaaaaatttctaggtttgaaaatttttttttttaaatttttcggggggaaaatgaagtgcccccaaaacaatgcgagatggggggggggatttaaaaaaattaaaactaatcacactaattaaataattataaaaagtcctaaaaccaaaaaaattttcttgacccattgcgtttttcattccattattttccgcttttttcagttgatcactgccgcgctgcacacggtgagcatctgtctgatctgtgtgctgccggagagtccgcggtggctgatcgtcaacaaccgcgtggacgaggtgtgtcagctgcggcggtggattcctccgtactaatgccatttacatttgttgccctgtaatttcaggccgaacggtacatccgcaaggcgtgcag

SEQ ID NO: 75360 - DNA, 220 bp, Heterodera glycines
  misc_feature (160)..(160): n is a, c, g, or t
  Genomic contig location: Contig_ID=SeqID_11863; Location=925..1144; Strand=+
  SCN-specific regions: Sequence locations=1-167,210-220
tgtaccagggatgggccaaattgaaaaataaaaagcgaaatgcgaaaagcgaaatttgcgaaactgaaaatgcgaaatgaaaaaaaagcgaaatgcgaaaagctaaaatatgcgaaaatgcgaaaggcgaaatgcgaaagcgaaattttttctacaactntttaatagttaaaatcataaagcaaaaatcattttttaaattttatattagccaatttat

SEQ ID NO: 75361 - DNA, 2971 bp, Heterodera glycines
  misc_feature (2956)..(2956): n is a, c, g, or t
  Genomic contig location: Contig_ID=SeqID_11865; Location=372..3342; Strand=+
  SCN-specific regions: Sequence locations=1-184,207-1059,1081 -1384,1545-1859,1881-1952,1978-2926,2952-2971
  Gene Ontology: Mol. function=voltage-gated calcium channel activity; Cellular component=voltage-gated calcium channel complex; Biological process=calcium ion transport
atgcccaattgttggagcaaattcattggtcggacattgaccagcagtaccggcggaaccgtgagcagctcaaagacctcaattttcagaagttctgctccgagtcgggctttttgcgctattttccgtccgccccgtggctttgggaggtgtttaaagcgtcaaaatgtgccgattattccaatttttgcccaaggaccgttcctcggagttggacctgttcgactgtcggaacacggaatggtacgtcaacgcggccaccgcgtcgcgtaatttggtcattttgctggacacttccggctcaatgctcggccaacgcttcgaaatcgcacggcagacaatcgaagcgattctcggcactctttcggacaatgacttcttcaacattatcaatgcacgtgctccgccccaatcattaattgctgcccataatccgcttctcctccttaagttttctaagcaggccatccttttggaggagtgcgacggcaaaaaattggtgcaggcgacgctaaggaacaaaaagttgcttctctcgcggctgtcaaatgtcagctcagagggaaaagcggactacgaaatggcactgcacaaggcattcatggcactgatgaacgtgagagccgaagagattattaaagccaaactgagagcttagataaatgattgaatgttgcttaagctaagctaacggtacccctcagcaaatattaatttgttgctaattgcaatttctaatttacttaacttttgccttggactgcttatgcacataacttccttaaatacccttaattaactaattaattgctttttaatgcctttctcattgccctcctaccgctcaattgtctttttgctttccaccgcttttcgcttgctcagttgccggatgaaagtgtgcgtcttcgaagcaaagaggaagcggcgcgtgaagcggcgcgaagggaagcggcggattcgcctgagtcggagagagccgcggaaggaatgcgccattttgtgttggaggacaacgttttaacagtgccggaacgctttatggaggcggttggtccctttgctgctttgctttgctttacctccgatcactttttccgctgctattcttctgatctttttccgctttgcttttcctctaatcactttttccgctttgcttttcctctgatcactttccactttgcttttcctctgatcacgttttccgctttgcttttcctctgatcacttttcccgctttgcttttcctctgatcacgttttccgctttgcttttcctctgatcacttttcccgctttgcttttcctctgatcacgttttccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttctcttccctttctcttttccataatcatttttcaattaaatatcaatctcttttttcctgttcaagattagcaaatatgcgggaagtgaccagcagatgggatgccaggatatgatcatgctgataactgatggagcacccggctttttccgcgaaacattcgaattgttcaatccggaaaagcgggtaaaaagggcgaagccaacaaaagtccaaaaaatgccatttcaaaattcaggtccgtttcttttcgtttgtcgttggagaagaggcaaaggattttgagcaggtgcttatcccttatattcggccaaatttgaatttgaaaaaggtccgatggatggcatgtgcaaaccgcggatttatggcacatatcagttcaatggccgacgttcaggaggtgagacaggcgaaaatatatgggaaaagagagagagagagagagagagagaaggtaattaattacatttgatcaaggcaattaaaaatgaaaaaacaaaggaatgggcaacaaaaatacaaacttttcggggatgaaacattcaaatgcattcaaacgtttatccacttaccccatagaaagtgcagcaatacgttcgcattttgtcccgcaccgtttcgcgacaaaaggccgctttcaccgaggacagtccgttttggagtggggcaacccgcgaaagaatggtcagtcggtgaagaagggagacataaagcggggggaaagggagggaaaagcgtgtccttagtagcaatggattggtaactttacgttaacaatttcgccaaatctctccaacagagcgacgacttcatcgtttctgtttcctttcccgtcgtccttcccgacggccaatttatgggcgtttcctccgtcactgtgccactctttgaactgtcccaattggcccatccgtcgcgcgtcggtgcgcggagtcattttgtgctgttggacggcagcggatacgctctgattcacccccaactgaggccgatggtaagcgaaggaaggaagaagcaattatggcattttgagaatatttggctaaggaagagacgggggagctgaaggccggctttaacagcatctcatggcacgaggcggaagcgcaacggacgcattcgccggtaaggcaaattcggacgaaaatgccataaaacggagcagatgctttgccattcagcaccaccaaaagcgatccttcagctgctcaacaggcgaaatagaaccaaaaaagcaacacactctcttcgcggtggacaaaatggtaattgaggaggaaaagcataggaaaagcatgaaaggagaaatgcgggaaggaaggaatggcatttgacaaaaggacgacacttttctttcgtgatgcgacatttgcgccgcccagcaaaatcgacatttgcgccgcttttaaaaaattttaatttcaactagantatttaatcaaatta

SEQ ID NO: 75362 - DNA, 1132 bp, Heterodera glycines
  Genomic contig location: Contig_ID=SeqID_11866; Location=549..1680; Strand=-
  SCN-specific regions: Sequence locations=1-88,113-320,343-948,972 -995,1031-1132
atggacgtctatgtggccctcaattctggcgcgattattgattgtttccatgatcaaaagaatggactcgccagccttaatggtatgtcaattttttcaaaataagattaataaaattacatgctcgagtacatctgtttccagtaaatactcagatccgtcgccgaaaaatcttatcttccagaaatggcagattttttcacaacgcaggcagttacagatgtcgtacagtcgaagggatgctatctcgtagaattccttcccttcgtcctcaaaatcgcgttcacattgctccctgtggcgatgcgagcattgctgggtttttaattattattattattaggccgctctggtctttcggcgagcaaagagcccgccatcaggcgagcaaagcgcccgccatcaggcgagcaaagagcccgccgtcaggcgagcaaagagcccgccatccggcgagcaaagcgcccgacgtcaggcgagcaaagcgcccgccgtcaggcgagcaaagcgcccgccgtcaggcgagcaaagcgcccgccgtcaggcgagcaaagcgcccgccgtcgggcgagcaagcgcccgccgtcaggcgagcaaagcgcccgccgtcaggcgagcaaagcgcccgccgtcgggcgagcaagcgcccgccgtcaggcgagcaaagcgcccgccgtcaggcgagcaaagcgcccgccgtcgggcgagcaagcgcccgccgtctggcgagcaaagcgcccgccatcaggcgagcaaagcgcccgccatcaggcgagcaaagcgcccgccgtctggcgagcaaagcgcccgccatcaggcgagcaaagcgcccgccgtcaggcgagcaaagcgcccgccgtcaggcgagcaaagcgcccgccatcaggcgagcaaagcgcccgccgtcaggcgaacaaaagacagtgcccataagccacctcttgtgcttgctgccgcctcgtccgcgctcctcctatcagactcaagcgcaggtaaagagtggactccttctggatgttgtagtcggcaatagtttgaccatccttgagcgtttttcctgaaaagtgcattagttttcgctaattttcatgttttagtaattcttacttacattccttattattacaataaa

SEQ ID NO: 75363 - DNA, 1098 bp, Heterodera glycines
  Genomic contig location: Contig_ID=SeqID_11866; Location=2093..3190; Strand=+
  SCN-specific regions: Sequence locations=1-215,243-251,274-387,409 -526,548-620,643-665,687-1098
atggatcttccgtcttcaagcggtaccgtggagttgttcgaccgagggttggcattctctgtacaggaacgatacggtctacaaacggctgcgacattgcgacaaaaggacaaccagtttctcacaacatcacatgccttcgcccccactgaaatttctgctgatgctctttttaaatctgtcgttgctacggcaactgtgcaaccacaacaaaaatcaccaccatcatcatcattatcatcggcatccccacaacaacaacaacaacaacaatcatcatttttggcatcggcaccaccaccgccacaacatcgtcctcaccaatttattgattgtgaaggaaggctcacaacacacctaataatagatgagggcgaagagttagaagaacagcaacaccaaaaccaacaatattcacctatatctgacaatccatttgagggtgtctcgcaatcgggcaccgagatccaaatcgcaggcttaatgacttctattttaaaggtgtttttttaaaatcaataaaaaactaagtttttaccaaaaaatgataacccacgggaaattgtaatttttgtaattttgcgtttttcggaaaagaatggaatttctttctggttatgaaatttttgaaaattttgtttgagattttggtttccgggtctattaaaaacctcaattaaatgattgtcaaaaataatacaattagttaaaattaatcataaaatttaacattctgacgtttcccacaaaagtttcaaaaatacgcaaaatcctcaatgaacttatcaaaaaacacaaaatgatgataaaaatcctattgtttagcgtatcccctctacttccggctcatcaacctcatcaaagtctggacatgaaattcggaagcatgtccgagagttgtacgcagaattgggcgagaaaaatgagcagcaacgcgagagagccaaaaacgccattgagacaaaaaatgaaggagggcggaagcgatcaactgccgagacagacaaaataaaaaaaaaagtcatccaacatcttaaatataaacattctcatgagtgttcgttatgcaattctattcacgctgcttatcaaaaataa

SEQ ID NO: 75364 - DNA, 267 bp, Heterodera glycines
  Genomic contig location: Contig_ID=SeqID_11868; Location=1383..1649; Strand=-
  SCN-specific regions: Sequence locations=1-267
ttgaatttcaactctttcaactgcatcccaacggcacccgcgtcaaactgcgcccaattcccgtctgaattactgtatcagaagcattttaaaataattactgtaccatggcgagtgggagaggcagctttagaatgccgcatactgtaattttggaataccgtacccaatcaatcacacattcgcatttatttctcagctgtttttgttgcacaatcaacacaaatcatttgataaatgattggatcatcaaaatgaacaaataaa

SEQ ID NO: 75365 - DNA, 840 bp, Heterodera glycines
  Genomic contig location: Contig_ID=SeqID_11869; Location=411..1250; Strand=-
  SCN-specific regions: Sequence locations=1-35,57-288,310-333,355 -473,500-697,720-840
atgtgtgccaagcaccaggcatggttgaagaagaatggaggaaagaatgaaaaagcggcgaacaacgtccgcgttggaagagttttcctggttaaatctgagaaccagaggaagaatggaataatcgatgtaccgattgatgtgaatggcaccaaagtggatttcattgctgatttaggcactgagggaactgttctttgtgaggacactgtgcgccaaatcggagctttgaaattgagccgttgtcaagaacgtgctcagtaccacgatggcacaactcgtccattcgttggcaaaggaaagacaactttttcgttcggagaccgctcatgctatggacatttctttgtttccaaagacggatccaagaatttgctcggattggacatgatggacagacttggattgtcggactccatcagaaatggtctgaaggacaaattccgaactgaggcttccaaagagaacggagcgagccaaaagaaaaagaagaaattcttcagaaaagacggacgtggcaaaaagaagaatttcttcgctgtgggagcgaatgtgatcgccagcttgggtgatgagccatggcgtgccggacgtgtgatcagccgaaaagaaggcacttacgacgttcaatttttggacggcacgactggagaattcccggcaaaaggtgtacaaccgtacaagccggatgaagatgaaaatttgaattttcttcttgacgggtttggtctgaagagagcctcatccggtggatctatcgggaagcacggcagcgatggccgacgagatcaaacgaaagatgatcttcgagaagcttccgactgtggacacaaggcataa

SEQ ID NO: 75366 - DNA, 756 bp, Heterodera glycines
  Genomic contig location: Contig_ID=SeqID_11869; Location=1211..1966; Strand=+
  SCN-specific regions: Sequence locations=1-445,467-756
ctccattcttcttcaaccatgcctggtgcttggcacacatcctttccaagtggccactcttcttgcactttcggcaaacggttttttcatgtcgacaattcctcgacgaatggctcaaaccgcatcgccaacatacgcgttgcgatcgattgctgctccgtgttcctgtcgaaatgctgctcgcattcgacgaaagatcagttcgttcgtttcttttttgccttcaatttggtcgccatcaagtttcgtgagcccatcggttgttgttcgaggacctttgcttcagcgatggtcgactggtacatttggaggtcttcgacgactccatcatactcgaccaggtcaccatccgctgcaagcttcgaaaggattcgctttctcagctcggcatccttcggtgatttcagtgccgtcaaaagcatgaggcaagaaaattgctcttcgttgagcttttcaaactgaaaatcacgcaagagtcgcttatgtctgttgataaaaggacgaaagctttcatcttcgcttttcgaggccctcagacattcatagcgatcaatccaaatggattgtggccggctgaaggcaatctttaggcgctcctctgtttggctgtagtcaaaatcgatgactttcttcggcagacatgacttgctgtactggctgaaagccacttcactcagcttcgtcatgagcagcttgacctttgcttcgtctgccagttgcggtgccgcacagtcgagggcaaaattgaagcgttcc

SEQ ID NO: 75367 - DNA, 711 bp, Heterodera glycines
  Genomic contig location: Contig_ID=SeqID_11869; Location=1408..2118; Strand=-
  SCN-specific regions: Sequence locations=1-442,464-711
atgggcgacgcaatccaacaactcactgcggcaatccagcaattattggcaaatcaaaatggtgcgccagccgcaaatgcgcatgctttgccaacgcttccgaccatcgactgttttgagccatcagacgatagaagcatttccgattggttggaacgcttcaattttgccctcgactgtgcggcaccgcaactggcagacgaagcaaaggtcaagctgctcatgacgaagctgagtgaagtggctttcagccagtacagcaagtcatgtctgccgaagaaagtcatcgattttgactacagccaaacagaggagcgcctaaagattgccttcagccggccacaatccatttggattgatcgctatgaatgtctgagggcctcgaaaagcgaagatgaaagctttcgtccttttatcaacagacataagcgactcttgcgtgattttcagtttgaaaagctcaacgaagagcaattttcttgcctcatgcttttgacggcactgaaatcaccgaaggatgccgagctgagaaagcgaatcctttcgaagcttgcagcggatggtgacctggtcgagtatgatggagtcgtcgaagacctccaaatgtaccagtcgaccatcgctgaagcaaaggtcctcgaacaacaaccgatgggctcacgaaacttgatggcgaccaaattgaaggcaaaaaagaaacgaacgaactga

SEQ ID NO: 75368 - DNA, 1133 bp, Heterodera glycines
  Genomic contig location: Contig_ID=SeqID_11870; Location=542..1674; Strand=+
  SCN-specific regions: Sequence locations=1-49,138-439,482-879,902 -947,978-1133
atggccgatgttgaaatgcaagaacagagtgtgccacttaaaaatgccgagcaacaacaaccaacacaacaacaacaaatgaccacggaagggacggaaacaacagcaacaacaactacagtaacgacgacagtaaccgcgccgggcactggtgtcgccgttccccaacaaggggaagaagccccgccggcatcgaaaagcaaggagaaaaaggggggaggatggttcgcaaaaaaggtattgtaaattgttttgttcgaacttgctgaatatgctccgaccagcaaatatttacttctaattacacaaatacaactcatacgttagttagctgaaatgcgtagagttatgattaggggccaattattttcatttttgcctattgtacgctactgctttttatatttaattgatgctgaatattaatcatgtatgtaggtaaaataaattaaatttattttttcatgaattatttaattttgtttgcttaattgaattgctttgcctttttgaagtggtttgtgcccaaaaatgggcgccttttcatggtttagctagtgtccgggattttgaaccagggttgacgatgaaccaggactacaatgaaaacgcgtagtttttcggtactccaatttcggtattttccaaaataaaacctgggttcgggagtcctgccggtcccttatgggctggcattttccttataccagcgatcagttactactgtttgcttacagtaataatacgcttttaagaagacgcaaaagtcgccgcatgatggtggtgatgaggaatccgaaaaattggttagcagtgacaagaaagcgaaaaacctagcagcagcagcagcaggagacggaggtggtggtgatgagaaagaggctgcagcagcagagacaaacaatgtgaaggatgaagccaagaaaatgaagaaggacagcagcaacggcacaaagcagcagcagcaacgtgccaaatgcccgttcagtctgtgccgtggtgcgcgaaaggtggaggaggtcggccatgccgagcagcatacgacggcgtcgcaatggggcgaacgggagccgacgccgacgacgacctttcgctttgaccttgtccaacgcgattcggccaagctgcaggaa

SEQ ID NO: 75369 - DNA, 642 bp, Heterodera glycines
  Genomic contig location: Contig_ID=SeqID_11871; Location=1651..2292; Strand=+
  SCN-specific regions: Sequence locations=1-93,115-642
atgtgtgagcatccgcgcgaaggacagcgccaaatgaagagaatgtgagtaaatatagttccaggctatttttggcaacctgagttttttctgggcctgatttttgtatagaaaatagaaggcccatttttcaaaacgagctctaatcctccatttgcatgaaaaaataacaaagttttggtttcgggattccgaaatttttcgatgggattttctgaataatctgaaaaacccaatcaccataaagctagacatagactcgaatacgatggcaaattttttttcaaaatccactacagtaaattatgtgccgatgtttgctacgacgtgctcgccttctttgggcctgtaatgctcgggctcggaattgcgctggtcagcggcaaattcaacgcggtggccgaccatttgttgagacgaaaactgtggacagttggccacattcaaattcgccgtgccaaggacggcattgattggatgttggacattgtcaaggattaccaagacgcgcagaaagccgtcacatttcccgtcgccgtgtcaccacttccgcttggcataacagatttcaaaagcatccaaataaagtggaatattttagtgcattcatatgagaaacaaatatgactgtgaccagaaaaa

SEQ ID NO: 75370 - DNA, 1228 bp, Heterodera glycines
  Genomic contig location: Contig_ID=SeqID_154; Location=471..1698; Strand=-
  SCN-specific regions: Sequence locations=1-48,70-219,241-462,490 -523,552-676,725-819,841-878,908-989,1011-1090,1112-1228
atgatgaaccgcaccatgtttcgcccaggagttcaggagtatgttcttatgttgttttattttaaaaaatgggctgggattggagaatgggttttttttttgaaattgcactggaaaaaaacatagagacaaaaaaggctaattcctgggattgaaagaatgttaaatttgaacccgattttggacacaggtgctagtgtttgaggcgcgcaaatgtggggtaaccggagagggaggaagggaggtccccagatccgcacgcactcatatttttttcaaaaaaatcaacttgctcaccactttatccgaatggagtagtgatcgggcagcagcagcaggacctccttctgctaaaattatttccatgctgtccgtgaatcagccagcgtcttgcagtgtctgaaaaaatgattcttttttagcttgagcgtaggtggtgagagaaaataccacctaagcctcaaaaaaaaaaaataataataattttttgtcctttctcggcctaaacggaaggttcgaatggaaaaaattgaaaaattttatatattaaacagcctgtgtctctgacaattttgaaaaacttgacatttcttagggtttaatacatttttttgaaatttgggggatgtgggggggggggcaggatgaagtgcacacgttcaaaagcagtgttgacaaatattttgatatataaattaaaatttaaaatctataaaaaaatttaggctttttgggcacccagaaaggagcgaaattaacgcaaatgacaatgacgaggatgccgaactgttgagcgtgagtgaagcaagcgtggctagtgatgaaagtgaagaagagttcgaggacgacagcggcggttttgtggtttgagatcagaatttgatttgttttttaatatttattttgttggggaagtttcaaccaacccgtttttgtattggtccgtattttttttgggttgaaacctgacgacaaacgaggtcaaattgatgaaaattttagattttttggtgttcaatctcggaataaggctttttatgtcattttaaatgttttgggaataggttaagttaaaaccacaaattttcgagtttagaaaattaaaaattttctaaattcttttggactcatttttgatcaacaaaattttttttcaaaaaaattatgaaagcctgcgtatattaaaaactgtgaacactcgcctaaaaagcatcctgagttgaataaa

SEQ ID NO: 75371 - DNA, 71 bp, Heterodera glycines
  Genomic contig location: Contig_ID=SeqID_154; Location=4399..4469; Strand=+
  SCN-specific regions: Sequence locations=1-71
gttgagcatcatctgttccgtcgtctacggtggcgcccgtccaaactgttgctgtctgttgttgaccgatt

SEQ ID NO: 75372 - DNA, 1370 bp, Heterodera glycines
  Genomic contig location: Contig_ID=SeqID_154; Location=5043..6412; Strand=+
  SCN-specific regions: Sequence locations=1-703,725-1149,1173-1370
  Gene Ontology: Mol. function=lipid transporter activity; Cellular component=integral to membrane; Biological process=transport
tagacaaatgtggtgaccaatttcatcgctggcggcgtcggcggctcatgcgccgtcatcaccggccatccgttcgacacggtcaaagttcgactgcagacaatgccaaagccggcgcccggacagccgccactgttcgccggcgcgatggactgtgtgcgccaaaccatggcacgggagggattttttgtgaggtttttttgaaattaaaaatttggtcttctaatccgcttccgtcacaaatggacagttcaaatatgagtttttctcactaaaatcctatccaacccttaactcatcgaccgttttatctgaacaatagtcgcaatttggttgaaaaagcacacttttcaaagagttgtgaggtttaaacaactgacgggttgtgaataaattcggttttggtgggatttcctgaaaaaaaaatctcagaaaattttggagatttgttttaatctcggattaattccgccgaatttcggtcgcatttgatcgccaagtaaattcatttgctgttcattcatcagtcatcctttggttggggaaatccacttgttttcttaagtggctgaagtgaccccaatttacggcactcacattcgttcattcattcaaatgatcttctctgcctgccgatttgttccccgctcaaaaaccagcagctctcacataacgccaaacttttcgttttgtctggggccatttttgttcttttttgaattgaaattcattttgaagtgccagacttcaatatttagattctttcagccttttcggcagaattcgaaggcaatttcccaaacattaaattttcaaacttgggaactcaaaatttccagaaattctaagtaattcccgcactttccaatacaatattcaaatccggggggggggggggtaaaattacttgctattagtgagaccttcggcgtaagctttaatcccatggaacattcaaatgaatttgattgaaactcccgaaaatgccaaccgctcttaattaaatgctaaaactcgagactcccgaaatttcgtcaaaatgccggcaaattctttcccgatcaaaaagccatatagctgcttcaacatattgctaattacatatgaaccaaccacaccgttctttgtactctgatcgcactcagagtacggcggcgggggcgggcggcgcgacataaagtgcccgccacccaccgacggcaccccaaattgcttcttctccagaggcggcggcgtcatttgttatgtgcctatgccccgctaatgggcgccgctggcgcctcattaggcgctggctgctctcactaatcagtgccggtcggtcggcgctatgaaaccatttgttctcagccggcggcgctctcccaccc

SEQ ID NO: 75373 - DNA, 705 bp, Heterodera glycines
  Genomic contig location: Contig_ID=SeqID_154; Location=2977..3681; Strand=+
  SCN-specific regions: Sequence locations=1-98,120-705
atgaccaagctcatgcagggtggtgcgggctttggtaagtcgccccgttctttcgcctctttccatgctttcggcaagccttttttcgtaccggcgtctccgtcgttgtgctttttgttgtccagttaaagcggccatagttagtgataatttatttaaaaataacagaattgtgcagatctgaattcgcaagccaatatggcaagacgattaagcaacaaaacacaaaaacaaatgcttaaagatgcaaaaaacacttttttgtttgtttgtttttttttgcaatttacgacttgggtagaagcgtgacatcaatactcatttttgagtgtcagaacatatcgcatcaacagttttcgaatatgccattacagtaaccttgcgtttcaaaaaaaaagtttctgatgccattacagtaacctcgcgtttcaaaaaaaaagtttcaaattcttgcgcttaaatggcagccctcaatcggctacggttcgctgagcattaaaaaaaaaacgattgataattcaaatttgcacaaatttatctatcaacttcagaacacgcagccaatttgctgcatcttttcagaatacgtccgctgttgttcatttcctgacaagcaattcggttgaactgagcagttttggagggtaatgcgttaattgtgtcaaaggcaaaattttcgactgcttttcgtttacttacaaaaaa

SEQ ID NO: 75374 - DNA, 926 bp, Heterodera glycines
  Genomic contig location: Contig_ID=SeqID_155; Location=1406..2331; Strand=+
  SCN-specific regions: Sequence locations=1-257,279-322,353-926
atggccacttcctccacaggcaatgtcaaatggtacgagtaccatatgacagcgatgagttgccgagccttgacgagttgccagaaatttaagatgaacgcaaacggttcaacgacattcacgaatttaaaaaaaatcggtgcttttgatcagtttacgcccccccccccctgtcgctacgctcttgcggagatccgaatttgactaccattttcgcccatgtcgaattgcgaattcaaacagcattttggaaaagtacgaggggataattttctgggaatttcagccctcatttgagcagccctaattggtgcatttaatgtgaaaagtgaaagaaataaaaaatatttttgacggaaagaatcatcaaaattaacgagtcaaaaaaataagcatcaaaaaatggaacagcagatcaatttgtccattcaataaatatttcacttccgcacagttcgacgccgcttctttttacctctttttggtggggacaataatggcctaaagaaatgccaaaatctattttttatctcgaaattttttttcttaattcaataaaagaatggtaatactattctgttttggcctcatttcattttctttgcccgaatttgaacaaaaaggcgaaaaaaaaacaaaaaaaaaattgtgaaattattaatcgcaattttaatttttgatttttttaaggatatgctcaacatcggtgtatttttattaaaatcaaaatttctaatttggtattgatttaacgtataggaaaaagatataccgtacgaagtaaatatattagagaccgagccggaccggatccggtaccggatttttctggatccggcaatccggtccggcgattttgggaaaaatctggattgaccggattaccggattatgagagaccggatccggaatccggtcatttttga

SEQ ID NO: 75375 - DNA, 132 bp, Heterodera glycines
  Genomic contig location: Contig_ID=SeqID_156; Location=200..331; Strand=-
  SCN-specific regions: Sequence locations=1-90
atggacggacgaaaattcgatcaatttgaacaatgtcagcattcatttgaatggcgcaaattgcatttggtgagcaaaaattggataaacatttaaaataattaaaattttagaaattttgattttaataaa

SEQ ID NO: 75376 - DNA, 1384 bp, Heterodera glycines
  Genomic contig location: Contig_ID=SeqID_156; Location=1529..2912; Strand=+
  SCN-specific regions: Sequence locations=1-869,891-1384
atgtcgcaaaaatctatttctggttttatttctaaaattacatttgaacaatcatcttcaactcaaaatttcgatgaacaaatttcaagtgctgaggaagcaatttctgatttagccgtttctgtttcgagtgatgagttttgggtgaattttagcaaatgtacttttgtatattaaattgatttgttcactgagattgctgagttgaaacagacactgaaagagctcgagggcgactggttcaataggaaaaacgtggatgaaaaatggacggctattttcaaaaatcctaattttgtcctgctcaaatcactagtctctgcaattctatcaattttcccttccaatgccgtttgtgaatctgtcttttctgttctcaagaaaatcaaaacggacgagaggaatagtattggcatacctttgttgaattctcttatttcaatcaaattcaattcaaaaatttcgtgcctaaatgttcacaattattttctttcattggcaaacttgctcaaacaggtgaaaagtggtgataaatatattgtttaaatgtttttgacgttttttacagtgaacaattgacctaaaaaaaattgccgggtttttgccgggtatttcaactggtttgccgggtttttaggttttggcgatattgaaacggggcgaaagcaatgccaatttgagaccaagttgggcgccaaaaaatgggagaatgtccatcaacacgtcgttgcacacccaactgaatgaaatgcgaggaaaaatgattgagcgcttttatcttaatttatgttcaccaattggggcggtagaagaaatgaggcggcgattgtcggcggaggaaaacttgctttttttgtgacgggcggtgccattaaaaataataataattgcccaaatgaaattttgtatgaaaaaaaatactcgagaccgagatttccaaaattcgccggaccggtaccggatccattaaagaccggtacaattcccggtcccgtacaactctatttgaatcaaatcaaatgcctccatggacggtaaaaaaatttaaaaagcgccaaaaaaacattggcgtaaaaaacataatgccaataattatacagaatttcatcatttattttagagaccgagatttccaaattctccggaccggaccggactggtattttaaaaaatgaccggatcccggatccggtctctcataatccggtcaatccgataatccggattttcatattgccggatccggaaccggattccggattggtaaaatatttaaatttcgatgttaatttagggaaaaaacccgcaaaatgtcatcaattatatgtaaaatttggtgcaccagaaaatgtcgccatagaaaagacaatgcgccgaaaaaaaa

SEQ ID NO: 75377 - DNA, 1526 bp, Heterodera glycines
  Genomic contig location: Contig_ID=SeqID_157; Location=606..2131; Strand=+
  SCN-specific regions: Sequence locations=1-1042,1064-1150,1172 -1359,1386-1494,1516-1526
atgacaaagaaactgcgcgccatggaagtctcttgggcattgggcgccgctttccatctgctgaacacgtaccatgacaacatgaagcgcgaacggcacggcaggcggcactcgcgcgaggagttggagcagcgcaggcgggcagtcgaggagcgcgaggcggccgcagacgcgcgcattgccgagttggcgaacagcaggaacttgctgaaatcagtgggtgggccttccgagttatgacaaatttcgttgggttttaaaaaaatctacggccaaaaatatttagaaaccaactttgtaattttctggtcataaattttttaaaacccaagaaattttttgaaattttttcccatttgataaaaatgtttcaaggctttgcctgcatggctgttgccaagacaaccgttaacgaaccggtacggcctcttcaatttgctcactgatcatgacgatgatgcatggaatggctttttcgatgcctatgtgcgccaatacgttggtgtccgtcgccggccataatttcttcgacgagaacaatgtgaccgtccaatggaggccaaatggacggcggattgagggcagttccgggtccggcacagtgctgtgcgctctgtgttcgctggcgaccggccgtttgtgcagagccgacacggcgataacggcgagagttgtttcggctccttggctggagagcgttgggggtttggagctgaaggcggcggctgcgcgaaatgcgcgggtgagacgcctggtgatgtcgcggactaatcaagtgaattggcacgcattgccagctgctgcgacggtcggagtggaaccagtgtttgtggagggcgttggggaattattggaaaatgtgctcgtttgatggggattctcatttgttgttttgcttatcgggcggcccgggattggtgggttttaagcacggcattgtttttgggatgggtcgcccggccagggctgcacttaccaagttcaataataatgtgagataaagggaactgaacattttctaaacaaaaaatgtaacatactcaatcacttttttaaacacaaggaaattttaatcactaattaattctggaaacaaatctttttgtgcagccctggttattagtgcatatatatcattcacccgatttttaaaaatttaaaacaatgatttaatttagttggttacggtctgcactatgtgtcgtactgtaccagctaatagcattgtgcactttgtagtaaaaaaattaatttcataaattttggaaggtgaacaactttttaatttcgggcttaatttaggtgattaattttaagtgtaagggtgaatgaatagatatgcctaacttacgttatcatattttttgttttgtttcaatttggataaaaaacacaaaatggcaagttaaagaaagacgtcaaaaaatatatcaaaaaaaaaaaaatcgttttccaccgtttgtgccatccaatttgtgccaattcgtccgcacttaaaatttaaaatacaaaagagtatattcaca

SEQ ID NO: 75378 - DNA, 392 bp, Heterodera glycines
  Genomic contig location: Contig_ID=SeqID_1698; Location=5..396; Strand=-
  SCN-specific regions: Sequence locations=1-6,29-44,98-392
atgttcaaaaaagggttggtttttgaatttctcagatcaaaaactaattttttttttaaatttaacaaaactttttaaaattttacaatataataaacagggctgcaaaaaatatgcacgaaaagtggtcaaaatatgcaaataaactcgtgaaatatgcaccaaatatgcacaaaatcacaaaatatgcaccaaatatgcataaaaaacatgaaactgaggggtgtaaattcccggtcaaaacggtcaaaacccgggactttggggtactcagttgtccgcttccaggtcccggtcccgtggcactctacattatcgagtacagttctggcaccatttagtgctgttcaattgaattgaaagaagacaaatcgttctcctctggaaataaa

SEQ ID NO: 75379 - DNA, 1194 bp, Heterodera glycines
  Genomic contig location: Contig_ID=SeqID_1701; Location=1863..3056; Strand=+
  SCN-specific regions: Sequence locations=1-628,650-946,968-970,993 -1194
atggttcccgagagtgaatatctcactttgataaatctgctgaagaggggaacaacaacttctggcccctatgaaagtgagagagctgaactggacacagacatccaaaaaaatttggccgatcataaacgcggagcagatgtgcaaatgaagcgccattcctggctgtataagcaaagacggcagctaaaagatttagcagaaaatagaccccaaaaggtggtcattgaaaacctggcagccataccgcccaatattgctccttatatgggaattcaggctccttccgccaaagctaagttagagacaaaagttaaaaaagcatcggataatgagcagcagaaaacgaattctttttataataggcttactgcagcaggtgatgaacggaaaagaaggagtcgtaaaaggaagttaggcaaaaaaatggtaatgaacactggcgatgagtctgatgccgacaacaatagtggagataatgccgatggctccttttattcttcagcgaaggatgatgagctcgagcagacatcttatcataaaagaaaacgagcaccttctttgttgacacaaatagaccaaacagaccctgaacactatgaagaattgaagaagattgtggaagcaaggctcataaaatatggaattgatgccaaaacgggcgcaattttgaccaatttcaataaaccggtcgccggatcacattacctgaacgcaattaagtacatgacaggccagctgaacaacaagccgaaaggacatagatttttaatccaacgcttgaacagggaaaaagaaattttaaaattcttcccacatctaaaccaatcgcagcagtccggagagggaatcaagagatttagagccaagaagaaaaaattcttagcccttgttcgcatgcaaccccctataaaaacaccgggactacaccgaactgcctatgccgaaaaactacatgcaaaatttcctccaaaacatcaacaacaaaaatttacgtttaagccagcaatatgggcaaaactgtagagaagctactagagcaaatctattatgaccttcgctccccggcaagctacgcaggggttcttaaggtctggcaagaagcaaaaaaacataacaaatcaattggtattagcgatgttcaaaaatttttgcatgatcagcgaacctacactctgtttaaaccgcgtcgga

SEQ ID NO: 75380 - DNA, 1802 bp, Heterodera glycines
  Genomic contig location: Contig_ID=SeqID_11872; Location=276..2077; Strand=+
  SCN-specific regions: Sequence locations=1-386,408-787,809-990,1013 -1165,1187-1422,1444-1493,1515-1635,1657-1678,1700-1765,1787-1802
atgagagccctctggcgtttggcgcgggccttccccggaacactcatccgctgcatctgcttctacgccgcgcaagccctggagatcgaacggttggtggcccaacaagaaatcccggacattttagtgacaacagcggacgcgacacagggccacgagtcgtcacttgccgtcctcgtcacaacatgctccgtcttcgacagtggagcagactctcagcctttctgggctgatgccgcgcgggtggacgtcgccatctctcgcgccagccatggaatgatcatcattggcgatttgctgctgctcaaccggacggagacatggcggcgctacctggaccaagcgacaacggaaacgacagtggtcggcccggagtacttcgacttcgagcagttcaacaaccccgacaactactacgacaaggacggacagctgatctcagccaacggcggtgcggtacggtcagagcatttctacagcaagtacggtaaaaatgtgtggtacaacaactccggtgagtcaaggggggcggagaacagatatcaaccttatcttcctcaaggtggcactcgggaacgcactcgtggcaaagcctcaacttctggcgcgcgcagatgaatgaaagccaagctgtacgacttcagccatggtcggcaactgcgcatggacctgctttcattcccttcccctcacgttttaccattttccttttgttttgactctctctttctcactctctctcgtcatccatttcttaaaattatcattcattttgtctttatttccgaactgttaatggcctttctttctcccaattcaaatttctcaaaaatgcgtcggtttcctcacactttctctgacccattctctctcttctctcatcatgcttttacatctcgttcccaaaccggaatgacccctggttgcttttctccgatttcccatgccatccatctgagatgaaggtggaccactgctcattattgtaatgcgcagcttggccgtggaagttcggattggagagatgaagggcgaagccgagagtttggtccattcattcactttcacttcatttttcatttaaggatcggggacgatcctaaggaaaggggggagttgtaaggattattcgacgcatttccctcatttaattattccttattggccattatcaattcaatcacatttatccattttcacacgtttttccttttctcattgtaatgtttctccgcccattctcttcgtatttctctttccccagtgatcagttagtcagtagttgtgatggaacagacttcaattattattccgatttctcgcttcgtttaaatccaacatcgaatgaataaacacatctttaacagtcaatgagtcgtttgggggttcggggcttggtcaaaggcgccttggcttttccccattccctcccaaactccatccgggataaacggtgcatagttggtctgggggcacagtgcgcatccctcactataataatttaagaaaattttgtaataaaatttctgtaaattatcaaatattgttgatttatttgaattaataggaagcgagtttagcatagatcaagaaagaaatttcaagatgcataagtgtttaaattgtgaaattgccaatttggcattaaagaaaattaaattcgcagaaaatatggaaaattgttaaaatgtaattaaataaatcctaataatcaattgtaacaaatattttatcttttaatattacaatgtttcttttattcagtctttttaaatctaaatttgttatagaagaaaatatca

SEQ ID NO: 75381 - DNA, 921 bp, Heterodera glycines
  Genomic contig location: Contig_ID=SeqID_11873; Location=469..1389; Strand=+
  SCN-specific regions: Sequence locations=1-291,319-489,511-874,896-921
atggacaatttgctgctgtttccgctccaaccgcagtgccgcacccgccctttgctcgcggccatccgaaaagccattggcgcaatggcaaaccaaacgcaatgccaacaaaaacaagcggaactgacgagtgggttcgtctgtgccaggcaattcgttgtccgcaattcgcccgtctcattttcgctgctcatcgcggacgaccaaattgcgtggacccactgttttgtgcaagtattgtacacatttaccatgccactttttaatggggataggtgctaaaatcgacggaaattattattattttttaatttaaatgaattttgcatgcttttatcagccgacggagtaagagaaaacagaaatttagaagtgggaagtgaactggtatttttgaaaattgagacaattttcttacaactaattgctttcgttcaaatttttttacaatttccaccagcgacgtccatcgattgccaaatttgataaaatttgagtttttctcatttgtggcttacaattaaaacgtaattattagcatttaaaaacaaaaaaagcaggcataaaaagccaatttttcagtattgggtggagcgaattctgcccctgttcgccgattatggtgccatcattttcacggccgtccgcccaacgcccgtcgagcagctcgaacccgccgcacgccgtgtgatgcatgcgctttatcggcattcgccgttggccaccccctggcgctgtgccgtccattacgcgtgggatcaaccgtttggccattgggtggaccggttggcattgatgaggtgaccctgactgagttttaatagggtacggtgcagtggagtttggaactcggaaaaaatttttaagaaatttcaagaaagtttttgaaaaaattatcaataatttcaggaaattttctga

SEQ ID NO: 75382 - DNA, 2224 bp, Heterodera glycines
  Genomic contig location: Contig_ID=SeqID_11874; Location=256..2479; Strand=+
  SCN-specific regions: Sequence locations=1-224,246-1395,1417 -1502,1527-1542,1564-1634,1673-1762,1824-2106,2128-2224
  Gene Ontology: Mol. function=general RNA polymerase II transcription factor activity; Cellular component=transcription factor TFIID complex; Biological process=regulation of transcription, DNA -dependent
atgcaaaaaccgataatcgtaaatataattgctctcgctaatctcggtaccgggattaaactaaacgctctgatgatcaccgaatgcgaatttaaatataaccctagaaaattcaatgccgcggttatcaaatgtataagccccatcaaagccacggcattattatgggaatccgggaaaatgatatgtctggggacgaaaagtctgatagactgtgaaaatgctattaaaaattttatagaaataattaagggctcggggtgtccgggggcttcttacaccggacacacggttgaaaatattgtttcgacctttaaattcggacgtgaaattgaactgaacgagtttcgaaaaaatcgtcgtgcattttatgaaccggaaatattttgcggtttaaatttcaagcggggtaaaagcatgactgctttaattttctggaccggtaaagtcgtaattacgggaacaaaaaacaattctgaaattgacgaaatgtaccattatatgctgccctatctgaaaatggctcaaaagaatttaaagagacgataaaaattttaatttattgggacggtcccccaatttatggttctgttgtgtatttattaattatcgattactacttgcggcatcagcatcggcggggagggtgggggtagtgtaattatcgattaatttgcgcggcggcacatcgacggagcggatgagagtggcggtctcattatcgattttttttttgcgcggcggcgacatcgatggggagggtagggcggtgtcattatcgattttttttttgcgcggcggcgacatcgatggggagggtagggcggtgtcattatcgattaatttgcgcggcgatgcatcggcggggagggatgggttgggcaaaaaaaagcacccgtgcggttttgggaaatcggatttgggtgggcggcaacttcaaagtggtccaatagattttggttctgggcggtaactttaaagtggtccaataggtttgggttctgggcggcaccttcaaagggctgcacccctcccataggctttgggttcgtgcggggcggcaacatcaaagggctgcgcccctcccataggcatgggttcgtgcggggcggcaacatcaaagggctgcgcccctcccataggcatgggttcgtgcggggcggcaacatcaaagggctgcgcccctcccataggcacgggtccctgggcggcaacatcaaagggctgcgcccctcccataggcatgggttcgtgcgggaaacacccgtgcgaaaccgttcgcttttggtactttatactactgagggcaaatattcacaaactctattattaaaaagaaggcagctttcatgcaaaataatgattttcaatgaaaaaaaattctcatttatttctgaaaaataatttttggtgccaataatttgtataaaaatgatcaatatgacagtaattgagccattgatttttagccactcaatttattagctaagtgaagaatctacttatgaaaatgggttttattttatagccctaagagtttagaatataaaatttcaaaaatttcgtctagtatgaaccaagttatggccaaaaaacacaagcaaccaggttttcaaacatttttggccctaactttttagaaaattaattaaatttttgaaatttgacaggctactagagaaaactaatgctatcgaatgatatcacgagcagttaattttgttggttccaagaaagttttaaacagaatttctggtgatcgaaattattttaattctaattaaaaaaaaattttagttataaattattttattttttattttcttgctatcattcgaaatacgaaatataagtctaattggtaaaatcaatgttttaagcatataaatcccagaaaatctcattctttatcattttcaccctcacaattaatacatttcgaggcgttcgggggtaaaattagcctttgccggccctctttctttctcattttttttttgaaaaatatcacaaaaaatgcctcaggaaatagactaaatttgaacatatacatttgaatttttaatatttacaggaccctcactaaattttaaaggaggatttacaggacttttcttgaaaaaatctcgttttttagaatacagtcttgtaacaggagacataaattcaaaattccgaccacaaaaattattaatattgttgattaagttgattgttactgcta

SEQ ID NO: 75383 - DNA, 550 bp, Heterodera glycines
  Genomic contig location: Contig_ID=SeqID_11874; Location=2576..3125; Strand=-
  SCN-specific regions: Sequence locations=1-196,256-286,310-550
atgcctcctccgctgtcacaaaaaaatccgatcacagttcaactcaaattgaccaacagcacggacacatgcagcgattactcgttggaatttacgaacacttgctttaagctggtggaccaagtcaaattccatgtgaaagtgccgaaaacggtgacattttcatttttaattgtattaatttgagtcaaagttcaattaaaataaaaaataaattataaaaattctgagtatattttaattatttgttttattgtactttgcggtgtccctaggagttcacaactaatatatataatatatatttttgtcagtcaaaattggcaaatcattggggcatcgttccgcttgccactgacaatggcactgctgatcagcaacagttgttcacattgcccaacaatgtgcacctttacccgggcaaatcattcgcgtctgccggcatttcagtgaacggtgctgaccgtccggaaattgttattttggatgtgcaatcggttctttgcacggaaaagcatgacgatgctgccactaattgagcagaattaaa

SEQ ID NO: 75384 - DNA, 709 bp, Heterodera glycines
  Genomic contig location: Contig_ID=SeqID_11875; Location=1268..1976; Strand=+
  SCN-specific regions: Sequence locations=1-195,225-442,464-471,494 -498,548-631,659-709
gtataattgcttaagttaggccggtgtttaggcctaagctttcggctaggcctacgcttaggcttgattgggtctaggcttatgattagcttaagctttattttgtaaaatatgagttgccttttgtacaagttgccattgagccattttccgattatacaaaacatgcagaagccataaaaatctcatccctacttattttatttattaagtaattaatttttctctattttcagtaaatttatgagttcaaagcgcaaattacaggtttcttatttaaaagattggccattaaaaaattgacgaaacccaactcgtacttggccaacacgtactgccccaactcgtactgtttgacaaaaaaatcgtcataactcttgcaaagtcgactaaattaaactttcttggtgccattcgataactcttaaagttctccatctacatgaagcaaaatattagaaaattttattgcttttcaaaatttatgaccaaaaatggtaaaaaaaattttgttaattttttcaaattttttattctttaattttttcacatttcaattaattgtctcccccattggttcatttccaaaaggtaataagcggctaagagagagaggcgtgcgttgttccaacggccgcgccggcggcggggcgcggggtcgcgcaagaattcggcacaaattaagatagcattatttacaaagaaaaaa

SEQ ID NO: 75385 - DNA, 1507 bp, Heterodera glycines
  Genomic contig location: Contig_ID=SeqID_11876; Location=350..1856; Strand=+
  SCN-specific regions: Sequence locations=1-206,230-272,307-333,367 -463,501-509,532-828,883-940,962-1327,1349-1507
atgattggcttaatcttaaatgaagagtcttgcagttttctccgccaaagcatcgcacctacggcacttctttcatgccttaaactgcacattattgagggcaccgaattaatcccggagttttctcgcaatgacattggggaaacaactaacgaaaatgaaattaatcgatggcttgtgaagcatctcacaaatacttctactccaaaaatttacaaatgtcaaactgaagatatcgctttcaacgtttccgcgtttaagacggtattatgaattaaataatatattatctttatttttaaatatcgctataggagttaaacccaacttttctttttaaatttaaaaatagaaaattatttttaagggaaaaattcatgcacctgttgatttaaattttattggagtccaaaatgacgagtggagcagaatttgttttttaacagatggtacgcatttcacgttatttattaattgaaaacaattttaaagcaaatttgcgctagttaaaaagtgacagattttgaattttatcaaaaacctaagggggggggggggtttgtgttttgcaaaatttttttgagataaaaaatcgtgaaacactttttactagccataattgtgctgttaatgcttaatattatcattagtgtaaataaacaaaaaaaaaagtttgaccaaaaaagtgaaaaaatttttaaaaaggcccttctttaaagtggcgctaatttttctaatttgcaattagttataaagcataataatatttgaaggattataagaaagtattatgttttttaagtacttttttgtatataaacccaggcgttattattataaattattatttttatccaatttaattttactattaaataaattcagcttttgctttcgccgctgacctgaagtgcctgtctcgaaaaacgatctttttcataatgtatttatttttattccaacacatttaaaaaagattaaacaatcatttaaaaaactactttagtttcgggtcagattccggctcacttatatagattgaattcatttcaaaattaaatgagcgttttattgctatgtattcactctccgaccattcgttttctttacaactgattgagtctcttcgcaatacccaaagtccattcggattgaaatggttttcaaaacgacgaaacgtcatccttttctcgtgttcgcgcgttgtcccattctaatgggttcccagtgaaattaaatgtaaaactaaaatcaaaacagacggcataactgacgggcaattccgcattgataaacacctaaaggcgcaaaaattttaaaaacagtcaaattttgaaaatatcatttttaaatcttccaattgcctttcaatgttggaaagacaataacatttgagcactttgggacgtccatcgtcgcgcggagtgtgaagccacttggacaatgcctggttttgtgatgcccgggggccatcatacgacggactctcgggaaaaatattgcggca

SEQ ID NO: 75386 - DNA, 112 bp, Heterodera glycines
  Genomic contig location: Contig_ID=SeqID_11877; Location=1393..1504; Strand=+
  SCN-specific regions: Sequence locations=1-2,24-112
gcactttttgtgttgtatattttcccaacctcttttttcattttgtttttttttttttgctactttttcaaattgtctccattccttttattgtataaatttattctaatta

SEQ ID NO: 75387 - DNA, 444 bp, Heterodera glycines
  Genomic contig location: Contig_ID=SeqID_11877; Location=423..866; Strand=-
  SCN-specific regions: Sequence locations=1-124,146-176,226-412
atgtccaaacaatttctgctgttggctttgctgcttttattgctgccattggacactttgcaagaatgcgtttggaacgatgaaattacgctgtgtgttgggctttgttcaacaggatgcggacaattaagtcaagcaaactgtgcttgtgcaaaggtttttttttgaattttggcaatttttaatattttttaattaaaatcattttttatttatgaatttaaagcattcctcaagggaggaagtccacggcacctaaaaaacgcttcttttattaaagtttgaggtgttcattttccaattaatcattttggcacaaatacaaaaaaaaattcagagaagaaaaaacaaggaaaagcagaaacaacagcagaagaacaaaagtgtcgaatgtgatgaagacgaaaaatggataataatattaattaaataattattaataaa

SEQ ID NO: 75388 - DNA, 986 bp, Heterodera glycines
  Genomic contig location: Contig_ID=SeqID_11877; Location=1865..2850; Strand=-
  SCN-specific regions: Sequence locations=1-863,885-986
  Gene Ontology: Mol. function=aldehyde dehydrogenase (NAD+) activity; Cellular component=mitochondrion; Biological process=carnitine metabolism
atggccgtgcacggggcgttgttggccaactttctcagccagggccaagtgtgcagcaacgcgtccaaagtgttggtgcagcgcaaagtgttggagcagttcacccaccaaattgtgcatcagacggagaacatgcgcattggggtgggcatttggggggggggggaagaaattgggagagaaatgccaaaattgtcatggccaaaggttgggagaggcagatagaaaactgcagcagccattagttgacaattgcaaatgtttgttttggcattctctgtttttaggacccgctcaacgagtccacccacgtgggcgcctgcatttctgaacagcacatggacaaagtgcgccaattcatacgaaccgccgtcgacgaagatggcgcgaaattgttgacgggtggcgaacgggtcaccacaatacagggtcattaaaacacaccatttggactaattaggtcgttaatcaccccagtaaaaaggggccatttggactaagtccgaatattaaattgggtgaatctgcctgcacatttcacactttccaggccttgagcatggctattttctgtccccgtgcgtcctcacaaatatcaccccgaaaatgactgtttaccaacaagaaatattcggcccggttttgcttatcattccgtttgacgatgagcaggtgaaaaacgaaggattggattacttttggaaataatcagtgctaattccaaggaggcacttcaaatggccaatgacacggagttcggcttggccggtggcatttttacaaagtctgtgcagtgactaatgacgcatttttctttacttgattattgttgtgtcaaatttgccctttttcccttcagggatttggccagggcccaccaattcgccgctcggatgaacgccggaaatgtgtacatcaacacgtacaacgacacgcacccgaatgtcccattcggaggcttcaatcagtccgggttctctaattaa

SEQ ID NO: 75389 - DNA, 105 bp, Heterodera glycines
  Genomic contig location: Contig_ID=SeqID_11878; Location=434..538; Strand=-
  SCN-specific regions: Sequence locations=1-1,23-105
aaaaatcatagataaaaatcaatgattttcaaaatctgagttcagattcgtgatcagcgcattttttaagcctagaaaaaatagctgcgaatttttaaacatttt

SEQ ID NO: 75390 - DNA, 801 bp, Heterodera glycines
  Genomic contig location: Contig_ID=SeqID_11879; Location=182..982; Strand=+
  SCN-specific regions: Sequence locations=1-301,323-650,686-709,750-801
atggagaagatcgtctacttaaagctgttccaaattgtgctcactttgaccatcttttggcaactcatttcacttcaccaattctgtggcactttgccgacccaaaagtgctgtcgctgttttttgttgccaccaattcattttaaatttatgttttcagactttcctctgtcacatccgtgcgggcaattgtgaacgctacacgctcatcggaatggactcagaaactggcgaattcggctcaatgtacaacaaattgcacaaccaactgtggatgatttgcaccaatggccgaccaatcgaagaacagcaacaccaattcatggacgaattggccgcgaaattgcctcccgctggacgccattgcattccgataacagtcaatcagcaaagttgatgcaaattgtgctcactttggcattcttcaacagctccaatggacagtcaaccaatgcaccgcaataccaatactttcacttcttggtcgagaaattgccacccgccggacgtcattgcattccgataacggtcaattagcaaaaagctatcataacgatgaaagcaaatttcatttgtttttcagatttcgccttttgaatggattggcaaagacataaacgccctcaacaatgacactttgttatatttctccacccaactgttcttctcattggtgtcgcttggcgttcttggctatggcatcatacacaaaataaatgttaaattaaaaacctccattcttcagatttgtcgtgtccaaaaatgcctttcttttcgtcacaccccgttatctttttgctg

SEQ ID NO: 75391 - DNA, 1375 bp, Heterodera glycines
  Genomic contig location: Contig_ID=SeqID_11880; Location=419..1793; Strand=-
  SCN-specific regions: Sequence locations=1-168,191-784,806-1162,1184 -1351
atggccaccctgattgtcttacataaacattttggttatttaggttataaggccaacgtaaaatttttacaacaaattaaattttgtgagactcaacaaatccggtggatgcttatcctcgggccggaagaaattgctaaaaattcggtaaaattgcgttacatcccggccaaagacaaaggagaggaggttcgattgggaattggaaagtaaacaatgtgtttttaattaagcttgtcacaatggacaaactgatcgatgttttgcgcgaaaaactggaaaacgatgatgaaaattaagaaaatgtgaagagtgaaaggcgcatttcccatttatatatgattgttgaattggatgttctatgttttcatttatattgtctcattgacgaacaaattgagcttgtttatatcatttgatagtattaaaaaacctttaaacgttcggttggctaattatgagccgtatttagtttctctattagcagaaaaaataatagtactatgaatttcgatcatgacgattaccatatgagctcatttttgtgtggaaaggttgtccttgaaaacgcaaaatcgtgatggtacgtcaaaaacaaatgcgttttaaaacgaatcctttttgtgctaaaattaatttcaaaataactggattaaatataaatgcaactctggatggtgcagggtcgttacttaaaaaccatcataatgggcgttatttaaaaaaccatcattatgtaaatttttgtcgaaaaattatttataactttgctcgaaagaaaccaaatttttaattcttgatatcatttgatagccctaagtgttctctatcagtctgcagaatttcaaaaaatttcgttaagtttcaaaaaagttatagctcgaggaactcgaaaaaccttgattttcgaacatttttggccatctttttttaaacttaacgaaattttttgaaattttgcaggctcataaagaacacttagacctatcgaatgatatcaaggattaaaaatttggtctttttagaaagcaaaattttttattttgatggttttttaaataacgcacataatgatggtttttaaataatgacatagcacccatgatccaactcaaagtatcattactttgttttgaggatcagagctcaccttactttcatgaaggaaggcaaagaggggcaatccctcaattttgtacagtgcgccatattttgcaaataatgggcgtttactgtaattttggcatgtttgttccctcttcccattaaggggggaacagaaacaaatgcttatcaaaccaatcaatgcactgagtgcaatcttctttgctttaacaaacgcgttaaagcaaagatcccaaaggaaattaataaa

SEQ ID NO: 75392 - DNA, 605 bp, Heterodera glycines
  Genomic contig location: Contig_ID=SeqID_11881; Location=112..716; Strand=+
  SCN-specific regions: Sequence locations=1-26,161-211,293-369,481 -495,541-605
atgaaacaaatgtttgccaaggagagaaaatataaatttattattaaaagagaaaatgtaaaatgatttataaaatagcaaataataaaaaataataaaccgaaataattcaatttatgtaaattaattaataattatacaaaaaatagaaaaaaaattagtcagcactttttcataggttttaaaaatgcactttttttgcttaatatccaaattataattacataaatttaaaaagtaatacatatataaattaaaacataaatgcgatttaaaataaaataaaataaatgatgagatggaaaagtacaaaaattaattagcaacggacaacaattccgaaagccggaggagatctctagtcaagagtttaaataaaaataaaaagacaaaatttaattgtgaaatttaataaaaaggaacataattaatttttaaaataaacaacagcaaaaaattaaacatttattaattaaaaaagaatgttaaaaaagcgaattaaaccatgaaaatgaaaacaattattgttatttaataaatgagcaaaaaaataaactcaaatatcagctaaaaatggataaaaaacaattttaatttctaaaaaa

SEQ ID NO: 75393 - DNA, 279 bp, Heterodera glycines
  Genomic contig location: Contig_ID=SeqID_11881; Location=1077..1355; Strand=+
  SCN-specific regions: Sequence locations=1-250
atgatatggtcaatacggctacccgacttttggggatttgcaacttgggtacccgacatttggggacccgacatttggggacccgacatttggggacccgacttttggggacccgacatttggggacccgacttttggggatcccgtcatttggggacccgacttttggtgacccgacacttagggaacccgacatttggggacccgaaatttggggatcgaatgtcttttggggacccgacatttggggattttattaaaacaaaaaaaaatatttaa

SEQ ID NO: 75394 - DNA, 603 bp, Heterodera glycines
  Genomic contig location: Contig_ID=SeqID_11884; Location=19..621; Strand=-
  SCN-specific regions: Sequence locations=1-451,475-603
  Gene Ontology: Biological process=locomotory behavior
atgaataagaccacgctgaaggctcgtttcgggtcggatattaggaagaattggatccatcacagtaacgacattagcctgaatgacttggtaacgaagatgcagcgttatttcgatattaaggatgcgaatgccatcaaactcaaataccgcgaccaaggttttataacaataaattatgtagcttaagtgtaacggaaaataggtcatgtggtattggggacgaatgacatcggtggggttcccactaatcacttacttttttcaaattagtagttggggttgtttttttgcttgtaaattttaattcatgtcatgttcggtattgttgcacaacacttaatgcagagagcgactgggttaccctcgccgacgacgacgatttggcttatgcactcgcctctatggaacttctttacgtggacgtgatcgtcgagaaatatcaattcaagcaagatgaggaaacagttgagaagacagcgccgcctgctgaagttgtgaaggcagtggcgccgccgagggacgcaactcccgtggacaatggtgacgtggcacagctgcaaaagcagcagcgttcttctacgactccagtttcatcgatcg

SEQ ID NO: 75395 - DNA, 305 bp, Heterodera glycines
  Genomic contig location: Contig_ID=SeqID_11884; Location=3064..3368; Strand=+
  SCN-specific regions: Sequence locations=1-305
atggaccaaatagtaactgagtttttatctaaattgggaatggcaaaactatatgctaattgtaagtgaaacttttaagaaaacctgcacaaaacacaacaattataaattaattattgtaatgacaaattcaggtcagagacgaaactttaacgggaaatgagcgaagctaaccactaccgctaacagctaaaaatgggtggtgaaacatatcgtaattatgtaggacgaatgaactgaactcccttctaactggacgaacctagaacaaatgtaaaagtacgattagccaaaggccaacacaa

SEQ ID NO: 75396 - DNA, 1676 bp, Heterodera glycines
  Genomic contig location: Contig_ID=SeqID_11885; Location=1373..3048; Strand=-
  SCN-specific regions: Sequence locations=1-846,868-1394,1416 -1633,1655-1676
cgactgaactcactttctctctgcacagaattcggctttttttaggggctttcacaccattcaccactcaagcgagtattacaacttctcaaccgctcttcgccaagctgcgattcaggtccatcgggctgacaaagtccgacgctcgggtgctattaccgttaaacgtttttccacaggacgcgggactggcggcgtatgatattttgcaggtgttcgcccgtgtcattcattattcatgcatattcgttcattggtctgctaatcacttccattgtccttccaatgcaggcctttctcatccctccgtccattttcctcgtccatcgctatttctccgaaatcttccagttttggatgcacacttccctgctcggttctctcggcccccttggctttgtgttcaacactccgtcccaccaccgcgtgcaccacggacgcaatgtccgcactttgccactctctccagcagcaaattaatgagtattccctttccaggcatactgtatcgaccgtaactttggtggtcggtgaaaaaagcacttgtactaactgctgttttaatattcggaaggtgttttgatcatttgggaccggatgttccgcactttcgaggccgagcgcaaggaagagcccccggtctacgggctgatccgtcccgagcgaagctttgatcagctgtggctccaggcctgaattgtcggcttccaattgtgcttctaatcagttttcgttcgtttttagtttcacactctcaaggaattgttgtgcgacaaatggcgcttaaaggacgaaaaggggcaaaaagtgttccccaaatggacggacaaagtgaaggcgcttttcttccctccgggttggttccctggaacaaaagtgcgtttagcagggcaatctgtgtacttttccgatttgctcagccttttgtcctcagattcgccacttcttccactggacttcgttggatgaccactctttcggagttcccccggtgaatttccattcaaatggcttttcttctcccatttgtatttggcttctcattatttttcgttccctgtgctaatccctcccaacccttcactaattcaggtgcaattgcctgtccaaaagtacgacccgtccctttccgtttggcttaaggcctattgcctcgcccattttctgctgctcctttgcattttcctccacttcgaatacgacagggctcagttgggctatttggacttcacactgaaaatcgccttcttcatttgcacaagtcctttgacaaaaagtcaaaaaacattcgtaaaaatggtttccttttagtgcagtctttcggcgctttcttcgacaaaaagtgggaaatttggcatttttattgcgtcggaaatcatttttcaggaaatttgctccctttttggaaatatttcgttcatttggagtcttttcttattatacgactcgaactatcattgagcacaaaaagcctcagcccaatcgcattttcattgccacacttttcgtcgcctcagcaattgtttgggtcgttgtccttctccgacactttgtccgttcaatttaaaatgcatttcaaaagcattgccattccatttaaggtcaaaaaggaggcgaaggcaaaagtaacggcgaaagatggaaaagaaaacagaacaattggcaaggaattgaga

SEQ ID NO: 75397 - DNA, 1638 bp, Heterodera glycines
  Genomic contig location: Contig_ID=SeqID_11886; Location=68..1705; Strand=+
  SCN-specific regions: Sequence locations=1-1060,1082-1192,1216-1638
atggtcgccaaaacgtgcaattggcctcgctggaagtttttcgactatgtgaacgacagaaaaggacagcagggacaactccatcatgatgcggttgagctcatgcagcaggttaatgcaccaatggatttggttggctacgacgcggacacatttgtgcctcacgtcgttgactactggaacaacacgcagcgacaacaccgctttgctgtgttcatctttggatcgttgggacagtataagccactctacaagtacattgacaacacctacgacacaccattgctgctatatttcaatgaggaccatttcgatggtgtgcagaagcagggcggtctgttcggtcaaccgtactgtttggagtgtgaacgaccttacgataaaatgtcaaggcacaacaaatcttgtaaggcgcattgtgtgatgtgctcacgtgttggaccgcagtttccgtgtcagccaacggatggattcgtcaaggaatgctctaaatgctataaaaggttccgaaactacgactgctaccagcatcatcttcattccaacttttgtatgcggtcaaagatgtgcaaagattgcggtgctgtttgggatgtagcagataacaaaagaaatggcagaaaggggcatgtgtgtggcgagaattattgtgggctatgcaacaactaccacaacactgagcggggatgctacattcaacccattgagccgaaacaacatactccctatcgtattgttgcgtttgacgtggagacaatgcagcatacgttcattggggaatctgaacaacggaaccatttgcctaattttattgctgcgaaagtaatatgcccgggatgcatcgagaatggagactggcaaagaggaacaaaagggtgtgaggtgtgcgggccaaacagaacggtcgccttttgccaacgccgcttcacagaaacaacagtcgacaagcaagtggtcgcagacaatcctttggaggaatttgtcgattggttagtcttccaactcccgctgaagtacgacacttatgtttattcgcactttggtggccgcttcgatatggtgttggttttccgtgaacttttccggcggggattcaatccgagcatgttgaggaagggcaataagctgtatgaaatgaaagtgggcaagcagaagaaacgcaatccaaacgtggtgttccgagactcgtataatttgatgccctgcgctttggctgaacttgtcccatccttcggcttggatgtcgaagacaagccattcttcccgcacatggcaaaccaaccggataactacggaaagcagatataccccacgcctgaagactacttggccgatgggatgatgccggataaacgacaaaaattcaacgtctggtatgaacaacatcagcataaacccttcctcctcgacgaggcgttggcaagctactgcacaaacgacgttgaaattttaaaggcagcgctggtagcgtttcggatggaattctttgatgtgtctcggagggaagaaggcattgtagcggaaagggcacacgaaggaattaaacggcgaaattttggggtgcacccaaagagacgaacttcagcgcaccgacacatccaatcactgaattcgcgacctaacaacaaaattcactaa

SEQ ID NO: 75398 - DNA, 446 bp, Heterodera glycines
  Genomic contig location: Contig_ID=SeqID_11886; Location=2009..2454; Strand=-
  SCN-specific regions: Sequence locations=1-446
  Gene Ontology: Mol. function=acyl-CoA dehydrogenase activity; Cellular component=mitochondrion; Biological process=electron transport
gaaaacaatttggacaacggatcatcgacttccatcgttacttaggcgataaaaacattttgaattacggatgggattctttaggctgtccaacaccaacttgccgacttggcatgcgatattgaggccacccgtttgcttgtgtacaatgccgcgcgtctgaaggaatcgaatttgccttacataaaagaagcggcaatttccaaattattctcttcgaatgtggccacgaaagtgacgagcaaatgcatcgaactaatgggcggagttggtttcaccaaagaatttcccattgaaaaatactacagggactgcaaaatcggtctttaataacaaggcaaattccttaatttttgccaatttcagggactatttatgaaggcacttccaacatccaactgaacacaatcgccaaattcattgactccgaatacacccaataaaaa

SEQ ID NO: 75399 - DNA, 962 bp, Heterodera glycines
  Genomic contig location: Contig_ID=SeqID_11889; Location=194..1155; Strand=+
  SCN-specific regions: Sequence locations=1-143,165-478,518-962
  Gene Ontology: Mol. function=DNA binding; Cellular component =cytoplasm; Biological process=nucleobase, nucleoside, nucleotide and nucleic acid metabolism
ccagccacaataaagtcgaacaatggaaaggcggagatgccgatgagtttcagctcaagttccacttcgactttgcattcgcagccattcaaaactttggtttgtcatttcttttgttcattttggcattctgtttggactgacttttaggctttaccttccgatgttgagcttttagcagcgaaaaagcaagcaacaaaagcgcatgagaacagttatttgggggctgttcttcgcggtgagaaaaagatgaaacgatttgtgaggagttgtgggggacaggttggcattctcatggcgaaacattaaaaatggaaggtgaactgcacactttgccaccatccttttaaggtgtgggaggactcatccatggccgagtgggacccaaatgattttcgaattttttgtggtgaccttggtaacgaagtttctgacgaattacttgccaaggtacttgtttttggtttaactctactacaattaataattacatttttaaaaattatattttttaaatcatgatgggcaagatcacgaaagattctccaatcgaactttttccccttttttgttccttttttgaatcgtatgtagcgggataattaatcatatttttggttaaatttttgcttaaatgtaatatatgaagtggacatttacaaactttcaggcttttcggaaatacccaagcttccagaaagcgaaggtggtccgtgacagcaggacgaacaaatccaaaggctttgggttcgtctccttcaaacaccaagacgtaatttctgggaaaaagatgtttatttgccacttcattggttaaggactttattcgtgcaatgaaagaaatggacgggaaatacgtcgggaacagaccaataaaattacgaaagagcaattggaaggaacgcaatttggacatcgtcaaaaagaaaaacaaggccaagaagaagctcggattgttgtga

SEQ ID NO: 75400 - DNA, 1175 bp, Heterodera glycines
  Genomic contig location: Contig_ID=SeqID_11891; Location=2343..3517; Strand=+
  SCN-specific regions: Sequence locations=1-344,370-701,723-956,979 -1175
atggtacagccagtgacagcggaagacagcattccggagtatatgaacgtgttggggatggtcttttcgatgatgggtcttatgatgagagtacggaataagcatttaattacttttctacaaagaattccaaattctttaattaactcattgtttatttatttagctcaaatggtgttcttgggtggctcttatttgctcttgcgttagttttgccaatatgcgcgcgtccgatgacactaaacaggtggtcagctcgttcatgctcagcatttcggccgtggtaattttccagctttgatgcatgattcttattgttagacctacacattcaattccaattcaggtgatgtcctatctgcagaatccaacgccaattgtgccgccatgggcgtaaaaaataaatgcattgaattgttcagttcaaattatgttattctatcggtttcatttacatctcttattatttgcctgaaatacccgttgttcagcccaaaaatggattttttggttccgtgtcaaattgagttaaccctcataaaatatctaaaaaaacgtgtcctttaattctttgtatttgccttattgatgttgagtcggagtcctgaaatggaagaagaacgtttgcccattgtttcgatggtaattgtcgcggacaaaagtcgtgcgccggccaatttcattacggtgttttccgattatttctttaatttttcatttccccgtttttccaacagctaacgaaaacttacgacgacggaagtgacgccgatttatggaaggatgggttcggtttcgggttgttcaaccgttccgttcgttatatcgctgtaagccgacacatcgccgaaacgccggtttgtccgtctgtctgctgcttaaattgtgtgctttttagcccagcggtttggaagtgttgactgacgtggccgtcatttcggacaaagaagcagttccgtccagcttcgtctgcttggacttcaccgttgacaccagtgcgtcggtcgccttccatagttcttccttcactttttttgccctttagaagaacgcgccctgaagaagaaatatttgtgcgcccgcttcactcctcggactgatgcaattgacgcggtgaccaatttgattgttttggcgcggtcgcggaggccccccaaaggatacactttggccgg

SEQ ID NO: 75401 - DNA, 439 bp, Heterodera glycines
  Genomic contig location: Contig_ID=SeqID_11892; Location=112..550; Strand=-
  SCN-specific regions: Sequence locations=1-96,118-191,214-395,419-439
atggctgatccgaaaaaggctgtctgcgtgctcgtcggtgatgcggacccatccgtgaaagggatgattactttcactcaagtcattaaaatttcctaatattttttagtaagtataactttgtatatttccaggacaaggaaggttcgcccgtgtcagttcagggcgaaatcagtggtcttgagcctggtcttcacggcttccatgtccatggtaattaaattaatgcttgcagtctaaagttatttatctgtttagcctacggcgatttgtccaacgggtgcacttccgccggcccgcatttcaatccaacaaacaaaacgcacggcggaccgcaggttctatttcattcaccggtcttttcaataatatggttgtgggaaatgctttccttttatatttgcatagaaatatttaaaatagcgaaaaaattaataaa

SEQ ID NO: 75402 - DNA, 1131 bp, Heterodera glycines
  Genomic contig location: Contig_ID=SeqID_11892; Location=3080..4210; Strand=+
  SCN-specific regions: Sequence locations=1-154,176-215,238-631,653 -868,891-1017,1041-1131
atgcaaattatactgatcgaagaacgcttggacagtgcgcataaaagggacaaagcggcagaatttgtgatggaaaaggcggagaaagagggcgaaaaggcgccaatccattcgtttaaaatgagcggacattgtgacggagaggccgtagaaaaggaggaggaggagtacggtagcaaacaggtggaataccgtagtttagcaatatgtaagcgacatagaagaaaatttaggagagatagtctaacaatggaagtatgtgcattaatgaaggtttatgggcaggcacagtattaaataattgtggaggagttacggtagtataagtaaaacaagacgcatagatactgtatttgaattcatttgcctggactacagtagtatcctgcccaatcagctgatcccttgtgctccgtacgctcgtctgttgctcttcggcacgccctctgccattcaaagtgcgcaattggctcagctccgtgcgctcgtccccggcgcgcaactggccgtggccaactgtcggcctggcctggacacggacgaagcggtggaggaggaaattgttgccctgggggcaagccatctggtatttgtccatggggcaggtgagacggggaaatggcatttcacagaaaataaattaatgacataattgccagacggagaaacgcgcgacgcatgggaagcgggcggaccggcgaatttgcgggagaatgtgcgcgtcaacctgttcaggtaaagccctggttgaatccatttaaattttgtccattttcagcccgtggctgctctccaacatttgtgaccgttttggcattgtgttcatcgaatttgatggggagggcaaaaactgttgcaattcggtaaatgtttttgtttgttcgagactctcgaattttctaattttcgaacattttttttaagaatgggaaagtgccgacaaatgctgacgctttacaaatgagtcgctacgcggtggtgcgccactttggtgaaaagctttgccaaatgaaagtccacttggaataataagaaaatgagggcaaagaaaaatgaatccatttatcatacagtaatatggaatttacaaaaaaagcaaaatgatactgtaaccaacaatttatagaaaaa

SEQ ID NO: 75403 - DNA, 690 bp, Heterodera glycines
  Genomic contig location: Contig_ID=SeqID_11893; Location=333..1022; Strand=-
  SCN-specific regions: Sequence locations=1-189,211-303,325-418,450-690
atgaaaatactcacctctctgtccatgctcattttcatcatcagttttggctatttttttgcgattgtgattcgtatcatttcgtctctttggaaaattgccaattttgcttacatcacttttctctcttcgatgttttcagcgattgcgatggccgccaatgcgccggttttgtacatttataggtcgaaaaaaaattataaattaaatgcaattaccgtatgaaaaaacatgaattttacaaaaccaattaaggccaaataaaaaactcaaaaaaattctgattgctcactaattaatctttatatttgccaatttttggtgccgtttttagctccgactatcaaaatgcgttgcgtcagcattttccacgcctttttaagcctcagcaacgacaaatgggagggtcaaatgctttcaacaacaacaacaacaacaacaacaacaactgggcaacactttcgttggccgcggtggacagaacgacacgcgttgcgcccataaatgtgagaggagccgcagcagagacgaaacgccaaggaaatggccaaaattaaaaaaaatttgaaaaggattcaatagaaatggctaaactctttttttgtggtagttgaacatggctaatcatgtgaagtttttcttgataaagaagcgatccgggaacgttcttggcaataattactcaataaa

SEQ ID NO: 75404 - DNA, 452 bp, Heterodera glycines
  misc_feature (13)..(13): n is a, c, g, or t
  Genomic contig location: Contig_ID=SeqID_11893; Location=2624..3075; Strand=-
  SCN-specific regions: Sequence locations=1-138,164-203,234-452
tattttaaaaatnttggtacaaaacttatattacaccttaagtgttattgcgaatgaattttctcaaggaatattacatttcttttctattacgcctttaattatgtatatgccttttcttttatgactaacacagacataaaattttatttattttttatttgtgtcttttgccgtgcgaaaatttagtttttccaattaataaattaacattttttaatgaaagcatttattgaattgaaaataataaccctttttaatttatgtgaaaaaaagtctaagaaatttttaagcgttgtggagacttttttttctctgttcaccgcggtaaattttgtgtgcggcgaagggtctgcccaccaccgaaatttttgaaaatcgtgtggattttaatgtcaaaaattcaaacaatgcaatgtttctaattcctaaattttaattgaattttcggt

SEQ ID NO: 75405 - DNA, 1088 bp, Heterodera glycines
  Genomic contig location: Contig_ID=SeqID_11893; Location=1019..2106; Strand=-
  SCN-specific regions: Sequence locations=1-78,117-441,463-1088
gcaaaaaatcaagtttatataacaatgatttcggatttgtacttaaatgactcatcaagaaacaatgtaagccaacagttattaaagtaaattttaattacattttatttttttaagaattacgccatttttcaacgcgacggcgtccctttggcatttgtggcattgatagtcatacgatttctcattgccatcattggcattctgttcaatgcaagcttactgtatgtagcagtgaacacttagtaagaatgaaccatttaaaatactcattttgattgaaaaccaacaaattcagcgatttgcaagggtcgtgcaactttttgatcgcattcaatgctttctgtctggtcatttttatgccattcatgagcatctccgtcttcaatcacagcttaatgccagtccaaatatgcttctggtgggaattggtcccaatgttttttggcaatttgtttatggtctcaaccttggcaattgcttttgaccggctattgagtgtgctcattcccgcatggtaagtgccaaaaatggaagaacaatttaaatatttttttgagaaaagtgtgccggaaagttcccgattactgtccaatggctttttcctactgtaggcacacacgccataacaaagagttcaactatttgggctccctgctaacactgtgcattctgtacgccggttgcattgtgtacttctgctacaccgctttaccgcaattgacggctgactcaccgtaagaaaaagtcaaattaaacttttagggttaaatcattggggcgaggagcgcctcgagactctcggtcataatcgagacattttctgttttaagcattctgactgtatgaaagttcatacaattttagcactgtcatctgcttgaacccctccgattcgtaccaaggcggaattgggacaattttgtttgttgtgtcgctcgttgtggtcactttgtgcatcctttgctatgcgatcatttgggtcattgtgcgcagaaaccgaacaaaatgtaaaaggcacaacatttaatcatcattaaaattgcaaattgttttacaaatttcagggaatggcactttcacaatga

SEQ ID NO: 75406 - DNA, 1471 bp, Heterodera glycines
  Genomic contig location: Contig_ID=SeqID_11894; Location=411..1881; Strand=+
  SCN-specific regions: Sequence locations=1-302,332-504,527-588,610 -851,874-875,901-988,1010-1041,1063-1229,1252-1320,1342-1471
atgaccctcattagcaaatgttcgcttctcctccttttcgtcgcgcccttttcccatgcgtttttctccggctttgagtgagttcattacaaattttgtaatccgatgatcattgtcattgcttttctaatcatttggtcccctcaagggtttctcccaacgcggcacgtctccgtcggcagtgcggttgcggcgggtgccctcctccgcccagcggcggtggctctgtccaactcggcatcagctgcgactcgccgcgccctccaccgccccctccgtgctgcggttgtcagtcgtcttgcggctgcggtggcggcggtggcggcggatgtgagaattttcaaatttaaaactgagtagtgccaatctgatccggacaatttttgccattaggaaaattctcggcattttaaggtacagacggttttgtttagctttggaatttttccttttcgatttttacatttgttgcataaattaaattaattttcgattttttaaggtggcggcggttgcggcggcggtgccattaaacttacaattggctgcgactccccacgccctccgcctccccctccgtgctgcggttgcgggtgcggctgcggcggcggatgtgagttcatttggtgacaaattaagacaaactgaattaattggcatatttgcacaataattatacaataattctttcaatgaaaatccaaaaattacttttcattgctttcacatcgctttctcaaccaagaactctgactttgtgattttggctttttttggggtatattcgaattcgattgaccacgacattcctcgggggtcaattccctaatttaaatttgctattattattaaggtggtggtggcggttatggtgcaaatggcggcggcggctgcggcggttccattaagctgacaattggctgcgaaggcccaaaagccccgccaccgccccctccgtgctgcggttgcgggtgcggttgcggcgggtgccctcctccccccagcggcggtggctctgtccaactcggcatcagctgcgactcccctccgccccctccgtcctgcggctgtcagccctcgggcggctgcggttgcaatcgccgcaagcgcatggcttttctgcgccgcgccgttgctcagcgctctgttggccgtcattaagtgcaaaatgaagcttaattaggcactgcttattgatgacgtcaattgctgacccgaatgatccatttaattattaatattttagcatagaaatgattttaatttttagtgactcaatcgaatttagtattagtttttggaaaacaatccttttcaaatgtttatttaatgaataaattaatcactacaaattcggcgaaggttaaaagctattaaatttctttaaattgaaaaatttcttatttgatggatgcaattaagaactgtcatatttaagctaattggaaattaattttattcaaaaattcta

SEQ ID NO: 75407 - DNA, 874 bp, Heterodera glycines
  Genomic contig location: Contig_ID=SeqID_11895; Location=124..997; Strand=-
  SCN-specific regions: Sequence locations=1-265,294-435,460-567,595-853
atgagttcctcttccgctaaattggacgagttccaaaatgctcttccgttcggtgtttttttgaatgatttcgacggcgcagcgcttggaattgtcgcatttgaaattcattgtgccattggaacaaatgacgtgaacacttgcaaaacgatggtaaagtgaaacttaaaaaaataaatttgaatattttgaatgaaaaaaatggttggctacggggggaatagaacccatggctacaaaacaactgagatttgaatgtattaagaattttttttaataaaaattttaattttgtaggctaccgaagaaaaaagtcgaaaattgaccactcggggaattcaaacttccacaaccactcgggcaactccgccaaaaacaaagctgaaaattgtaactccattcaaaactgaaacaccacgcgttgtaatcgttttcattttttaaaaatttaaaaataatgcctttttctagtctgaaattgaaaattcatctgaactgaccaccttggaaacccatacaaaaacaaacccaaatgtcggaacttcatctgctgtaatcatttccctcaaattaaattaaattaaaaattttttagccgaatctgttcactccacgggattctactgtgaagcatttcggcacaaattgcgtccaaattgattttccagctgaaattgcccaattttcgctgaacgtttccgccgcactattcggcattgcctgtaaacaatacctaagaaagtacaaaattggacaattgccaaaaaattacgacgaaaaaatggaaataaaagacaaaatggaagcgtgtggaaaagtgccgacagagacaaattgcaaaaagttaaaaaaatggaaattaaaattaaattaa

SEQ ID NO: 75408 - DNA, 78 bp, Heterodera glycines
  Genomic contig location: Contig_ID=SeqID_11896; Location=118..195; Strand=-
  SCN-specific regions: Sequence locations=1-78
atgatttaccccgtggaaatggaccccgaatttttttattccaggctccgacttttttggacattaacatcacaaagg

SEQ ID NO: 75409 - DNA, 1095 bp, Heterodera glycines
  Genomic contig location: Contig_ID=SeqID_11896; Location=1587..2681; Strand=+
  SCN-specific regions: Sequence locations=1-93,115-124,158-300,323 -415,437-1029,1078-1095
atgagcatcaaaaccaaaaaagacttgttaattgtgggtaagttgattttgtaaggtaataaaggaaaagcatcttgaagcaccagaattagcttatgagtctttaaaaattttcatttgcttagaaagagtttcttttcatcaagagcttttgagtggccaactttatatatttttattgcgaaaattcattttaatttttttgaacaaaagaaataaaaaaacgatgctgtatagttttaagggctgccactgatcaatgtttcattttttacgggtgtatttaaaatgttcaggtcaattcatatatatttcctggactgtggtggcccgaaacgcacgaaaaacatgtttttagcttggttagaagcttctaggatggatttctatatccatatttcgcgatttatgtccatattttggcatttttccaaaaacctattagaacggcccccaacagctaaattggccgttttgacccctaaagacctacaatcaggtccaaaagttttacaccaaaaaatattttagtgaaaaacccgattttcttaaaaaaaggaatggtggcaataatgttttgtttatgccaaaagaaacgccaattagtgcactaattaattcccaaaacttccccgataactctcttagttgacaagaaaattttttcatgacccgaacaaccccctttttggcggtgcaaaagtaatgcaccaaaagatgtatgcacgattaattcaattttttatgagattttgatgctgatcaaacagtcttttggaccaacatgatcagaacacttcttcatggtgatctggaaagtcaaaaatagcttgaaatcggaaaaattttcaaaaaaaattctaggggattgaaaaagttttctggaagtttttgggaatttattagtgcattaattggcgtttcatttggcaacatttttgagaaaatcgagtttttcactaaaatattttttggtgtaatactttttcacttgactgtaaaaaatttccgaaacggacattttttagcaaaatttttaaaaaatattgattaaatttagatttttcttaaaaaattggttaatttatgtcaaaa

SEQ ID NO: 75410 - DNA, 2212 bp, Heterodera glycines
  Genomic contig location: Contig_ID=SeqID_11898; Location=662..2873; Strand=-
  SCN-specific regions: Sequence locations=1-77,108-465,497-500,522 -632,664-770,800-972,996-1006,1028-1051,1073-1755,1790-1916,1959 -2152,2184-2212
  Gene Ontology: Cellular component=mitochondrion
atggcggccattcgtggctatcgtttcattgctgtgatgtcctcgtcatatacaattgaacgagtgagaaaatactctatttaatttttaatttataaaaattttttcggttaaagtgtaaatggcacttttgctgctgatggcctcccaaaaaattcaatgggggacctttggttttgcaatttttgttttatcacaagtcgtggaaaacttcttcaatgggttttggattttttcaactaattccaaactctaaaaaagcccccccattggaattttttcggggacccccgacaacaaaagtgccgtgttatttcttattactttattagagaacagtgctgcgtgcgcttggtgccgaattggtgctgacagacccaaaattgggctttactggcgccgtagagcgagcggaacaattggcacgagaaattcccaattctttcattcccatgcaggcacaagttttaaaatttaaatattaaattattaatttggtcaattaaatttattaaagttttgcaatgaggcgaaccccgaaattcactatcggacaacggggcctgaaatttggcatcaaacgcagggaaaagtggacatttgcgtatttggaattggcaccggaggaacggtaataaatgaaaatattttaataaattatttgttgttttttcattattaagatgacaggcgttgggcgttatttgcgtgaaaagaatccaagcataacggttcttatagaaaaactataaatgcatttatcaaataacatttaaaaaaattatttattaatttttatcccataaatctactcaatgtaatacaaagaattgtaatcagtagggatgggatttttatgtttttacatattttttctgcggcttagttatggcgagagaagcccaaaaataacattttctccgaacaattttcgatttagagcgacttataaaaacataaaaacacatattttggcattttggcacataaaaacatatggcacatatttcggggttttggcatttttgagaaaaatttgcaatgaaaatacaagaaaattgaaaaatacaccgtaaaaatcaactttttcacaattcttatagaattttcaaatttttaaaattttttttcgaatgtagaaagtaacaaaatcgaattcattaattcgtcattggatttcaaaattctctgctggaactttcaatttataaaaatgattaatcaaaaaaagatcaattttaccccaaacactttgaaatgtatttgatttgcgttgtatgggcgaaaaatgataaagaatgagatttttgggaatttttatgcaaaaagacacttgatttttccaatttttaacacatattttagcacatattttggcattttttagcacatattttattacatatttcaggatttttagcacataaaaatcccatccctagtaatcagatatgggttttatatagggattatattggtgcaaaattcaaacatttaattattcggatagcaaaattgcattcacaaatattgcagttttacgccgttgagccggcggagagtgccgtgctcagtggatgccgtcccgaaggagcaaagcatcgaattcaaggcctcggcacgggcacagtgcccgccgtgttggatacgcacatgtacaaaaacggcggcggaattgtgcaagttcactcggatgacgcaattgcaatggcacgacggatggccgcggaggagggccttttgtgtggtaaattcaaattaaataaaaatattttaaaatatttaatttctatttaggcatttccagcggtgccaatgttttcgcctctctgcaaatagcgcggcaaaaacaaaatgccaataaactgatcgtcactgtgttgccaagctcgggcgaacgatatttgtgcgcaaagatttttaaaataactttattatcattttaaatatatttaatagatcgtctgaactctattcgaatgcgcacgaagaaacggcagcaatgtgccacacggaaacacttgaggaaaatttaaaacgtttgaaattggcatgaatttatctatttttcgtgtcagaaaatttgcaataatatcatttttgttgtccatttttgcccggatattaaaatcaaagatttagttaagttaagtttaaaatatgttttaattattttaaattatgtttcatttgatgttgtttatttaataaa

SEQ ID NO: 75411 - DNA, 211 bp, Heterodera glycines
  Genomic contig location: Contig_ID=SeqID_11899; Location=1087..1297; Strand=+
  SCN-specific regions: Sequence locations=1-43,65-88,110-170,192-211
atgatttgttataacggtgcaatgccctgtgttctttcacttaaaaatgtatgtggtaaataaatattagactttgacaattcttttcaggtttcactggggtttataaccaactgcctatcaattcttggaccgcaaccaaaaaagacaaattaggcattgttcgaacatgaaaaatactgtacaaaaagtcggattgccagttttgtta

SEQ ID NO: 75412 - DNA, 657 bp, Heterodera glycines
  Genomic contig location: Contig_ID=SeqID_11899; Location=1420..2076; Strand=+
  SCN-specific regions: Sequence locations=1-51,73-657
atgactgtccaacaacagcagcagccgtcctccactgccccccatgtgccgtcctcctccgcctcgtcgtccgttgccactgcaccgaaacgccaattccggccattggccgagtacagaaaggcactcgaagagttctcggcagagcgccagcagcagcgtgaagtgagtggggggggggggagggcgttggttgatgtggggacgagtcagcgaaacacgaccattcgacaaaacggtagcggactacttcagtctactcaaagtcaaataaagcaatgacgtggtaaaaatctacgtctcactcttcacctgcttggccatccgcgcccttcatttggaagtagcacgaagactactctgttgaagcattcctccgagcctttcggatattcacgggcagaagaggcataccatcacttatcatgtccgaccaaggtacaaacttcatgtctggagcaatagtcatcagagataactggaccgacgcgttagtgccggagtacatgcaacaactaatggctccaagcggaatcccgttggattttcaacacagcccacgccacttgaaaaggcgagatttgggaaatacttgtcggcatcaccaaatacgaactacaaaggacagtcagcagagaacttctcacattgtacaag

SEQ ID NO: 75413 - DNA, 452 bp, Heterodera glycines
  Genomic contig location: Contig_ID=SeqID_11900; Location=72..523; Strand=+
  SCN-specific regions: Sequence locations=1-393,415-452
gttacaacggtgacggaaaacggaatgcgaataacgggtaaaaatggacgagaaaaaaaagggatgggaattgttatcaaaccgaataaattaaggcgctgatgaggaggaagaagcggaaaaggacgcgccaattcgagtggagagcaatttcattgtcagcgtaagcattgcggaaaataattgagtaattagaaaaagggtatttttaaaggtcgatgaaatggacgaaccattggcattgaaattggagagacaaaaccgaacggagaaaaaggaagcgatcggagagaatccaaagtgggggagcggagattatcgaccgagattataaatgaattcgaatttgcagcaaaacacaacgccaaattgacgaggcgcacaccgaaagttcggaagagacagagaagcagacgaaggccaaagaaagcgaagcgcaagaaaaacaatga

SEQ ID NO: 75414 - DNA, 718 bp, Heterodera glycines
  Genomic contig location: Contig_ID=SeqID_11904; Location=46..763; Strand=-
  SCN-specific regions: Sequence locations=1-97,129-158,180-502,525 -681,707-718
atgccaattttctattttctttgcttcactttttacacttttatggttgtttttgaaggttcaaaaggtgatttttgtcatttttctaattcaaaacaaatatttttaaattaaattttcttaattatcttttagtgcttcatcttgaacacattcccttttggttggctctgttaataagcattggagtcggatttagtgcaatgttaatttatttgttcattttgcgaccaaaactcattcgatggatcaaaaaaagtatgcattttcagtaatttttgcaattttatttttaatagacagcaaaaacgaaacatcgaaggctactgtaataccgatgacaaatgcccgcgtgcttacagtacccatcagtccgattgaaaaaacgcagcaaaaaatggtcgaaaataatcgttcacagccattcgaatgctgtaagaaaatgcgaagaaaatcaccaatacatttaagcaaattacaacgaaaatgattttcagctcccatgggactgattaattggtttatcccccggaaagacagaaaagaagacgaggacacattgcgactgttcagcattgtccaagtaattaaaaagcattttgttgaatatgttattttgcatttgatgatgttcgatttaattagataattacgggatgttttgcgggcttttcccacggggtaagttttattttttaaattaaatgcggtaaataaa

SEQ ID NO: 75415 - DNA, 1074 bp, Heterodera glycines
  Genomic contig location: Contig_ID=SeqID_11905; Location=119..1192; Strand=-
  SCN-specific regions: Sequence locations=1-21,57-199,221-223,249 -305,329-347,382-396,446-578,600-1074
  Gene Ontology: Mol. function=sodium:phosphate symporter activity; Cellular component=integral to plasma membrane; Biological process =transport
tatcgctcaatgattttcaagtaaataaaaataaatataattttttaatttaatttccaaaaattcagcaccaatttctgtggacagtcatcgccggctttatgtgctcatttttgctcggctttggcatgggcgccaacgacgtggcaaatgcatttggcactttggttggctcaaaagtgttgacgctgcgaaaagcaaatgtaaaataaaaagtgaattgaaaataaaatatttaaaataatttagataatggcgacgattatggaaacggccggcgcagttttagtgggtaatgaaatttcaaattaattttgtacaaaaagaattcattgaccttttatgttgttttaaaaattaattttgaatgaaattagctttttggacaatctcttcattaaaaataaaacaaattcaataattattttggaatttattttattttcttttgcgtttgctaaggctacaacgttgtggacactgtacggaaaggtattgtcgagattgaattgtaccgaggagcgccgcaggatttgctggtcggacaggtggcaatcctcgggggtcagtcacatgcatttttggcgcttgtttgaaaatgacatattttgaagggatggcattcaatggtttttggggtcatttctcaataatatgacattcatttcgattgattcagaatttccgaaccgaagtcgaacaaaaaggccagatttcaaatgttggcttgttgtcttaattcgttttcatggttttgagtcgaaaggtgtcagatcataatcaaacgaccccgaaactcacagaaaaaaaatttttaactaggaattaccgtacaaaatattatgctaaccaatttttcctcgcttttgtttataattttcaaaatttgtcattttaaattagcggccattttgtcctttttacaaaaagtttttctaaggctgtgcctgctggttacttttggccactatttttcggcttccaatctcttccacgcatgccattatcggctcaacattgggcttcactctgctgatgaagggaaatgccggaatccattggagcatggtgatt

SEQ ID NO: 75416 - DNA, 1416 bp, Heterodera glycines
  Genomic contig location: Contig_ID=SeqID_11906; Location=642..2057; Strand=+
  SCN-specific regions: Sequence locations=1-987,1009-1309,1331-1416
atgacggtgagtcacagcacaaaacgatggatcaaatgaaataatgggtaaaacaaaccgcaaaattagggggagggaagcagggtctaattagcgttttaattgggtcaaagccgaggctaatgaaggcgaacgcgtcgcctttctgcgcgttcggtgtgctatggcctcgtaaagtgttttctgactttgataagccgaagtgactttattttctttgtgttggcctccggtctagaacagtcggacaattaatgtcgaaaaaaggaaaaaagcacccaattgtttagaatgaccgggagacgagtgcccgtgaactgttgcgggcaatttgcgaagcggagtcagcttatcaggttggcacggtgttagggtagttgctgctcccttttcaatttaatggattcgtttccataaatttcaaaattcaatctaaaaagacgagttttgttatttttcttgcccaatccccccgtttagacctccatccaggagtcccaagtgcaaatggagagcaccttcaaggcgcttcgccgtcagttgcccgtcactcgctccaagctgaactggctgaacttccactccttccgcatcactcaacaggacatgaaacagccgccgacgcccaccgtcgctgtccaacaacagtcccagtgaaaaacaacaaatgaacggactgacggacggatgaatgacaccgcaactaattggagagagacactttcgcgtcctcaccactcatttgtttagttgtactcattcgttcttcatttcattaggcttattgggtgcgggcatttattaaccgtttggaaatggtgctttgcgattccttccattaaatttgtccaaatttggtttccaattaaccctaaatttggtgttaatgctccgtcgtgccctgcctaattattcgctcatttgcagaaaaacatttacttatttctacagtaattggtgtactaaatcataatctgcttgtgtctgtttcatctccttcttcatttgtccgtgtgctttttcttcgttttgtgcccttcgtgaacattcgccatccaaaaattaaggcaagtgaaggcatttaaccgttcccaagtcgacttttacacttacaaattgaattttaattatttgttttgcagaatttggcgctatctcacaccacctctccgactgatcagtgatcagctttgtcattccctgctgctcgtattgactcatctccgccgtttgcgattgatttttgatggattttccctttcttttctgtttgtaaaacataccctcccccactcttcagcataaattatttaaactgagaacaacaaatgcagaaatacaaatttgatgtgtcaccccaaaattggacaattcgtcccaaattattgcccatttcagtatcgatgccataaacaa

SEQ ID NO: 75417 - DNA, 332 bp, Heterodera glycines
  Genomic contig location: Contig_ID=SeqID_11906; Location=2471..2802; Strand=-
  SCN-specific regions: Sequence locations=1-26,62-332
atggacctctttttaagtagcgccggtatgtatatatgtatatatacatatataggtatatctaaatgttattaggcatacttaacagagaaagatccaaaaattagcaaatttaaattaatcaatacaaatttacttttagaagtcgaagttgttcgatttggtggaattttttcaaaacgtctcttcattattaaaaattatatgcagtaaatatgttaagatttttagtatatgtgtaaaacgagaaacgaaactgaaaaataatgcttctgttttaggacagaaaatacgcctattaaaaaacgtaaaattcagtcccaggcaataaa

SEQ ID NO: 75418 - DNA, 1935 bp, Heterodera glycines
  Genomic contig location: Contig_ID=SeqID_1705; Location=335..2269; Strand=-
  SCN-specific regions: Sequence locations=1-66,98-1077,1101-1284,1324 -1935
atgactttcaaagctttgcgtggcatttcgccgtgctccaacgaaaaactgaaggacgaagtgcgaaggcagcagaagaaggaggaggaagaggaagcgaaaaaggtggcaaaggacaacgatggcgaggggtggtcggtaagtaaagcgattaaaatgagaaatgaaagcaaattaaaattcaggacaatgtgccgataaatgtggcacgaatggcacagctgatccgccacttctacgccttgggatggatgcgcgacaacggcgccggcatggccgcgcgctttcgctgtcggaagacgggcgaaagtctgattttgaacacgtccaactcgttggccaaggagatattcgccgagtatctcaaatgcttaggctttaatcctaattaaaccctcctcaagaaatgagcattttgtgatgaaggccagcggcacagttgtaaagcgcccgtcagacccggacagaacgccgacggcaccgttttatttgctgcgcgataaccccggtgggttggaaacagaacggcacaaattctcattcaaaatgccaacgtttaagttcaccgtccacctatccaaaagtaaattcgtacttttcattcagatttggtctgcatcattcacacgcacacaaaatgggccaatttgatcacgcaactgatcaccggcgacgtgtttatgatttcgggccaagaaatgatccaagtgatgaaaagggagtcaaattagcataattgaaaggtttcagggcattgagaatcgtcagacaaagcgcagaatggaaaacattgacactgttgtggtgccgatcatcgagactgaaatcagcgaattcgttctttgtgtaagccgtgccaatttcaattcaattggaaattcaaatttaattttattgttagcattatttcattgttttttaatgttagcttaattagccgttgattaagctttttcagcctcagctgatgaaagttctgcaaaagttccccgaggcgagtggtgttcttgtccgcggccatggcttttttgcgttcggcagcaacacttggcaacgcaccaaaatgatgtgggaatgcctttttaaaattggatttttatttaaatttggaaacattggcattctgcacaggttggagtgttacgaatatttgtttgagttgggctgcgaattgattcgatatggcattccgctggtgaaggacgaggaggaggacaagaagtccatttccaaaagcaaagtcgaagcatagtgaagaaatgtggggaggacgaaacgccaaatgagagagagagaaagagaatgagagagagagagagagagttacagtatgccaaacgaccatttattaccgtatacactaacgtaaagcactgagacaccgtagaatagatcagcagaacggcagcaaacgcgttcaaataatgccctttgactttgggaatacagtcgatagtagcacaattacagtacctgcctttttttgttttatactgtttgtaattcatattttgtgaatccttttttctgttatttttttaatgtaataaattcttcacttttttatttacacttctttttgccgcaaataatttctaaacaaatagaattggtccgctaaaaaccgcctaaaactagttgcaatcaatctctaatgacctctaagcattataataatagtccctaggcgcggaaaataaaaaaacggttttttaaccggtttaaatcacgaaaaattgaaccaaaatcaaccataaaaacattttaaataaaaattttcagcaattttggcatgattcgaaagctcttgacaagttaagtctaataattggggatgaagtcgaacctgctgcggatcacgcgcggatttcttccggagcccgtagtctcgccccacctattggccgccgtagtcgagagtgcgctggtttttag

SEQ ID NO: 75419 - DNA, 1259 bp, Heterodera glycines
  Genomic contig location: Contig_ID=SeqID_1705; Location=3264..4522; Strand=-
  SCN-specific regions: Sequence locations=1-63,86-1070,1098-1259
atgcgcgatcaaattcttgagttggagcgtttcccggaaaatgccacggcgcaagcgatggccaataaaattttacatttgaaagccatcgcgcagcaattggccaaattcacacaagcaaagttcgcgcggggagaggccaaactgatagacccactgcttcttgaacacgcgctcaaaatttgccatttctgcgacaattttctaatcggcggagaaagcgagagcggagaaagagtcgggaaaaggctacggcacggaattggcctcgtaaaggcgcgggtttgccaagtgcagcgactgatggacgccaatttggtcgaatggaacgacatttggcaattgctgcgcaatttcagcccaaccgaaggcccaatgggaggggtggaccaattggcaaagagtttggaacagagaattggcacaatgattcgccaaagcaacgggagttattatgggaaaatgccatttacgaaggcaattagccaattggccgaagtggaaagggacagaagcgaagacgaagcggcaaaattggtcatactcttcaaaattgtgctcgaattgatagtgggagccacgcaggaaatgctacgaaacatagcaacggacactttggaagcgaacggcgccacattttacggcactaattttttaattgtgttttcgaatactaccaatgaaacggaaagacaatgccaaggattaattggcacttcagaagtgccaaatgggcagctgatggtccgcttgtttgatggcgtgcgaaaggaagcgaacgaaatgtttgaaagacgaaaaacggacatttgcgcacaattcaaaagcattggaaaaatgttgaaaacggaaatggcacaatttagaattggtagaaaaattcgaatgagattgaatattaaattacaaatttagaattggacaagggcctcgagagacacatatcgaaacggcacaaactcttcaatggcaagccaaaactgcgaaatacgttcgaattgttgaaggaaacgcaaaatgtgtttatgattgtacacaacgcgttggatatggtagacttacagtacccaaaggaaatggtaaagaaaaaattggaacaattgggacggataatgcagcagggaattgtggcgaacaacacaatcaccagcgaggactatgaagagcacgatgaaattacgaactgtttaaaaaccgaagagattgaagaacaaatcgaattcgaaatttactcgatgggatttcgaacgattttctga

SEQ ID NO: 75420 - DNA, 331 bp, Heterodera glycines
  Genomic contig location: Contig_ID=SeqID_1706; Location=79..409; Strand=-
  SCN-specific regions: Sequence locations=1-102,124-331
atgcgactcgttcagcttctccatttggcactgcttgttcagcttttgctggcgcctgttcttttggccgttggccaaaccgatgaaaaagtcaaacgaattcaaaagagagaggggccccccgaggcgaatttggtcgacaaaagtgcggtgccggccgaagggaatggcatgaaaatgtaaaacgaatttaaaaatgagaaattgctaaatgcttttaaaaatgctcagacggagacgacgcggcaccaaactgaaggcaatggcaggcggtgccgcggcaggactcggcgcggcacttctctacaaagcatttaagggcaaaggctaa

SEQ ID NO: 75421 - DNA, 2371 bp, Heterodera glycines
  Genomic contig location: Contig_ID=SeqID_1706; Location=2092..4462; Strand=+
  SCN-specific regions: Sequence locations=67-67,124-146,282-282,327 -333,370-376,412-456,610-746,926-956,1003-1003,1126-1177,1414 -1706,1844-1845,1885-1893,2014-2057,2213-2213
  Gene Ontology: Mol. function=serine esterase activity; Cellular component=endoplasmic reticulum; Biological process=embryogenesis and morphogenesis
atggctgatcagcagccgatcagcgaggactgtctctttttgaatgtcttcgcgccacaccgatcggttatttaattcaaaattaacaataaaaaaaataatttaaattttttgattaaaaaagacgtggcttttgtacttattaagccttctgctgagcagaacaaaacgttccctgtgcttgtggtgatccatggcggtgcttatgaaattggctcttcggcacgttacacaaagtacgaagtgatcggccaacgatttgtgacagacgcaaattcgcggggcattgtttttgtgagcattcagtatcgattgggagtgatgggtcggtagaaaatttaacaattttaaagaaatattttttaaattctgtgtaggatttgccaccaccggagatgaggaacttcccggttgtttgctgaacattttaatcatttttaaattcattttcaaatctgtcatttttaaaggcaatttgggcatttgggaccaaatttcggcacttcaatttgtcaaggacaacatcgcggagtttggcggcgacccgagccgagtcactgtgtttgggtacagtgccggctcgggaagcacggctttgctgagcatttcgccgaaaagccgaggcaaggaaattgaaaagagaaaagcaaaattaaagaagaagggaaagtgccgaatgatttggctaaatgacacccttggcacatttcaaatttaaccatggattggtaaatttcgtccacaggtctcttccagcaagcgattcgcatgagcggcacaccgttttcggtgtccggcagcggcacttttgtggcggaagagaccaaaaagttggccaaagcgatgggatgcgcagcgaatcggacaaagcaatgcctaagcgagaaaagcgtggagcaaattttcgatgggatagacaaaattgtaaaacattccaaacccaccgtattttactctattttattatttttatgggcctgctccgctttcggtttacattgccaagttcagtccacatcgcttggaccgggaactcttcccgcaggattatcccgaaatgatcgccactgcccctcccaagaaaatgattatgggttttgccgaattggactttttgctcttcagtaatcaatcaaaatgcatttaacagcagcagttataaataaattgtttttaggcttaatttcgagcaaaaacaacagcatttccatgttggcacttacggacgaacaaattgccaattacgaccaaaaagcatttgaggcatctgtcagtgaattcgtcgtcaaggaaaaatattttggcaatcagacaaatgaagtcaaagcagaaattgtgcacttttatgtgaacgaatatttgccagcggagacagtcaaagaccaaaaattctttgtgttgctttacacaacggttaattacataattaatcggacggagggaaaatgggggaaatgccaaaaacaaataaaacggaaaaatcaagtgccaactaactgatcagaaaccaacttttttgatcagcatgccgagcaggcattcgaagaatcgagcccaacaaatttgggcatctgatgaaatccaaaagaaagggcgttaaaacattagttttttggggtttcacatggtcgggaaaaaaatcgggtcgtcaaaagccaattattcacggggggagggagcataatgtataatttctttaagttttagttgctttctgatctgatggacgttgtgcctaccttatgggaggcgcaaattcgcctcgcttccaattggccaatttatctgtatgaaaatgtgtactttaacccggcacagttcccaaagcgtgccataatccaaggcaaattaattaaaatttgaaaaaataaaataaatttaaaacatttcagcagcttatcatggctttgatcactctctgattttttatgatgaattcactaaaaagagcgaagaagaccgaaaaatgtccgaatatttggtgacggccatcaaaaactttgtcattaacgggtgggtgttctaatatgataacataaatttaattaagtattttagtgatccgagcaccgaaacaattcgatgggaccaattgacagattttccatctattgaacgcgttgaaaaggttcaacacatgcgaatggaggcaaaaaagacggggatggtggacggaatgaaagccgaactgagaagagcgcgtttctggcgagaattggccaaaaagtacacaaactttgatttagtccgtggcactttcccagaaaaaagtggacagtcggcggcatttgtcccttcggcacaatttgctcaaatattttccattttcgctattgtcgcaatcatttcgctgaacaatggcatttattga

SEQ ID NO: 75422 - DNA, 1113 bp, Heterodera glycines
  Genomic contig location: Contig_ID=SeqID_1706; Location=6018..7130; Strand=+
  SCN-specific regions: Sequence locations=1-300,322-449,471-606,629 -1113
atgaaaaatttggccaaacaatttatgtactggcccaaaattgatctcgacattgataggtgggttagaaattgtgaagagtgtgccttagcagccaaagcgccacccaaagtgccgcttcaaccttggccagcatcaactcaagtctatgaaaggcttcacatggatttcgctggtccatgtgcagatggtaacaaatatctggtagtggtggattcattcagcaaatggccggaaatcattaaaatgaagtcaaccgaacaccttttgatcgaacagtttgtttggttattttcgcggtatggtttcccaaaagaaattgtcacagacaatggccccccattcaaatcgcacgaaattttcacgttttgcagttcgcatggcattcagcaaacattcgcaccaccttttcacccacaaagcaatggccgtgccgaacgattcgtcgacacactgaagaggcaaatgaagaaatgtgcgcgtgacgatccacattgggtacaaaattcactgctcgcgtaccgcaccacgccgaacgcaagtttaaatggtcgtacgcctgccgaattgttcttagggcggcccgttcgaactgttctatcgttaattaaaccaaattcccaaaaacaaaaacagggacccgtgttaaacgagcagaacagcaaaatggcgaaacaattcaacaaacaccatggagcacgaaatcggaacttttccatcggtgacattgtccacttcatcaattatcgcggcccttcaaaaatgtggctgcgagggacaattgtgtcaggaaaaggtgtagtttggcgaattgagtcgccacaattgcatgccgttgtaacccgtcatgcaaaccaaatccagaaattcgatcccattccatacaaggaaaattcggacattgacaatcaggcacaaggcgaacagcaaccggagacaccaaaccgatcacctcgtagagttcggttcgctgacgaacagaacgaaccgctcgaacagatacaaccgattgagccgagacggtccacgcgccaaagaaaagccccacaacagttggacatggacgtgaccaaacccaaatatgattatgtcaaacaggggaagacaaattaa

SEQ ID NO: 75423 - DNA, 119 bp, Heterodera glycines
  Genomic contig location: Contig_ID=SeqID_11908; Location=828..946; Strand=-
  SCN-specific regions: Sequence locations=1-119
aaagcgcacggttgcgcacgggtgtttcccgcacaaacccatgcctatgggaggggcgcagccctttgatgttgccgcccggggacattttcccgcacaatcccaagcctataggaggg

SEQ ID NO: 75424 - DNA, 670 bp, Heterodera glycines
  Genomic contig location: Contig_ID=SeqID_11911; Location=642..1311; Strand=-
  SCN-specific regions: Sequence locations=1-151,174-514,538-590,612-670
atggatctgcctgcctccgtacagcgagtggtttcccggccggattggcattttctggtccaacaaatgttgcccatttttgtgccaaacattcgccacctggaattgattggctgtggcagcattgacatgttgttccacatttcgcccacaattctctccgatcttggcattgcatcagtggaaaccagcaatttgttcccctatgaagattggcaaaatgcgattgctcgaaaagcggtgaccgaatggttgcacattccgcgcaaagatggacgcccgaagcgattgcgttgcatttgttttcaccacaatccaccaattgacattgacgtcgacgaatggatcaacttattcaaagaggtgtggccacagcttcagtgtcacgacaacgcgtacaaaggcttagactaggcctaagctttaggtttaaacttagttctaagattaggaagaacccaacttgtactgccccaactcgtactgttttcaacaaaaaaaccgtcaaagtcgactaaattaaaaaatattattggtatcattcaatagcccttaaagttctctatctacatgccaagtttcagcaaatttgatcaagtttgaaaaaagttatggacgagaattttttttttttttgattttggtcattacttttttgaaaagcaataaa

SEQ ID NO: 75425 - DNA, 1065 bp, Heterodera glycines
  Genomic contig location: Contig_ID=SeqID_11911; Location=1852..2916; Strand=-
  SCN-specific regions: Sequence locations=1-48,71-301,323-406,429 -716,741-814,837-1044
atgaaaagaactttgaggaaaatgtgagtcaattcttttttttggattaaaaattaagaaaataagcatttcggttttgctacccccacccccctcgaaagatttaaaaaattcatattgcgactttcacggtcacattgatcacgatcggcttaggctttagtttgtaaaatatgagagcccaggtcgaagcaaccctaaacctagtcctaacctaacctaatgaattttttaattttttcgaggcggaggtagcaaaacacggaagtgcccaaaccgaacccggattcgaacaaaagtacgaaaattcaagttttcgaccattgacagtattacctagagatggaatttgcccttatttttaaacccaaaatcatttttaccagtgatatccctattgttttggaaaatttaaaaaattaatgtttcagttggatttgtaacgacgttttgatggacattctgccgttttttgaccatgctcaacttggtctcaaattggcactgatttcgcctcattttgatgcactggtggacacgcattttgatggcaaaagcgatttgacaatttggagaagaataacaatttgggtaataatttagttgatattacccacagagatggcacggaattccgacatttttggggtcggaattacgatttccaaaaacattttggacaatcatcggaattccgaaatttttgataaaattggaatttttaaaaaaaaaatttttttgaaattccggttgttttcgaggtcgctgatcacgaatctgactcattttgactaattccgaattcgaatagaaatcaaaatcatttaaaaactgttgctacaattttcaagggcttcggcgaaccgaaaataattgtcgaacgcaaatcggaagaatttccattgcccgaccgtccgctgcccagcaaaattcactttaaggaccttcacattcggtattcaaaaacaaaaaagcatataagcaattgaaatgggtaataatagtacagatggtaccccctcccccaacccttttcgaaaaaatgaaaattttttccgaaataaa

SEQ ID NO: 75426 - DNA, 82 bp, Heterodera glycines; identical to SEQ ID NO: 71853
  Genomic contig location: Contig_ID=SeqID_11911; Location=4169..4250; Strand=+
  SCN-specific regions: Sequence locations=71-82

SEQ ID NO: 75427 - DNA, 761 bp, Heterodera glycines
  Genomic contig location: Contig_ID=SeqID_11915; Location=1329..2089; Strand=+
  SCN-specific regions: Sequence locations=1-171,193-343,369-523,566 -624,710-761
atgaacgattatgtcgaaggtgagcagtcgaaattccccgttaattgcctcaattatttaattgctttactttttcggtcgactcgccggccgtcgcatttggtggtgtccgagtggcgaaggtttggtttcgaattgccgtaattaaattatgcctatgttttggcatacatcaattaattaataattaatgccaggttatttggcttattgtccccagcccacggacttcgaccagtacacttactgttgtctgtactaccatttgggtgttgaccgaccttcgtgctgtcgcttcccatttcataccggtaatgggcaagtcattttgccagctttgaagttttaagtaaaaattttaaaaattatcccccccccccccttgtgaaatgccctcaggcaaaaagacataagagaattcagcatcaattagcgatgcattaattgtaattcattcaggtgtgatcattgcactgtttgtttcgagtgttgtcgcctttttgggtaattacggtcaatttacattttatctaatttcattttagttaattaattattatttttagttctattgtttctaatgtgttggttttgcccaatttgtccgttggccaaaaaattgagggaaagaaaagaagaggaggctgaaaatagtggagaaatggacgaataaatgaagagaaaagagggaagagagaaaaaaagagaaatgatcgaaaaatgaccaattgacgatcagaagaagaacagaaaatgagaaa

SEQ ID NO: 75428 - DNA, 81 bp, Heterodera glycines
  Genomic contig location: Contig_ID=SeqID_11917; Location=494..574; Strand=-
  SCN-specific regions: Sequence locations=1-81
atgataataaattatatgggtgaaaaagaaggaaagcaatgtgaaggaaaggagttcaggatcaaaaaagagagcgcaagg

SEQ ID NO: 75429 - DNA, 694 bp, Heterodera glycines
  Genomic contig location: Contig_ID=SeqID_11918; Location=1258..1951; Strand=+
  SCN-specific regions: Sequence locations=1-192,223-694
atggcatcgacaaaaactggttttacaaagagcggattttggcagttacaaatcttcctggggagcacaccggtttagcaattgcgatgaaactccgtagcattttggaacaatggcgcctcgaaggagaaaatgtgcattgttttgtgactgattccgcaaaaaatatgtgtcgggtataaattatcctacaaaaattttataataacataaaaattttaaggcctttaaagaagttgacgaaaatggcagtgcaattctcccctttttgaatgcaaattgtgccgcccatttactaaatttggttgtgaaagaagggctaagtgccgaccttgatattgaaaagcttttcgttaaatgccgtaaaatcgttggccatttcaaaaagagcaacaaagcactcggaaaattgcacgaaattcaagaatttcttgaaattcccgagcattgcttgttacaggtatgtataatgttattagatattggtaattcttaaagagtgtatttttcaggaagtttcgacacgttggaattctggtctgatgatgattgaacgactttacgagcaaaaaaaggcaatcaacgaatatgcataccaaaactgtgactttggtctcactttaacaagcgacgaatggtcaattttagaagaacttattgcgggtattcttttaaagcaaaattggtagaaaaa

SEQ ID NO: 75430 - DNA, 571 bp, Heterodera glycines
  Genomic contig location: Contig_ID=SeqID_11918; Location=3081..3651; Strand=+
  SCN-specific regions: Sequence locations=1-545,567-571
atggactctacaaaaccgatcgtgtttttgaaggtcagcctaaaaggaaagccggcaacagttgtagggcgagtcggtgagttgtaagctcttctgtatgaatgattaaaaatggcttatcaaaaattctgggtgattgtttgtattttttcagatacgattacgtccgttttgtcagaagcttttgcctctaaaattggtgacattgattcgaacctgcgtggccatgtgacgctcccaactgccgatgtgcccgttgtaggatggtaggaaatgttcgtacttgtcaaaaaaaatttaatttgttagggtggatgacgtgtcagtcgctttgctcaatgccgaaccatatgtctttgcacaacgttttggcgtcgtggcggataatcacatgatcgcgtaagtttttgaattaagttaattttctgtgcgacatactgtaaatttaagcttttgcgaacgcaaggtcgatggcgtctttggagccgacttactcaaacgcatgggcattttgaacgaggaacagattgacgccattccgctcgcttctggagatgttcctgaggaataa

SEQ ID NO: 75431 - DNA, 889 bp, Heterodera glycines
  Genomic contig location: Contig_ID=SeqID_11920; Location=742..1630; Strand=+
  SCN-specific regions: Sequence locations=1-61,91-507,538-665,687 -831,853-889
atgaatagtttcaatccgaatgaaaaagctgtccttcatgaagtccgggttggtcagctcggttttacagtacggatacgcattccacgcgtgttcatggaccgacatcgaaccctttggcataatcgccctcagaagagacggcacttttcttgaaaacgctggattagttgccgtacattttgccacttcccctcccccaaactcacgaatcgaaatggtaaattttatgcgtatattgtccggaagagaactggccattgaacagactctcaccttcaaaaggttcgttgcgcaacacctgaacaccttctccgccgcccgtctccttaaaagtcgtataaattgttcacactcctcctccgccgacggccatcggttgacaagcggttcaagagcttgaaaccgttgtttgttgcctacacttttctgtgcgcggcgttctctgctgggtgcttgaacgccacaacattcgcatttgtaaatattgccaattttttccggcactaaaaatagaaatttaaaatttttttaattgtgtatctgtgatcagcgaaaccattgggactgactcagccaggggctgatccctgcgaattttcttagggttttcaaggccaacgacagaatgtgcctaagtctaggcgactgggaattgtctttgatcacttttactgtgtttgtttgggttgatcaaaatgtttttttttctaattgtacaaatgccaagattcactatctaattaaaaagacctccccccaaaaaaatttctcattaaatgccaacaaaaaaaatataaatcaaaaattcctaaaatttacaattaaatgtgccatatttgtttcagatttaaattaaagtgatgattttgtttttacactaatatta

SEQ ID NO: 75432 - DNA, 1850 bp, Heterodera glycines
  Genomic contig location: Contig_ID=SeqID_11920; Location=47..1896; Strand=-
  SCN-specific regions: Sequence locations=1-115,159-303,325-469,491 -618,649-1065,1095-1850
  Gene Ontology: Mol. function=calcium ion binding; Cellular component =integral to membrane; Biological process=nonselective vesicle transport
tctctgatcactactcactgctcaccattgcatgtcggtgtacagtcgataccgtacaaaggccaggtacagtaaccaggagttgagcaaagtgcaaccgatggtgtaccacagcttaataaatcaatttttaaatgaaaaaattaaatattattaaacacaatatgtgtccaattaccgaaagtaatgtgtttggttgaacacggaatacgcaggttggcattctcgaaaattggcacttacagaagcaaacaatcaaaatttattaatattagtgtaaaaacaaaatcatcactttaatttaaatctgaaacaaatatggcacatttaattgtaaattttaggaatttttgatttatattttttttgttggcatttaatgagaaatttttttggggggaggtctttttaattagatagtgaatcttggcatttgtacaattagaaaaaaaaacattttgatcaacccaaacaaacacagtaaaagtgatcaaagacaattcccagtcgcctagacttaggcacattctgtcgttggccttgaaaaccctaagaaaattcgcagggatcagcccctggctgagtcagtcccaatggtttcgctgatcacagatacacaattaaaaaaattttaaatttctatttttagtgccggaaaaaattggcaatatttacaaatgcgaatgttgtggcgttcaagcacccagcagagaacgccgcgcacagaaaagtgtaggcaacaaacaacggtttcaagctcttgaaccgcttgtcaaccgatggccgtcggcggaggaggagtgtgaacaatttatacgacttttaaggagacgggcggcggagaaggtgttcaggtgttgcgcaacgaaccttttgaaggtgagagtctgttcaatggccagttctcttccggacaatatacgcataaaatttaccatttcgattcgtgagtttgggggaggggaagtggcaaaatgtacggcaactaatccagcgttttcaagaaaagtgccgtctcttctgagggcgattatgccaaagggttcgatgtcggtccatgaacacgcgtggaatgcgtatccgtactgtaaaaccgagctgaccaacccggacttcatgaaggacagctttttcattcggattgaaactattcatctgaacgaccgcggcaccactgaaaacgtaataatgcttcaatttgttattttggcattttacccatttttaggcgctctgtctgacgacggatatgctaagtaaacgcgaagtcgtgcgcattgacatcgcgaacgacaaagagtttataaatgcagccgacattcgtgaagacacaaaaccctcgacgttccactcggagaggacaggccgaggtccgttgttgcagtcgtggcagaccaactgcgagccggtgatgtgcgcttacaaactggtcactatcaacttcaagtggttcggcttccaaaaactggtcgagacttttgtgcaaaaggtgagcgaaaaatataaattagtgacgcgttttctgaacggtttttactcaatttgagtttttgggctattaaaatttattcaaaatcggcattggcagtgtaaaaatttccgagtacactttccaatttgtgcatccctttagcaatacccccgccttttctgcaaattccatcgcgagttgttctgttggatggaccgctggtacggactgacactgatggaaatccgtttgatcgaagaggagacacagcgggaattggatgaggtcggctctcctgtcactgtccagtttcccctttacgtcgtccctccctttggctcagatgcgttcgaccggcaaccccgcggggatgaccgcc

SEQ ID NO: 75433 - DNA, 72 bp, Heterodera glycines
  Genomic contig location: Contig_ID=SeqID_11922; Location=586..657; Strand=-
  SCN-specific regions: Sequence locations=1-72
attttcgcctctcgtcccaaaaaacgagaggtgagaggcgagagtcccaaaaatgacgagagttggcgagag

SEQ ID NO: 75434 - DNA, 734 bp, Heterodera glycines
  Genomic contig location: Contig_ID=SeqID_11925; Location=467..1200; Strand=-
  SCN-specific regions: Sequence locations=1-329,351-442,464-734
atgacctttgagcgcggaaaaaccaattttgggtgagattgtctatggttgaaaggtatgtttgaagcgccgcaaaaaatttatttccaaactattcaggatttagattcacacaccactcaggaaatcgctgaagatgcacaaatcgattttttctcaattatcttggccgtcttctcctggaatgccaatgttcttcctttacttctctcgaacatatatcggcttgacacagcgccagatgttggatggtgttgacgcattttgagataatcgactcaatttttcacccatcggcaaccattgtttgtttaaatttatgcgtttagtttccaaaaatttaaatttttagctgcactcgggacaataatttcgactatcaactcggaacaagctatgcggctacccctagagttcggcaccggctcaccggcaccatcaactcttacatggccaaccactgtgagtccacgtgagcagcttgttcaatatttgttgagtccgctatcgacttcgatagcgccttcaggcagaattctttaatcaattaaaccgtttaaactcaataaaaagattcatttacagcatgggaggacgaaatcgttcggcaccacattttccaattccgccggcactctcaaattgagggatatgcaggaaaattgaaggatttgaaaattttgatgattcaattgtccatgtcccgtaatgaattttattgaatgtttaataaa

SEQ ID NO: 75435 - DNA, 712 bp, Heterodera glycines
  Genomic contig location: Contig_ID=SeqID_11925; Location=388..1099; Strand=+
  SCN-specific regions: Sequence locations=1-350,372-463,485-712
aaaattagaataagtttaggggtggtatgtgattggaattagatacatagactcagcttcacacattgaaaaaaataattttattaaacattcaataaaattcattacgggacatggacaattgaatcatcaaaattttcaaatccttcaattttcctgcatatccctcaatttgagagtgccggcggaattggaaaatgtggtgccgaacgatttcgtcctcccatgctgtaaatgaatctttttattgagtttaaacggtttaattgattaaagaattctgcctgaaggcgctatcgaagtcgatagcggactcaacaaatattgaacaagctgctcacgtggactcacagtggttggccatgtaagagttgatggtgccggtgagccggtgccgaactctaggggtagccgcatagcttgttccgagttgatagtcgaaattattgtcccgagtgcagctaaaaatttaaatttttggaaactaaacgcataaatttaaacaaacaatggttgccgatgggtgaaaaattgagtcgattatctcaaaatgcgtcaacaccatccaacatctggcgctgtgtcaagccgatatatgttcgagagaagtaaaggaagaacattggcattccaggagaagacggccaagataattgagaaaaaatcgatttgtgcatcttcagcgatttcctgagtggtgtgtgaatctaaa

SEQ ID NO: 75436 - DNA, 1175 bp, Heterodera glycines
  Genomic contig location: Contig_ID=SeqID_11925; Location=2630..3804; Strand=+
  SCN-specific regions: Sequence locations=1-184,230-283,314-581,657 -735,763-1175
atgatggcactgatcgaatttgcgttcaattcggttgccaaacaccgccaaatgttcatttacgtttcaaaggtgttggacccgcactttgacaaagtgatgccacccgtattggccaaagtgagcgccaaagggcccgtggaaacgcaccaaaaaatgccatttgcctaatcatttatttgtgatttattatttttataattgccaaaatttaattatttttaaaaatcgataaaaaaattcttctccatttgttttgtcgctcgctcgtctcatcatttagtttaaattattcaaaaaaaaataataaattcaaaaacactgtagggatatttgccattttgttgttcacaacagcaagaagtacggaatcggataactggtaatcacaccggaaactgtgacccggaaataggggaatcagtgtccccgtacggtgagaaatgtatgaaagttttaaatttaacacagataaataactgattaagattcttctaatttaactaaattttccaaattatgaccaaaaaggacaaaatttacctaaaaatggaaaaatgacttaaaagttaaaaaaagtgaatatatttttattttttatctttttcatttaatttctttttaaatttttgaaatctttgaaattattatttttagatgaggcgttaaggaaaaaatcgaggctcatatttttgtataagattttagggtttttgattttataactattctaattgaaaacaaaaatttgtaaaaatatttttcactaagatattagcgattttttagacttattcattatgtaaatttatttcaacggttttacttttttatttagttcatttctccatttttgctcatcggtcatttttactattttttgttctcgttgattccctaaaccattcatccgtttggccgtgtgcatattgtagcggcattaatttcccattttagcctggccaaacccctcaaacggttaccatggcttttccatttaatttaattggcattaaatcaaaacatctttttattaccgaaaaagcgtaattattcatgtaaaatcgtaaagtagatttatttcgcttttctcattaattttccgaagaaaaatccattaagcattcatttgatgagcatttttggcgtcttctcatttgcccatcctctcccaa

SEQ ID NO: 75437 - DNA, 719 bp, Heterodera glycines
  Genomic contig location: Contig_ID=SeqID_1708; Location=390..1108; Strand=-
  SCN-specific regions: Sequence locations=1-213,235-691,718-719
  Gene Ontology: Cellular component=mitochondrion
atgtccaagtacggcatgtcaatgtgtgtgttgggaatgcacgaagagttccgcaaagatggcatcgcagtgaacgcactttggccacggacgaccatttggacggcagccacacaaatgctcacttcgggcagagggcagcgcaattcgagaaaagtgagcgaaaggagggggaagcaaactgatgcgacaaaaaaaatgatgaaaccgaaaattgggtaagaaataattccctttcaaaagggtcctccctttggttccccccccccccaaatttaaaatataaaaataccaattaattcgtgtttttaattttatgttagccgaaaagccggtttttaagtgtcgttttgaaaacaatggcatatattgataggattgttaaaatgcttttgtttaagcctgaaattattgccgacgcggcttatgtgattctttccaaaaactcgcgcgattacacgggaaatttcgcaattgacgaagaagtgctaaaggaagtcggagtcaaagacttttcgcaatacgccaacgatccgagtaagtcaatttccattgggtaattacagttttctaaaacaaaacttagtcttgaaaatattcgttaaaattcagcggctgaacttttccctgacttttttgtgcccggtgtaaattacgaaaaagcgatcgaagcggcctttgcagcggcaatgggcgaaaagaaagggaaaaaagtctga

SEQ ID NO: 75438 - DNA, 486 bp, Heterodera glycines
  Genomic contig location: Contig_ID=SeqID_1709; Location=377..862; Strand=-
  SCN-specific regions: Sequence locations=1-166,188-294,317-409,431-486
atgcgcaaatacaaagcggaagaattgagcaacgcaaatggcaataatgacgagggacaatcggcacagaacggtggggaaggcattgactatcactcggccgacaaacgccaaaaaattgtcatcgatttcatcaatcagtgggcaaagctttccattgaggccgaaagctcctttttcctggtcgcctatttacgctttttggtcgttgaagtcgaaaaaatatctcaaaaaggcaatttgagcggcagagactcagtggtcgcgttaatggccaattatgacggttggtttggggtttggggacacatttttgcatatttcgataaaaacttttaaaaatgcaccccctacgaagcgagccttcaatttttcaacattgctttctaatgaaatattttactcaaaattccattctgaaaatttaatagcgaccaaatttaaaagatttctctttttttaatcacttttgaatatagaaataaa

SEQ ID NO: 75439 - DNA, 321 bp, Heterodera glycines
  Genomic contig location: Contig_ID=SeqID_1709; Location=1538..1858; Strand=-
  SCN-specific regions: Sequence locations=1-321
  Gene Ontology: Cellular component=mitochondrion
tttacagttaaattgttttttacatatttatttacttttaaaagcacttgtttttcatttgtcaacacctttctgagtcccattagtcatgctcaacacggggttggtcattcccttgctgttatgaaacaaaataatttcatgtttagaaaatttctcggcaaaacttttgtcataacgggggcatcgcgtggcattggcaaggaaattgcacttaaattggccaaagacggcgcgaatatagtcatttgcgcgaagacaactcagggcaacccaaagttgccagggacaatttacagtgcagcggaggaaattgaaaaa

SEQ ID NO: 75440 - DNA, 529 bp, Heterodera glycines
  Genomic contig location: Contig_ID=SeqID_1709; Location=1776..2304; Strand=+
  SCN-specific regions: Sequence locations=1-40,107-529
atgggactcagaaaggtgttgacaaatgaaaaacaagtgcttttaaaagtaaataaatatgtaaaaaacaatttaactgtaaaaaattaatttattagtttattatcactgattaggtacttaacatcatatcattgataagttattcaattgtttacgaatcaaaaaataaataaacaaaaatgtgttacataggatattgattgtttgttttcgtataatttcaatttgtcggttgcatcactttggcaatttcaacctcctcttttgtaatgtccaaaaatgacaaaataaatgcatcaaactttgctaaaaaattcattgtcagatgaattaggtaattaagcaagagcaaataagcgagaatggttaatatgaaacgaatgggttaaggaaattgattgtacagctcgagggataccaacaggagctcaacgacatccgagtcaaggctgacgccgtggtcaaagagaaggaagtgttggagtatcagctgaccggccagaaaaggaggggaagcaaacaacgg

SEQ ID NO: 75441 - DNA, 2575 bp, Heterodera glycines
  Genomic contig location: Contig_ID=SeqID_1710; Location=245..2819; Strand=-
  SCN-specific regions: Sequence locations=1-386,408-486,512-519,541 -676,698-727,749-827,849-957,988-1032,1071-1082,1104-1150,1172 -1564,1587-1891,1913-2138,2170-2524,2547-2575
cgccaccggaacaacaagacgctcctccggcgccgaacatcgttttgcgtcagcagtcaccgccggcacaacaacaccacaggcgtgacgacaggctgaactttgatacaccttctccgctactgcgtcagcaaagaccgttggtgcagtcgccgcttgtgggtcagcaaccagacactcctgttgcaccaccatcgccaaacgcaactttgcatcagcacccgttggggccaccgcaacaaggacatcgtactcctgcgccaaaacaacagcagcgtaaacatcttgtcatctacactccatcggagggtacgccatcgccagttcggccgccgcaacatcaacagcagcacgacaaaaatccaaactttcgcaatatttcgtacatattttcattttttatattgaactttaattcgttctaggcctagttaggtcatttttatgcattttgtgcctgtttcaccctttatgaataatttttttccaaaaaataaccattttaaaattttgtttcgtacatattcctgggtttttgtacataattcatacatagtttttacattttttatttacatatttgctttttttcttacataaaaaggaatccttgtatattagccttatttttcagcgaacatgtaattggtttgcacgcttcattctcgtagataactttttttatatatataaaaaagcaatcaatagaaaaattgattttatggcatattaaaatgaatattatttttcgcaaaaataaaaatgaattattcagttgtaattattcttaaattaatttattcggcaatttttatttgcttatcactgaagctgagatttataaatatttatgaaaaattccgaaacatttaaataaatatttacgaaaaaaccccaaaggccatatttgtaaaaggggacaattgggtgcgatttgggaaatggttttcgttaaatttatgttttattgtatttttgttaaaattgccgaaatattctcaaaatattgaaatagttaaaaaaacatattcgtaaatattttatttatgaaattaaaaaaatattttttacatttatggatattaacgttaaaaacgtcaaaacaatctatttccggctaaaaatgttgtctttcgtccattctcattaaaattaaactgttgaaaaaatgccataattacttttcactgttttttaggtgtaattagtaataatcttttcctttttattctacgacagtaataaaataaatgcgtttccctttttttgttggcctttttatgctcccgtttttggcgttctgtttcgccaagaaagaaccggagaatattttgtttaattttgatgccatttttgaaaggtttgctgaatttcagcacaaacaaaacaaccccatgacagcttcttccagcaacaacaactgcccaaattcaaacggtactacttttgaggaacaccagcaaaacggaggcgaaaagatacgataccgagcgacggtaattaccgtaaagcacagagtgaattacctaattgtttgacagtgtaaaagcgaaaatatcgacacaaaaaatgcttaaaattttaaaagaaaacgcccgagaattcgatgaaatttggcgttccattcctcttaaaaatggataagttgtgcttggtcgtttcttcaattccgcaacttttcctaaatcccaaagggaaataaaatttaaaaaaaatcctaaacattcttaaaaacccaatctaacattcttggtatcgttcctattctaggaatggttctaatgcacttctttatgagtccactcaattaacaattcatggtttttttacgcaacatttcttcatgttcgaataaaccctattttttggttttttcgaaacacaaagtacaaattaataatttgtgaaaacgagaaaatgctaacacttaaagaaagttacaaacgaaaatttccaacaattacttaattataatattttggcaattgcctaaacgctgagattttatatagcttagctgctttagactttgtgctttcgaatgataccaaaaagatagggttattcgaacaaatatattgtataaaaattgtttatggttaattgtaaacattaaaataatttctctcagaagcaggtaaatttttttttgaaattaaatatttttatcatcgcctaaatcagatttctccgcctggccgatatgccgtgattgcctgggacggcattttgaatgaagaggacaatgaatgccaacaaaaatttgtgctgccaaccaaaagcgtggaaaagctgcatttcttcaccaatgtgttgaatgcgactgatcagttggccaaatgttttaagcatttttacatggcccgctccgatgcgaatggccaatttgaattacggcacaatttattgacagaaaatgcggctaatgatggcatttggtgtaacattttcagctcggcagattggctcagtaaattatggtttggccgaggagaaaaacggcaaaaaattgacgatgacgatccactcagaattgttcaacttcagatacttccactcaattctaaaggggttg

SEQ ID NO: 75442 - DNA, 201 bp, Heterodera glycines
  Genomic contig location: Contig_ID=SeqID_1710; Location=2625..2825; Strand=+
  SCN-specific regions: Sequence locations=1-201
atggtggtgcaacaggagtgtctggttgctgacccacaagcggcgactgcaccaacggtctttgctgacgcagtagcggagaaggtgtatcaaagttcagcctgtcgtcacgcctgtggtgttgttgtgccggcggtgactgctgacgcaaaacgatgttcggcgccggaggagcgtcttgttgttccggtggcgctataa

SEQ ID NO: 75443 - DNA, 960 bp, Heterodera glycines
  Genomic contig location: Contig_ID=SeqID_1711; Location=22..981; Strand=-
  SCN-specific regions: Sequence locations=1-296,318-960
atgaaggagacgaaagcgaattttgtcgggcagcggacggtcgggcaatggaaaatcaattgaattggcatggccaataaacaaagctctctaatcaaaatcgcaacacaatcatcaaacatgtggccatttggtgcaagggaaagcaagatcaacgtcttgaggttgagcaaaggcgtcagcagctggaaggagaagtagctgcactggtaaaagcttgtggacgcctcaaaaggaatgcgcaaaagaaggacatcgcgttcaagttgaaaagccttgaaatggtgaaatggcctcctgcaaaagccttcgacaatccttacatcaaacaaggtatataagcaactttacaagctctaaattagtgttctattgatatgtcgcaagttttcctattatgtaaggattccttacatgtgattgattttgccctatgtgtaacaaatagttacactacgcttgaaacttactaagttggaagaatttttacatatgagcatgcgtacacacaggctaatcaataaatttcatgtaaagcctacggccgaggcaccgatcaccaattccaaaaagcagcaaccatcgctggccgcttccgcgcaaacttcttgggatcgtcgaccgcacggttggcgtcagccgcgtggtacgccacccgtggagtttactacccaatcgaggactgcccacccattcctgccgacaaggacgggtatgtgccaccagaacagcctggactcaacgcggacgaccaacctgtcactcttgcaaaggcattgcaagatgttagcaattttttatgtcttcagttttgactaataaatttagcctttgtttggacctgctgatcgtgaggccatcatcggccaacagccgacagatgaaattgcgtcagcattcgacgcttttgcgcaaaaggctggtgactttgcggaccaactgcgcagacggattgaggaa

SEQ ID NO: 75444 - DNA, 2002 bp, Heterodera glycines
  Genomic contig location: Contig_ID=SeqID_11926; Location=764..2765; Strand=-
  SCN-specific regions: Sequence locations=1-240,264-276,322-475,497 -506,540-540,570-1307,1329-1600,1621-1892,1914-1950,1972-2002
atgccaacgcgaggagcatcgccagcgaatgcagctgccatcaatgaggcatttggcttgcatccctttttcgtcgcttttttgatgattcagaatttgagcgattttttttataactgtgagaatgacaagtttcttggctgagtgccaatcatcgatagtcattggcatttattagcggtaaatctcttcgctgtgatcacgtgaaatgaactaataattagtttacatacttaaattcttaaggtgaattttatacaattgtttaataattccttaaaaattcaatttatatattttataatttaaaaaatttattatgttgacgtaatatatgtatagaaagcattattattgatatgcaaataaataattgaatcaaatgcgccatcattttcccggttaaaattatgcgctagaaaaattcgcagaacaacatccggcgccacattatgttttgaatatatttctccgataaacagttgaataaaacaatatataaggagaataataaattaaataataaataataaaattttcgacaaaatattcaaacataaattttggagaattaatatttgccaatttatgtcctgctgataatgttctccctccgcttcatcatattcatcttcgtcgcttcttcaacacttttgttcaaaagcgtagacaccaaagtggtggcagtcaaaattttaacagcgtactcaacagagtataattcttataattctgattctcaagccgagagctgcttgctaatttgccttcaaaatggttatgaaatcgttagtaatgctttttaactaattggcttggtgctatgtcgttatataaaaaaaccatcaaatgaaaattttcaacaaaaaaactgtccataacttttgtcattgttaaccaaattaaacattcttgatatcattcgatagaccaaaatttcaaaaaatttcatacagtttgaacaaggttatgactaagggtagagcggtaccggcaccggttttttcaaaaataaatgtaccggcaccggttttttcaaaaataaatgtaccggcaccggttttttcaaaaataaatgtaccggcaccggttttttcaaaaataaatgtaccggcaccggttttttcaaaaataaatgtaccggcaccggttttttcaaaaataaatgtaccggcaccggttttttcaaaaataaatgtaccggcaccggtttttcgcaaattttgctttttatttttcaatttggcccatccctgctaaaaagtaataccgtttttgcacccaaacttcccccctcccattcactattgatataaaataatgattttgaggtctgctcgcaaacattccaagcctggaactgttggatgaaataagcaaggaaaatgcattggcaaaacaacacaatgtatgcagcagttgaccagttttatttagttttttttcaatttttacattttcaggaaccccagtatgagctggagtgttttgtttcgcttggcactggcaaggcaccgactgaaccggttggcacaacatcgttggagattgggattattggagcaattaagaatctggcggggattttgatggatcaggtacacacacacacacacacactatatatatatatatgtgtgtgtaaagcaaatcattttaaaagtaatttcaagctgggtttgtatatttccccttcctcacaattgtttctgaaataattgtttttttttggaattagactcaaaattttcaatcgaaaaaatttgagtgcgtttcaggcctcccacagtccaggaaaaaaatatggatttccatataattggaatccctaattatgacccctcgaaaatggtagaactttgggcgccatggtgccgaaggcgatgccagaaaattttgattttattgaatttagttaagaaaatgttgcacgcactttgaagtcataaaacgaaattttttgcgatttttcaaaaaaaaatttgtttgttttttgaataaa

SEQ ID NO: 75445 - DNA, 1550 bp, Heterodera glycines
  Genomic contig location: Contig_ID=SeqID_11927; Location=2118..3667; Strand=-
  SCN-specific regions: Sequence locations=1-442,606-1005,1028 -1260,1282-1550
atgacacccggaacatcaactccatcgacaatgcttttcatagttccctcaccacacaaacagactctgcacaccaaacgtggcctcaatctgacgatgcttcacctacaaatgttgttgtctgccaaccgtgaccggcaaatgccatggcccatccatttgtgtaacttcccctcaacatcatccgccgacgacggcaccggcggtgccgacgctggtgctgttgcggaagtgcacgcactttgtcgtatgcgattgaacacgctggacagcacgcgatgcgtcaccggcgaactgcacaccgagtcgtacacggagttgttcccggagttgcgcagcgcagacaaaattgtctacctgagcccgcactccaaggactcattgacagtgcgttttttggcattttactctgcccatgttattattgcatttttttttgttttctctctctctctctctcttcccatttctctttgtctctttctttcttccgtccgtctatctgtctgtcttatttctctctttgcttttcatctctttctcgctctcgttctttcatctctctcttccatctttctcttttttcatctctctctctctttttccactaattactccctcccctcccccttcacagcatattgatcccgacgcctgttacgtgatcggtgccattgtggacagggcacgtgagccgcgcattccggtgaaggcatcgctgttggtcagcgaagaagagcaactgccatgccgacgctttcccatcccgcccgagttcctgcgcggtggtaacccaatgctgaccctggtccaagcgatggccattctgcagcacgtgttccattcgcccggcggcgacgattggcacggcgcatttgaacagtgcgtttttgggggttatgcaataaaacgaacgaagtcttaattatttactattaccagcttcgggcacggatttggcactagaaaagtgccgagtcgtgtacaaaaatgtcgggtcgtgttggctttcaaaaatatgaggttgtttcaagattcgtataaaaaaataattttggattggggaggcaatcctggctatttttgtaatagtatcccaatttgagcggagctaatttgccggaaatgaatcaaaatagcccgatttacatatatatatgaaattaaaaaattacaaattcaaatcggcacagtttagataaaacggaagttgtaagactcgggacgaaaaaaatttcgtatttgggggaggcaaccccacatttttctttatctctacagaatatcccttttacaaattcaaatcggcactgtttaggtatatcccaaaacggaagcgtttggcgccggccgagaagaacacggtgatccgactccgttacgacaacattcacacacggaacagagaaatggcacgcattgttgagcagcgaataccgacaacagcagcagcagctaaagttgatcaacaacagacaactaatggcggcggaagaagtgatcaaaaaatggctgttggaatgcgctttttgagtcggattttcggctga

SEQ ID NO: 75446 - DNA, 262 bp, Heterodera glycines
  Genomic contig location: Contig_ID=SeqID_11928; Location=224..485; Strand=-
  SCN-specific regions: Sequence locations=1-83,193-239
atgcggctgaaaacggagcagaaaaaggcgcaaatgcaattgatgagaagcggtggtggcgatggcacggcgatgccaaaaatggaagaagaggaagacgaattggaagaggaattggaggaagaggaggaggaaggaagaagaacagtggaagaggaggaggaaaaggaacagagggacgaagaggaggagaaaaagggcgatgagcaaagaacagcaacacgcaaaaccaaagcctttacaatcccattcatctccacgg

SEQ ID NO: 75447 - DNA, 247 bp, Heterodera glycines
  Genomic contig location: Contig_ID=SeqID_11929; Location=108..354; Strand=+
  SCN-specific regions: Sequence locations=1-247
atgcaggtgctgtattcttttgttttgtattatattagcagaccagacattaatgaagggggacgtgggaatcttgaggtgaccactgttttatgcattcatttcatcccgaaatggcccttgctaattgtaagtaattgtttgtttcgtttcagaattgcaaggcttggctgagtccgtacgatgtctattggaagtgccgatacaaatgaactacggaattgtttttgttctttattaattcaaa

SEQ ID NO: 75448 - DNA, 1534 bp, Heterodera glycines
  Genomic contig location: Contig_ID=SeqID_11929; Location=459..1992; Strand=+
  SCN-specific regions: Sequence locations=1-108,141-185,207-536,558 -966,988-1032,1055-1213,1235-1534
  Gene Ontology: Cellular component=integral to membrane
ttcgatttatcttatggcttttctgtgatgcaaatttttggggaggaagagctcctttccgtcccattcaaatacgtcgtcctttttgccgtcggttgtcctttggtcgcttttttgctttgtttgtttctcagcatattcctccattatgagcaggtaacaaacagctaattgaacgtaatgctttcctgtttttccccttttaggctgtgtggacgcattgcgaagtaataaattatataaataacttcgcattttgtgggttctttaaaatgtctctcttcctttccggttcctaattggcttccctctttgtcggctgctgtttccacttttgcgcctgaacgttacatttggcggctgttcatcggactccatggaactccgaggtttcaattctccccccccccctccattttcgtgcttctctcttttccctcagattggtcgctgcgttcgccttcaagtgatcgcttttgctcttcggcctccgaatgttccatttttttcctccttcagaaactttctggtcacttccagcctttggcctttcccctttcgtccatggtatcgttgggcttccaaattcgcttgttcgttgaatttggccgaaattctgtcactgattttgctctcgtcggtttcttcaacggaggaccattgtgagttttgttttctgatgaccgctggtcagttgtcctttctttaacagtccttcacgccctttgtttctccgggttcactttcttcgctcatttttacatgtttgtcaggttcagcccgtgttggttttgaatttcttatcaatttcattatttaagtatttggcttttcgacttctccggaagacggcggtccagcaaattggtaattttgggcagattacattcaacccggccttttcaagaaggggcattcctgtgttcatgagtttgggatgaaacttaatgcgtagcttaccgcggttagttttgtaaaatctttggactccgaggcttctctattagcaagcacaattttgaaaaaaaactcaaatcaaagtcttgattttcaaacaatttcgtcatgatatatttcatgttaatagagaaacctctgggctaccaaataatatcaaatatattggaataaggcaattttgaaaggtctgatagccaaaaaactgggatggcgcccattcaccttcgcttgggatttagtaaatccatttgcccttcctttttgtgtttgctttttcatcccttccctcttttgttagggtgaactgtccttccaatacaaagtgttgtgctgcgtcggttctgtgctttcgctgcttttcgtcctttatttttactaccgtcacaatcgcttctgcgagcccggcgtttacactcttttcgcgctcagcgagtacagtctgattctgttcaacattctcttccactccacgctttactacgacttccattcccgcgcactcactttgaacaccgcggcactctcttccgtcgcggggtacgatttgttgccgttgtacagcgagaaaaggacg

SEQ ID NO: 75449 - DNA, 399 bp, Heterodera glycines
  Genomic contig location: Contig_ID=SeqID_11929; Location=3870..4268; Strand=+
  SCN-specific regions: Sequence locations=1-399
atggatttgactcgccccactgatcaattggcaaatgaccggtcaaactcttcggaggccccacaacagcagccatttgttgtaaatgtggtggcttctcgccccagaagtaaaactgaccccaaaaattacgacccgaagcctttgatcgtcccgccgggtgctgccgctgatcagcgaggcccccgtcggctttccccggtcccgtgcctttgtatggcgcgcaattcgtcgcccaccggtgcctccccctctcaactcgtctaccaaccgcggactgtcccttctccgtccgcgagtctctccccaactgatcaaaaggggtggggcacgctgaagaattcgtcggatccgtcgacaataaatgtgccgataaagacgagtgtttgcacggcaacg

SEQ ID NO: 75450 - DNA, 581 bp, Heterodera glycines
  Genomic contig location: Contig_ID=SeqID_11929; Location=3239..3819; Strand=-
  SCN-specific regions: Sequence locations=1-138,160-289,311-581
atggaagggaaaagcagaagcgggcggaggagagactgtgagggattatgggagaagcaatcgctgctcgaccccaccccccccccccttcgtcttgtacataaactgtccgtcgttgcccacgtctatctgctgcgcaaataataaaatgcttactcccccttcccccggcgcatttgcccattcgattccatcgataaaatattgagaaattctaattaaaaataaaaaagagagagagagaaagtaattaatcagtagacggcggaaggaaagcgatgtgagagaatggataatgattgagcaatgaatgccaaagggcactttcactgatttggcgatgcctttgaaaactcacgcaaatgctccccctccccctccgtctcttccgcccggccctttcggcggtgtcctcgcccaatttcttctcgcccattggccgcgcgtttcgtcgccaccgccccaacaatttgcggggaattattatggaggtgaagcaacagaacgaagagaacgatgagaagcgggggaatttgggaaggaaaagcgaagaattgtgggaaaaccatcggaaaataaaa

SEQ ID NO: 75451 - DNA, 906 bp, Heterodera glycines
  Genomic contig location: Contig_ID=SeqID_11930; Location=69..974; Strand=-
  SCN-specific regions: Sequence locations=1-86,121-322,344-731,760-906
  Gene Ontology: Mol. function=RNA binding; Cellular component =nucleolus; Biological process=regulation of transcription, DNA -dependent
atggctccgcttccgctaccccaccgtccgttctctcagccgccgcgatcgccacgtgccacggcacaaatggcaacggaaagccaacagcaaaatcgggaggaggagcagcaacagcagagacaggaacggcacaacaccgtgccaaattcggttagccaacagcagcaacagactatccgaaaattatccgcttccgctacttcgacgatcgcctccgccaatgattttgtgtgcaagttttgcgggaagcgttacgcgtacgcgagttcgctgtatgtgcacacgcgactccacacgggcgaaagaccgttcaggtgggagagagtggcagagaaaaaggggaagcaattttaaaatgcaaaaaaaaaaaacagattatttagatgcaatttttgcgacaaatccttcaccaaccagggcaacatgcaggtccatttgcgagtgcacaccggcgaaaagccgtaaattcgaaattggaaataaacaattattttttaattccattttcacagatacaaatgcgacggctgtgggaagggatacgcgcagaaagtcgggctgaacattcaccaggagcagtgccaagtgagtaattgacaatgctaatgactatactaattaacctactaggaatccctcactcatcatccctttgatgaatttttatgctttaatgcgaaaaaaccctctaatgtccacacccgttcattaaatgaaccgatcagtgatcagaatggaaaactgaattcattggccgatttttttattgctaaacttcagaattggctgagccgtcgcagttctgtgtccacgtccgctgagaaaggcgaagacgacggaatggcaaacgaaggccaacaaacggtgccgacgagaagggcatctcttcaggaggccttttaa

SEQ ID NO: 75452 - DNA, 1321 bp, Heterodera glycines
  Genomic contig location: Contig_ID=SeqID_11931; Location=1..1321; Strand=-
  SCN-specific regions: Sequence locations=1-109,134-176,198-232,254 -314,336-406,444-465,487-985,1007-1198,1220-1242,1273-1321
  Gene Ontology: Mol. function=zinc ion binding; Cellular component =nucleus; Biological process=regulation of transcription, DNA -dependent
agttgttcagctctgttcagcgcctcttcaacaaattcctgccaaaatgtctctgcacagagagacgaagacgaatttgagggggaggaggaaatgtttgaagaatgttatgaggaggaggaggatgacgaattggtggacgtggaagggcacgacgaagagacggagatgaaccaggggagagatgagcgtcgggggatcagacggaggccgggcggaacggccacgacgacgccggaggggacggtgccgcgaagggataaagtgccggtggagaaacggcacaagtgcgacgtgtgcggcaaagcgtttccctacctgtccattcttgaatcgcacaaacgctgccacacaggtgggcaaaaaaaaagggggggggggagaaagggccaacaattattggcacaaaattggcatttttaaaaaacgaatggaaaaaagtggcattttgaatttacaggtgagaagccctttttgtgccatttctgcgacaaacgcttcgcccaaaaagcgacgcttcaagtccacgaacggacgcacaccggcgaaaggccgtaagtgcgaacgatttgaacaattaggaaggcattagcaaattccaatgattcgcttaagtcttttgatcactttgctgattgatcagttgcaattcgtttctcctgatcagatacaaatgcaaattctgcgacaaaacattcgctcagtacggcacaaaaacggtgcacgaaaagtcggcccacctcggcattcgcaactacaaatgcccccactgtgacaaggatttgtcttccccgtcagcgctttacactcacaaaaaaacacacggcgaaaaaatgttcaaatgccaacattgtccgaaaacgttcactctaaagaactacctgaagctgcacgtcaagcaggtgcacgagcagaacgaacgcaaacacagctgccgcttctgcggcaaatcatttgcttacgcggggagcctacaggcaagcggaaggatgggaaggagcggaactgatcggagatatcgattgatcagggcagaggatttatggccggagcctatgcgatatcgattgatccgggggtttgaccggatatcggttgggttaattgggataatgataggacggaggcactgattaaaagaaagccttctccctcgcttggcagtctgatttgtctaatccctttctatgatcacttctccacactgccaacctcagccccccttcacaggtccatttgcggacgcacaccggcgagcggccctatcagtgcaaattctgtccgaaagcgtttgccagccaagggaattgcaaagccacga

SEQ ID NO: 75453 - DNA, 2162 bp, Heterodera glycines
  Genomic contig location: Contig_ID=SeqID_11934; Location=256..2417; Strand=+
  SCN-specific regions: Sequence locations=1-564,589-736,758-872,894 -931,953-974,997-1010,1035-1145,1176-1217,1242-1277,1300-1380,1415 -1528,1563-1634,1657-1703,1727-2037,2097-2162
atgttgaccggcatggtcaaggagcacatggcgcgccagcacttgcgccgtgagcagcaggaaaagctgaagaatgaggcaattgtggcggcccacgagctgaccgaggcgctggtggaccatctgaaccacaggttttgcaaaatccatcctacggcattgccgactcgtccaattattttccggactttaatatcctgagaaaataaaagtcggtgtttctggctatttgtaatcgctgatttctaattggcattcactttggcctatttaaaaatgtgaacaggaagtctaattcaaattggctattctcagatggtgggcttccatttttggaaaaaaaaaccaaatttttcctgagaaaatatttttcgggttttcatggtcgagaataagaatccggcatcgctttccgggttcgatttaggccgagaaggtggtcggtttaagattcttcgaccccgaaaacccgcaaaatagtgtagtttacctcgagaaaaaaaattatttttcaaaaagtggacccaccccaccatctaaaggtttaccttcaaagtttccgtttgcattttttaaaattaaaatggattaaaactagcaaaaacgaatctcaatcatttgcaacaccaaaaatgtcatgtttaatatggtgtttcgccttcttgttcgaatagggtacgggatttaggaataagcacaaaaattaccgatttgtggaataattttttgatttttgtaaaaacaattatttttcagggtgtcccatgcctacaatttgcagaaacggttggatgtcgagtgtaaaaagttggagacacaaagtgcggcgttggcacggcacgcggacgcatgggtggcactggtcggagacatgaaccaggcactgaaggtacacaccggcaaaggcgctgaatatttaaacgctaatgccaagggagggctaaggcccagcaaatttaagcgaaacaaatatgttttattttttaatttaaaaatgttagaattatggctaaataaatgaaatatttttaaaattcgctccctttttattggcaaaaaattctttttttttcaaaaaaaatttttttcggaaactggccaagacacagttaaaaagtgtaatgaaaacttgcataaaacgcattaataacttgaaataaacaaaatctttaaaatttcatgattggcccgattttcatttacgccaaaattcgattagaaatgaaaaaatgcaaacaaaatttttctggctattcacctgcctcaacccctgtcgaattttttaaatttattgttttggtctggccaatttcttgcttgctaaatatggcgagttttcatttgtattttcactttctaagaccatatttgaaagtgccagaaacaaaaaattaacaaaaaggggtgggggaaggtaaaatttgaactattaaaaaaaacattttaaaaatccaaaaaattttcctgcccgctcctaaaaatccttatttgtcttgcaaagatttgcccaaatcgcaaaatttgttcatttttggataaaaaatatttaaacaaattcatttaaaatcacaatttttcccatggcgcgtgtccgcaccaccggactccctcttgtcgcccagtattttttttttgaaaaagtgggctacaaaaaaagtcggtgttcaattttttggtgggagtttttttttttgctacaaatataaaaaatgatggaaatttttctccttttttgattctcaaaagtctaaagctttgtgccttttctcaggaggttggcgacgtggacaactgggcacgagcaattgaggccgatgtgacacaatgtgccgccactttggaacgcgtttatcggacccggggcggcgctgggcatggaccggcggtgggcgcgggaggtaaaaattattggattggaaaatttttattagaaaaatcatttgatcaccaacattcagccccacctgaaaattaaaaaaatatttttcctttcgagttttttctcgttaaaataaatttaacgagtcgattcaaatgttttttattaaaaaaaacaattataattacaaaaaaatttagaaacaaaatttttttttcagtttcttcaaatcagtgagcaaaattttttttggttttaaactagtattttcaacaaatttgca

SEQ ID NO: 75454 - DNA, 3015 bp, Heterodera glycines
  Genomic contig location: Contig_ID=SeqID_11935; Location=1..3015; Strand=+
  SCN-specific regions: Sequence locations=1-150,172-200,222-744,770 -1454,1477-1956,1997-2608,2630-2648,2670-3015
  Gene Ontology: Mol. function=1-phosphatidylinositol-3-phosphate 5 -kinase activity; Cellular component=vacuolar membrane; Biological process=vacuole organization and biogenesis
ctctttttctttcctccgttcggaggattttgccgaattccgtgcaaattttgacgcattgcagcagaaattggatgcggtcgaccgagaagaatgcgaaaataaaatgcaaaatgggataacgattaggcacagatgtttggatggagaagcgatgggcggagagccgcgaaaattgctggaccggaacggatggatcagcttcagggccacgtccgcactgcattttcaacgaagggccgagctgaacaggagagccaaggaggaaaagtgagtggcaccaaagggactgcctgaaatttgaccttttaagcgtgtttacatacttaagactgaaaaaacgcgaagcattgttggctgaatcggaaattggtcgctgtgaactgctcgcccatgatgacttccagcgggacgtgctaagcccgtacaaccatcaaggcatcgcctttctttattgtgccaatgcgcgacgcgccacgagccgacgcgtcgaagaggcgtcgcgcattttctgcacggggccatacgttttgcaacgccaattttaccacggcaaagacacatcgctgggagcctttttgcttaagtaaaacgatgcacagattgggactggaacagccataaccaataattcagctgctgcttcaactcggacttcaaatgcaaaggctgtgaacggccaatgttggaccatttccggcgcattgtgcacggcaacacgcgcattgaggtggtgacgcggaatgtggccagcgggggcggcggcggcactttccgtaacagttcctcgtcctccttggccaacgcggcggtggccaccgtcggtccattcgtcagcgggggactcgcggccgcaattccgtcgtcctcgtcgggtggtggcgacgacgagctgaacaggacaatgccactggacgagttgccctcctccatccccaacaacaactgttccgccatcatttgttggctccgttgcaatgcgtccgctttttgtttttatggcaaaaattgctctgtcatattttaagttgttctgcaaattcgtcgattgccaaaatgacggacgaaatgttccatttgagttttgctaaatttgtcgattatttggccaatgggtcccattgggtcgggttttttttgcttattgtcttcccatatttgtccattcatcgctctttgccaggtgtccccctttccttcgtccatcgacttggccgagtgtcaccactgcacctttcactgccattcccacttttttgcccttgacaattttgtcgcgcgtttctccgtcaacccggtcctttcctccctttcttttcccatttaatcgtccgttttcatacgtccctttttggctcagatttacccattgaatgttctctttgctccaattccgtgctctgtcgactcgacgacaattactgaatcgacgcaacagaaaagtgtcatcaaacaaaataatgaatgtgtgtaatttcacaaatttaagcactttccgaaattgccttgcgctgcactttggacgagaagggcggcgggaatggcactcaaatggtgccggacgtcggctcggtgattgcccatgcgttggcccaaccgtccgagtcgcggcacccgccgggccgtgaaaaggaaaagggctctttcggttcgctgggcgctttcagcgcgacagcgaacaatggaagcaaattcgccgactttgtggaaattgtttacgcggaagagaattggcagtacacagtgaaggtgccaaatcataattggcacatccaattaagtgtccaatttcgcctttaggtctatttcccggaacaatttgagcgttttcgttccctgactttctgtgatggtgaagaaaggtttgtttttgaattcagattgtgttttgttatgttatttttatgcttttagctttatcaattccatctccacttcgtcgccatggtttttctcattttttattataattttccattttatttttaatttaaaaggtatccccaaggaggaaaaagtggcgccgttttttcccgcactgacgacgaacgctttgtgctgaaaacgttaaaccgtttcgagttggacgcgttcaaacaaagcgcactcaaatacatcgattacatttcgatggcactgatggagggcaaactgaccgcgctttgcaaagtctaattagtggacatcaaattaattggcgtagggtttaatttagatttttggtgctttttccgtaaattgcactaacaaacagacgggccaatcggtgaagagtgatctgatcgtcatggaatttctgttctacaggaaggacatcaaacagatttgggacctcaaagggtcactaaggaatcggtcggtcgacgtcttttgaatggcatttgtttccaccgacttttcttcacattgccctctttttaggctcgcctccacaaaaaatgacaacaacggcgcctcttccgtgctattggacgagaactacattcagaacatgtggcggaaccaaatttatattacaactcattcgaagacggcactgaggcaagccaagcaaatgccaaaataatcgaactctaatacactaactgtgacgaccaatttcagtcaggcgatcatcaacgacagccacttcctggccgaccagggcatcatggactacagtctgttggccggaatatgtcggggggaggaggacgaagtgatcgtcggcatcgtggactatatggtgggcattttcatgccaatttcatttctaatttgtgcccatcatccgcatgtcagaggacattcactttcgacaaaaaagtcgaaagtgccatcaaaaatgccattcctctaaccaattcgtccactgtcatttcgcctgagcaatactgccgaagattttacgaagccatcgacgggtttattcccgacttttacttttctatctccctaaccgtaacacctttaattttcaggtatttcgcggttgcgcccgaccaatggaccagcgaatcagtttttacttagaac

SEQ ID NO: 75455 - DNA, 375 bp, Heterodera glycines
  Genomic contig location: Contig_ID=SeqID_11935; Location=583..957; Strand=-
  SCN-specific regions: Sequence locations=1-188,214-375
atggcggaacagttgttgttggggatggaggagggcaactcgtccagtggcattgtcctgttcagctcgtcgtcgccaccacccgacgaggacgacggaattgcggccgcgagtcccccgctgacgaatggaccgacggtggccaccgccgcgttggccaaggaggacgaggaactgttacggaaagtgccgccgccgcccccgctggccacattccgcgtcaccacctcaatgcgcgtgttgccgtgcacaatgcgccggaaatggtccaacattggccgttcacagcctttgcatttgaagtccgagttgaagcagcagctgaattattggttatggctgttccagtcccaatctgtgcatcgttttacttaa

SEQ ID NO: 75456 - DNA, 371 bp, Heterodera glycines
  Genomic contig location: Contig_ID=SeqID_11936; Location=106..476; Strand=+
  SCN-specific regions: Sequence locations=1-275,297-371
atgatggttaatggagttttctgtttttgtctggtaattgtcttacttcaattaggtaatcgttggtaatttaattatttaatcagggaaagggtttttaggtgttcgaaaccgtaaaataggtaccgaaataagtgccaaaaaagtggcaaaatatgtgctaaaatcgcgaaaaaccctaatttttgttgaaaaaacatgtcgaaaacccaaatgttcaaaatgactaacaatttttttttagtttttcctcgtcggcgcctaaatttctgtgcttttgactttgaaaatttttagtcacatttgctaacagagttttttttgttgtattttctttaggaatttttcgaggattgcgagaattatgaaaa

SEQ ID NO: 75457 - DNA, 1099 bp, Heterodera glycines
  Genomic contig location: Contig_ID=SeqID_11936; Location=747..1845; Strand=+
  SCN-specific regions: Sequence locations=1-70,223-293,393-532,554 -642,664-694,716-811,836-903,952-991,1013-1099
atggttgtagtgttgctgaaagttcaacttcgagtaatgagacggacaacgttagcgaagaaacaaagccaattaaaaatttttggtaaataattttaaaaaattaaattaattattattatataaaaaatgatttccaaataatttggctatttgaaaaatataaagttttaatcgggtaaaattttaaaaaatacaaaaaaaaataaatataaaaattttcatttaagaaactgaacatttgaatccaagaaagcgaaaaaaaccagatcttcaagatacggttaattacgtgaataaaattaaggtcaataaaatattatttttatttaaattaataaattaaattggcattttatttaatcaaaattgaattctataaattaaattgacatctttaggagcatttttgtgataataaaaatgtctacaaacagtttctggacatactgaaaaagcataaaaatgaccataaagaattactttggcaagttggccaactatttcatggccatggtgatctgatcgacgaatttattgactatttatctgtgatggacgggaatgatcaaattcgccaaaaaaccgatgattaaaatgatttttcaaatttttctgtttaaaaaaagaatatccattcgttttttatgttgttgtttatttgttgctttatatatggtaaatctttggttttagtcttgttattttcaaaatttttgtgatttatcccaaaaatccaaaaatgctcaaaatttccaaaaaaccacaacaagtctaattttgagaatttagccttaattgcctctacattttgatttgtttataaaaattaaaatctgatagataattttgagttttgtgaattttttaagaaagttaactggaaggccaaaaacaatactgaaaaattttaaaaatattaaattgattttgaaaattttaattatttttgtgggtttttccgaaaaactaaaatttccaaaatcataaaaagtctcattttgaaaatttagctttatttgcctctaaaaaccacaaaataaggctaaagcctcgcatttgagagttctgtttttgaatgtgtataaattgaaatgta

SEQ ID NO: 75458 - DNA, 431 bp, Heterodera glycines
  Genomic contig location: Contig_ID=SeqID_11937; Location=126..556; Strand=-
  SCN-specific regions: Sequence locations=1-41,64-116,145-283,308-409
atgctgatcactctttgcttggcaattttatttcaattcggtaaaattttatatttaatatttcttaattgagatgaattataatttattcttccaatatttttcatagttaattgtagaaaatttaaaaatccattaaaaattaagtgaaaccaatgccaccaatggaaaatgaagcgccggcggaagagtatgacggctcattgccgagttcaattgctatttccaaggtgtactgctggcttccggcggacaaacagccaaaaaagcttgtgaacatcaaagcggcgccgccaccgccgccggctaattatgacataaagcgggtggcatcagaggcagccgaaagcgtttatagttggctgccaaaggagcaacagcctaaactgatggacacaagtgcgtattaaaaattatggataaaaaataaa

SEQ ID NO: 75459 - DNA, 63 bp, Heterodera glycines
  Genomic contig location: Contig_ID=SeqID_11938; Location=1125..1187; Strand=-
  SCN-specific regions: Sequence locations=1-21,43-63
ttcatgaggatgtgaagcttgatttcaatgatgacattttcggccaacatgttagtggagaag

SEQ ID NO: 75460 - DNA, 965 bp, Heterodera glycines
  Genomic contig location: Contig_ID=SeqID_11939; Location=2168..3132; Strand=+
  SCN-specific regions: Sequence locations=1-134,201-326,365-394,416 -536,565-824,866-929,961-965
atggaaaatgcaaaagtgatgggccaactgaaattgaagccgattggcaaattcgaacgttcaagccaaagctgagctgcacgaaaaaggatgattcatgcgcatgccattggcaaataaaggcaatttatagcaaatatttaaaaaaaaattaaaaagaaaccaaataacaaataaaattaaataaaaaacattttatagccaaaggatggcaaaaaagtgatcaccaaactgaaatggctgaacgaaaaggtgctcagctgtggcaacccctgcggcacttatcgagtcgaaataaaataccgaaaagacaaaagagcgcggggtaatttaatttaaataatttttaaagtattttatttttgtaaaggtgcatttgtttgctgttctgcccaaattgaagaagatgaaacaaagaattggattgaagcggatgcacccgacgaggacattctcatttcggcttatatcaatccgtcgaattttgagcaattgacggaattgttcgaattgacttatgaaacgggtaagggcacataataattattattttatgttaatattgctttaaatttcttagatggtgctaaaattttgccagcgagcgattgtcccgacggtgtgaattggaaccgggagagatcacccggagtggtgtttttttgcgagcatcaagatacaggagagagtgtcgagtgctgcactaagggacacaaatgcccattaaaggccaactcggcatacggatgtcaactaattgtggtaaaaaccagtgggattttaaacagtgtgccgaaaataggtgccaacaggcgcagccgtaaaaaattgaaaatttggccatatttttaatagttagatttattaagctgaacggccaataccgcgaaatcagaggcgtaaatgaaagcagaatgttttgtaagttcttaaataattttaaaaattaattaattaattcttaa

SEQ ID NO: 75461 - DNA, 650 bp, Heterodera glycines
  misc_feature (33)..(33): n is a, c, g, or t
  misc_feature (79)..(79): n is a, c, g, or t
  misc_feature (133)..(133): n is a, c, g, or t
  Genomic contig location: Contig_ID=SeqID_11941; Location=1..650; Strand=+
  SCN-specific regions: Sequence locations=1-171,193-262,285-650
  Gene Ontology: Biological process=protein modification
ttcaaatacgttgagcagctgaaccggcaccancccaattgtcctacagggtgctgttcccgatggaacttcggttgcnccaatgtggtaagtttaattaatttgggtgaagcatcacatggagccacaaacnccatgcaaatcgtaaccgacagaattatagagacaaattgaggatttcttttttcatttactctgtctaaaaatttttttcaaaagtttatgtttctttaaaagattatttcttcttccttacctccaagggtttgatttgcttttaaaaattctcttcagaaagatgcttgcgcccacagtgaccacatttacgacttggtcgccgtcgtggtccattgtggttccacgccgaaccgaggccattacattacgctggtcaaatcccattcgtattggctcctcttcgacgatgacattgtcgatgtaagcgatggatttttaattaaaagctaacccccaataatttgctccttaaagaagttggacgagtcatccattgaggactttttcgggctttcggacagcaacgcacaaaagaactccgagtccgcgtacattttgttctaccagcaaagggcaaatactcgttgaatttgtcccacccatttcaatttgttgcgaatgggcattttgta

SEQ ID NO: 75462 - DNA, 1947 bp, Heterodera glycines; identical to SEQ ID NO: 11942
  Genomic contig location: Contig_ID=SeqID_11942; Location=1..1947; Strand=+
  SCN-specific regions: Sequence locations=1-5,27-51,73-93,117-153,175 -252,275-1005,1027-1059,1081-1329,1355-1422,1444-1509,1531-1567,1589 -1947
  Gene Ontology: Mol. function=betaine/GABA:sodium symporter activity; Cellular component=integral to membrane; Biological process=synaptic transmission

SEQ ID NO: 75463 - DNA, 1183 bp, Heterodera glycines
  misc_feature (17)..(17): n is a, c, g, or t
  misc_feature (29)..(29): n is a, c, g, or t
  misc_feature (44)..(44): n is a, c, g, or t
  misc_feature (79)..(79): n is a, c, g, or t
  misc_feature (1022)..(1022): n is a, c, g, or t
  misc_feature (1176)..(1176): n is a, c, g, or t
  Genomic contig location: Contig_ID=SeqID_11943; Location=1..1183; Strand=+
  SCN-specific regions: Sequence locations=1-140,162-1183
  Gene Ontology: Mol. function=betaine/GABA:sodium symporter activity; Cellular component=integral to membrane; Biological process=transport
ttaggtcagctcaattngcgatcagttcncccgaacgacttcgnaagtccagtgatgattcattttttacatttatttntctcattcctttccctcatttctttcttaaggaaaccatcgccatgtgctcacttttacactttttgccttctttctgttgggtcttccgctgtgcacagcggtagaaaacaatacaattacctacaatcattttgtttttgccgattaaaataaatttctttttttaggctggcatttattggatcgttttgtttgaacgcttttccgccacttggcctttgatcatcatcggcttcttcgaggtcatgactgtgtgttgggtgtacggtcagtcatttgcttttttcattaaataaccattgaacggttcatttttctcgtttcaggtgtcgacaactttcttgacaatgtcaaatggatggtgagaaacactccaaagagagaaattatatgccgttgggtgcaattttcgatactttcgaatttacggcatttcaaatttattttatacaattttccgattaacctaaaaaaaaatttgacggctaataatgccttaatttcttccctttattttagattggtttttaccctccgttttaccttttgtggaagatcctctggaagttcctttgtcccattttgcttttggtatctttgcccattaattaatttgttaatcgttcctttgcccctcccccttcccccgaaggcgcttctgtcgttggtttggctgcaacacaacccgttgcagtacaactccttcctcttcccccgctggtcccttctgctcggctgggccatctctctgtctcccgtcttcatcattctgttcatgttcttctaccaatttgcctctattagcggtcccttttcaaaagtaattggctacagtacaattttttgctatttacagtacctaatatagtaattgttcaatgcgaatgcccttccgttaagcgtctcagagagctgttgtgcccgacggatgactggggacncgcgttggcggtgcaccgtgccgaattgtaccccatgcaaattccggaggcacaaaagctgatggcaccgccgagcagctgcgtgtatcggaacgcaacggttcattcattgaccatgaaatggaattaccatcaatttgttgaccctcccccncttttta

SEQ ID NO: 75464 - DNA, 167 bp, Heterodera glycines
  Genomic contig location: Contig_ID=SeqID_11944; Location=115..281; Strand=-
  SCN-specific regions: Sequence locations=1-167
atgagcagcgaatgggcggaagtgtacaaaaattggtggacaaatggacaaaatggacaaaacgaatggatgattcaccacttttggcacaatgctaaagccaatttctgctgttgggcaattggggcggaccttcggctaacggacgaactgacggagggacggac

SEQ ID NO: 75465 - DNA, 303 bp, Heterodera glycines
  Genomic contig location: Contig_ID=SeqID_11945; Location=1882..2184; Strand=+
  SCN-specific regions: Sequence locations=1-67,89-179,207-303
atgatgaaaataataaaaagaaataataaaattggaattgagtgagaacaataataatatttacagaatgattttaaaaaaggtgtaatgagatgatcaaattaattcgtatgaattagtagtgaaagatgagcaatagatatttattaatagggataagaaaaagctaaataaaattaggcaaaaaatttattgcatttgcagggaggaaaccaaatttggaatcattcaagaagaaataaacaaaatataattcttaaatttgtgaagactggaaaaatttttgaattaaaaaaaaattga

SEQ ID NO: 75466 - DNA, 769 bp, Heterodera glycines
  Genomic contig location: Contig_ID=SeqID_1712; Location=534..1302; Strand=-
  SCN-specific regions: Sequence locations=1-182,204-273,297-304,346 -468,491-661,698-748
atgaaaataaattctcatcattttcgatatattaatgtaagtaattaataataatttgtttgtcatgctgttgcattcccttaatagtatttttcattatttttatgaaaattattttttgttatctaaattaactcgtcgacatcactgatgttgggcgtgttgaatacattagcaattacaaaatttgaaaaaataagttgtaataacaagaaagttgatattaggggatgtttttttcaattttctttctatatttttttatcctcattgaacaaaattgaaaatattaatcaatgattacttttttatatttattaaatttttaactttttttttattattccatgctttagcaaatagtatgaaaaagtatactcgggttcttgaaatagatattatataagcataagaccagatttaatattgtaatattgatatactgcatttaaaactgtatttactttgttattttaaatttatttaatttgtatcaccattgtgtgaaaccaactcgtctaattaaattcgcttttttaatagtttctcgaaacttactcaaccttttcgaatactgactgtttgttatttgttttatgttttcactttatatttcttttttaaattgatagtaaaattcagtttttaatagaattgtttgaattaataattataatattttcatataattattattccttgtatatattgtaaaaaccggtccaaagtaaaaattctgaaaattccattaaaatgacaaagaaataaa

SEQ ID NO: 75467 - DNA, 2470 bp, Heterodera glycines
  Genomic contig location: Contig_ID=SeqID_1713; Location=3914..6383; Strand=+
  SCN-specific regions: Sequence locations=1-349,372-622,661-739,763 -990,1028-1281,1305-1390,1412-1470,1493-2275,2301-2470
atgactccttatagaatagtggcatacgacttggaatgcacggtaattaaagattttttttgcaacaaattacggtttcttatttagacgaacactgttttggatgaaaaatcattgaaaaaagagactattcataagcccgattttattagcgcccgatttacttgttcaatatgtttgggagaaattaaaaattgtgaaatttgcggtgatggcccacggcatttaaaagggtgtagtaaggatggagttgacccgttaaactgttttgttaaatggattattagttttgaaaaatatgaaacgtatgcgtatgcacattttagcggtaaggattaacaaataatttaaaaaagctaaaattttatttagggcgttatgattcacattttgttttgagggaacttgctaatttgggatataaacagccggaattaacgatagcggatttaaaaatttacgaattaaaatttaaaagaggggaaaaattcccgaaaattcattttcgggacagttggcttttaatgcagaataaattagctcatttaccaaaaacatttggattggattgtgaatcaaaaatgtactttccccaccaatttaacaaagaagaaaattacggtaaaaaaaatacaaaaataatagaaatataaatttttaggcataattttgagtaccctccctccttttgaggattatttccccgatgaaatgagcgaagaagaatatgagaaatttaaaaaatggtattatgcaaattatcataatgggtttatattaggtaaaaaaactttttgaagaccataaaattggaaaattttttagaagaaaaattggatgaatattgctcaaacgatacggatattttaatgaacgctctattaaaactgagaaaaatatttattgaaataacaaaagatgaggaaacaccaaatgggatagatgtaatgagattatcgacaacgattgcatcttcgtgcatgaagtaagttttaaaaaaatgaaaataaataagtaattttttttagcatttttcgtgccaaatttttaaaaaatagtgagaccttacccatcattcctgagagtggctttgaaccaaaagacagccagagcaatattgcgattaaatattttgaatggattatgcatcgggacggagttaaagggaggcacgccgcaaatgggggagaaatatcgcttttgggcgacaaaaaattaaaaatcgattgcataattggggcgcaaaagagaataattgaatttcaggtaataatggaaatgaaataaatattaaaaaaatttaagggttgcgcttttcatgggtgccaaaattgttataaggggtatatgattcaagcgaatggatttacggcagagcaaaattatgaaagaacacaaaataaaatggagagattaagaagtgtagggaaaaagatggggtatactgtagaagaagtttgggtaagtgttattaaaaatagaaataaaataaccaaatttttaggaatgtgacgttaggaaaatgttaaatagaaagagtgaattttatgatgagcaaatgtcaaaattttttaataatttaccggaaataggaccaattatcccgaggaatggctttgcgggaggccgtacaggtagatttaaacattttttctggtttaatgattaattttaggcccattatgtctttttgctaaggcctctgaaaatattgaaatttcaatttatgatattgttagtctgtacccttgggtgaattattccaccccctatccggttggtatcccaaaaataatcattccgaagcaatatatagtaaaatggtaatttttcggtaaaaaaatacaatttaaatggaattttaggacaacccccgacgatatcccttacgatggacttttaaaagtacgagtcattccccccaaaaatcaattgttgcctgtgttaccgttccatactgtaggttaagaaactttttgattaaatggtgatcttttttaggatgatttattattatttacaaattgtacttcgtgtgccaaaaaatcaaaatgtgattttgtttttgccaaaaattctaaaaaatgtagacatagtgccgaacagcgggcactaaccggggaattttgttctttagaattaagaaaaggtgaaataaataattaaaatgaatcatgctcgttttttgcagcattagaatatggggcagtcatcgatcggttttatcgcggttaccattacgaaaattttgatggaaatttgtttaagaattatgtgagaaaatttttaaaattgaaggttgaggctaccgggtggcctcaggatgttaaaactgaagaagaaaaaatagaatttgtgaaaacatatagagaaacatatgaaattgaattggacccaaaaaaatatgaattttaatcctggattaagacatattgccaaattagcattaaactcattatggtaagaaaaa

SEQ ID NO: 75468 - DNA, 236 bp, Heterodera glycines
  Genomic contig location: Contig_ID=SeqID_1714; Location=411..646; Strand=+
  SCN-specific regions: Sequence locations=1-70,173-185,207-207,229-236
aaatatcgcttcaaggacgttatgttttggatgaggaggaagcaattggcctgggaaagagaatgagggtaattaaataagaaaataaaaaatcatgagagttaaaataaaaagtaatataacaaattaaataaatctagaaaataaaattcattagaaaacagaataaaatggaccaaaccgaatcaaatacttaaaggtctacaaggtaggaaattattgcaaattgttaatta

SEQ ID NO: 75469 - DNA, 485 bp, Heterodera glycines
  Genomic contig location: Contig_ID=SeqID_1715; Location=467..951; Strand=+
  SCN-specific regions: Sequence locations=1-132,154-250,272-411,433-485
atgtcaaaagaatatgaggattcagaaatattagaagttgtctgtgcgggtaatgaatgaaaaagagataaaaataaatgagaattttagggcctaaacaatacgctttgaaattacaaaaagaaaatggagaaatttggtacaaaacaaaaattagagggatgacgcaaaataaaaacaacaaaattgattatgaagagtttaaggacatggttttgaattatgaggaggaaaagaaaatacagtttaaacatccaaataaattcgggtatgttttcaaatacttagctaaaattatgaattttatttagacctacgagggaaagttatgtgattagcagaaatattacaaaggattatagaccgattcaaaagaaggggttagtttgacagttttattaacgaaataatatttcaatttaggattattttgaacgatgaaaatttaagtgttttgccttttggttgttggtgattttttttga

SEQ ID NO: 75470 - DNA, 622 bp, Heterodera glycines
  Genomic contig location: Contig_ID=SeqID_1715; Location=1058..1679; Strand=+
  SCN-specific regions: Sequence locations=1-125,156-236,270-281,303 -531,553-622
atggataatcaaaataagccaagaggaaggcctccgaaaaaagttgagaaaaaggaaactcctcaaaacctggagaaaaaagaaattcatcaaaaagcaaaaattaaaattctaaggcccaaaatacagcttaaaggaagaaaaatagaattggacacagaaaatggtacaaattccgttccaactaaaataaaacttcctcctatttatgtaagattgtaatttgcttgtttaataattaaaaactttagaaatgatgaaaaatattctgatcagtaaagttttaaaaaatatatttaaaacaaaacttgaaaagtatagtcatattttatcatgctcaaaatacatacagatctttgtagttgtaatagtgagagaccaatagatgactaaaaaatgagagatcgggattaacatatgctcaaacagtgaaaaagttaggtgaaaaatcgttgatctgtgtgtacctatgggggcatgtgatcgagtgactacgaacaagtgcatgatcaaaagtgattagaaatgtaaagagagagagagagagagagattgattagagttcgagggaggatgttcgaaataatgattagagtaagtatgtgagtgttttggtatgaca

SEQ ID NO: 75471 - DNA, 192 bp, Heterodera glycines
  Genomic contig location: Contig_ID=SeqID_11947; Location=336..527; Strand=-
  SCN-specific regions: Sequence locations=1-192
gtaaatattgatcataggccccaaactcaaaaatgcttaaaaacggtcagaatcgatgtaaaaaggtttgaaatgggttggaaaaatagaattaggggcgcgcttgcccttttccaggatgaaaagtgccgaaaatggagtgccaaactcagctgggactcaagtgaccgcactataaaaagcacacaaaag

SEQ ID NO: 75472 - DNA, 571 bp, Heterodera glycines
  Genomic contig location: Contig_ID=SeqID_11948; Location=38..608; Strand=+
  SCN-specific regions: Sequence locations=1-120,142-187,211-267,290 -321,343-356,378-467,489-571
  Gene Ontology: Mol. function=ATP binding
atggtgttagccgacttgggcaggcgaattcggaatgccattggcaaacttggccaagcgacggtcatcaatgaggacgaactcaacgctatgcttaaggttggatggactggccaaagtttatgagatctgcacattccaggccttgggcttgctaaccgctggaaatcaaaattaatttcatccaattttagtggattttttgaaaatttacccctttggggttagccgagtcaaaaaatttctcttttaatcgcttcattctcctgttttttctttcaaatcaacaaaatttgtataaatttagcgtaaattctttagtttttcataaaaaacactccgttccatggacagggagacaatataaaaaatttaaacgtttttttttgttgaaaactgaaagtatattacctcctttgttcaggaagtctgttccgcgctaattgagtcggatgtaaatgttcggttcgtttttcaaaatttaaattgcataattttactatgcccatgcaaaattatgattcgaacatttttgcctttaccaaaaaaagggaaaaaatttgacagataa

SEQ ID NO: 75473 - DNA, 1704 bp, Heterodera glycines
  misc_feature (5)..(5): n is a, c, g, or t
  Genomic contig location: Contig_ID=SeqID_11949; Location=41..1744; Strand=+
  SCN-specific regions: Sequence locations=1-89,111-202,224-320,342 -346,369-378,402-771,824-840,867-943,965-981,1003-1067,1089-1091,1116- 1328,1351-1424,1451-1704
  Gene Ontology: Mol. function=protein binding
atgcnttgtgccaacttcccaatttccaaattgcacaatgtgtttttggcatttaaccaagcgcgccattttgaagaaaaggtaaaaaattattgtcatcagcagagatgagattttttggaaataaaaaattgccaaagggtagccaaatacagaggaaaaacctcatcccgatgactctttaggttagagccctaaattgtatgttttcatttttcatggtttaaaatgattttgcactgtctcaaaatttaatggtttaaatttttgagtgcttaaattcatttttaaaaaattttcatccatattttgggatttttaccatattataaaccattttcgggtattttttatatataaacatttactctaatgagcatttacatataattaattataaatatgtgcatttccgttaattcgtaggaatttgctctccgttgcttggatcacatcgatcagaatgcgtactcattgctcaaatccgatgcttttcttaaaattggcacaaattacctctgtgaaattctggcccgtgatcagcttcaggctgaagaaatcacaatttggaatgcggtaaattaaacatttggtgattttggcactatttcgaatttttgccaaactataggctcttcgctgggcggacgaacaatgccgtcaaatgggcaaggagtgttcggcggagaatcgtcgtgccatgcttgggccggcacttttccaaattcgttttccgttgatccaattggaagaatttccaagaaacattggtaattaattaaaatttatcatcacatataaatattttcattttatattaattggaacagacaggtcggcactgcgttttattaaagaaaaattctttggcatttttcacaatgtctttttacaaacccaaaactgaccaatcctttcaaaagttttccggctgcaccgtttgatctcaaaaatctcataatttaaacaatttatcgcggctaatcactgatcgatatcattgtagcattaatgccatttcaatttattccccattaatcccctccaaatttaattctttttttcccttcaaattttaaaatttaattgctccttctgctgcagctgtttctggtgtgttgacaagtgacgagttgctcggtgtgctgcttcaccttgcccttccttcagttgcctgttcgcagcctccgctttacccactgagttttccggccaaacagcgaaattataatggtaaattcagtagtctgaaaaagccaagttccgacaggcgccaggccaaaaagtttggacctgaaaaagggcttttgtcccgttaagctcatcccggcccattttccaagtccgggtcctgggctttactgttcatttcaaaatttgtctttatttttaaatgagaaatgcattgaaaacttttctatcgcggaaattctttgtttttaattccataattactttggatttattaagaataagcaaaaacgcaatcgctttaagtgagcggaacagttactctgaaaatcgacaaattatctgaatttggaaaaacgactgacaacaccgaacggcacagtaatgccgtgatcatcagggaaatcccgtggaaaatttcggcatcatttgacacaagcgatatttcctgtccccatcatcgtgtgagaagctttgtagacttttggctccattgtgatgtggaagagaaca

SEQ ID NO: 75474 - DNA, 2119 bp, Heterodera glycines
  Genomic contig location: Contig_ID=SeqID_11952; Location=909..3027; Strand=+
  SCN-specific regions: Sequence locations=1-550,572-859,881-897,1062 -1353,1375-1464,1510-1520,1546-2119
atgccaaaccaacctgtgccatttcctttctcaaagggtcgcttcgtcaacgatgtggcagagttgcatcgggtgcaactggcgattagtcagctggaagcggaacaacggcatgaccacctgaagcacttgcaacagcaaatgtctctgggagggagcgtaagggggggggggggaagtgatcggaaaaaaccgatcggaaaaaagtatgggaaatgaattccgaccaatggccgttcacctgaattcggtaccaatgactaacaaaatttaggatagaaatgcagcgccgggccggtcatttgtacgaacagttgaccgaatgccgtgccaatttagtaagtgccaaatatacccactcaaaccaattttccatttccttccaaatttacaggtccatcgcctcaacgacggcgtcaaactaatcgcaattatgcaaacgcatttgatctctgagcgactgttggagtggaaaaacagccaaaagttggcacaaattggcgtttcttttgagcagcgcgaacaaattttggacgaaattcaaagcgagtgagtcacaagaacagacaaagaattctttggtcaaaaatgccaatgtcttcgcattgtccaaggttcgaagtgctggcggagaacaattggactttgcgcgcgtgcgcatgttggcaattggacttgttgaaaaggtcgccacggctgaacgatacggttgcccacggcttcaaaacccacttattattatgccaattccattcgcagactgtgcaaacgcacatttccaatctgaactacattttggaaacactcaccaaattgctggtccgttttttactacatttttatttttatttatttgttggcaatggcatttttctctctcatctgctttcccctccactctctctctcctctctttctcctctccttctcctctccatccccccctctctcttctctctccttctcttctctccttatcttcctctctctctctctctgccccttttttctctttcctctgtcccattctctctctgcctctctactctctcttatctctccgttctatttccctttgtccttcccttaccattccctcctcctccatattcagtgtatgttggtcactcaatcttttgtggtcgctgttcagcctgatccggtgctgaaaacgcagcataaatttgttgcggaggtttgggggggggggggagagaaaccgaccaaagcttctgctgttgcatctgtctgttaattcttttgctaaggtgcggcttctgatcggagaaagacttggcatcaaacaacaattggtaagttcggtaaacagcggaagaaaggagaaagggagggcacggcacagacaacagtgaaatgccaacgtaaagcattttctgattggcaccgaatgggtccttttttgacaattgcttattagtcactcctttatgaaatgattattagccttctcatcctcctcttcctccttttgcttttctttcctttttcagatcaacacaaatgtcactgtgaaggtcaaccgaatggaaagtgatcggaacagttcattaattcgaaactgatcagatcattgccgaagaggaggccaaattgctgtccacgggccaactgaatgagaaggacatcaaaacggtcggctcaatttccaatgactttgagaagctaatgttggacgagaggggacacatggcctccaaattcaacaattcggtgcccaattcaatcatttgaatgtcttccaaattcgatttgtcagaagttgtctcgaattgcgcatcggaaacccccggccaaaggctctttacagtccaaccaatccgcggcagacggccaccgaccagaaatacgcgctgttgtttcacattacgccctttcagctgggcaacttgggcaagttcgacgtgtggacgctgtccttgcccataatggtcagaatcagcaaatggaaattgttcattttctccatttctggtcaccgttcacgggtcccaggactgcgatgctcaggcggtcatcctttggcaggtgagtcatccacccgggcattttgccaaattaaaacaatttgtttgaatttcagcgggcgttttcttccgtt

SEQ ID NO: 75475 - DNA, 264 bp, Heterodera glycines
  Genomic contig location: Contig_ID=SeqID_11953; Location=758..1021; Strand=-
  SCN-specific regions: Sequence locations=1-264
atggctgcatttttgaatggcaatgctcacagcagcattgaatgcaatggtgtcgtccatgacaaaaatggcattgatcagaatggcaccaaattggctgatcgcttacaacattcggtgcaaattgggaccaaaaaagcgccggtgtcaaaggggagcatcaatgtcaacaaatatgtgctggaagtgatcagtgacactgatcagctgcacacattggaacaatatgccattgactacgctcattcaattggtcagtgtgct

SEQ ID NO: 75476 - DNA, 1178 bp, Heterodera glycines
  Genomic contig location: Contig_ID=SeqID_11954; Location=487..1664; Strand=-
  SCN-specific regions: Sequence locations=1-189,211-211,257-264,302 -433,457-636,667-1178
atgacggaatatgaaaaaatgttagatcattctttgtccaacctttcatttgtgctcacagcggaggactcacattttttcccacaaaattggtatgttttggtgaatattttcgggctctctgacttggaattacacgttcaacgccgatttgagtatttagaatgttctaatagacaaaaggtgaacctataattttgtgtcacattgtaatttaaagggcaaaaaattttttaaacagaaatgaaataataataatagcagaaattaatttaatttaacgtttaaattaataaattaacgaattttctttctgaaaatcatatgcaaaaatctattgattttcagataattagcgaattatcatatatttttcgaggaaacttacaaagttatatttgggaagggtgctggcggggccgggatataggtcaaattttgaaaattttaggggaatttcatccctcattcttaggcgtgtaattcgcgtttcgcgccaaaatgcaaaacgcgaaagcgaaagtactgaaaaaagcgcgaaagcgaaagccccatccctgatacgtaccccttgtactccccgtgtccatgggaatgtgttccttctgttgaggtcaaaaagtctcgaaaatcccgaaaaataatttatattcatttttatttttaggctatgcccgttccagagaatcaatttcacgttaattaaatataaaagtttggcaaaaactgaggatgaacaaaatttcacagaccaattcgtggcatttttggccaatattccaagcctaagccatgaaacgattgaattcgtccgagcccaagcgggtttgaagcttggccatcacacttcgggatcggccgcgtacaaatttgtgaagaagcgcatttatgaaagcccatttttgatggaatttcttgtgcggatgttttactgggacttcaaagtgttgggctttccattgccaaatctttttgaaatgcgttatggaaatgattagacccaatgtaattgaatcaagttcgatcaattttctgtaaatttgtgctctttctatctttactttttgttttcgcaaacttttccaatatttggtatttttgaaaaattcttgcgtttcttgattatttcagaaaaaaacaagtaaaaatcgagaacatttggatttttttcaaataaa

SEQ ID NO: 75477 - DNA, 1098 bp, Heterodera glycines
  Genomic contig location: Contig_ID=SeqID_11956; Location=1008..2105; Strand=-
  SCN-specific regions: Sequence locations=1-621,647-1098
atgaccggcgctgctgcaatgaccggcattgtcatctgcttaagcctactccatctgattttcgtcagcactttgatcagtgacgagaaaatacgttccgaactgtactgggtggtgttaatgcctccggtgggcaattgactatttaattaccctaattactatcccctcccccctctcttcaggtgatcgtcgtttgtggcttcaccggcatggttctgccgagggcggcacttttcctgtacgcaattgcgctcgtctattacatgatctgcatttttgtgctcgtctgttttatgaacacggtcagtttaactcattaatgctaattggttttcaatttggtgccaatttcagctgcacggttctcgcaaatcgatgtgcgaaaaactgatggccaaaggcgagcgaatttcgatcagaatttatccgtttgcttgttggttgatccgcttcgaggattttctgccgacagagtgcgttttatatggacattggaatggattactgatcagagaatagaccaaatattttgaaagtgatcggaacgttcagagaatgtttgaaattgatcggaaaagtgctcccaacattctctgatctaagaagccctcggaaatgaaaaaataattttttttttttttttgcaaattcaggcaaaatttccaccgctttgaagtgctcgtgttccaatcgccgattgtacgaattatgctcgaaattttgaacatcaccgtgtttatggtgaacatcaactatttcacaattacattttttaaatgtttcctaatttggcattctgtcactcaggaactgagcagtcgtaaacacatgtacttccaaatatccaattttgctggcatgatttccatgttcattggctcctacagctcttacgtaattgtgccgcttggtgcttcgatgttgcacgaatatcggcacgtcacatttttcaacaattttatttcaaaaaacgaaatttttcagttttttgctgctcttccgtatcgtcgacttctgccaactcttttggtccgtgcaaaagttcgtcgccgacatcttcggcattctcgacatggtgccgagcatatcgcatga

SEQ ID NO: 75478 - DNA, 1741 bp, Heterodera glycines
  Genomic contig location: Contig_ID=SeqID_11958; Location=562..2302; Strand=-
  SCN-specific regions: Sequence locations=1-107,129-437,459-1035,1060 -1211,1233-1255,1277-1444,1466-1602,1624-1741
  Gene Ontology: Mol. function=transmembrane receptor protein tyrosine phosphatase activity; Cellular component=integral to plasma membrane; Biological process=neurogenesis
atgagtaatgccaatctgtacggtctgaatgggcagctcgtgcagcaccatgcgacgacgggcggcacggaacgaatgtcagcgcatttggccacactaatggcaccaattccattggccgaatttgccacacatatcgaccgacagaagttgaacagcaaccagggctttatccaagtagcaagggaaaagcaaggccaataaagcggttttggatttaaggagtttgaaagcattgacacggggcaacatttcacttgggagaactcggccaccgaagtgaacaaacacaagaatcggtgcactattttatcagtgaatattaatcaccaaaaatgccgactttcaattagttatgccaacgttgtcgcctacgaccattcgcgcgttgtgttgccgccggaggacgacgcggaggaggaattgccgggcacggattacatcaatgccaattacattgacgggtacggcacaccctcacaatttaaaattaaatatgttaataaaacatatagttacgaccggccaaaagcgtacatcgccacccaaggcccactgccggaaacatttgcggacttttggcggatggtttgggaggagcggtcgatggtcattgttatgctcacgcggctggaggagcggtgccggaccaaatgcgaccaatattggccagggaaaggcacttccatttacggaagttacaaagtaaaattgggaagggggtaaaaaggcaaaattggccaattactgaacaaaaagttggaataaatctgactgacatggtcgcattactattagtggttgaacatgttcccgataattagcttactgattaacaaaaagcgttttctaaattggacattttccctggtttaaatgtgccattgcccgccaattacttttacaattgtttgccaaaaaggtgaccctcgtggacaccaccgagttggcccattactgcttgcgaaccatgaggctggagaacacgcgacggcaccacgacgccccgcgaaacattcagcactgtcaattcacggcttggccggaccacggagtgcccactcatccgacgccctttctgatgttcctcaagcgggtcaaagctctgaatcccatcgacgccggtcccatcatcacacattgcaggtgaatgccgaagggaacgggcgaagggaggggacgaaatgccaaaagccgtttttgacacgcatttaaaagttaaattaattttagtgccctaatggcaaatgatagattttgtttctgaatttctttggcatttcgagaattgccatattttcccttatttcttaaatgaatctacataatttgacgtcaaaatagtttcattgctaattttggcactttcagcgcgggcattggtcgtacgggtgcatttattgtcatcgactgtatgttggaacggttacggtacgaaaacacggtggacatttacggctgtgtgcgttccattcgggcacaacgctcgtacatggtgcagacggacgaccaatacattttcatccatgacgcggtgttggacgcggcacagtccggctctacggagataccaagctcaaaattgtatgttttcaccaaatatttctaaaaatttatttggcatggaaaactttccaggcaccaacacgtgcagacgctgtcccggccccagcacatgcaggaatactcaggcatcgacatcgaattcaatgtaagtgccgaaatgcaaaaaccaaattaa

SEQ ID NO: 75479 - DNA, 2391 bp, Heterodera glycines
  Genomic contig location: Contig_ID=SeqID_11959; Location=39..2429; Strand=-
  SCN-specific regions: Sequence locations=1-17,39-270,343-1128,1150 -1230,1254-1437,1459-1532,1554-2014,2055-2183,2211-2391
atggtcggattgtttgggaacaatttaaatggcagaagcaacggaagcaattcgcagcagaaaagtgtgctgaccgcagtgattgaatcgctgctaaaaatggaaatggacaatgccaaagaaaagaatcaaaattgtaatgaaaacgcaaaaaaaagggggggggggggaatggtgggacatttggcgattttggcgatgattggccatcgccagcagcagagatttttactcaaactatttgtcctgttatttgagtgaacttccattttaataaacaaatttatattaattattaaattaattaatttttttggtccataattaattaatgagtcaatttcagctgcgattggaccgcccaggaatatccgagtgcagaccatttctaacagttccgttgtggtccaatgggacttcgacgactccgacagcgatgttggtggagcaccggacggattcatggtgaagtacatgcaggagccaagtgcagttcgggaacaccaaatggacaagtggcggactcagccggtgatggacccgaaggcgcggcatttggaagttcacaggtgggggataagctaattagctagctaattagtgatcgggaaatgaccgggatagttagttgatcaaatacaaacagcagcagacactccaactaacaaaaagatgaaacttatgttcaagggggtcgatagtcaaaatcggacccaccccatgtgaaatgggcaatttcaaggagaaaattttgtaatttaacgaattatctgatttaatcaccgataagttgatcattaatataaattggccagcaaattgctaataactaggaaatagatttaaatttgttgacagatatattacgtttttgatagttttaagtcaaattttgagttcacaaagtgatacaaaactgatgacaaattgtttaaaaaagttggcaacttcgcttactgacttgatcgaattctatgaaaggtcgactcccccctcccccgcaaatatgccaaaatgggagaccctttcgaagtgaggaggagggctcgatttaaagcataataatccattccttgctaataactatgatcaaaatttctatctccgtgatttaacaaaagtgtttggtttttatcattaccttttttcaaccaaattccttctttttcagattgctttcacataaatcatacgctttttgcgtgttggccatgaaacatcgagtatctttggccattttttctaattttattaattgtccctcccttttagcgtcttggcccctgctccgaccccccggtgaccattcagggcccactgacgccaacttttattgtccaaaatcttcgattggattataaaacgagtcaatccgtgaaaatccgctgggattacgacggaccaatgccaatcggcttcttcatcaaacagatgggccagaagagctatttggaccaggaattgatcgagaaatccatggtgtcgcctcaatacgaaaaaagggtcaatggcacggagagggaacttttgtcagtgaaaattcatttggtaattaatattctgctgatcatttcggttcagtctgtccaaccttcgtccccatatgaattacactttccaagtgggcgttttttcgcctggcgacggccgattgtattggccgcgcgaattgtccgtccaaacggaccctcgtggcccaccctttgtggagccacccgaatttctccaatcggacgggccaaacacggcacaattcaggctgagctgtgccaggtgccaaccccaagacaagattcatcaaaaagtaaatcctttagcgaggaatacggtccgatcagtcactattggctgatcgttgtgccaggcaacttttccaaggaggacgtaacacatgccgaccgcgcacaacttcaatttgcgacgcgcaatttcaaaaatattaaaatggccttcctccagcagattacggtacgaagtgccaaaagcgacagtgaaaaggcggaggaagaaaaagggaacagaaaatatggggaaaacaagcaaaacaatgaaacgatggtgcaaaatcatcacaaacgaagacgaaggtcagcacaacttggaacaatatcagcagacaatcagcataggcaccatcgaattcatcacaacacaaagtgatttcattatccattggaaagcgatttctttaaagcattattatcaaaaaagcattcattcagagtgccgtcatccgattatcggcccgccggtgacacgcgtggccgaaggcacgtgccggtggacggcgtttacatcgccgctcaaattccgtccaacgaaatgcaacggctttaccgcgatgaactgaccttcactctcggggacggacttgtaaattcgcgaaattag

SEQ ID NO: 75480 - DNA, 631 bp, Heterodera glycines
  Genomic contig location: Contig_ID=SeqID_11961; Location=1020..1650; Strand=-
  SCN-specific regions: Sequence locations=1-220,258-529,551-631
atgtattatatgcgaagtacttggcaatgtgacaaaatagcagatggatttaaagaatataagcggacagaatgccaaaaatatcgtaaatatttggacattttatatgaatatttgctcagagaatacgtaggaattccaacagttaagccaaaatttgtatttaaagaacgaattgaaattgaaggaccaataattcatgcggtgcattgtctcgtcaaaatttcgcaattttattttaaaccaaattatagtaaacatattgaatacaaattaaagaaacttttcatttattatttcgaacaaaaattgttgaatgagaagagcttaaattatgaaataaaattggaaaatgaaccaaaagtgtcaattaatgaaatgatttttcaattggcaattgaagcagcgaataattataaaacaaatgaaagtgctgaaggaataatccaacaaaaacttgaacaaaatttggaggaaaagtttaaaaaagcggaagaaagggcgaaaaaagactatccacgggaagccaatgaaataaaatgatgacaaacattggataattaattatcaattcaaaattcgatgataaaaagacatgggtgagaattaaattcaatgaaaattaaataaa

SEQ ID NO: 75481 - DNA, 72 bp, Heterodera glycines
  Genomic contig location: Contig_ID=SeqID_11961; Location=2237..2308; Strand=+
  SCN-specific regions: Sequence locations=1-72
atgtgccgagccagacaaaatccgattccgattaaatcgccgattccgattatggccaaaaatccgatacgg

SEQ ID NO: 75482 - DNA, 685 bp, Heterodera glycines
  Genomic contig location: Contig_ID=SeqID_11963; Location=1538..2222; Strand=+
  SCN-specific regions: Sequence locations=1-161,206-251,273-297,342 -387,432-481,504-525,570-615,660-685
atggtggctttcaccattattcctcatctgctgctcttcactgtcttcatgtccatcatcctggtgatcctctctcaatgttgcggctgtacgccttcaaagaagaagcaaactgcgacgtcaacgaagaagaagaccacgacgactacatccgaagcgatgaaaggaaagaaggaagagaagccggccaaaacatccgagacggacaaggcagcgcagaagaagccaactgtgacgtcaacaaaggcatcggaggaagaggcagaagaagaccacgacgactacatccgatccgacgaaaggaaagaaggaagagaagccggccaaaacatccgagacggacaaggcagcgcagaagaagaccacgacgactacatccgatccgacgaaaggaaagaaggaagagaagccggccaaaacatccgagacggacaaggcagcgcagaagaagccaactgtgacgtcaacaaaggcgtcggaggaagaggcgcagaagaagaccacgacgactacatccgatccgacgaaaggaaagaaggaagagaagccggccaaaacatccgagacggacaaggcagcgcagaagaagaccacgacgactacatccgatccgacgaaaggaaagaaggaagagaagccggccaaaacatccgagacggacaaggcagcgcagaagaagccaact

SEQ ID NO: 75483 - DNA, 64 bp, Heterodera glycines; identical to SEQ ID NO: 51065
  Genomic contig location: Contig_ID=SeqID_11963; Location=311..374; Strand=+
  SCN-specific regions: Sequence locations=55-64

SEQ ID NO: 75484 - DNA, 993 bp, Heterodera glycines
  Genomic contig location: Contig_ID=SeqID_11965; Location=1663..2655; Strand=+
  SCN-specific regions: Sequence locations=1-827,849-993
atggatatcaatcttgaaaatgccccaattccggcaacctcgcacattgtgtctgaaaaaattgacttcagcactgtgccaattaatttcgccacatcgcgaaattttgcctgtaaaatttggagatgggcagcaattggcctttatgagcgtgatggcgaaacagcacttggcccacgctctggcccaagattcattgagacctgttggaacagaccaaatgaatggctaaatgacagctttattgttgcctatttagcttacattgcaagcatttcacaacgaaaaacagtagttgtggattctttggcatcgagaactgatgtttctcgattttccaacgtgaagaattacactttcggctatgatccgaatgctgttcctgaagttgtgcttatgccgcttcacttcccaaatcattggactctcatcgtctacgatgttgcacatggtgcatacttccttgactcgctgcatatgagcagcttgagtgatgagagaatggcactcatccagtcaataattgctgagatagtgcccgggaatgcgtcattcgctgttgaatacgtgcagcaattgacaaagcaaaatgatggtaacagctgcgggtacttcgtgtgcctgtatgctgaatcctggctgatgaacaaccgtacatttgttctgccggatttgaacatcaattatgagaagaagcgcattttatggcacataaatgagctttatggctcagatattgtgccgtttcatccaagggaaggtgtttcaacatctttcgctgttgtgtctcatcacaatggggatgtagcgcaaacttcctccaaggtcataatgccaatggaagtggatgattcaccagtgcttccttcctcggaagatactgctgttcttgcgcaagcaccagtgatcggcgaaaatcaagctgacacacccacggtgttgttgcggacacaattgtccagcaagaaccaatcgcgcaggctgatgatgtaa

SEQ ID NO: 75485 - DNA, 1218 bp, Heterodera glycines
  Genomic contig location: Contig_ID=SeqID_1716; Location=6168..7385; Strand=-
  SCN-specific regions: Sequence locations=1-747,779-850,874-1127,1157 -1182,1205-1218
atgaagcacacaacccgcatgctgctagtgccggaggaactgtaccgctccttgttggccaggagctcggctcctgttgccgacgcatcctctgcgaggggcggcttaccgcagcacaccacgccaattgagcacacggcaaagcgcatggcgcgtgctgcacgcagcaacgtcacccggagcacggacggcgtatcgccgtcatcggggcaacaacctaaacaccttctgaacgatgacgaacggttgatccattaccaacaggagttcaaacggttcaaaaaatttctggaggatgagcaggagcgtccagcaccagttcgtctcacccaactgcccaccgacgaagcctctaagggcctgctgcgcgaggcactttccgaggtggcgcgaacaattcaacaacaacctcaaccaaaacagccggcgctgcaccaacaacaacagcagtcgtcgcagtctgattcgtcaacaatgaggcagcctccacgtcgcagacaacgaccagccaaaaggacacaccgtacgacatcagcctctacggatggcgccgaagctagccgcttcccgtcatcgtcatctgccgtctcattgttgacacgcactgataatggaggaaaaggaggagctgagacgactgagcgtgaagacagctccaacgacgaccgaccccaaaatgttgcggcagttgaccccgcaaggaaaggacagcgggaagaagcggacgtgcaactgcatccatcaacatcgacagcaccagcagcagcagcagtcttacgtgacactgagcagaggaaacgacaagccattgactatgcgttacgcaacgcgggcacgctgggcatcggagatggacagcaggtgtaccggctgatgcaaggcgcgtaccgtccgatcaagaacagcgatttggatgctttactcacttttcattttgctgagcccaaaccggagaaggcaccgcctgggtacaaaacatttattggcaatgctcggcaagacccgcgcatggtacggatcctgttcggcaacagcggcgcggaaagtgggaaaaagaagaagatgggtggtggcggctgctgctccaccgctgctaccctcttgcatgcatttaaaaagaatggaaagccaactgctgctgttgctgctgattacgcgaaacggtccaacagcactaccaacaacaaaacttttttgtttaaacccatgttatggtga

SEQ ID NO: 75486 - DNA, 1886 bp, Heterodera glycines
  Genomic contig location: Contig_ID=SeqID_1716; Location=9142..11027; Strand=+
  SCN-specific regions: Sequence locations=1-35,77-284,314-358,390 -925,964-1223,1280-1591,1629-1749,1771-1886
atgacgaagctgagcagcgatagtaatgatgaacatggcggtggcggtggtggtgatgatggacacgcgttgccgaccgaggatgacggggtgggcggtgctcatctcccgcccctcttgttcatcgatgaggaggaggaggaggagagcgccgagtcgcgcactggggatgacgtgggccgagacggtgacggtcaaatttacactgaaaaagtgacccaggaaggggaggaggaatcagacgacggcaacgctgacatggattctgtcagcaatgacacgtacagaagcagcagcaacagcagtagcagcaccatgagttcgtcgttgttcttgctgcatgactgtcatatgcgccaccactaccaccacgacaacaacaactgcaacagcccgccacgaaaacaagcggcgacagagctgctcaagcttccgctcatcgactatttgtgtgggcttaacaacgggtgcagtgtgagggagcttcacacgctgctccagaccaagggcccacgtgcacacatgttggcccatctgcaacagcgctgtctgctgcgcaccgtccatttgcggcccgccgagcgcaacattgcgctacatgcgcatgccctaagtgccctaagtacaaacctgacctttgcatgcggtggttatctcaacctcacagtaataattttgtttaaagaagcgccgcccgcattctgtttgttttttttgcctaggtgcgtcagtacttctatgccaaacacggtgtccgtttgcgccacccaaacctgccggcgctggttgagcgcggtggtggtgcacacatgtcctattatccgctagagtgtgtgcaggtgcacgtcatggtggcatcgcccacggaccccaacgagacggaggacaataaagaggagagcgcgggctgcgcagatgatgagtgaaaatagacaagcatccatttttctcattttttattgcgtcaatcacactgagataaaactataattcgtattgattttaagcaagcctgtttcaaaatgacatatttggtgcaaaatagtaccagcacattttctcttttcaaatcatgtggcgctcaagcggcctcatctccacggcagcaacaacaactacgctttacccgcgaccaattcttggcattggcacgcaacggtgcgtgcaccgaatatgcccctcgccgttttcacgccattgtgatgcgtctgcgcaccggttcaaccagcaccatcagcaccggcgccgtcaccatcaccaccacaaccaccgccaccacaactcccactggcaccacaactgcgcttattttccaaagcgggcgtgtggtgctaactggcattggtggtggtggtggtgtagcagtgcagcaaattcacgcactctgtcgacacgaagcgcaccgagtgtgccgccgtgtcgccgatgcactccggcgaggtggctttccgacgctcggccgctcgcttcgcgtcaatggggtgcagttgcgcaacctggtctccacacttcatatgccctaccgcttgaacattgaggtgatggcgcagcatcttttgcggcggatgaccatccatgggaagcagcgacccaatgacaaagacaacaacaacagcaaccacaataacttggccgggcagattgtgcgggtggcacgcgcgtgccttgatctgtgcacattcccaggccttcgctgcgccttgcggattggtggccaacaaaagggcgggacggaggaggggagcatgggggaggcggagtttgtggtgacagcccttttcttcatctccggcaccgtgattgtgacgggagtgcgcgaccctctgctgctgaaacgcgccgttgacactattcaacatttatgtgctcaatacattcgagcctag

SEQ ID NO: 75487 - DNA, 612 bp, Heterodera glycines
  Genomic contig location: Contig_ID=SeqID_11966; Location=697..1308; Strand=-
  SCN-specific regions: Sequence locations=1-170,193-218,240-494,516-612
atggctataattttgcatgaaagtacgttagcacaaagtctgaagcctggaacaggacgggattttgtgggatcaatcccttgggatatcatcccgcaaaattaagttttaatcccggagagggatcagaaaatttgaaattttcggactctaataaggactaccagcctacaaatatttataaatttgaagtacaaaactcaaaacctaccccaaaattagtgaaattttttgttaatttaccaaaaatgtgtcaaaatcaaattttcacacttttttcgctttgacagatcgctgcacgggtgcagccaccttttgttggcactgaactcctttttcgagttcctgcaccagagcggccattacattttcctgttcaccatattcagcgggcgcaatttcatcccctattttaccagtgctgtctttcagcttcaatcaatcttcggctacaatgccgcaattttcacgatgattggcacggcggtggaccgactgttgtccgtgctggtgcctgatttgtaagcgatatgttggcaaaattaaaactttaaaatctctctttatcagagagaatttctctcaaattttgtgtaagctattaataataaa

SEQ ID NO: 75488 - DNA, 1036 bp, Heterodera glycines
  Genomic contig location: Contig_ID=SeqID_11969; Location=499..1534; Strand=+
  SCN-specific regions: Sequence locations=1-137,186-189,211-894,916 -1036
atgtgtgaacggtaagcgctttttttagattatgtgccacaacaaaaagccttagttgataaaaactatacatataaattaccaaaaataattgaaatcaatttttctgaaaaaaaaaaaaatcgggtttctcagagaaataaatatttttaaaaattttttccgaaaaaattaataaaaaatttcgatcaaaaataaaattccttttaatttgctatttgatcggacggggcttatatgtgatttctttcatcagcgatatccagcaatctagaatgttttgttctggaacttaaaaataccgtaccaaaactagtatggtaaagcaggattttctattcgggaaacctgtcccggtactggtccctataattttggcaccacatttttgtcaaaaattgatcaattttgccatcaaagtgattcagcttctaatcactgcacaatctgttaacattcagactgcgatttgagcgctcctgcggcatccaatgtgccaatttggagccgtttggactgccgttgcaccgcgaattgttgtggagcgactttcgcgggcggttgagcgccgcacaacggacgaaaagccatccgtttggcattgcggcgcaaattgcgatgctaatgattacattgataatcatcccggcccaattaattgaccgaaggcatttctgctttaggtggtggtgttgagcattaattattttaattgcctagcattttactttatttttttattccggtaaaatggatttttggtttgcaaatttttattatgatttgctagagctcagacttgaaaaatttcaaaaaaagtttttaaaaatgtgtgagactttttcatgtatgaatttcttgatactgtattgtatgatacagtagtacctttcttgtgtatattgtaaatatttccattaacatattttatataaagatctatgtatagagaaataattcttcttttttattatactagcccgaaagcgcgctttcggcgcgcacttgggctagttataaaaatgaaattctctca

SEQ ID NO: 75489 - DNA, 518 bp, Heterodera glycines
  Genomic contig location: Contig_ID=SeqID_11970; Location=372..889; Strand=+
  SCN-specific regions: Sequence locations=1-5,57-68,90-253,275-518
atgtttctctctctttgcctcctttcctctctctctctctctctcgttttttctctttttatcgctcctctgtatttttattctcaccttccttttttttcccatttttccaaaccaaaattggcataacggctataagcgcaaattcaaatggcgtaaacatcgcggacatacagacacacagaaattgtcaaaattatatatagataaattgtgaaatgaattaatcatattttatagagctcgacctggacctggatccaggcctggatttttcctggatccagttccaggtccaggccatttttcggtaacttggatttttcctatacctggatttttttgtgctttccgttacccgactatcaccgcccactccccgagaattgcttttccagcggtctgggagcaccccgaactaaaaagcacgaaagaattcaaaatcatcagtgtttacactttaaaagcatagaaacatttagcaacaatagttccgattaagatttataggacattta

SEQ ID NO: 75490 - DNA, 1154 bp, Heterodera glycines
  Genomic contig location: Contig_ID=SeqID_11971; Location=1545..2698; Strand=+
  SCN-specific regions: Sequence locations=1-579,601-805,827-954,976 -1154
atgtgcgattcgtttaaggaaatcgatgcgcgtgaggagcagaccacgtacggattcggggacaccatttaccgcccattaatcccgcggcttggaaatcatcgcgtgttgacttcctttgtcggtgaaatatccggtgctggccagtattttcgttacgacgacgacagcggccgtttctgtgtggtgtcaatcaacacgcatgaagctaacgtaattataaatcaaatgtgattaatcgatgacttttttcaacaaaaaactgaattttaattatatatttcattcagccccttggtagttacaaaaatggaaaatgagtacacataccaacaaaataaaatgtcctctctacagaatttcgaaatgcttttcgtagtcaaattcatgttagcgttccccgaaatctccatcccctctgctgaagtggtgtaaattggcaaatgggcaccatcgtagtcaatacttaagaatcatttttcttattcgatattcagagagagatggtccgcactttctttcacgacaacgaggctgggttcaccaaaaaatattatttctgcgaactccaattttttgctatcaatgaattggtaaatgggatttcggcgtttttcgcaaagcatcatttgtccattttgaccaattccgtacaccggatccgaactcgaacaaaaagtcgaaattcaaatttttctaatttcagaaattgaaaaatttaaattttcgactttttgttcgatttcggacccggtcttcggaattttaatcttcaggatttagaatcacagaatgaaacaaaataattgtgttgaattaaattgaaatattcctttttcagccttgggacattgccgtgttgaagttctacgcagaaaccatgggaaatatttgggaccccctttttacgtacttggacgaagtcatcacttcggtgagcctatcatttacagcaaataattggcattattttataatggacaaataagcaaagtgtacaattctttattttccaaaataatcaatcagtcctatttaacatttagctcgagaatggtgacatgccggcgtacattatcgaatcgtcgccaagtaattcggccaattctctcgaggacctcccgtcggttgaggcaccgcaatcggatgattag

SEQ ID NO: 75491 - DNA, 366 bp, Heterodera glycines
  Genomic contig location: Contig_ID=SeqID_11973; Location=1526..1891; Strand=-
  SCN-specific regions: Sequence locations=1-70,92-209,231-366
  Gene Ontology: Mol. function=structural molecule activity; Cellular component=microtubule; Biological process=eye morphogenesis
tatttccctaattacctaattaaaagccggctttcagcccttaggctggcaaaattcaattaggcataatctgtcgctgaacgactgcttccgaaagctgcccagagagccgggaaatccgggcaaaggttttctcaaaaaaaatggcaattaaattttaaatgtctaagtcaaggcaattattggtatttggacccgaatgccgaaagcatgttcgacaatggcagttttttacgacgccggaaaaggcaagaaacaaaatgaaaatttccaaaaatttccaaaaatattttcacaggtttaagcggaagcccacgccaccgcctcagctgatgccggccggcgttttccctccgccgccggcac

SEQ ID NO: 75492 - DNA, 647 bp, Heterodera glycines
  Genomic contig location: Contig_ID=SeqID_11974; Location=187..833; Strand=+
  SCN-specific regions: Sequence locations=1-111,144-647
atgtctggtgttcaagacgaacacgatttgtcaacgccatcgccgccggtaagacaacactcaaattgtgcgttatgtcgagagtgtttagggtcacgaaacagtcaacgaattgccgccaccaccaccacctccgctatctcttcatcaattgatggcgccgcaggacaatgatacacctcatccttctccgacgtcgcatcttggtatgacagcgatgccaatggctccggtggtcgttggcgacgcgcaggctccgtcaaatgaaaacgaaatttcgcaaatggatgtcactcagtgtttgggcgccagtccctctactttcgttcggccttctgtttctggtgtgcaaccgcaggtgcaaccaaccggggtaattaagagattatgcttaattaaaaacctcaatacaaacttttgtttagtggtctaaatttttagtatgacgcattttagtaccaaggagcctgaaatttcagaaacttgcactttaaaatttcattctttcttgtcgacctccgtacataaatccaattttaaactatttattcattatttaagtttatatttgaaataatgaatcaaagatagtgctgataaagttattcgcatggttttaatggtcaatattgtgaaaaatttgaaaa

SEQ ID NO: 75493 - DNA, 144 bp, Heterodera glycines
  Genomic contig location: Contig_ID=SeqID_11974; Location=2687..2830; Strand=-
  SCN-specific regions: Sequence locations=1-37,68-144
gaaaagccaatttcaattaccgtattttctctaattaaggccccggggggattatttttcaacctcttcagaaagggggacataattggagacagggcctttaatggagacggggggattatttttcgacagatttttaatgac

SEQ ID NO: 75494 - DNA, 290 bp, Heterodera glycines
  Genomic contig location: Contig_ID=SeqID_11974; Location=899..1188; Strand=-
  SCN-specific regions: Sequence locations=1-290
atgattgagtcccagtggaactcggacactttagtacagagactgaaatctgttcagaattgtcgccgtgctcttcaagtggctccgttcgaattcacccattgacgaaaggaatcgaatcgtttaattattaaaactaatcaaattttaatgtatttatagacaatatactcgggagaaagcatgctttatattatgaatctttgattgccggctttaattctttattcttgataaaattacgataatttttttcggaaaaaactttatatacttgttcgtttaataaa

SEQ ID NO: 75495 - DNA, 383 bp, Heterodera glycines
  Genomic contig location: Contig_ID=SeqID_11979; Location=295..677; Strand=-
  SCN-specific regions: Sequence locations=1-45,77-235,259-383
atggccaatttggacaacttcgacaatgatgcggtaattaattggtaaaatattatttaattttacaatatattttcagttttattggccttcaaagatgccaatcccagctggtctctgattggatgcgcactgatttatggaatcattacaacatttggaatcatcttcaatttttctgtgatttttatcacagtcaaaacaaagtatgaaatgatgaattattatttgatcgaaattataattttatattttttagatcactcaatggcaccgccaattatcttttggcactttgctccttttttgaactggttcatcaacttggtcattttctgtttgtgtacaccgcattttctggacaaaattttaatataaataaa

SEQ ID NO: 75496 - DNA, 1075 bp, Heterodera glycines
  misc_feature (766)..(766): n is a, c, g, or t
  misc_feature (857)..(857): n is a, c, g, or t
  misc_feature (961)..(961): n is a, c, g, or t
  Genomic contig location: Contig_ID=SeqID_11979; Location=1025..2099; Strand=+
  SCN-specific regions: Sequence locations=1-28,50-153,212-358,387 -459,483-590,612-716,754-797,820-822,844-1075
atggtaagaaaaaattgcgcattttaccatggaatttctcatcaaaattttgttttaacgaattttcatatgaaaccaattaatttgtgggaaaaatcgaaaaattatgactgtaaactgtgcgaagcatttgtattgcgtgacctttttgtgtaaattattattttttaatgaattcattagaatattaaattttaaaattttttaaatagtataagaaaagatatggttattaattccaaaaatcttaagtgaaagttttgtgcataacttttttaaaattcaatgaaattttccgaaattttaaatgtaattagagaattcttcggctttagaatatataaatgaattttggctcaattattttaaatgtttataattatatacagggtgtttcaaaagtgattgaacacacatatttattcatcttttagggatgtgcgagagtctcggttctcgattcccgactcgggaaatttcccgggtttttcgcttcccggtctcgggtttttagtctcggaaaccgagaaatttttacactgttaaggatgaccattgtggggagtgagtcgccggcaaagtgggaaaagaggaaaattatatgaaattttaacatattttcttaacaaaattcataaaaaatctccaaacatttccacaaaattcccttaagatttcaaaatctgacctaaaaattgcctattttaatgaaatcttaagcaaaataggaaaatttccaatttttctcccgcgggcctatcgcggnaaagggggtgaactccgtctcagcaaagttcaaaaatctatcttttttctttgttgataaaactcaacaaaatattataattcgaaagctntaaatgattcgaagattcgacattttctgtaattattcttaggctaatagagccttttaaaggctttcgaatgatacaagattgttggatttggtcaacaactntaaaaagttatattgactcaattttgttcggatgtagttggtccgttccggtctatcagtaccgctggaccccaaaaacttatacattttttgtgtaaaatctactaaatctca

SEQ ID NO: 75497 - DNA, 1045 bp, Heterodera glycines
  Genomic contig location: Contig_ID=SeqID_11979; Location=2457..3501; Strand=-
  SCN-specific regions: Sequence locations=1-77,99-695,717-805,881-1045
atgtttttcactggcattgatcgactgattggaattgctttttcggaattgtataaaaattaataattcctatcgttaattacagtaattttcagtcacgataatcttcaaaagcgactgtatttggcattgttaacaattctttctggtggtctatggtttttgcttctctggttccggtgtaccaaaatgcaactaggggatggtgatcagatgaccaccggatcatattttgattttttaaaggttcttgtgtgatcctgatccgataataattaaatatttctctgctttttagagcgcacctatttttgacaaattaagttttttgattacttcaattacttgcattatttatctgcttcttggaattgccgtacgtataaaagcttcaggtaaatcagtctttcattaagcatttctccggaaaatggtcataaaagcagaccaggattttttgtgccattggcaaaaaaatttcggcatcttttttcttaaaatttgataagttttctaatttttgcaatttttgagttaattctctttttaaaacaatgattcacttgtgcaacattgctattaattacctaattaattgatttttataggttttccgtccgccgattcgttcaatcgtcgcacttttcgcgcaattttttgcattatcactgttaatattagcggctatttctttgcattaatttgttacattcttttaattcccaaaatttcgtctccgatcactgcgtggtttttacatgcaatcacttcaattcctttgaacattggcgcagcgtcaaacggacccattttgtattttaccaggtttttttaattgaaaaattattaaaaaataattaatttaatttttcattttttagtacggagtatcggcaggcattccaaacggtgtttccatatgtgttcaaacgaatttcaaatccaaatcaagttattccattgcaaaatgtgcctccattaggcgctacacaatggtgaatgatgtcattcataagatactcttccgtatcagcccattattaaa

SEQ ID NO: 75498 - DNA, 3562 bp, Heterodera glycines
  Genomic contig location: Contig_ID=SeqID_11981; Location=86..3647; Strand=-
  SCN-specific regions: Sequence locations=1-72,99-138,193-275,354 -400,422-521,543-686,708-798,820-882,957-1049,1126-1432,1455 -1670,1692-2067,2089-2348,2370-2680,2702-2982,3005-3079,3101 -3475,3546-3562
  Gene Ontology: Mol. function=ATPase activity; Cellular component =nucleus; Biological process=eye photoreceptor cell development
atggcgctgactaacggagtcgcggagggagaagtggaattggaggtgcagaagatggacgacggcacaggcgaaggggcggaggaagaggaggccacgctggtgaagaagggcatcaaactggacgagggtgaagccgaggcagagggaggcggagaaggtggagggagaggaggagagagggggggggggggggtgatcaaatggcagcttgtacaaaagccaacgcgtacaaaaaaacaactcgtacaaaaggcaacttatattttacaataaagcctaaccttaagcctaagcctaggcccaagcaagcctaagcctagcctaaagcttaagcctaagccgaagcctaaaaccaaggcctaatctaagcaaatgtacgagttgcctttgtacaacagtgggggagggggcttctttagagaaaccaaacaaaaatcagaaatgtacctaaaatcgaaaaaggccattttcgtgcccctcatcagctactcatccccatgtcaaagctctgctgggataatttttgggaggggaaaagggaagggaccagggctggccgtgatctcgtatcacgggtcacggatttttttttaaagccccgtgatcacggctcacggatttccgtgattggaaattcaatcacggccagcccttcaagggacacaaaagcgatcagaggaaagatcagtgacagaagggaagaagagggcgctgaattacaatgattgattcattcagaagcagcagcgaatgaaagtgtcgaaaaggaagcggcggcagaggacaaaactgaagatttggtaagggaaaattttttagataaattcaagtattttttgaactcctcccatttcactcgaatttatttctctccgattatctctctgtttctttctctctgtccctttctcgttttctctattcccttctctctccctccccccctttctctcaaaattaatagcaacttctcggcttttcctcttttgctttatccccgggtgggataccctttgctctgttcagattcttagtaaagtgtgtgtgagagagagagagcgagagagagagagggaaggcaacctgaagagggagaggatgagagagaaagtgagagagagaacaagagtgatcggatggttctctctgacaaagaagcagagagaaactgatcacacaaagagagatagtgggacatagtgagagaagagcgacacaaaagggtttttcctctcgacgattcgctctcgagggattcgatcagcgaaaagctttgtttattttgtcctgatcttgacaagtgttctcttttctgagctgcgcattatttttggcaattgtttcccgtttcttttttgtgtcaaaattgattttttcctttttttcaatttgcttccaatttgttctctgttgctgatcacaggtgcccgacataacaaacgaagacccaatgaccacatcgatggaaggcatcgacgacattgaggtccttttttgaaggggggggggagtctcatttaggcacaattaaagaaaaaagtgccgtgactttctgccattcaattaaaatttaattgacatcatttgtaatttgtgctataatttgaatagaaccaaaaatgattcatgctgcgtaaaaaattatggcatgcggcgaaggaggacaatttaataaatatttcaaaatgaattatagaaatagccatcatttttaatttgaattcgaattccctcggcacaattttgtgccgttctgtgctgttctgtctattgattgcgcatgttttacccctttcagcagcaacagaaggaaggcgaagaaaatgaggcgcctgaaaaggaagaagacagcgcagcggccgaaatcccggtcgatgtgtacgacgaagaggcggccgaggcaccgcccgcggaggaggcggaaaaggcggaagaagcggagacggaacaaccagaagcggaagcagcggaagcgcaagacgaggagggggccgttgaagtgcccgtggagaacgtcggaggcggagaagcggctgaagaagaagcgccgcccgcggaggaggcggccgaagcggagccaccggcggtggatgaggaggcgcttccggcggagtcggaaacggaggcgcccgaggaaacgcccgctgagacggaaggcgacgagccgaaaacggaggacgaacagcaaaagtttgaactgcaggtggacgcacttttagtcattttgtccaaaataggcttaataaagtaaaaaagttcacaattacttggcgctttagccgaagaatgccaaattatcccacagagtcaatttgtgccaatataatccgtgctgtcttttcggcattaattttaaatttttaatcgacctttaggcaccgcccaggggacggccgcgcacgccgaacgaattggacgaagtacagcaagtggaggtggaggtagaacaggcggaagaagtgccggaagacgtggcgagtgttacgggcagcagaaaggcgccgagtgtcggtgagagggacaaatggccgacactttttgaccatttgtcatccatttgatcattttttcatcgcaatcattcagtttcacctgtggcagtttcgccggtgccaacgacgccgaaaagtgccgcgtcgactaagaaaacgtgagccattgctaacatttaccgattttttcaatcgagcaattttttgggatttggacaaattgatgcccaaatgaacaaaatttctgctattgtcctgtctttatcattgtgttcagcactttcgaagacgaagtgttgtcagtcaaaagcggcagaagtggaagaagtatcagaacaaaatcgccgagaagccctcggacgccacggacgccaaagtcaccgaaatcgccaaagtaagcgcaaaagtttaagctgatcagtgatcggaaacgaagtggaaaaagagatgaattatttaagaaaagcagtcgaagtggaagatgagggagaagcagcgaaagaagaggaggagaaacagcggcaggagagcttcgatgcacggatgcgtgaaagggaggaggaagagtcgaggtgatcggtgaagggaggggaggaggaaatggcgtgggaaaacgaacggacaattgatcattgatcagtgggaattagtgaaaatggcatgccaatgggaaacaaagtgatcgggaagaatgatcgggttaaaccaatcggaggggagggaaatgccaacaaattattcagggaggtaagaggaaatgccagtgaaatgaacggcaatttgttaattgaaaaacctgaatttgatttggttgattgatcgcttttctcggaatgataatcgatcactgctgcctttcccgctgacggatcacttattgacagatggaagcgcatgaccagctgggacaagggcgaggatgggacggacgcggaacggaaagtgtcagcggtggcggccgaaactgtggacgaagtgccggaggagaaatcggaggccgagccggccgagaaggcggaggaagaggagaagccggccggggaggaggagcccaaatcggaggttga

SEQ ID NO: 75499 - DNA, 3648 bp, Heterodera glycines
  Genomic contig location: Contig_ID=SeqID_11981; Location=1..3648; Strand=+
  SCN-specific regions: Sequence locations=1-102,173-547,569-643,666 -946,968-1278,1300-1559,1581-1956,1978-2193,2216-2522,2599-2691,2766 -2828,2850-2940,2962-3105,3127-3226,3248-3294,3373-3455,3510 -3549,3576-3648
  Gene Ontology: Mol. function=signal transducer activity; Cellular component=extracellular; Biological process=invasive growth
ttctcccgccgcttccgccccttccggttgctcttccgttcgttcctccggcaccgctcccgcgtccgctgcgacaggtgcttcctcaacctccgatttgggctcctcctccccggccggcttctcctcttcctccgccttctcggccggctcggcctccgatttctcctccggcacttcgtccacagtttcggccgccaccgctgacactttccgttccgcgtccgtcccatcctcgcccttgtcccagctggtcatgcgcttccatctgtcaataagtgatccgtcagcgggaaaggcagcagtgatcgattatcattccgagaaaagcgatcaatcaaccaaatcaaattcaggtttttcaattaacaaattgccgttcatttcactggcatttcctcttacctccctgaataatttgttggcatttccctcccctccgattggtttaacccgatcattcttcccgatcactttgtttcccattggcatgccattttcactaattcccactgatcaatgatcaattgtccgttcgttttcccacgccatttcctcctcccctcccttcaccgatcacctcgactcttcctcctccctttcacgcatccgtgcatcgaagctctcctgccgctgtttctcctcctcttctttcgctgcttctccctcatcttccacttcgactgcttttcttaaataattcatctctttttccacttcgtttccgatcactgatcagcttaaacttttgcgcttactttggcgatttcggtgactttggcgtccgtggcgtccgagggcttctcggcgattttgttctgatacttcttccacttctgccgcttttgactgacaacacttcgtcttcgaaagtgctgaacacaatgataaagacaggacaatagcagaaattttgttcatttgggcatcaatttgtccaaatcccaaaaaattgctcgattgaaaaaatcggtaaatgttagcaatggctcacgttttcttagtcgacgcggcacttttcggcgtcgttggcaccggcgaaactgccacaggtgaaactgaatgattgcgatgaaaaaatgatcaaatggatgacaaatggtcaaaaagtgtcggccatttgtccctctcaccgacactcggcgcctttctgctgcccgtaacactcgccacgtcttccggcacttcttccgcctgttctacctccacctccacttgctgtacttcgtccaattcgttcggcgtgcgcggccgtcccctgggcggtgcctaaaggtcgattaaaaatttaaaattaatgccgaaaagacagcacggattatattggcacaaattgactctgtgggataatttggcattcttcggctaaagcgccaagtaattgtgaacttttttactttattaagcctattttggacaaaatgactaaaagtgcgtccacctgcagttcaaacttttgctgttcgtcctccgttttcggctcgtcgccttccgtctcagcgggcgtttcctcgggcgcctccgtttccgactccgccggaagcgcctcctcatccaccgccggtggctccgcttcggccgcctcctccgcgggcggcgcttcttcttcagccgcttctccgcctccgacgttctccacgggcacttcaacggccccctcctcgtcttgcgcttccgctgcttccgcttctggttgttccgtctccgcttcttccgccttttccgcctcctccgcgggcggtgcctcggccgcctcttcgtcgtacacatcgaccgggatttcggccgctgcgctgtcttcttccttttcaggcgcctcattttcttcgccttccttctgttgctgctgaaaggggtaaaacatgcgcaatcaatagacagaacagcacagaacggcacaaaattgtgccgagggaattcgaattcaaattaaaaatgatggctatttctataattcattttgaaatatttattaaattgtcctccttcgccgcatgccataattttttacgcagcatgaatcatttttggttctattcaaattatagcacaaattacaaatgatgtcaattaaattttaattgaatggcagaaagtcacggcacttttttctttaattgtgcctaaatgagactccccccccccttcaaaaaaggacctcaatgtcgtcgatgccttccatcgatgtggtcattgggtcttcgtttgttatgtcgggcacctgtgatcagcaacagagaacaaattggaagcaaattgaaaaaaaggaaaaaatcaattttgacacaaaaaagaaacgggaaacaattgccaaaaataatgcgcagctcagaaaagagaacacttgtcaagatcaggacaaaataaacaaagcttttcgctgatcgaatccctcgagagcgaatcgtcgagaggaaaaacccttttgtgtcgctcttctctcactatgtcccactatctctctttgtgtgatcagtttctctctgcttctttgtcagagagaaccatccgatcactcttgttctctctctcactttctctctcatcctctccctcttcaggttgccttccctctctctctctcgctctctctctctcacacacactttactaagaatctgaacagagcaaagggtatcccacccggggataaagcaaaagaggaaaagccgagaagttgctattaattttgagagaaagggggggagggagagagaagggaatagagaaaacgagaaagggacagagagaaagaaacagagagataatcggagagaaataaattcgagtgaaatgggaggagttcaaaaaatacttgaatttatctaaaaaattttcccttaccaaatcttcagttttgtcctctgccgccgcttccttttcgacactttcattcgctgctgcttctgaatgaatcaatcattgtaattcagcgccctcttcttcccttctgtcactgatctttcctctgatcgcttttgtgtcccttgaagggctggccgtgattgaatttccaatcacggaaatccgtgagccgtgatcacggggctttaaaaaaaaatccgtgacccgtgatacgagatcacggccagccctggtcccttcccttttcccctcccaaaaattatcccagcagagctttgacatggggatgagtagctgatgaggggcacgaaaatggcctttttcgattttaggtacatttctgatttttgtttggtttctctaaagaagccccctcccccactgttgtacaaaggcaactcgtacatttgcttagattaggccttggttttaggcttcggcttaggcttaagctttaggctaggcttaggcttgcttgggcctaggcttaggcttaaggttaggctttattgtaaaatataagttgccttttgtacgagttgtttttttgtacgcgttggcttttgtacaagctgccatttgatcaccccccccccccccctctctcctcctctccctccaccttctccgcctccctctgcctcggcttcaccctcgtccagtttgatgcccttcttcaccagcgtggcctcctcttcctccgccccttcgcctgtgccgtcgtccatcttctgcacctccaattccacttctccctccgcgactccgttagtcagcgccatt

SEQ ID NO: 75500 - DNA, 814 bp, Heterodera glycines
  Genomic contig location: Contig_ID=SeqID_1718; Location=192..1005; Strand=-
  SCN-specific regions: Sequence locations=1-295,326-814
atgatcaaatcattcccattgagtgtccttttcctcgtgtttggcttcaatcggctgctgctggtcaccagtggaccatgtctaagctgtgttcgtagtatgttttttttttctttaaataactatataataagaaataagcaaaatgctttaaacctcgggtgggaatcgaacccactcgtgcaccctttccatgggaagctattccattgagctaccgaggcacatccgccctttcttttatggattttaagctttccgcgttttaatcgcccagcccgcttcttccttacactattattaaatttatatttatttttattttggttagccattcccacaattatttgtcgttttgttttaattgggcaaaattaaagtgaatgaagattggcacgactattgcaatgcaatggcaaagtgttgcgactcgttgcgaattaaaccgtgtgggttggatgacagcgatgtgacggatgacagcgacagcgagctgtcgccaacctcgtgccttcccatttacgtgttcaatgcgccacccggtaattaattgggcaattaacacataattattatttgtctacaattattaactaaaattataagcactaattaatttattaaattcagtggaccaatattggagtggcatatgtgaaaatcaaccgactgacaaatgcgattcttatgaagtcaatctatgctttttggacgcaaaaaagcggtgtttaccgcgcatgccatggccataaaaagaacgaacgaatgttttgtataaaaatttcggctattaatattttggcaaattattaaa

SEQ ID NO: 75501 - DNA, 1449 bp, Heterodera glycines
  Genomic contig location: Contig_ID=SeqID_1720; Location=22..1470; Strand=+
  SCN-specific regions: Sequence locations=1-166,198-647,670-676,734 -894,945-965,987-991,1013-1095,1119-1204,1245-1449
atgccaatcgctgaagcgtgagcacaattaaaatagaaaaataggcacaaaaataggcaaataaaattttttgttaaggattttttgggagcaaaaaacccataaaaacttattcaatattttggttagtattaaatattttaaagttttttttcgaacaaggaccaaaaatttttatgaaaaaaaaaataattttagggaaaatttttcatttataggggagtattttctgaatttttttcggatcatttcataagggtttattttttgttttattgcatttttgtcgaggatttttccgcaatttttaaataggaacaaaaataggcaataaaagtcatcttagacaacacaaactaagctgaaaacgcgtttcgtgcttatctgagcgtattaaatgcgcagaaattttaggcatttgccttaaaatagaagcccaggtaattaattaagacggactgtgacggggctgcaaaccttcgttctgttaaatgatgtggcatttttaatttctgagtatttgtcttgattttgtatattttaaagagtcaaaaagattttttaccaatgaattttgtggtttttgagaattttcatttggtttttttaccaaaatttcaaaatataaatttttggggtaaactctgttgtaaatttccttcttttttgatgattcttataaaaattatatttttagtttacccaatttttaaatttaacttaattttatattgcagtggtgaaacgcgtctttgttcacagacgacgaaattgggcgaatttttggtggaaaaagggaccggagtggccgttgatgtgtacagttttcatcgaaacaaggagttatggggcgaagatgcagacgaattccggccggaaaggtgcaaattttgctattaaaaatataaattaattaattaataattttaattattaaaaaataagagacttaaaagttgaacgggatttaaataaacataaaataataagtcatttatttattctccatatttcttttcttgatattcgcttgtatttaaattatgccaaattaggcataaatacacacgtattagccaaatagggatcagtaacaaatataatatttttattatatagactcagagccaaacttcaaattcatagtctgtaaaatttccatgctaattgtaagaagattcatatactttactacatttatggcataaaaaattgttttaaatttaattatattttaattttttggaagcatactaaaactaacttagcttaaatttaatcaaatcaaaaaaaaccttggcattgagcgatagaacgcctttaaatttttgtatgaccataaaaatatgatacatttttaatttcttcataatatgtttcagaaacagccaacttcaacttttacattatatgattagacagacgaaagatgatttttctattctttaa

SEQ ID NO: 75502 - DNA, 859 bp, Heterodera glycines
  Genomic contig location: Contig_ID=SeqID_1721; Location=72..930; Strand=+
  SCN-specific regions: Sequence locations=1-313,345-479,504-599,636-859
atgcgatttgcacttttggaggagaaaatggcacttgtgcgactgttgcggcgttattcgctggtcaaaactgagcagacggaggtggtgaaggggggggggggggggaaattgtcaaatttaataattatggcattttatttttaaaatatttcccattttttagaaattgctcaatttcaattcgcaagtcgtactgaatcatggcgctgttatggtcaaattgagtcaaagagaagagaatttctaggagaaacagaaagaatttgaaaactttttaactgaattttggtttaatttaatacaaaaaaaaaattaattttttaatcaattaattaattaatggtgatgctctgatcatttctttatatgctaatcattacattcagctcaaaaactttaattagtttttggcaattatatagttgaatcaaaattaaggcacacatgatttcaaaaaaacacaacaagaaacattgatttttaaattttaaattttttatctgagttttaagaaatttttgaaagaaggatcggtcccgggttcatttttctcggtctcaaatagcgaaaaaaagtactgaaaagataggcgaaagttaaaaaaatcatattttaaattttttataaaataacattttgatcggatttttaggcacttaatttttttaataggtacctaaaacaggcataaaaaagtgtttcttccaacaattacgaaaaatttcatccaggtttaattgccttttcaccgatcgaaattttaatttcggaatttgctttgtatttttcggcattttctttggtgaatttcaaattttttttttcaaaaatttttaagctttttaggctctaaaaa

SEQ ID NO: 75503 - DNA, 897 bp, Heterodera glycines
  Genomic contig location: Contig_ID=SeqID_1722; Location=480..1376; Strand=-
  SCN-specific regions: Sequence locations=1-7,37-355,378-472,494 -591,628-869,895-897
atgttcaaaattctttccttctttcttctttttattgccccatttattgccgcttatgcaccaaattgcatagtgagtagccataaatgttcatttaattactttactaaatttgctatttcaaaatgttttttttccaataattttaagtgccccgaaaatgagcagccgggccaattgagttgcaaccgatgtgagccgagttgctacaacccgagaccgaggatttgcactttaatgttctgcacatgctcatgcgattgtgtggcgggattattacgcgacgaaaagacgaaaaattgcgtgtccaaagagaaatgcactcattaaaatgatatggtaattaagagctgataaggaggaatttggtgaaaaagattggttttaaaaaacccatgacaatgataaaacggcaaatttacaatgtgttgatcaattgcttacttttcttaaaattaaaaaatgtaaaaaagttgaatttattaaaaatgagcaaaatgttaggacatcgaacccacgcctcagcacaatcagttggaaaataattcaagtattaaatttgctcttgtctattatttttctcactgtttcattatttttacttttaaataataatttctaaattatccaaaatttttcggaaaaagtaaattacttaaagtaaataattaatcttgaactatgaaatttattcctaacaattaattagtctgaaattaatatggtttttgttgacattaattagctaaattgaccaatataaaatgctgaatacttcggaagaaattattaggtcaagcgtcaaagtgaaaatttgtacaaaaaatcaaatctcgaacaaaaacaaaaaactaattaaaatatcggaaattcatttttcaaaattttcaaaataaa

SEQ ID NO: 75504 - DNA, 2247 bp, Heterodera glycines
  Genomic contig location: Contig_ID=SeqID_1722; Location=2571..4817; Strand=+
  SCN-specific regions: Sequence locations=1-78,126-240,262-351,374 -861,883-891,916-919,956-983,1007-1057,1087-1214,1254-1529,1551 -1604,1626-1666,1689-1771,1793-1804,1826-1856,1943-1969,1991 -2076,2098-2217,2243-2247
atgtacaaaaagtggtccaaatatgtacataaatattaaaaattactttttttggtattttaggcaacattttcaaacttattttttctttataaattttcaaaatataaaaaaaatgaaaatatgtacaaaaatatttgccgaaattttggattttttttgaggatttccaaaaatttccgtaaaaaatactcaaaccgaaatatgtaaataaaagtcccggtttttgttcgcaaacacaaaaaagaaagtgtttttcctgctatttagagcaaggagaagccaggaaaaaaatatgtatttacataaaattggcagccctaattatttgtatgaattatcaatgcaaacttttttcccataaatgttttaaataaagcgaataaatttgcgagcctaaaaaagtaacaatgatagtaatatttaaatccaattttactaaatcttattaatttattcctgttttttaaatctcataaaactttttgaaaattagaatcataataaaatttaaatttgcttgtttctgaaaaaagttatgaaggaattaaaattaattaatttgactaagttttgtgctaattatgatttattattaatagagctcgcattttgaggcatatgcctttttttctgcgaagtagtttcgatatattaagcataaaaaacgcattttccacttggtttgaggcttctccgttgacttttattatgccttttttttgcctttttcgggattttcgtgccttaaatgcctttttggcattttgccgttttggtgccttttttggcgtttttttccgaaaaattccataaaaatgcaataaaatcggcaaaatacatccctaagaaatgacatgaaaattttttagaaaatacacccctaagattgaaaaaattttcttaaaaattgatcaccaaaatttattttatttttttcttgtaaaaaattttaggcttaaaaattttccttatttgaaaaacactataagtatttaataatcatttaaaagaccaaaattatgttttttggttaatttttacgtgttttgctccctaaaaatcattaataaaaaaattttaaatgccttttttcatgcctttttcgggattttcgtgccttttcatgccttttttttcaattttttggtgcctattttagtgcctttttcgcgatttttggtgcctttttttgcgagctctaattattaagcaaaataagattttaaaaaattaaatttaattcttattatcattgacacttttttttatgggacatagcaccaaaatgcagcaaaagtgttgctactgagatagagaagaagcttccccgagggaagattaatggatcaattgtggcatatatgatcgagcaacgtggagagctggagagtgcagggtaccggaaagccagagacgccggttcaaagcaggcctgccccattccctcaaaagcttccccagctcgttcatatatttcatggcgacccttggcggcttccagttcacccagcagcagcagagaagcgaaaaagatgagagagaataaagctggcactggaagtgatcgaatctgcaaccttcagccgagcagcagctgacgcagagaagaagaagaaaatggacgaggacgtcacataagagaggcccgggatgagaaagagaagaagaagcttccccgagccagagacgccggttcaaaggcggcccgcccaatatttcccttaaaagcttacccagctcgttcatatatttcacttctatcgagaataaataaataataaatttgtggcgattgattacggaaagggaagaaaggaaatgacaaatgatgataatgaaagataaattcagagaataaaaaattgaaaaaaagttaaattatattatattgtttgaattaactatatttaaaaatcattactaaaaattcattaaatttcagataatcaaaaaccagccaatcactgggggtgtaaaaaagtctcggtatagagtctcgaaagcctcgaagaccgagactgaaaacccgagaccgagaccaaaaaaggatgtgaaccaaaattgagcaaaaatctttcctcttggttccacctttgatctcagatcttttctctgcaaattccttcccgagatttcccaggccattatcatttttccattcttttccattcgatcattcacattttcctttcattttcacatttcataagcaaaggtttaattacccaagtttgagatggaaca

SEQ ID NO: 75505 - DNA, 143 bp, Heterodera glycines
  Genomic contig location: Contig_ID=SeqID_1723; Location=374..516; Strand=+
  SCN-specific regions: Sequence locations=1-143
aaaaaagtttggcacgtcatatctcggcactcagactcatttcgcagaaaataaaaacacttttcttaagaacccatgggtgctctatccacccaccaaatttcattcggaaatcccacggacacccggggaccttcctttgt

SEQ ID NO: 75506 - DNA, 1332 bp, Heterodera glycines
  Genomic contig location: Contig_ID=SeqID_1724; Location=127..1458; Strand=+
  SCN-specific regions: Sequence locations=1-27,49-207,232-286,308 -476,498-645,667-694,733-776,808-987,1036-1191,1237-1332
atggaaatgccaccaattctcacacaattaatgttaattttatttgtttgttcaacgttcattgaaaaaacaaagtgcggcaaaaaagaagctgctgctactccgatggaaaaagttagccaaaaaagcgacgaaacagcaaaagcatcaaaaccggtggaaaacaaaaacgaggagctaaaaaaagaagtgaacttattttcaattgttaaataaaggatctttttgatttaagtgaaggttgtttcgtataaattgccatattaatgtgatcaaaaattcctaattaaagcaacaatttttatttgaaatttgcatactatagagcagggatggcacggaattccgagttccgacatttttggggtcggaattccgacttccgaaatttttgataaaaagtaagttcgaatttttcggaattctttatgagtttttttttaaattagcaatttttgtacaatttctgttaatacattgcactgaaattatcaattttttcccggcggcgcctatcggcaccgccgcaccttaaaatccttaattttcttgaaaaatttgcttaaaatctctaaatttgttttttctacaaaatctgttaacaaatcgcattataaatcactaaaattttaaccgacacctccggacccctccccccagttccccaaattttcttttaattacgcttaatcaccaataatgtaaaaaatgaacaaattttgggtcaaaagtgcaaataaattggcagtttgtaaaaacgagttcgcatgtgcatgaattttaaattaatattaaattttatttaaagattgaaaatatgaaaaagcaaatggaccaaaagttaaagaaaatattgcaagaaaatattcccgcatttgcacttcaattgaatgaaattgcagcacaaattgacaatgaagaaaagcctttggagaaagaatttattcaaaaattgatagacaaagtacgaccattgtacggtaagtgaatataaaataatttaaaatgaatttaaaacataaattatttaaaaaagttgatgcgaagagggctcatctgcatttctggtcgaaagtgcgcattttgaagaatgacaaacatataaaagaagacgtgacgaccgtggaagtgttggtaagcaatcgaaattaatttacataattaaaataaatgaaactgacattaatatgcaaaaataaataattatttactgattttattagtttaaaataaattctggcaaatgagcccttaattatcactttgttttctcaggatgctgttgaggatcaaatttctgccaattataactgtttcaacagagaactcgag

SEQ ID NO: 75507 - DNA, 1787 bp, Heterodera glycines
  Genomic contig location: Contig_ID=SeqID_11984; Location=63..1849; Strand=-
  SCN-specific regions: Sequence locations=1-138,160-564,602-874,896 -1542,1572-1621,1643-1787
atggatcttttcgacatttttgaacacataaacactaacgaagacgttcagtttctgcgtagttctggaaatgctggtgccttggcaccacagccgttggtccccaacactgtctattcattgtccgatctgtgttcggcattcagctctgccgcttctctttctgcccctcctatgggcatggcttctaactccgatgcttttgggctgcgttcgacaattctccccgcggctcctctctctgcccctcccgtgggcatcagtacgaactccgatgactttgggctgcgttcgacaattgtccccgcggctcctctctctgcccctcctatgggcatcagttcgaacatcgataacactggcgcaactcgcgaacgcaaccaccaatacttttttggccatgactttacgacgggttagtatctcgaatgaaaattgataaaatttttcagaatctttctcgagcaattccgggacgacgcgcataagaaaaccgcagccgctgaacttctcgttgaaagtctttttgggtggtattcctgctaatatgacgacgagtaagtggggatttgcagagcatttcttatattaacaaattggtcggctttagatgttttggaattgaactttgcccgattcgggaagagtatcatcgactggccgaagaagacggcgcagcaagatcgccctccgaatggtaaatgacaaagcaacggttaccagatacatattgggattgcttaggttatgcttttgtggtgtttgaagaggaggagtccgtcttccgaatgctccgtctctccttcgtctccaacggtcgtctctttttctacgtctacatgcttgggcctgagcagacgcagcatccggttcattcctcactttccatctctttattatcgtttaaggtggaagtgaaagtgtgggagatgaaggacacgacacacgttggcatcgtcggatggcgaaaattccggcgttactccgtatttgttggaggcattccgcgtacatgcactgctggttggtggttaatgtcacatttgtgtgctaattgtttgttcatcgaattaactcattttagcgatgcttgcgtatggcatccaagaagcaatcggtgagtattcgtaattggaacgttaccgaaattaaaaccaaggtcctgttgcatattgtgccatcgagcttgaccggctccattactaccctaagggtgcggcttgcgtcgttttcgactctaaggagacctacgtacgggcgattgcagcgcatgatgttgtgctcagttttgggacattcgaacgaaaggtctttgtaatgaacaatttttgatggaaacatattcaaaaataatttacccctccaggtggaatttaagccattcctggccagcaacatgccatgtgagaagtgcggctgtacaagcgggacgcgtttctgtgcggaaatgatttgcctggcctattactgcaacaattgttggaaatacgcccacagttcgcgtccgtcgctgaatggacacattccatccaaacggttcatgcgtgggagcagcagcagcagtgggggcaaatcggagcaaatggagcgaaagtgaaaggcttacgggaaacaacttcattatttgctatttttccaatttcattttaccatttactcaagtatctggattattctcgtcgcaaatctaaatccaataacttttggtctaaaatctatgcaatttgttaatatctttcgaaaaatcactattgtttctaccgatttctgattgtgttttgaataaa

SEQ ID NO: 75508 - DNA, 525 bp, Heterodera glycines
  Genomic contig location: Contig_ID=SeqID_11985; Location=873..1397; Strand=+
  SCN-specific regions: Sequence locations=1-525
atgaatccgcggctcgatggcatgtgtattagtgcatctcgttcagatgccagtgatttcctcccatcatatttttttaaacatatttttgtaaaatgcgatgattccaaatttgttgtttacaaaaaggcatggaatgtatcaattgtgaaacgtcagctagggttttgcccacacttcctcgtcacattcgtttctccttcaagtttcggatgttgatgcggcattggacgttggcgcggcactttgcaacggttttgcaccgcctgatggagagtgtctcggcgagttcgccgcgaaaaaattctgcacttgctcttcattcaactcagttgatgctccaaactttttcgcaagatcctcaattacatcctaaacagtttctcttttttggttaaaaatgtaaatgacataactttttgctctattacgattctctccgttcgttttttgcattcttggagcaacgcccttttggctttttcatattcagccaacaattttggtccatgataacctgactaa

SEQ ID NO: 75509 - DNA, 859 bp, Heterodera glycines
  Genomic contig location: Contig_ID=SeqID_11985; Location=1142..2000; Strand=-
  SCN-specific regions: Sequence locations=1-8,38-123,145-488,510-859
attgaattgtttttacatttgaattttttataaatgtcatcaccgtcgttgccagctcattggccagccaggacagcgaaagacatcgaaataatacgtgaaatttagttatctaaaaaaaattaatttgtattattttgatgatcctccatttgattttgtaagttttttcagttttacacgaggcggcgcaagccaccgtttgtcacgcgcttggatgggcagtaactggtatgcgttttacggcgcaaggcggagtggtgatctaatattttgtcttttaatttcaataaaaaaaagttcaggtggattggcacagaaccaccaccttgaataaaatcgagacgcttgaggatttaatgaagcggatttgtattcacatgagtggtaaaatagctgaggaacaattacttaaaagcaacaacactgggtctgagacagacattaaccgaataagcgaagtaaaaaataatagtattcaggttgagaatttttctttttaaggagatggagaaaattgtagagaatggtatgttgccaggcctaccgaaatggaacattacggtgatcgagtttttttatcgcatttcctcaattatttaattagtcaggttatcatggaccaaaattgttggctgaatatgaaaaagccaaaagggcgttgctccaagaatgcaaaaaacgaacggagagaatcgtaatagagcaaaaagttatgtcatttacatttttaaccaaaaaagagaaactgtttaggatgtaattgaggatcttgcgaaaaagtttggagcatcaactgagttgaatgaagagcaagtgcagaattttttcgcggcgaactcgccgagacactctccat

SEQ ID NO: 75510 - DNA, 1374 bp, Heterodera glycines
  misc_feature (1286)..(1286): n is a, c, g, or t
  Genomic contig location: Contig_ID=SeqID_11986; Location=248..1621; Strand=+
  SCN-specific regions: Sequence locations=1-629,651-935,957-1072,1094 -1206,1293-1313,1335-1374
atggaaccaaaatggatttggaaaggaacacatttggcatttgccaatgaattgttatgtgaccgaaatggacttttgaaggaaaatagcacaaaagaaattcttacgttaaattctgaacgaaagaaaatggaaattgacccaacgtttgtagttgacttttctaaggcaatggtcaaagacaaagatttggaaaagctgaaggcattaatcgaagaattttcagatgtttttagcaaattcaggtacgatcttggacttttcacagccgctgagcatcacatcacaaccacaactgaggaaccaataacatctgcgccaagacgaatgccgtacaaatacaaagaggaattgaagaagcacattaatcagcttttagaagcaggagtcatggttgagtctgacaccccatgggtaactccaattgtcattgtacagaagaaggacggtggaattcgtccttgtttagactttcgcaaactcaacgaagttacggtgcccgacaagtaccctctcccacgccttgatagcatcatggaaagggttggaaattgccaattttacagctctcttgacttggccagtggctattttcaaattaaattgagtgaagaaacgtcaagaaaatgtggaattataactgaagacaaagtgtaccaaatgattacgatgccatttgggctgaaaaatgcaactgcagcattttcaagggccatggctatcgttttgtctggattggaggatacttcattggcctacgttgatgatgtgcttattttcacgaaaagcccaaacttttcagaacacctgacggcggtaaggaaagttttggagcgttttcggctttataatctgaaacttagcccgatttggcgtttcgcatttcgctttttggcgcgaaaagcgacttttgcacccctaagaattggattaaattcccataaaatttttcaaaatttttttgcgacaaaattattgggatgccaatgtttgtcatgagaatctccaaatcattggccacaaaagtctcattgtccattataagagaaatttttctgctggtattttttcataatttactttactaattcttcctaaaaaggctgttgttcgtctgtttttgctaaacatccgattttgctggacaataattcggctgacaatttttactacgaaatttcaattggaaataagaaatggtaagagaattatttatttttgaatataaaattaatcataaatattaaaattttatttatttgttattgttatttctttattattanaattttcagttgggtcatcagcatcggattcgtactcaaaaaacagaaagaattgaaaggaagaatgggaaatggcgcttttgcgtat

SEQ ID NO: 75511 - DNA, 91 bp, Heterodera glycines
  Genomic contig location: Contig_ID=SeqID_11986; Location=1116..1206; Strand=-
  SCN-specific regions: Sequence locations=25-91
aaattttgaaaaattttatgggaatttaatccaattcttaggggtgcaaaagtcgcttttcgcgccaaaaagcgaaatgcgaaacgccaaa

SEQ ID NO: 75512 - DNA, 729 bp, Heterodera glycines
  Genomic contig location: Contig_ID=SeqID_11988; Location=975..1703; Strand=-
  SCN-specific regions: Sequence locations=1-471,519-530,552-637,669-729
atgaggaattttatggggataagtaggacgggattatccaaaaaatcctggaaagtaactaatatttaacaactattttatccattgattatttatcaactttgcaaattcgactatttcttctacctagttaagtgggatggatgtttggtggacgcggggctgggccccggcattgcatacattggcgaggacaacattgtaattgttttttatagtggtagcaattttttttctgtataagcatgacaaaaattacttcaaaactttttataattatttagccgccgtgtgtccttggggaatttggggagcaaattcagtcggagcttagagatgccgaatcggtgcttgaatgtccggaacttatgctggacaagattgaagagcatatggaggacgacatacaattgggcgatgatgtaagctctcagcttaagtttttcacaccgagtcaaacaaaaacctctcttaatttaattaataactttaaaattttaataaattataaatattttgtaatcaaactttaaatatggcttagaacaaaacgaagagtacccgaatatcgtatcaaggagttcaaaataaaaaaatataccatcatgataagaaatggtaaatagctgctgaagtgaaaattatatctaaataaaataaaaataattgcaggcaaaaagaattagctaattagttttgaaattttcattaaaagggcattgaaataaa

SEQ ID NO: 75513 - DNA, 252 bp, Heterodera glycines
  Genomic contig location: Contig_ID=SeqID_11990; Location=2943..3194; Strand=-
  SCN-specific regions: Sequence locations=1-252
cccagtccgatcagcaaatcagtgaaattgactcgaaatgtgccgagtttggcattggcatagccaaagtgccatttgacgcccccaagggtaaaactaataagagacaataattcattaattatgcgatctattaaggagatcactcccaacgaaatgtgcctggcacggacagtgtgatttctatgcccggattgcccggctcacacaaacaatgaaaatgagtcaatgagatcattttggagttcattt

SEQ ID NO: 75514 - DNA, 983 bp, Heterodera glycines
  Genomic contig location: Contig_ID=SeqID_11991; Location=18..1000; Strand=+
  SCN-specific regions: Sequence locations=1-113,135-357,381-555,577 -732,754-792,814-895,917-950
atgttcgtcattgccgcctctgcttcttcccatgccagcaacaacagcgaatggcaggcattgagtgcccagtttggtcagcaaatcagtgaaattgactcgaaatgtgccgagtttggcattggcattgccaaagtgccatttgacggccccaagggtaaaaaaaaattagagaataattcattaattatgcgatctcttaaggtgatcactcctaacgaaatgtgcctggcacggacagtgtgatttctatgcccggattgaccggctcacacaaacaatgaaaatgagtcaatgagataattttggagttcattttgttatttgtccgtcaattagttgttggatttgtaatttagcaaaaataaataattattaaaccgcttaattggaatacattttgcatagacttatttaattgaaaatacgattattaaatcattggcatttatttgccggcattttctgcttgcaaattcatttatcgcccactctttccaacttcgttcgccaacgaattgaacataatttgttggctaagcccaacaaattaaattggaaaataaaatggctaatttcgaagaatggcattgttttgtcggcattatttgtaaagcaaaaggaaatgagtgggcgaaataatttttggcccaaattcaattgcaaaaacggaaatgcgtgggttttgcaaaggtataaaagggcaagaaattttaatatttcgacaattatgcaaataaaattattttgccattcctttgattttccgccgctaaattcaccaaatttccaaaatttaaaaatgcttttctccttcggcagtttctccagcgaagaagcggaggccatcgttgtcggagtgttccctccgctcagataatccgagaggaaattcaactcaaaatggaagtgtttgtgctgcttataacgaaagaagaagcggagagatggcaaagcaaagcaaagaaagacgaagaaaatga

SEQ ID NO: 75515 - DNA, 631 bp, Heterodera glycines
  Genomic contig location: Contig_ID=SeqID_11993; Location=199..829; Strand=-
  SCN-specific regions: Sequence locations=1-14,48-78,102-339,369 -439,461-631
atggtcatactgctggtggccaatgaaatgtgagttagtggaaagagcatctaacgaatacataatcaatattagccgtaaaaaatttaaatttaaaaattgaatgtaaaagaatttaagaaattcgcgggaaggaaagggagtggcgactaaggggaaaagcagcaaaattatgaaaaaaaaccggataaaatttaaattctgtttctttttgacaaatctattaggtaatatattgcacgcaaaatttcaattttttttctccgcgatgcctgccgcaccgccgtacacccccccccccccgcacccaaaattttttcgggacatagcgttgccgcaaaatttgttttttaaacaagaaaatatttaaaaaaatcgttttgaagttttttggagacctagatgttacttaaaagctcaattttcagaaaaacaactatttccttcaattttcttacatagtaaatttttttcaaattcggctgggctaccgtaggctattgaaatttttttgtgacgacaaaaaaaaatttctaacgttaaacaaccaattattccaattcaaagcatttttgaagtcagtgctgcaaaaactatattaaaaatttattaacggtcgtatcagaataaa

SEQ ID NO: 75516 - DNA, 1322 bp, Heterodera glycines
  Genomic contig location: Contig_ID=SeqID_11993; Location=1450..2771; Strand=+
  SCN-specific regions: Sequence locations=1-116,138-171,193-483,512 -644,688-766,789-848,872-971,993-1322
atggttccaaactcaaagtttggaacagctcataaggatgggtaagtttgaaccattgcgcaattttttttaaatttggtgaaatcccgttagggagtcagaaaagacggccgtctataaataaaaagagaaaatttgagaaggaatacctctaaaagagaagagacgtctataaataaaaagagaaaatttgagaaggaatacctctaaaaaaagagaagagacgtctataaacaaattagaagcgctagtgatcagggatgaaaagcccaagtgatcagaaaatgaaaagcccaagtgatcagaaaatgaaaagcacaagtgatcagaaaatgaaaagcacaagtgatcagaaattatgagccctacagatcacaaattaatgagacaaactgatcagaaattgaatgtaagggcgaaacgggctaaaatacagatgtatgtggcgaatattagtgccaaaaggaaaccgccagaacttacttacagtaagaaagaaatacagtaattttatggggactgaattaactaaacagagcagaaaaatttgaatttgggcgccctcagcggagaattagcatttttgctcataataacgatttaatctccacagctccaacagacgcgacattttgccccccccctttcccatttttccccattttctcctttgaattgtgttgatactgccctccctctgtttatgcagaatttgcaattggatgatgggcgttattcgttggccattgaacactcatcagagtgcaaagaaacaaatcttttcatttgttgacattaatattttttttcattttgttttcatctctaagaacaatttagtgaaggacaaatttatttacaaatttatttttgagtttcgaatcacttctccgagttcgaaaaggtattaatacttaattaatgatttaaataagtttatgtttggcgttaagttaaaatttatatagctattttttctcctcaaaaatcgccgaaatcgaccattaaatttgtctcttttctctatttttttaattgtttttgttcgttgtgcgctatttttatataaaagtttattttgccattttcctatgagatttaacaaatttataagcgctttgctggtggcgtagaagcattttcggcaactgtgaactttgcggtgctaaaccaaggccacctgccacctaacactaacaaatatgtgaacccccccaacaaacagccaaggggcggccgagacagggttcagtggtcgttactgtggacatgccaccattagaaatgaattacatataagtaaaataggttaaatggcaaaa

SEQ ID NO: 75517 - DNA, 1290 bp, Heterodera glycines
  Genomic contig location: Contig_ID=SeqID_11994; Location=246..1535; Strand=-
  SCN-specific regions: Sequence locations=1-264,287-518,541-575,616 -706,728-730,754-917,1035-1110,1154-1290
atgtcaagaaaatccgagcaaatcgacggagaaaatcacagtgaaatttcaaagagacgcatttgtaaaggtaaaaaatggaaaacaaaaaatgcatactgtacataataaatacagtacacaaatgaagaaagtgaggagggtcatgagaagggattgttcgggtggcatttggtaactttcggtggcattttcgaatttgcgcactttgaccaattgcagcgacagctttggattgccggtgaattcagtttaaaattacacaaattaattattaattttaattgcccttttacaataaaaccgttttgcaaatttcagacatcgaattggccatccgaaaacgaaacccttcacttctttgtcaatttgaccgtgcgaattccttcagaaaaattcccgaagaaattttaatggaaaaattggaaagcgaaaaaagggaattagaaaaagcattggaaacggaaagagaagcattgggagacgaaaagcacaaaagacaaatgggaacaaagtgagaaaagaaagggcaaaattcaaattaaaaaggcatttaatggaaagaaagttggaggaagagaaaaacagaggagagagactgaagaagacagtgcaaacactgcaggaacaattggagacggaaaagaggcagagaatggcaaatgaacgcaggtaaacgagagagtggcagagagacagagcaaaagggcagagaaacaaaggcaaattcagccgcaaagaggaaaaaagtgatcagcaacagaaagagcaaagttttaaagcgagtcgaactgatcggaaatgggacggtgaagtctcggacaacgcaaatgcgaccattggcaaccattcgacccgtattcgccaaaggcacggacaaaacgaggcaaaatgtggatgagagatgaactgaaacggagagagcagcagcagaaaaaggggggagaagggaaagaggaacagaaaaaagagaaaaaggagcagaaaagggagaaagaggaggacaacccgcaaaagaggaggagggaaatgagtgaaaatgggcgacggccggcggaaactaaaaaattcggatgatcaaaaccagataaatccaccaaacacgtagacaatcaaaaaaaaaataatcaaattaaagaaaataaaataaaatttgaaaattttgagaggggcgaaagagggagggacacgtgagcaaaaggggaggaaattggacaataattgaacaattggagtgtgacggagaaaggaatgcccgcagcgttattgtgatcgcaatcacataataaa

SEQ ID NO: 75518 - DNA, 291 bp, Heterodera glycines
  Genomic contig location: Contig_ID=SeqID_11996; Location=598..888; Strand=-
  SCN-specific regions: Sequence locations=1-30,68-88,118-291
atgtggggaaactgtaccgcaaatgccattgggggaggaggaggaggaaaaagaggaggaggaggagtgaatgggtgggaaatttggcatttattaaaaaaataaaataaataaattgccatttcagacaaatttttatacattagcatttgcgtgtctgctagaaacaaaaagggctgcttagaaacattaaaattacgaaacatgatgtggtgggaaactgtgccgaaaatgactttagaaaaacataaccgcgagtgagacgagacattttggtatttaaaaaataaa

SEQ ID NO: 75519 - DNA, 1423 bp, Heterodera glycines
  Genomic contig location: Contig_ID=SeqID_11996; Location=1116..2538; Strand=+
  SCN-specific regions: Sequence locations=1-50,74-157,180-280,302 -311,373-540,592-603,625-750,773-1000,1032-1171,1208-1423
atgtccctggcaccctctgctgccacttcttctacagtcggcacatcattaaccccaccagcagcagcagcgcaaatgctgttttcgcccttccaattgatgcaacaaatttcggctgcatcatccgtcactgctcaacacatcgcttcgtcaatgtcgagcagttcgccaccaacggcagcaacaagcagtacaaaaacggaacaacaaacaacaaatacgatgacaatggaaacttgtgacaacaattacagcagtttgatgagcaacaacggaatgcagaaccaccaaccaattcatggtggggattttgggaagaaactggataatttatatgaaaaaactttataattagggggaactgttcagaaaatttggtgtttaattaggtgaacattcaactgactatggaaacattaacaaaaaaagggggggataaagccaaagttaattttgttaaaattacattctaatggatttttatcttttttgaatatgtaaaattaatttggcacaatctggcgacgccgtggaaatatcttaattttaattcttaaaaaactttattaatttttcaaatttatataaaatgcaattaccaaaaaattattgttgttaaccataataaaaatttggaatacaaattaaaaaaaaatttagctgctgaaaatccgttgcacactttgccactttcggcactgcttcagcactgtgagcagcaaaagcacttgacagacgcaattaacaaactgcaacaacagcagaaacagcagacacaaaaccaacaaaatggtcgaacgataacggcacaatgccaaagttcgccaaatccaaattcggcattcagcgcgccaaatggacaacaaaaatgttgcaacgaaactgctttgcaacatgacgaggaggagcaagacgaacaccacaatgacggtaaattttcaatacactttttccattttgaaaattttgtaaaaaaaatgaattttgacaattactaacgttttaaaaagaaaattaattttaaaataaaacaatttgatcctggacgagatcgggatcccgccgggattttcccgggattccgatcctcggctttttttgttgaaaaactagccgagatcaggatcccgaacacaaaatccgggcggcaaaaccgggatttgaataaccgattatttttttttcatatatttaattattattttttcatttgccactaatcttaatagatgaaaatgacgactcgacactgacttccgcatctgtgaatgggtccttctcgaccgagtccgcgagctgtgccgttgccgcggccgcgtcactttgctccaatgccaacacaacacaatcactggccgaagcggcgggccgcgcgagtgcgccaccgcttgacgatgagcacgtgaagcgaccgatgaagtga

SEQ ID NO: 75520 - DNA, 1454 bp, Heterodera glycines
  Genomic contig location: Contig_ID=SeqID_11998; Location=70..1523; Strand=-
  SCN-specific regions: Sequence locations=1-139,191-259,304-417,501 -594,620-753,787-918,995-1130,1152-1263,1285-1321,1362-1454
atgcttgaattttcgctttggcttctctcattcaatgctttggctgcacaaacagccgaaatgacaacaaaaacggcaaaaaccacaacaacaaaacgagaaacaacacttgtgccactgacaaaaggtgaacaaaaacaatttaaattaaactaaaatatataaaattattgttttttagaatttatttctctgttggacgatgagaggcgttacaataaatacgcgactcccacccaacatttaggtgcggtttttcaatttttattttgaatttttttaaattttaattgaaaatttaaaggcactgccactaacgtgtcaatgtcaatgttcattgaaggcatttcaagtttcagtgctcagacaatggattatcagttggacgtttatttttatcaggtgattaaattaagcaaaattaattatcattaaatatttaattatgttacaaaaaaggaatttatcattaatcaatttattatttaaattcattaattgaaggaatggaaagacgaacggttgaaacacaacggatcaggtcccctgctgataagggataaagccgtttttaaggttgtttaaaatgttccctaaaatttttagaaagtttttgtttgacagaaattgtggcaccccgacatttattttgccaacgccagacaagcttcatttcaagaaataacagaagacaactttcttgtttggatttacccaaatggaaggtgaaaagggagtcaatcaatgcttttcaaaatatttaaatatttaattaaattttaatttgtttgttttttaaggatttggtacgattgccgcatttcgctggttgccatttgcatgatggatctgtggaagtacccattggattcccaaacatgcgaactccgtattctgagctgttagaaatatcatttgaaaaaatttcaataattttaaaaattttatttaatttaaataaatttgtatttttaacataattttcaattaaattccccccccccccctccccctttttcagatgcttatcccgaaaaccatctgcgcttgcggtggtccaaacgaattgatccgccaattgacagaaatatgggcatcaaaatgccgggtaaaaaatcatttaattgtttttgtgccatttaattttctgcaagcgacataattcatttttaagacatggaattggtccgaattaccaccggcgagtgcaatgggtcttatgtgacgggtttgaacttttaaatattgcttatatttttctgcaaattttcacaattgggttttcaggaacttggagctgtcagacggcagtgttttacggtaatttttaaaattaattataattattacttatttttttagtggaacgggcaatgcttcaccatatcatccagacttatgtgcctacttcgctgattgtcatcatatcatggtcagaaaacaaagttcattgg

SEQ ID NO: 75521 - DNA, 2100 bp, Heterodera glycines
  misc_feature (1259)..(1259): n is a, c, g, or t
  Genomic contig location: Contig_ID=SeqID_12000; Location=1..2100; Strand=+
  SCN-specific regions: Sequence locations=1-216,243-606,628-696,718 -923,947-1013,1035-1399,1422-1617,1639-1767,1789-1796,1820-2038,2071 -2100
  Gene Ontology: Mol. function=nuclear localization sequence binding; Cellular component=ubiquitin ligase complex; Biological process =protein modification
tttctttttaaattgtttctgaaaacatattaaaatctttccaaaagtaaatctaaagcaacataaaaattgtagatacatggcgactataaaattcaaaagtgcagcagcagccttttcattccatggccaatacaatgacatcgaattcaattccattgaatcggagaaatgccaactgcgttttgtggacacaatagagacagtgagaattgtatatcgaaaataaaaacaaaacttttgtttgtaaaattattatgggcaaataaggcatcattcatgagcaggggtcggcctgggtgaccttcgtacgacgtacggtttgcctagggggtggggtcggtcaggcccgatttttattatggtccatttttcgctttacctccatcgacgatttttaaccaaaaattactccaaaaaatttaggtctcaaccaaaaatttacaaaatgacgcatttgcaggaagaagaagctgccaacattgggggccttttggcagaccaaatgcattctgagccaccgatttgttcggtttgtttggagcggatggaggaaaacaatgtgttcaccatcctttggtttggccattatctttcgtaattgatgacattagactttcagtaatcactcatttcatgcggaatgcattggccaatgggcagacaccacgtaaaaatcggcgaacaaaaacgaaaatttaaataattccttttaaaggtgtccaatttgtcgttatacacaaactccagaactggtcccggatcagaaatgtttcggtacgtacgaaccaaagcagaaaaaactgctcgaataatgacattgactgtttttatggcaccaaatgcatattttccgggacattttcatttgttttaaatggttccctttttgcacagattgcggtcgtaccactgacctttggatgtgtttgatttgtgggaatgtcggctgtgggcgttatgaggctgcccatgcccaccagtgagttgagtgttttctccacacattcttaggcatttccccacaaatgtttttcggcattacgaaaagacatcgcacatttttacgctccaagtgggcagcaaattggtgtgggactacccccggtgacaattacgttcattcgctgattgaaagtgcaacggaccgcaaaatgatcgaatacgacggggggcggagcggggggcgcgacggaggtgaaaaagggggggaaaattcggggggattgggaaaggggggatcagaaggacgaggaganaatcagtgccatccaattggagtacacgtgtttgctgaccagccaattggagaaccagcggatgcattacgaggagaagttgcgggaaacggagcaacgtttcagcgaaagcggaagactgacccaaaagaaagtcagtgtaaaaaaataataatttaaattcctaagttaaatagtttaaaaaaatagttttttttgatgcccttttcttattttcctcttccaacctgggtttttattcctgtagctaaactcactcgaggcggagctgtgcaccgtacggacggaacgcgacgaggcgcggacagaattggccacgacgagcacagctaaacagcaaatggagaagaagtgccaacagatgcagcagaagacacagaacttacaacgtgaattggaggaggagcgacagctgaactcactgctcagcaaggataaggaattgttgggcaagcaaaaggaggagttggagagagtccgaagacaggtcggaggaagtggagaaacgaggggaggggggagagactgtcaattcacttggaaattaaaaaaggtgaaatcaagtaaacgcattcctttccaatgcctattttatttgtcaataaacccaaactctaaaagagtatcaacttttttattctgataccaggaaattgccgggttggaagagcaactgcacgatttgatggcacactttgacacgcaggcgaaggtacaacgacaagtggagacgggagcagtttcaaaggaagagttggagagcagcactttgggactgagcaaggaaaatggaagtggggggaaaaagcagcggaggaataaaaagtgacgaccaacggag

SEQ ID NO: 75522 - DNA, 782 bp, Heterodera glycines
  Genomic contig location: Contig_ID=SeqID_12000; Location=2309..3090; Strand=-
  SCN-specific regions: Sequence locations=1-310,334-782
atgccagtgcctgtcgcttctatgacatgtgagtaacgagcatttatcagcgaacaaaagaagggttttaaatgcggaaaaacccttcgaaggtatcacccggaaattggcattcttcgcaagtcgaagagttacagcgcattggcaccgacaaacgcaatgcgattgaagtaaaacaaaggaacatgaaaatgaaggcaaagtcctccaattgacagggaccgtttggtggcacccgacctaagaccttttcatccgtacaaaccgaagcggaatgaatggaagacggagctgtcagtcacatcggggcagtttccccacccaattgccattgctttttagtgaaaaattgcaccatggaacacatgcaaaactgaacattgcgccgtcgccgttccttccgccattgcctcccgtaaaagggacattttctgaagtttttcttagttcgcgtcccacagacttcgcgccgtcccttccaagtgccggccgatgcgactcgttttgagaatttctgtatgtattggggaggtcgggcgcgtggactcgactattcggagccatttttgtacgaaccgcagagagataactacagtattatggaggacagacggtaccatcgactgtactgggctcagcatatggtagaactaatggaaaaagcactgcccttccaaatgttcaatttcctcgcttccttagattcccagccaaccgtcggcacggcatggacgacaaattatgctgagtgcttattgaaagaattggagggaaaacaatga

SEQ ID NO: 75523 - DNA, 350 bp, Heterodera glycines
  Genomic contig location: Contig_ID=SeqID_12001; Location=917..1266; Strand=-
  SCN-specific regions: Sequence locations=1-68,90-138,240-244,273-350
atggcctcaagcaaaattaattttgctgagcgacaaatgggcagctcaaaagcggcaaatttagccaatggaaaggacaaattggcttttgaggccattcagctgagagatgggttttatgagggaaaaaaatcactggaaaaagagagaagagaagaaggagcagaagaggaggaggagaaaaggaggagaagggagaagagagcaggagaaaaagaagaaaaaaaggaagaaaagaaaaccggttcttcctcctcctccgccgccaccgctgccctttcgcggagagtgccgtccaaatgagacgaaaagcggcttcaaattaattttcaattggactgccaaataaa

SEQ ID NO: 75524 - DNA, 500 bp, Heterodera glycines
  Genomic contig location: Contig_ID=SeqID_12001; Location=316..815; Strand=+
  SCN-specific regions: Sequence locations=1-416,445-469,491-500
atgtacttccgtgccgactcgtgcccaatgcaagcagctgccgacatgcaattctgtgctgcccaaggccgcgaccaccgcgagtgctgcacgcgcaacggagtcggctcgactttggccggtgccaagtaatgtttttacgtcctttttgctcatagttgtgccattttcttcatttcgtcagatgtctcactttttgcaaccaaatccccggcaatgtcacccaattggacatgagttacctcagctgctacgaccgctttgagaatatgaagggatgcttttggcacgacttgcagcgccgtatgagccgcgaacatcggagtcggaagtgaaaagggacgaaacgaaggaaaagcgaaggacaattgggaatggacggatcagtccgggaggagaggaagaaatcaacaaatggccaattcctcctcctcttcctccgatcactttgacaattttcgtcgtccgatttatttttgatcattattcacttgcctatc

SEQ ID NO: 75525 - DNA, 2192 bp, Heterodera glycines
  Genomic contig location: Contig_ID=SeqID_1726; Location=472..2663; Strand=+
  SCN-specific regions: Sequence locations=1-675,697-756,797-1159,1181 -1590,1612-1615,1637-1698,1720-2192
atgtatgagatgaaagtgcgtaagcagaagaagcgcaacccaaacgtcgtcttccgggactccttcaacctaatgccttgctcactggccgcgctcgtcccttcatatgggctggaggttgaggacaagccgttcttcccccacatggccaatcgaccggaaaactacggcagggaaatccatccgacgcccgacgactacctggccagcggtatgatgcccagcaaaaggcggcaattcgatgcgtggtacgccgagaaccgtcatcacccgttcaagctggatgaggcattagcaaggtggtgtttctaaaaatgttgccaaagcccactcattttggctctctcagctattgcaccattgatgtggaaatcttgatggccgctctcgtcgcgtttcgccgtgaattcttcgacatttcccggcggcaagaatacgtggacggaatagacgatcgggagaaccacaacggaatcgacgttctgcgcgaatgcatgaccatcgcgggtgcatgcatgcgtcacttccgcaccaaccacctgcccgctgagcatctggccattgtccctgagcgaggctatgacaacgcgcagaaccagagcctgctcgcgttcaggttcttccactggtacgcggaggagcacggagtggaagtgcaaactgcccactcagccggaggagagaagagaatcggagcgtattcgctggatggatggattgaggcggaggggtgcgccattgaagtcaacggtgcacaaatttattttttatttttatttttatgaatataattttaggctgcacttggcacgggtgcaaaaagtgctatcccaacgacaacatgttgctccccagtggcaagacagcgggggaggtgcgcgagcgcgacgccaaacgcctggacttcctgcggcggcaagtgaaccgagtggacgtctactgggagtgcgaaatccatcggatgctggagcggagcagagaaatgcgcaagtcgtttgctgattatgtggatgatgggccgttggtgatccgggacgcgttcatgggagggcggacgggaccgctgaaactgctgcgcaaagcgggaccaggagagaaaatctcatattatgacttcacgtccttgtacccgtatattaagtatgtgtggtgctcgtcgtttttaaataataaaattttgaactttagtttcgtcactcgctaccccattggtcgtccaaaagtgcatgtgttgaaccggcaagtggagtggcgcagcgcagcggacaacccctacccattggcactgctcaaagtgtgggttgtgccaccccgtcgcgtcgacgtgcccgttctgccggttaaagttggagagcggctttgttttccgctctgcatcacttgtgccaaagagcatccgactggtggtgtgaattccgactaccactgcgcgcacaatgacagacaacgaggttgggtcagcacatgcacttcgattgagctcaacgcggcgctggacgaaggctacaccgtcacgagggtgttccgcgttctggagtacgagcagagcgacgaccaactgttccgcccgtacattgcggaattcatggctcagaagatccaggccagcggcttcgacaacaacatcagagggaacgccgacaaagaggagcagttcgtgcgggagtgcgcagagcagttcggcatcacaatcgacccgacaaaaatggtgctgaacaaagggaagcggtcgctggccaagctttgcttgaacaatttatgtaagtgtcatttttcagaattattttgatccaaaaaaataggggggcgcttttcgcttcgcaacttcggactgtgtcagacactgatcacggatgacccagcgattttggcagaatatttggacaacaaatcaattgaggtgacatcaatcgaccaattggatgaggagcacatactcatcacctatctccacaaaaaggactgggtggatgagcatgcctgctcaaatattggtgaggcacacacacacacaaaattcctactaattttttgtttcagtcatttctctgtggacaacatctgctgcgcgcctcgtgctgctcaaagccatgcagaaggtggtcagatcgccgggatccgagctgttgtacacgggtaaagcaaacagtgcacaaaaaccgaagatgaaatcagattattttagacactga

SEQ ID NO: 75526 - DNA, 815 bp, Heterodera glycines
  Genomic contig location: Contig_ID=SeqID_1727; Location=211..1025; Strand=+
  SCN-specific regions: Sequence locations=1-110,132-191,236-393,415 -712,734-815
atgaagagacgcgctgctactcttactgatgctactgctgagcaacatcccgagcccaaaccacaggaagagaccctcaaaaatgtcgagccgaaggacgagtcggcaaccaagaaacgcaaagtggaggaccgagagttgtggaagttggaaaagggcaaatttttgctgacgacctatttgtgtccgggtaataaacaataaaaaattattacatttttaattaattaattttgagatgattggaatcgactgttcaacaatcagcagaaggtgaaacgtgtggagggcgatcgtgtttgcttcagctttgatctgtgtgaggagtgcgcattggccaattgccgcgcaacggacctgctggctccgatgaaaaaaagacccaaaaatgacttttgaatttccttttgattcgcatttttatccctaattcagttgaattgttccatatttgggattatgcaataataatgaattttttcggcagtggccgcatttgaatctgtcacactgttaattaatggtcaataggcatgcgaaccgagcgcaggggtgggggaggggattgcatttcctttattcattaccaaatccatcgattccattgaatttccaacaaaaatggcaccaacccatcgcaaaggacaaaacccatcactgttcggaaccgcaagtgaccaaataatttaaatcatttgaaaaaatgggttttcaaggatgccatgagtgtcacggggaccggtgcatgccatgtgccaaattgcgagagcggaacagagaaagggcaaggatggggctgtgtcatgggcgcatga

SEQ ID NO: 75527 - DNA, 59 bp, Heterodera glycines
  Genomic contig location: Contig_ID=SeqID_1728; Location=679..737; Strand=-
  SCN-specific regions: Sequence locations=1-59
atgtggtggtggatttgtccgacggcggtgaggaaaatggagagccgagacgaaagcgg

SEQ ID NO: 75528 - DNA, 1507 bp, Heterodera glycines
  misc_feature (13)..(13): n is a, c, g, or t
  misc_feature (27)..(27): n is a, c, g, or t
  misc_feature (60)..(60): n is a, c, g, or t
  misc_feature (113)..(113): n is a, c, g, or t
  Genomic contig location: Contig_ID=SeqID_12004; Location=29..1535; Strand=+
  SCN-specific regions: Sequence locations=1-86,122-179,201-217,252 -332,354-404,428-836,858-929,965-1424,1447-1507
atgaaaataattngacagaagcgactngatgttttgctgatggtagtgaagaattattgngaaatgttcatgggccaaaaagttggatttaattattaattaacaaaaaatanttaaatttggaaatgactaattttgcgataattatttcatcagaaactttgaaaaattgctaattattgggaaatatttttaaaaatctacatttatgaaagtgaatttaaataatttaaatttaaataaatttatttccacaaattttgcacctccaaaagggccttaattgtgatgagaaaacgtgcaaagcgacgtgcaaattgccaaaacggaacagagaagtgccattgaaaagggaggacgaaaacccagcggaatatttctgttacccatacgaagcaattaagaaaatataattaattaattaattggaaaattaaattcagctgatttacgaccacgcaaattccattggttgtgccgttcattttgagaccaaacgcaaaacggagctacgcgccaaattggtgtgcataatgtgagttcatcttgaaacaaaaaatgccaaaaaaaaacggaaaaatgccattaaatttttaaggagcactgagcatggccacaagaaaatgctgcaccatcacaacgtattcaaagtgagtgccgacaaaattaatggccaattttggcactttctgttcaggtgggcccgtcgtgttcaaattgtgatcgaaatttcgaatgcgatgccaaaaacagattgtgcatgaagcgaagcaatccgagccaaaacggggcacaaatgccaacgatgggaaggggtaaaataaagcaaatggaagttaaataaatatatttaaaatggtaataaatggggcaaaagaaattaatcgggacaccgaaatggatttaaataaattcaaaaaagtaactccaaatattttttaatgaataattttaaattaattttcccccaatttttctcttttaaggcatggactaccaaatgagaaaatgaagcgagggaagaagaagcattggatagaaagaaagtggcaaattactgtacatttttttgaattactctcttacagtatcccctcccgcctttcagttttaaattactgtagatggatataatataccgtaacttttttttaaattttacacaaatatcaattgtgaatttgtgaatgggaggacatgaacgacatgaaactgaaaggacaagcgagcttttggcacaaagaaaagccatgacaattaaattcgatttaaaccgaccaatttaagggttgcccttgtaaacatgaaatttgattagaaatttgcctatcttaagagagaatggcaattcgacgtggaaattgcgacagatagaaaatgccgacacttttttcgactcgatacagagacgttcgagcagtacttgcagtttgaaagtagaagcattctccactcagcagctgacttgtcatttcgatcacatttgattttactttatttggcctaa

SEQ ID NO: 75529 - DNA, 2024 bp, Heterodera glycines
  Genomic contig location: Contig_ID=SeqID_12005; Location=87..2110; Strand=-
  SCN-specific regions: Sequence locations=1-277,299-735,772-1022,1051 -1091,1139-1351,1376-1767,1789-1795,1819-1984,2011-2024
atgtccagggtgagtttgggggcttttcttttctctgctctgattgtgagtccattcttttttagggtgctgctccgcctccccttcttccgaatcaggccaagaaagtggtcatgaccagcatgccgtatcacgggcgtgtgaattaccatcatcagcaacagcaccatcaaaatcaaccccatcatcaaatgggtggcggaggcggtggcaccggtggtggtggtggtcgtttccatcaatatcaccatgggttagcaaaaatgttgtctgtttcaatccctcattctttcattttacagcaacagggttagcactggtgggagcgttggtggtggtgcgggtgctgggaatgtgaacaacaattttgtgcgtcgttcgccatccatcattgacagacgttgtgaggagtgcggctcgcaggagcatacggcgctgttctgtccgaacagtgagtttccgttaaacacaaaaattgtcgtggctcatacatttacaaaaaaaagtacaccaccaacctccctcaccgaattggaaactacctaattatattattagatgcgtttacgacttataagtttttggaattgttttttccatcattttgtggccaaaacggcaaaagacatgctttattcgataatacttttcattattttcagcaaaaaagcagcgcgcactgttggaaatattcgctcatgagttccaagtggcggctggccatccggcactcgtgcagcaacagcagcaaccgcagcagcaacatcagcaaccgctgccgcaaaagccgtatcctccgtaccctcagcaaccgtactcgcagcaaccgcattcccatcagccgcatccccagcgaccgcgcaatgttcaccatcactattccggggtgcgtcagttgtgtattttaactattaaatgcattatattctcattttaatgggttttgttgctttatggcgttgagatataaaaattttcatcgaagttaaagtgtttaaattccattcatttgtctcccttccatttttttaaattttattttcttattttgcttttttaggctgttgtgtattcttcgtcgcatgcaagccgtggtggtggtggtggtggtggaggtggcgctagcggtggcggtggttgggtgggcagtcaacggaaatttcgtccggcgcagaagtgattttttgtgtgtatggcgcttgctcgtttttgatgacagccgattttttgattttttgttgaagatatatggcgcagcatataaaatatttaaatctcatcatattcacgcaattgtcctgattttaatgacgacaaaaaaatgaaaaagaatttcttcttcgaccatataaaaatttaaaagaaattagtttcttaattggcattggcaatcccggcacttcttttactttgggcaacttttgttttcaaaaattgtgcatagttcacccggaaaaaccacgctttcctcggcaatcatgtcttttactggtcccgaacaaatttttttttaaaactaaaaattctaataacatatttctaggggtattttgaggcgcagagtgcgaatccggcctcctttttaactgatttccaattactgtaatccgtaattatgtccagccctcctctcgattgactgtgttccgctcatctatattcaattccgatacattcctgggggatgggttgtcaaatggctcatttgttcaacaacagatgcgccgcatgaggcccacccattcgctcgatcattgtccaattgtccctcattttcttccccttcacaactcaaacactaacaaaacaacaacaaaaggggggggggggaaattgaagtttttcaccccaatgataactgtaaaaatagttaatgtactgcaattttaatgaactggttcagctggtggatgaaccataggtgccattttggaacccttttgacattggaaaatggccatttgtttgtgtgctgcacatccgtttcccatttcccattttcttttgggtcaaaaagcaataaa

SEQ ID NO: 75530 - DNA, 566 bp, Heterodera glycines
  Genomic contig location: Contig_ID=SeqID_12006; Location=1956..2521; Strand=+
  SCN-specific regions: Sequence locations=1-236,266-566
atgaaacaaaatacatttgagaatagtgaaggtgtcaaggcatatggtaagaattaagttgagaaatggttaatcaccataatagagtcagtcgatgtcattaaacattaattatagagaaaatgcaaatgtgacacattaaactagaggagttaataatatccgtgagatatttggtcaaaataggaaatatgttaactgtccatcaatcacataaagttgaatattaaagctgacaatgagaaaaaataaataaatttgaagatgagcgattatggcgtcggggagaggtcgaggatcgagtgccaaatggggctgttgtccaaattggacaccaacggctggacaagcatctgaacgcgaattttttcaaagtccctctggaaagagagcaagaaggtcattttgagcaatgccaaagtccattccgcaacggcggagacgcagtggaggttgtagccctgaagaacacaaaccaaataatgtttaagccagtcatgccacgacgtacgggaagaactccgtgtttccgattccatggtctcggagtggggaggtccggataa

SEQ ID NO: 75531 - DNA, 454 bp, Heterodera glycines
  Genomic contig location: Contig_ID=SeqID_12006; Location=666..1119; Strand=+
  SCN-specific regions: Sequence locations=1-131,153-282,304-454
  Gene Ontology: Mol. function=transcription factor activity; Cellular component=nucleus; Biological process=epidermal differentiation
tcgaaaagcaaatcaaacggaacaaagatggaaggccgaggaagcgatcacagcacacaaagggaaacaaactgtgggaattcatcagagacgcactgaaagacccgcgcacgtgcccatccgtagtgaggtgaaaaaggggggaaagtgccaatggaagggagtgccaatgaccggccatcgtttgcctgcaggtgggaggacccgacggaaggcgtttttcgaatcgccgaatcggaacgattggcatttttgtggggtcaaaagaagaacaaccaaaagatgacttacgagaagctgagcagagcgatgaggtgactgactaatgaatggtgtcaatgacaacattcggactcaaactaatcatgccacccctttaaggacgtattatgagaagcaaatcctcgtgccggtgccgaagtcagggctttatcctaaggtgggcgagccttag

SEQ ID NO: 75532 - DNA, 1839 bp, Heterodera glycines
  Genomic contig location: Contig_ID=SeqID_12006; Location=1425..3263; Strand=-
  SCN-specific regions: Sequence locations=1-361,383-516,538-687,711 -1043,1073-1304,1326-1344,1387-1476,1499-1596,1640-1688,1711-1839
acactcattctttgttttaggcttggtgctggtcatttgcccattcttttcgctgtttgtttcgcgactatgctcggtgtttttattccttaaattgatccgtcgtcattacttttttcaatgccattccaactccttcaggctgtacttacgttttctccgtttggcgtggtgatgttgaccccgtcttcccttacatttctgcctctggtgaccttcgccccgagtcgtgcattttctcaatgttgctcaacatttgctcctttttttcgatgcttctcatcattcttaggttttttattcccatttgccattaaatatgcccaatttattttcaggtacagcctcgtcgttgagctcaaccgaagttcggatctgagactgagagcggtcaaccgattggcattttacgttgggatgttggctggcctcggcatgttcatcgtcgccaacgttcaagagactgcagtttttcaaatccatttgctcggcgccctcctctgcttcggatccggctgtgtgtacatgcttcttcagtcgtggtgcactctcagaatgagtccgctttacaacgaccctcaaatcgcttacattcgatttgtgattgcaattgctgcttctctttgcttcgtcactggtcagtcttctcgccttcgttgattgcctcaatcactgctaaaccgcgctcaatttctttagccttttcctttgggctgatggcttccatcactttccaccattattatccggacctccccactccgagaccatggaatcggaaacacggagttcttcccgtacgtcgtggcatgactggcttaaacattatttggtttgtgttcttcagggctacaacctccactgcgtctccgccgttgcggaatggactttggcattgctcaaaatgaccttcttgctctctttccagagggactttgaaaaaattcgcgttcagatgcttgtccagccgttggtgtccaatttggacaacagccccatttggcactcgatcctcgacctctccccgacgccataatcgctcatcttcaaatttatttattttttctcattgtcagctttaatattcaactttatgtgattgatggacagttaacatatttcctattttgaccaaatatctcacggatattattaactcctctagtttaatgtgtcacatttgcattttctctataattaatgtttaatgacatcgactgactctattatggtgattaaccatttctcaacttaattcttaccatatgccttgacaccttcactattctcaaatgtattttgtttcatttttattctgtattaaacattttactagacatttacatatttaaatcaatagataaattatataaagataaaatttatgaattaaccgggtcatttaaaggaatgaatcaaatggacaaataggaaaagaatatagctatagaaaatcacaaatattctgagagagtaagcacagaaatgggaagcaaaattttgtttcctgaaccggacaatcaaagtaaaaacattgtacttgtattaattaatgaaggaaataaataagaattaaaaaaacataaatttaagcaaagagaatctgattctgcggctattttatgaaacgaccaaaaaaggtcagtctttcgtaagagaagagaagagggcaagaattgcgcaattaaaagggaagggaaaggaatggccaatttggtctaaattagagagaacagaacaaagagaaagggacggggcatcggatcggtttataaaaccggtgaaaaggatataattagtcaaatcccgctccaaaaagactactcgggtgaatcaatc

SEQ ID NO: 75533 - DNA, 1418 bp, Heterodera glycines
  Genomic contig location: Contig_ID=SeqID_12008; Location=275..1692; Strand=-
  SCN-specific regions: Sequence locations=1-133,188-456,489-823,945 -1137,1182-1371,1405-1418
atgttggcgacacttacaccattcgttttgcacctgcgcgattggaatgcgcaggttattaccgcctttgtgccgagaacagtcgcggatgggtggaggcgcaaacgctcgtccacatccggcccaaagtgactaattattattattaaaaaaaaatttttttaattaataattttatttaaaatttgaagtctatgattccgaaaccattacgccaacggcgctcacttggcgacgcgcgcctgggcgccggcaccggtggcattcaggcgctgttgcgctcacagcatgaacggtattgggtaagcaattttaatgaattttgaaaaattttagaaaccacgaaatctttaattttttccaaataataaacacgtataattaaaagtggaatttaattaccttaatgaacaaattttccatcaaaattgtacagaaaaactgaattttgaaaacaaaaataaaatgaaaatttataaatttttattcaatgatgactaaatacagaaaatttacacaacttttcaaggggtgcacttcgaaattctaaaataattgcaaaaaaaaatagtagaaaattgaaaaaatttcttacattttttattgaaaattttctgttttttttttaaatttatcggggaggaaaaacgcaacggggggggggggggaagaaagaacggttgggaacgtttgtgcacaccaaatttggcagcattcaaaataaaaattggtgatattttaatgaggttttgttattaggattttacttttaaaaacgtttcaaattgaaggcacaacgaaagcgtgctttgagcacaccgccacagcaacagcaacaaaaccaacaactgttcatgcgcacagacgaacaacaaatagcaggaaaagcagcagcaacaaactcattaaatcaacaagcgcaagcgcaacaacaacaacaacaattttatgccatttacaatcagaagcaacaaaatggtggacacaaatggcagcaaattacggcactggcatcatcaattaaggcaacagcagcaacaactacagccttggcgacacggccacaactgttgatgaatgggacaaaacagcacaacgagcagcagcagcaatttgataaaagggtgaaggatgttgaattaataatttttaattggattttattttaagatataaattttggaatattagaatatattcgtgttattttttgaaattatcacagccggtgatatttttgctttttttaagccgatataagaatggcccaaataattaagccgttttaagagccaaggaaattaactgttaatgctatgctaccaatattcgccatcaacccgcaaaaatttaaaaattgtcttcatttcgaaatttattttaattattttataaaatatttttcgcaaaataataaa

SEQ ID NO: 75534 - DNA, 877 bp, Heterodera glycines
  Genomic contig location: Contig_ID=SeqID_12009; Location=93..969; Strand=-
  SCN-specific regions: Sequence locations=1-141,163-223,262-441,476 -483,506-778,870-877
atggaagccaataacaacactgatcaccaccagcaacggcggcatactgatcagcgcagttggggcagccaaagtgtggcctcgtcaccgcgtggcattgtgtacacactgagcaaatcggaccgtgccgagtcggcacggagcagtgattttgaggacccaggcttaggtcggaacagatcgtccccctcccatatgcgtagtttctccccgataattttttataaaaagattctaaaacaattgttttaaggaaaaaatcttagaaggtttttataagaaaattttcaagaaaaaaattctgaaaaattttggcgattttttggaaaaattctgaaaaacttaatattcagcataaaatttcgaaaaaacgcaagaaaaatttttcgaaaaattattttcttaatttctataaaagggtttctaaaaaatttactcgataaatttgagtttgaaaaaattttaaagaaattttcgggcgggaaagaaacggggtaggggttggaactcagtgcacccggcttaggtttttgcggaaattaaggtcttagtgatatatttttcaaaaaatttcaggctatagcagccttgccaatccgcccgaattcatccgcgcattccaaaccgaagtgaccatcaatgaaggcgaattggctgaggtggactgtctgatggtgggcaatccgaggcccaaaatccgctggttcttcaatgatcgacccgtcaaatccagtcctggattttttgaggtaaaaaattgttggaatattgcataagcaattaaattattcaattttaattttatttattattttaataaaagtgaaatattattatttttagctcaaattttaaaatatttttattttcgattaaa

SEQ ID NO: 75535 - DNA, 254 bp, Heterodera glycines
  Genomic contig location: Contig_ID=SeqID_12009; Location=1335..1588; Strand=-
  SCN-specific regions: Sequence locations=1-59,156-254
atgtactggttggacttgatggtaggccccccaaaactttcatttttgtatttggtttgattaattatttaataatatattttcatataaatttgaaatttttttcaaatcattaaaaaccttttacattttaattttttaaatctaattttttagaaacaacctcaaaaacaacattcacgacaacagctacaacaagtccaaccagtggatttgattcgccgcaggcaaacataaacaaaaaaatcaataaa

SEQ ID NO: 75536 - DNA, 837 bp, Heterodera glycines
  Genomic contig location: Contig_ID=SeqID_12010; Location=167..1003; Strand=-
  SCN-specific regions: Sequence locations=1-47,69-105,127-161,212 -226,265-312,343-520,542-570,637-763,785-837
gtttttgactataatccgatcaaaggaatcaccataatgccaaatttcgaccaaactcctgccaaaatgaattacaaacacaaaataatattggctatgaatggagatttatttttaaaattttcttcattcattttaattcggcagaatattaggacatgaaatttttttaatatattatttaattttgcatgtttttaaaatttttttagatgtttacagaattagtagcatagaatatacattatttataattttgtatttaagcgtattatttgtttgcttaagtttccgtcgtattgcataagagtaaatgatatttttctttaaaaactttatataaaataatgaattaggcaaaattgtcatttatttacagccgttttgtaaacatttaataatcagctttagaatttattttattttttcgttatttttaatttagacaagctgttttataggcattttcagaaatttatatttttactggatcagttttgtttgcagcaactgaatttaatcctatttatttctatggaaaatgattaagaatttttcttatgtacaaagtaattattatttttattatcattttctttaaaaatacaattaagtataaaatttaagtttttaattcaatcttcaccacaaattattattattttcacgcgtcaccttttacaatggcttcaaaatttgagccaaagtctgaaaaaaaagaaaatagattatttttaagatttcagaattttcttttattcaattgggcggtatgatgtgataatttagcaggctacaatttacaattcaaatgaaacttttaaaatgtaaaataaa

SEQ ID NO: 75537 - DNA, 723 bp, Heterodera glycines
  Genomic contig location: Contig_ID=SeqID_12011; Location=409..1131; Strand=+
  SCN-specific regions: Sequence locations=1-8,31-334,356-723
atggcatgcgcagtcgctgcagaacgagctacaattcaccaagagctgcaacgattaactctcatcacggagctgatccgagtcgaagaactgcaggaaacgcaggtgaacatcacgttcaggcaccagctgaactccgtggccgaaatgatggacatgttgcaaatttgggaagaagacacggcaatcaactgccgcgtcgaccaaaatgacgaaaccaagccatgtgccctcggatttggcacaggtaagacgtttacggcggcaggaatcatgtctgccatcctgcgcgaggatccgtcggcacgcatcctggccatggcaccgcccaacattgccgtctgtaagctggtgctggaaatggagaaagcactgcgcattgagggacaacccgagccaatgatcgctctgttcagcggcgcgggaaaaatcaactatgctgaagagttgaggcgcatttctcagcacctcttagcagccgccgtggacactgaggaattccgtgagcatttggaaataccagacacccgaaaagtggacaaatacgtcgccgcgtgtgcgcgtaacccgagattggcccaagaaacgactgtggcccgcattctgaaagagcatgctgagcgccgcatctacttctgcacactttcatttgctgaacagacagctgaactctttgccggcatcactcatctcctggttgatgaggcaggtcaagccccgtaa

SEQ ID NO: 75538 - DNA, 245 bp, Heterodera glycines
  Genomic contig location: Contig_ID=SeqID_12012; Location=604..848; Strand=+
  SCN-specific regions: Sequence locations=1-245
atgctcttcgatcttaacattaactcaatcaattctggtcgtctttcccaaatgccattgattacggcactctcgtcagaaatcattgaattggtcaacaatttcaaggaggtgtgccacattttcgtaaaatattttagattaattgccaattcattttcgttgcccatttttaggcatttctccatgccatcacttctgccagctatgaaattcaatttactgtttatgcgccatttcaatag

SEQ ID NO: 75539 - DNA, 1465 bp, Heterodera glycines
  Genomic contig location: Contig_ID=SeqID_12013; Location=849..2313; Strand=-
  SCN-specific regions: Sequence locations=1-151,189-639,661-1332,1358 -1465
atggcacccgtcaaaaaaaagaaaaaactttcctccgccaatcaccgcctcatttctgcaactgaacaacagaaaccgttgggctcatttgtgacatttggaaatcggcgaagtctccgtgtggcaatgaaaacgaagagccgacggtaagaaatttttaaaaatttacaatttttaatacaatttttccacatttcagttggatttgcaacgacatttggatggacattttgccgctttttcgtcgtcgtcaactcggtctcaaaatggcacttctttcgccacgtttcaatgcgttggtggacaaacatttcgatggcaaaagcgaactgacaatttggagaccaattagaattgacaagaaaggaacaaaagcaaaattgtttgttgagaagagaaatggcaaaagtgtgcgattttcgttgcccgaccattcgctgaccaacaaaagtcgttttaagcatcttcggatttggtaattcaattccaacatggattaacggacataaatattcctattttcagccacatcgaccattccgtcatcacatttctccgtgccaaccagcaaatttttgacaaaggcatcaatttggatttgcacgtgccgcagttctcctataaagccaagaatttccagccaatttggaatgcttttgcccgtggaatttggccaatttttgcgccaaacattcgccatttgaattttgccaaggctcgtcatcttgaaaatttgcttcgctacacttcgccgacaaatctttacgacctcaatgtcaaatcaatcgattccgatgatttgttgcccgcggtggttgctgatgcaaaagggccaaatgcaactgctggccaagcattgtccaaatggttgcaaatgccgagaagcgatggccagccaaagcaattgagttgttccggttatatgtataaaaccactgaattggtcgacaattttaaagaggtgtggtcacttttttgtaagattttggattagatgccatttgcttttcgtttcccattttatagtcatttctccgtgccaccatttcttcggccagttacataattcgaattaaacttcttgagtcaatgccattatttgcgccatttgaattgacgaacgaacggaccaacgaaatgctgacattggagaaagaaaacagtgatgaaaatgcgaagaaagaatacggttataaatggcacgagcgatgggtaatgaagcgatgccaaattggggagacaattcaatgggaggacgaaaagacggacaaattgaacaatgtcgacttatcgctttgtggaacttcttgcattgggtgagtggaagcagcattttcttttgtttaaaagtaattcaaattgcacttcgtttaggccattgtctccaccaaaggcggacaaaaagaatgcaaaaagtcctctgaaaatgagtgccgggccaagcggacagcgcaagaaaaagtga

SEQ ID NO: 75540 - DNA, 138 bp, Heterodera glycines
  Genomic contig location: Contig_ID=SeqID_12014; Location=335..472; Strand=-
  SCN-specific regions: Sequence locations=1-22,45-115
ttgtttgccgttggcgtggccttttggcttttggaaaaggctgctgccgcccgcctcggccccatcgttaacggggagccgccggactgcgtgccgccgtgccagccaaagcagcaaaaggaggaggaggaaatgcct

SEQ ID NO: 75541 - DNA, 837 bp, Heterodera glycines
  Genomic contig location: Contig_ID=SeqID_12015; Location=251..1087; Strand=+
  SCN-specific regions: Sequence locations=1-515,546-547,576-837
atgtacccaaaaaggtacgtaaaaatagaatagagaataaacaatatactgtataccgtaaccccgtcaaaatttgtgaataaaatacccaaaacggatttgcctggaagaattttatgccactgaatttcgaattcattcctactcctacaagaataccgaatattcaaatataatttggtatttttagagtggtcgtaaacttccaccagggtggcagcgattatgacgacatgccattgcatttgtccacccgttgggatgaaggtaaataaaggccacggatcaaacagatttttccgaagattttgacaaccgtaattatttttttccgaaatagccaaaaaaaaaaatccatcgagaatctcgaccctaaattgcattattccatctttgtcaggactcttttcgggcaatgtcgtgttcaacacgtacagccgtcggaattggtctgaaccggaggagcgagtttcaagtccatttccggctgatggagaattcgacattcgcattcgacttttgcctggaaaattccaggtccaaaaggatttaaatttgaaaattaaaatttaattctggcatttacttttgaaatcccttttttaaatgcaattttttgtaattttaaaattgaaaaaagctcggactaaaatttcacgagataacgaaattccagcttgaaacgagacgggggagaaagactccaaaaccgttagttgtgattcgagatcgagacttttgagagcactattagcgccttcctcgtttccttttttgcatccccgcttccgtccccgattatcatccacgtccttgaatacttaacattttttgtga

SEQ ID NO: 75542 - DNA, 760 bp, Heterodera glycines
  Genomic contig location: Contig_ID=SeqID_12017; Location=1383..2142; Strand=-
  SCN-specific regions: Sequence locations=1-610,632-760
atgggcgacacggaggagtacaaagagaagaggcaatttgcggagcaaattgtgaggtgagaagaattaaacatttgttagaggattatctaattaatgtttagcctttaattaccaaatgaaagaaaacgaaagtgacgtccgtctgaaaatgagtaatgaaagccgttattctgatgaaagccagacgaagtccaaaaatacattcacaagacccaaacattgttcaattgaaacaatattttaacgataaattcatatgataaaagtgtgcggatttatatttataacgtggtaagggacttttggggatttgcaacttgggacccaacatttggggacccgactcttagggaacccggcatttggggacccgactcttagggaacccggcatttggggacccgactcttagggaacccgacatttggggacccgactcttagggaacccgacatttggggacccgactcttagggaacccgacatttggggacccggctcttagggaacccgacatttggggacccggctcttagggaacccgacatttggggacccgactattagggaacccgacatttggggacccgacacttagggaacccgacatttggaatttttaaaaatgaactctgtttccggactcaccgcgatgaggtagcagaattttgaatcgggtctttaaaagtcgggtccacaagttgcaaaccccaaaagtcgggtagtcatttaaaaaatgcagaaatatttaaataaa

SEQ ID NO: 75543 - DNA, 756 bp, Heterodera glycines
  Genomic contig location: Contig_ID=SeqID_12017; Location=2643..3398; Strand=-
  SCN-specific regions: Sequence locations=1-113,136-294,316-528,551-756
atggaaaatgccaaggaaaagacagtgccaaaggcatttgaaagtggcggacgaaacccctgaaaaagcgacacttgtctttttgagagatttctccgtttgtttcagcccttctccttttgtcgtgcattgacttcgtaagtgccgtttcggacgacggcgcgccttttctgtccgaccaacagaaacgtggcggtgcgcgcgccttcaatctctttgcttctgctgctttcccaccgccgaatgagaagagaagcggcggacgtgcctttggaggttcgtcgagtgattttggcacttttccaattcatttgtcagagtccgttccgttttcaggtggcattcagacaattaacgacgatttcgatgctaatttggctggagaactgaagcgtgccggtgcccggttatttcggatgagtgacctttcatctgacggggacagtttcgtgccggaagggacaaaacgcggtggtgccaggcccttttacggcggcggatacattgacggagcgtggaaaagaggtggaacacggagaacaaatcgaacaaatccattgcttacagcgggtggacgatatttcttgcgtcaatttgacgatgtgccgtttggcggcggatggatggccaaacgtggcggcggtcgctcatttttcgagtgggcaacattcattcgatttgcttattgcctcggggaacttccaaaaatgaaatgccaacaatattaaccccgtgccaaggaaaaagtttaataaa

SEQ ID NO: 75544 - DNA, 500 bp, Heterodera glycines
  Genomic contig location: Contig_ID=SeqID_12018; Location=772..1271; Strand=-
  SCN-specific regions: Sequence locations=1-17,39-83,106-152,174 -191,214-268,316-461,483-500
atgtcgcaattcgccattttccttctgccaccactttttgtttggtcggccttggttgattcttgggctgattgtcttcatggtcatcattttcttcttcgttttcggggcgccattttaattgaacacctcgtgaacacatctaacaatacttaatttattctctaatttattttcattttcaatgctcgtgtatttttgaatattttttatgctcaacaacgattctcatcagataaaatttatttacaatgattaatttaattttagactgttccaaatgattttattttcaaatgtttttatgtttcaaataattgccaaaaaagcaaaaactcataaaacataaacaacaaattgtcaaaaaatattatctaaatgttaaaaaatgaatttttgacctctttaggcctaaaaagcgaaaaattttaaaataatttagaaaatcttctttgagaaagtcatttaaattaattcaattataaatgcaccaaaataaa

SEQ ID NO: 75545 - DNA, 718 bp, Heterodera glycines
  Genomic contig location: Contig_ID=SeqID_12019; Location=179..896; Strand=-
  SCN-specific regions: Sequence locations=1-48,71-126,148-410,433 -442,488-718
atgtccgctcggatttacaccactttctgcggagttgaagaagcagacaaagaagatggaggaacagttggacgaagaaggcggcgacgacatcaaccccaaaaagagcaacgttggaccatcgttggaggaggagctgaaactgttggagaaaagtgcggacagtgaggacaccacgcgcagcaggtggcaggcagcggagtttgtttatataaatgtataaaaactcatttttatgagttcaattcaattagtaaatgccatttgagcaagcccggaaacaatttttagagacttgggcagtgacggtcccatgatttcggcttaaggggggggggtggatatttcccccgggcgacgattttttttgcttttcgcacttgtcttgttttgaagcacttttctcaaaatttcaccaaaattgctaattttgtgatttttgaaaaaatatttcttaattaattaattctttttatgaattaaatttgccaccaagtttcagcaatgctaccgcagccgatcatttgccaaatcaggtggtcctgcagtgccgtgaccaaatgatggacaattcgcttggacaaacggatgagacaaaaagtagcgccgacgacaacaacaccaaaaacagcgatatcgctggtggaccatcgttggagaaagtactgaaaccgttgaacaaaagtccggccaaagaagacaccaagcgcagcagcag

SEQ ID NO: 75546 - DNA, 368 bp, Heterodera glycines
  Genomic contig location: Contig_ID=SeqID_12020; Location=839..1206; Strand=-
  SCN-specific regions: Sequence locations=1-126,154-201,252-284,306-368
aaaaatgataaaaattattatgaaaagaaaaagcaagaatttattgaacgaattgatgagatttacagaaggttaagaaaaggaaaacagaagcaatttgcgaaagaattggacattgaccaaaaaacattcattaaatggaaaaaagaatttggaattgaaattgacaaaagtgtgattcaattaaaatttgaattaaaatttgatttttttttaaatttttattttatatttatattttattatttttagatggaattcggtattcgaatgaagaaaaaataagcaaaatgaatatttattataaaatgaagaaaggaactccttcaccgagtgatagagaaattgccggattattggaaatttga

SEQ ID NO: 75547 - DNA, 877 bp, Heterodera glycines
  Genomic contig location: Contig_ID=SeqID_12021; Location=181..1057; Strand=-
  SCN-specific regions: Sequence locations=1-54,76-164,186-764,787 -839,861-877
atgctaaggacggcgtaccgcgggatggttttgtttgagggagaattggctttaaaaatggcactgctaaacaaacattaccttttgctcgccgttttatgcgggaaaataattaactattttgagcagcaattgacagacgataaaaatgaggacaaaatggcaaaacttggaaaatattggaaattattcaaacggaatcttgagagtttcaaagcaaataaagaattggactccatgaaagggttgctgatcaaattaaggcaacttttggattatttgagggaccaatttggggaacaaaaactgtcgagcaaatggcaaatgattgtacagcgaatggaaatgatatttttcgaagaattttatgaggaaagtgatgaattcagaaaacactttcaaaggaataaaaacacggcgatgccaatgttgacaaaggtttttgcgtttgccgaagagaagtggggaattatttcgccacacttttgggccttaggtaaatattttaatcaatccatgggcgactaattaaccatgcactaattaatgatgccttggttcgttggaggccaaacgaaacattaaaagttaattaatttgggattgtcattaagacattaaaaagtctgaaaaaactttgtcaataaatctaaataactaaataaccgaaatagcaagtattatttgtaatgaaatgagtgaatggattgattcattaatttcgcttaattaagaaaaattgacaaatgaaatggatgaaatgtccatgacacagaatgaacaaaaggcgtcgctccttattaaatgcccaagcaaaataatcccattggaaatgctgcaagaattagatttaaaagaaacagatgaaggcaaataa

SEQ ID NO: 75548 - DNA, 1418 bp, Heterodera glycines
  Genomic contig location: Contig_ID=SeqID_12023; Location=601..2018; Strand=-
  SCN-specific regions: Sequence locations=1-220,256-422,464-1231,1284 -1418
  Gene Ontology: Mol. function=anion exchanger activity; Cellular component=integral to plasma membrane; Biological process =reproduction
atgctaacgacgaaaattcgtgccacaagcccgaaaaaggtggtgacgaaattatttccgatcgtcggatggctgccaaaatacaatttgcgcagcaatttgcacagtgatttggtcactggagtgacaattggcattatggtggtgccacaaggtgattttgtttttatttaccaataatgttacaattaataaactgccatttttgcggcggatgcggtaaaaattcaattaattaatttaaaaataattaatggtagtacaatttaaaataatataattgtgatggctttagcgatggcttacacaactttggcgggcgttccgccggctgttggcctttacacttgcttctttgcggccttgttttatctgtttttgggcacatcatttcatgtttcaattggtgcgaatattttctctatttttaatatatttaattttttattttatatttttttatggaataaaatcatttaaggcacatttgcggttgccagtatgatggttggcaatactctggcgaaattgcatttgaatggtgccgataacaaaagcaatttgactacaaatggcacagagaataccacggcactttctggcgctgatctgaacccattggtggtgaccagtgcaatcacttttggagcgggactttttcaggtattaattaattaatagtcccaatcccttccctcttttggcttggtccctctcaatggctgcctaattgcccaatttttttgaataattaattcagcctaatcaatttatattctgttactcactccatatgaataactaattttacaatgttcagcttacaatggccgtctttcggctgtcttttctgaccgtttacatctctgatccgctggtcagtggctttacaacagcggccgcttttcacgtgctcgtcgcgcaagtgccaaaactgattggcgtggcatcgaaaccgtacggaggcccgggaatggtcattttcgtaagacatttcgataaattttatgacaataatacggagaaaaattgtagagaaattgaatttctttgtcagatgttgcgcgatttgtcactttcattttggcatgccaatttgtggaccgttggcatttcgctgtgcggcatcgtttttttgagcgttggccgcgactttttgaacccgcccttccgaaaacgttttaacgtgccgcttcccttggaactgattatggtaaggaaaaattaactcaatttattaaattccatttaaaattaagcaaattttaaatttaaattttaaaggtgatcttctcaatcggattctcagtgctgttcaaaattgaagaaaagcacagtgtcaaaatcataaaacacgttccaaatgggtgagtaaagcaaacaaatggacaatttttcaaagttttttcagacagtaa

SEQ ID NO: 75549 - DNA, 1449 bp, Heterodera glycines
  Genomic contig location: Contig_ID=SeqID_1730; Location=132..1580; Strand=-
  SCN-specific regions: Sequence locations=1-55,79-296,318-388,411 -430,452-457,480-787,811-1055,1077-1107,1130-1449
  Gene Ontology: Biological process=development
gagtcgcctttcgtccgtcattattctatgtcctcatttggctgtaagttttcctctccaatttcccatttttattttcaatatttaagcacataattccgaagcttcgaccagcaccaattttctgctcggcactttttcgtcgcaccaaaacagcagcaaataccgcgcctacgcgtccgccgtggacaaagcgctcaaatcgtttgagtcgaccaccgaatgggccgatctaatcgcagctttgggaaaactcggcaaagtttgttagcgctttttaggccgagaattccgattttctaattaaaataactgaatatttattggcttttaaatgccgggaaaatgcaattctcatagatctattaataaatttttcgacggatgtgaaatgaggtaccgatagatttaacgaacttttatgaaaatcgggccaattttataaaatcttccgttaaaatctcattttctaggtttttgcgtccaattcaaagtcgttcaacgatattccaaatcctctgactgttgccaaacgtctctcccaatgtcttcaccccgcacttccatccggtactaatatttgtcataatttttctgtgtttaatattttgtcaacaggtgtccatctaaaggctttggagacgtacagacaagtgttcaacatcctcggacattcaggacacaatcagaacttggccagatcactgtttctctacgcaattggcctctttcccgtaaatttttttattgggtagtttctgtttctgaagtcgtacgtagttcagtaattaaaaacaaaatttaaattttttcgacaaatctgaattgtttatctttctcgagagcgtttcaagcacttttcatgaaatttcgacaattcagtaaaattgggtatcaaaagtgaattttttcaaaagcaagaccttatgataaaccgttaaaattaaaacgttgtgtagctgttttatgaatcgagtccctcccccaacctctccaaaccccccatttttcactgtttccaatttttgggtgcaattttaactactatatttgtaaaaattggtatcaaaataagttgtttttttttgcacaaaaccctgataaaccttttaaaattaaaatttattttgtgtatttcttttatgaattgagtccctcccctctcccatctccaagtcctatttccatagctaaattgcagtttccatcaattcttttattcagttgatcgaccactgtggcatcaaagtgaagtcggagctgttgtccatcttcgagcagtacctcctccccctgggcactcaccttcggccggccctccccggcttcatcaccgccgttcttctcgcacttgaggagggcaccgaattctatggtcgtgcctttcaattgttggaccaattgctggataaagtcggcaccgccgcgttctacacttgtttctggcag

SEQ ID NO: 75550 - DNA, 1854 bp, Heterodera glycines
  Genomic contig location: Contig_ID=SeqID_1731; Location=4308..6161; Strand=+
  SCN-specific regions: Sequence locations=1-164,211-538,560-629,651 -758,780-971,993-1250,1378-1395,1454-1577,1599-1746,1771-1854
  Gene Ontology: Mol. function=heat shock protein activity; Cellular component=cytosol; Biological process=protein folding
tctgcgcttgcactgctcctctcgctgtctgcccatggcgccggtgctgaacactccgccttctacgacttgctcggcgtgccaacggacgctgacctgcgctccattcgacgcgcgttcaagcgcttggcgctggagaagcatccggacaaaaatcaggtggcaaaaaattaattaattaaatatttttaaaactatttttcatattttcgcccatttttaaaattttgaatttcctttaaaaataccttaactaattcgttaaattcttttttgacccggcgcacctcctaaccaaaatttaatcaacaaattatcaaaaagtttcattttggtgcaaaatttgttagcaaatctcattaaaagtgaggaatgtaacacttaataaatttatgcattttatacaatttcagtcgaaaaaaacattgtcttttgcgaccatttttaagcatggtgtccctattttgaactgtgatcggtgatcgtatctttgacctttttaaaaatatttttttccttaagaaatatgatcaaaaaattctcagggattttgatcaaatctgaatttaaaaattgccatttattcttaactaaaaatagaaacagcgcaataattttgctctgagctgttcttttcggtacagacaaaatttttaccaaattggaattacaaaaataaatgtccctgatttttgttctaaactccgatttatttataatcccgcatttgtctaaaaaatgtattggatttcttcatcattttccacgctttgttcttccaaaatatgaattcaagtgacttttgccgtttgtttttaacctatggcctcaaaattcgttaaattctcccctttcgtatgactcattttttgatttctgcttttttgagtcaaaattttcaacaaatttttctcttgtccaagaatgacccggaggcacatgacaattttgtgcgcataaatcgggcctacgaagtgctgaaggacgaggagttgcggaagagatacgaccaatttggggagaaagggttggaggagggaaacaacgccgcggggggctgggcacaacgccaacgccaacagcagcagtgggagtcgtgggagttttacaatgacaaatttggtgcaaaaaaacataattactataaattaaagttaatttaggcaataattattattcctgtaattagaccacaagaaaaatttgattaactatattacaattagtgaattaaaaagtgttcctttttgaaaattattaatttagtaaatcaattcttattttataaaaacattaacaggaaaataaattaaatttctgaaaagaataacatttatatattttttttaattaaaattcttttaatcaaattaaaatgcttgctttaccgtatacttttttaaaataaatttaagatttgaattaataaatgagtttttttaaaattaattatccaatttttgcaggaatttatgacgatgaccaggaaattgtcaccttgtccaggtaaatatgtgcgaggaacatagctttttatccacggtaatgggatcccgaccggagggattggtcccggccggaacccggaagcccggctgtttagacccccccccccctgattttgggtcccaattattatggcccctgttttttcagagcccgtttttggtcccgacttacccaagattattctgatccccgtttttcagacgcctttttaattcgactttttcaaaaatctttccgttttaattaaattttttaattttaggagtgaattggaggaagaagtgttcgaatcaggcgaagttgactctaataaaaagcattttgcctcgttaccatcactttttt

SEQ ID NO: 75551 - DNA, 84 bp, Heterodera glycines
  Genomic contig location: Contig_ID=SeqID_1732; Location=218..301; Strand=-
  SCN-specific regions: Sequence locations=1-84
gccggatcctgcatgtcccgtaaaaaattttgaattccaatcctgtgcaacaggatccgcaaatttgaaatttccggtctctaa

SEQ ID NO: 75552 - DNA, 2980 bp, Heterodera glycines
  Genomic contig location: Contig_ID=SeqID_1732; Location=875..3854; Strand=-
  SCN-specific regions: Sequence locations=1-22,44-557,580-1501,1523 -1685,1712-2398,2420-2980
atggatatttatattattatgcaaaaaattctaaaaattttaatgagtttcaaaaaagttagcgtcaaaattgttgagccaacagctttttcgagcgtttgggcgaaccgaggttggaaaaagttggtaaattagtgggttccttttcgggccacaaattgaagttgttgggaagtttcaagtgtgacgttctgttcagaggagtcacaatgcggcttgaactttcagtggcagacaccgaagcgccgatcattatgggattggattggatcatccctttcgagcgtgccacccaacagccaattgccacgactttggagcaacagtcgctcattgtcaacagtgtgcaaccaacaaatgatccggtcaaattggaagggcaaatcaaggcttccttcccgaaggtgtttcaacctggcctcggacattgtgtgaagacgaaggccacgctgcatttgaagcaaaatgtgaagccagtgttctgccgtgcgcgacctgtgccgcatggagtccaagcagcagtcgacgaagaattggaccgacttttggactcgggagtgctgaagcccattgatttttcgcgctgggcagctcccgttttggcagttcgtaagaaaagtggtaatgtgcggatttgcattgacttttctacgcgactaaacgatgcgctggagttgaacaggcatccccttccgcggaccgaagacatttttcatgctctgcgtggagccaaagtgttttcgcagcttgatttgcgtgatgcttatctgcaggtcgaactggacgaaagttcaaagcagttagtcggcatgaacacgcaccgcggactttttcaatatcagcgtcttccttttggcataaaattggccccgtctatttttcagaaagcgatggaccaattgacgtccggtattccaggcgtgtttgcctatttggacgacatcatcattgcttcggccgatcactcgcagcatgttgctgctctcattgaactcttttcccgaattcaggactatggatttcgagttcaattggacaagtgccactttttgaaggctgaattgaagtttctcggacatgttgtctcgtccgatggtctgaagcccgatcccgctcgatccgatgccatccgtaatatgccgtcaccgcatgacattggcactttgcgctctttcctgggtgcactcaactattacggtcggttgtcaaggaaatgcgcgatttgcgtgcacctttggatctgctcttgaagaaggacactccttggttttggggtcctgatcagcagaaggcttttgatcaggccaaacaggttcttcaatcggatttgttgctgacgcagtatgatcctagtttgccgatcattgtcgctgcggacgcaagccaaagtggaatcggagccacgatcagccatgtgtttccaaacggagtggagcgcgtcatcgaccacgccagccgaacgctcactcccgctgaacgaaattacgcccaaattgaacgagaagcgttgtctttgatcttcgctgtgcaaaaatttcacaggatgatttacggtcgtaattttactctattaacggatcataagcctctcttggctatattcggtaataaaaatgggatcccgatctacacggcttcccgattgcagcgttgggccctaattttgtccaattatgattttacaataaaatatgttaaatctgcaaattttggacaggccgacgttttgtctcgactgatttctgagcaccggacagacgaagaagtcattgtcgcccacacatcggacgacgtggacagcactgaagaagtcgaatatgctcttcttgtcaacttggagcagctgccagtcgatgcaaaagaagtgagcgaattgacgacttcggacgatttgttgcaggaggtggcataattcgtacgttccgggtggccaaacaaatgcccagctaatgaattaatgcctttctattcgagacgtgatacgctcacccttgtgggcggttcaattttgacaggaaaccgagtcattgttcctgcgccgcttcgttaacgtgtactcaagacgttgcattttgctcatcctggcattgtgcgaatgaaggcgctggctcgcaaccatgtcttttggcccggtcttgacagtgacattgaggcaatggtaaagcattgtgcggaatgtcaattcgccgtcaaaatgccgccgaaagcgccacttcgaccatggccaattcctggtgaagtttttggacgtgtccatattgattttgcaggcccatgtgccggtggaaacatttacctcatcctcgtggatgcactttcaaaatggcctgaagtgatgcagatgcgcacgacaacagccaagggcacaatcgaagcattaaatttggtatttcatcggtatggtgccccaaaggaaatagtgtctgacaacggaccaccatttacttcccatgaatttaaggacttttgcaggcttaaaggcattaagcacaagttctccccgccgtatcagccgcactgtaatgatcaagccgagcggatggtggacacattcaaacggcaggcaaagaaaaacgcaaaatccaaaaatcaacaatggatttcggaatttttgtttgcgtaccggtcctcgccgagtccaattttgaatggtttttcccccgcagaattatttttggaaagaacactccgcacgcccttgtcaatgcttgaaccgagacagcacacgccgaacgagaacaacaaccaacgtggacagtaccaatcgaggatgtcacagcagtacaaccaacatcatggcacaaaaagccgttcattcaattcaggagactcagtcttagtcttgaattatggtaggagtggtaaaccatcatggttggaaggtaaaattgtgagtggtagtggtttgatttggaaaatcgaaattccaatccttggaattaccgtaacgcgtcacgtcaatcaaatgcgttcattttcc

SEQ ID NO: 75553 - DNA, 1847 bp, Heterodera glycines
  Genomic contig location: Contig_ID=SeqID_12025; Location=1658..3504; Strand=+
  SCN-specific regions: Sequence locations=1-363,385-687,709-1847
  Gene Ontology: Mol. function=peptidase activity; Cellular component =integral to plasma membrane; Biological process=proteolysis and peptidolysis
atggcagggggcgctgaacttcacttaccgagtgggaccaggcctaaaaagcggacgaggccaaacggtgaaagtggaggtgcattccaagttggaagtgaggtaattagggggtaattacgaggaaaataaattggggaaaagtcaaggagaataatgaaaaatgaggaaaagccaaggaaacggaaaaaatatttttaagcgaggttagggttggtagaggtcaggaattttaactaagccaagtgcgaaagtgataacgtaaaacattgaaaatgaataaaaaatggaaaagaaaaacaatttattcacaaaaaatatttgtccaaaatattaattaaaatttggcattttgccaattaataaagtgaagaaatgatcaaacttttcattatgaagatgccattcccacattttccttgtaggcccattcaaaatgtgatcggatacatttggggcagtgaacggcccgacgagtgggtgatgctcggcaaccatttcgacgcgtgggttttcggcgccatcgacccgaacagcgggacggccgtgctggcggaggtggccaagggattggcccaaacggtgcgcaccaccgggtggaggccgaagcggacgattgttttctgcgcttgggacgcggaggagcccggactgatcgggtgggaagcactcactgattatgcataattaacaaaactgatcacacacattgacaaaactatatctagtatatattttaactttcactaatttttgatcatagatcgaccgaatttgtggaggaatttgcggatgttttacgcgagagagctgtcgtttatttgaacgtggataatatttccagcaatgtcacactgtgattgaaattgcttaattaatcaattattataatgattaagcaatattcatgctgtgccctcgctttaccaagcagcggtcgatgcgtccaaatcagtccaaaacccaaatggccaagggtcggtgtttggcccgtggattgagaattacccgtcgagaacgagttggctcccggatttccctcacatgggcatccccgggggaggcagcgaccaaaagtgagtgaattgtgtcgctttgatcactaatgagggcggagccgttggacaattaaaaaacagaaaatccaatttttttagatcttttctcgactttctgggcattcccgtgatgatgatcacttacattgaccccaaacgtggtcaatacccgctctatcacacgcgttacgaattgccatttgtcaacgaacacattttcgacaacaatcagttggcggtccgtttctcaaacatttttttttgcatatttcgaactcaattctttaaaattcaggtgcataaagccgtgggcgaatattgggcggaattggcacgtctttttgccgattcgccgcttttgccaatcagtgcgaccactttggcacatcgattattggccgactatttggaggggatcaaaaaagttgctaaattaaattcaatttgaatttcgttattatttattttattcagccaatcttggatttgagcagccaatttccgagtacgtgtggaccggcgaagacccaactggacaatctgatccaaaatgggcaccaatttatggcacaggcggaagagttcgaacggcacgcccaaggccaaagtgcgggtgccaatttggcccaattagcgtgggcaaatgaccgactgagaaagttggagcaatgttttgtgaacccggcgatgggactcgcgcgggaagaaccgctcaaaaggcacgtgctgttcgctacaggaaatgacaacagttacgcggccaccacactggcaaatgtttacaacaaa

SEQ ID NO: 75554 - DNA, 765 bp, Heterodera glycines
  Genomic contig location: Contig_ID=SeqID_12026; Location=291..1055; Strand=+
  SCN-specific regions: Sequence locations=1-36,59-158,180-196,253 -407,456-515,538-584,641-727,751-765
  Gene Ontology: Mol. function=RNA binding; Cellular component =nucleolus; Biological process=regulation of transcription, DNA -dependent
aaacgacctagcacccatttgaaggtgcatttgcgcgtccacacgggcgagaagccatttgaggtgagttacggatctttggtttttaaaagtagataaaaaacaattttttgttttattaaatggatgaaaaaccgttcaagtttaaaaaagaaaaattattttctaaacttattttttaacaaatgaaatggagtaatatttaaactaaataaaaataataattaaatgattgaatttaacttattttttgattaaagtgcgaattttgtgagtggagatttgcggagaaaggaaatctgatcaagcaccgccgtacacactctggtgagaaaccgtacgaggtgagttacggatttgtgcgatttaaaaatgaagtaaaatattttatgaacgcctgtttaaagaaaaaaataataaataaatattattattatttttaaatgttttattaagtgcactgaatgtgggagaacatttgcgcagaagggagctttgcacattcatcggcgtacgcacaccggggaaaagccgtataaagtgagttgtggatttgcggttttttaaaaagatacactaatatgatttatttgtttttagttttataaataatttgaattttaataatatttattaatttctgatcaattcagtgcaccgaatgtggccgagcatttgctcagataagcaatttgcatgtgcatttgaacagaaaaaaaaagtgcggaaagaaatgatcaaatggaatttggaatttgatttcat

SEQ ID NO: 75555 - DNA, 230 bp, Heterodera glycines
  Genomic contig location: Contig_ID=SeqID_12028; Location=388..617; Strand=-
  SCN-specific regions: Sequence locations=1-230
cccacaaaatgtccaagtctcgaatttgagttttttattattcagatgggcctaaggttaggcaaggggtaatataaagggtatattcgtatatattcgtattcagcgaccccgaaaaccctaaaaattcgaaattagactcattttgtttttataaattttgaaaaattttgttcgtgggtttttactcttttggacatttcgtggcttggacactttgtgggggcgcc

SEQ ID NO: 75556 - DNA, 91 bp, Heterodera glycines
  Genomic contig location: Contig_ID=SeqID_12030; Location=1021..1111; Strand=+
  SCN-specific regions: Sequence locations=1-91
gtccgaagataacaaattaaataagtttatttgccggagaaataaataaaataattaatgcagagaataaattggagaggtcaaattggtg

SEQ ID NO: 75557 - DNA, 91 bp, Heterodera glycines
  Genomic contig location: Contig_ID=SeqID_12030; Location=1757..1847; Strand=-
  SCN-specific regions: Sequence locations=1-91
caccaatttgacctctccaatttattctctgcattaattattttatttatttctccggcaaataaacttatttaatttgttatcttcggac

SEQ ID NO: 75558 - DNA, 1272 bp, Heterodera glycines
  Genomic contig location: Contig_ID=SeqID_12031; Location=1084..2355; Strand=+
  SCN-specific regions: Sequence locations=1-59,99-346,375-443,465 -1187,1209-1235,1258-1272
gccgttggccaccgcctcgttaccttcgcttctcaccggccaaaacggcaccgacacttccaacgtttgtgttttttgtaatgaaaaaatttgacccaactttggatccgttcttaatttctaccattgaaaccttttctggttaacttttctccacgtttttagttggtcgagctgaagcaggacccgggcattcgttctatgcaaaagtgagtccatttatagtgccgttatcaaagataggattacagccggaagagcctccgaatttgaaaacattgtcgtaaattattgggattcttaacgaatttcccgtttaacaataattgttacttaaccaaatcggttgaatttttcaaaaattttttcattaatttttttttgaaaatccgaaaggattttattatttaagacacaaaattcgcgatatttggattgactatttgataaaacaggattttccattttaaggtcgattacttctggtggtggctcttttttggcgtttgcaaagctattagctgagtggaagtggatagtggtgtgttttgctttacaacttgccttctaattgacactaaatatgacttttccagattaataagaaatttcaaggaaacaaatgaaaattttcactaattggaaaacattttcaaaaaaaaaatcataatgaatcttggaaaatcgctaaattacgattattttatgaaaattttcctgtttttttatttttctggggggacgaagcgcgtgaaacgtcctgctctgtaaataaacatttaattgttttagattttgctgatcgttttgcaactcgtgttgggtgttcttgcggctgacatgtccaccgcgtcgtgcaattgggacgtgaaaatgctcataccattcttgtcgattttgacggggctggtagttatttttggttttatttgggcgatcgttcatgtgttggtgaactccaaatttgacgttgtattggcaaaaatggaagcgatgaaatcggatcagagggcagaacttcgtggagaaatgaaaggaattcgtggagaaatgaacggaattcgtgaaaatatgaacggtctgcgtggagaattaaacggtctgcgtggagaattcaacggatttcgtggagaaatcaacggaaagttcgaaattatgaaaatcgaattgcgtggagacatgaaaggtctgagtggagagatgaacgccatgaagtctgaactcaatggacggatcaatgttttgcaagcagagatgaatggaaaaagatga

SEQ ID NO: 75559 - DNA, 305 bp, Heterodera glycines
  misc_feature (14)..(14): n is a, c, g, or t
  Genomic contig location: Contig_ID=SeqID_12032; Location=1..305; Strand=+
  SCN-specific regions: Sequence locations=1-141,163-208,230-305
agaacacaaaacancgcgctacacaaaacgacggacggcacagaagcgaaaggcgcgcgtgccgcccgagtgcgttcagctcccgtacagcacggcgttgatctcgcccatgatgtacacctcgcgcccgttgtacctcctggacaggtccttctccaactgaatgaaagggacgcaaaaattactacagattttggtatacaaattaaaaatgcaataaattaattaattccccgcaaaaatgtcatcaattttatttgagtattttttatttctttttgtttaataaatgcactttgtaatat

SEQ ID NO: 75560 - DNA, 1671 bp, Heterodera glycines
  Genomic contig location: Contig_ID=SeqID_12033; Location=53..1723; Strand=-
  SCN-specific regions: Sequence locations=1-193,215-356,378-616,638 -720,743-1255,1277-1671
  Gene Ontology: Mol. function=neuronal Cdc2-like kinase binding; Biological process=regulation of CDK activity
atggaccatttgcccattgacattcacagcaataagcttcttggtgcgtccatgggatgggtttctttgtcttggaattgtatcgtctctctcctctttcaatccctcagattggctcatttcgcgtcgccattgccacaagaattggcgtgattcggtcgagacgattcgggccaaaattggacatgccattcaggacatgccggagaacgagcagatcttggccattctcagcaacgcacaatgtgtgctcttccgaattcaatgacaatacataattatacgaaaaattcaattaccgttttgaattaaccctttgaaattaatccgtttttaaaatgaatttttgcccctttttcagacatcaactatttccattgcaaacaaattgtggacattctgcgcgacactgaaaaggagacgaagaacattttcgggatgtactcatcgcaacggatgaaagattggaaggtccgttcatcagattgtgccaattcttacaatatttttccattgccattaggagatcatttcactgtacgaaaaggacaacgtttgcctggcagaggcggccaattttctgcaacgttttgtccaatatgaggcaatgctttgaaaatttggaaattaataattaattttccctaaaggttcccgcgctacgcaaacaaattgccaaggccgagaacacgtcaagggtgggccaaactgggatttgaaaaataaaattggaattaaaaataccattttcggagtcggaacgaaaggaaagggaatacgcaaagcaagcggcggaagtgcgacgaaatttggacaaggaattggccaaatgggcactgcccgccaaagtgaaggacttgcgggccgaactgctcgccgtcgcatgcgcaacggaaccgacggaattggccaccgtcggcacagaattgggccgaattgtcacgtatttcgacgccttcggcacttttgtcgagtgggacggcattccaatttactcatttcaatttgtttgtccaaattcagcaaacacttggaaggaatgttccccgtcacacgctttctcctcccttcgcttgtcagtggcgacgcaaaacggccgctcagcgaattgtccgttttcgaatggcgccacggacagagaccaaatgccgtactcgtcgaacaattcggcgcagcaccccacaatcagtctcccccgacagatgacggacaaataacagccgccgatgttggcaattttaatgatggacgactcttacaattaccattttattccccgtttttaggacgatgaaattgactttggcgatgatgagattgatttttgtctggatggaaatggtgttgttgagtgcgaaattgagctgatcaatgacaagactggggacggcgtaaagccaaaagtcggcggcggtgccgttgcggcggacgacggaattgcccgaggggaggaggcgctgccccttttggagcatttggaagtgcggacagagtttttggacgagttggaccaggtaaaaaactcaagacgcgaattcgaacaagatttgtctaattaattgatagtattccattttatccaacatttactcgcccctaaaaaaactatattctcagaattttttttttaatttaccattgggacatctctgccggcatataattaataaa

SEQ ID NO: 75561 - DNA, 1210 bp, Heterodera glycines
  Genomic contig location: Contig_ID=SeqID_12033; Location=2318..3527; Strand=-
  SCN-specific regions: Sequence locations=1-172,195-205,229-230,252 -449,471-1210
atggttttgcagctgtcaatgatcggcaccgacagggaggcggccacttcggccggttcgatcaccacacgtctgctcggcaaataccaacacgttgaacatgtgatcattgtcggcgtggcggggggacaggcgcatttgactgaccccgaaatggtctccgttcgctttgctttttcttcctttaacaatgcatttatgaatgttaaagcatattcgacttggcgatgttgtcatttcacaagaggaaatggacgaacattcgacggacggacgaattggggcgtatgtttatgcacacaacattggtaagacgtacatggcacaattttatacaaatttcattttactgattcagaatccgaccccaaggcaaaagaaatacgcttcgaagtccataatttgtcgccaaaagtcaacgcattggctgcggctgtgcgaaatgcgtaggcaattaattaattaattgtccgtttaattaccccactgttttttattcccaattcagcaataaaccgcgctttttggacgcatggcatgcgaattcgcagtcgctaatcggccgactgaatgacaaacacagggaccaacagttggacttttcgcgccctcccgccacatccgatgtcattctccagctgacgaacaacggcaatattttggtgttcccgcatccgaatgagtcccgcaccaatccgttgtaccatttgggtcccgttggttcaatggtccgtccatttcatgcatttgtgccaattttaatttgcaatatcagacatttgttaattgttttgcaggtcaccttctacaaaaggccggacgaagacgaagatagcaacaaaaaacagaaaccgccaacgccaccgctaaaaccgacgaatcgttttagttttggcaaaggcaatcaaaatggtccgagcgtggacaacacaaatggcattggatcgaagtatttcaaaaaaataaattgatttttgatcaaattcattttagtggaccaatgctttctcctggaaatgttggcgatgagtcaaacgattcggaagagaaagcgaaggaaagcgcggccgacacttctttgaacagcgaaagtgccacggatggcagcagggacgtgcgactcgtcaatgaaagactgcgcgaaaagtgcgggggaaatacgggcaaattgaatgccaataaacttcacaattcctttcaaaaccgttag

SEQ ID NO: 75562 - DNA, 660 bp, Heterodera glycines
  Genomic contig location: Contig_ID=SeqID_12034; Location=562..1221; Strand=-
  SCN-specific regions: Sequence locations=1-249,271-660
atgctgatcaaaaaaggtagcaacaccaagttgatcagatcactccttcatggtgatctgatcagcccattttggctgggaacgaggggtaaatttcaaaaaaaatttctagggggttgggaaaatttttctggaaattttgagtaggcccattttatagagcacaaaatttgctaccgaattgcctttggaatagtgggtctacgatttaggcccgctgagatacgtcgacttttattttggtgcctataaaaagtactgtatttcttaagaaaatagtgcattttacactacgtcaaaattgaagtgcccatacctcagccggtataagtcatagagacatgcggttttttgaatattgtagagaattttgtgctctataaaatgggcctactcaaaatttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttaatgctgatccagagaagcaatattttaaaaatgaaatgggacaacacttttgaccacctatattttgatcaaattgtgaatatggtaaaataaa

SEQ ID NO: 75563 - DNA, 66 bp, Heterodera glycines; identical to SEQ ID NO: 53774
  Genomic contig location: Contig_ID=SeqID_12034; Location=545..610; Strand=+
  SCN-specific regions: Sequence locations=1-66

SEQ ID NO: 75564 - DNA, 143 bp, Heterodera glycines
  Genomic contig location: Contig_ID=SeqID_12034; Location=1778..1920; Strand=-
  SCN-specific regions: Sequence locations=1-49,82-143
cactttcgcctcgcgcggcagagggcgtcagggcatttgatgagagcgacggaagagagagaaagagaccaaatttataaccatttttttgaatttgttttgttgtgtcttctctatttttctttttgcttaaaacacacaca

SEQ ID NO: 75565 - DNA, 568 bp, Heterodera glycines
  Genomic contig location: Contig_ID=SeqID_12036; Location=744..1311; Strand=-
  SCN-specific regions: Sequence locations=1-225,257-312,354-472,494-568
atggccgagaaggtacagcccgaagcggaagagccggtggtaattgtggtcggtggaatagcacatggaaaggtgcgtgatcctttctggatcgcaatttaatacctctcccataataaaacaccaattttgtgcagattagcaccgattacacggaggaggacatcaaaatttcaaattatcctttaagcgcgggtgagcataataaatcggtggcccaataaattgttttctttattttgtttttagctctctgttgtgccaaattgacaagtgcttttgagcagttgtggggcgtcctttgacgacacatttttttttttgttttttttgttgttctttttaatatttttgcataaattaacaatggataataattgcttaaaaaatgctttttaactaacagtaaatccgaaatgagaaatagcggtaccaattcaccatacaggccttggtctctttttttaaacatagccaaaaaatacaaatttttaggtgcaaaataaagcgatgtgtggcacaaaaactgaatagaattctcgcaccaaatctttttattacgaataaa

SEQ ID NO: 75566 - DNA, 238 bp, Heterodera glycines
  Genomic contig location: Contig_ID=SeqID_12038; Location=718..955; Strand=-
  SCN-specific regions: Sequence locations=1-238
atgacttatgtttcggcccaagcgcacaatgttttgtcggacattgacaagaagttgcatgagaacaatgcgttcaccaatttgctgggcaaaattgagaccaaaactggcctcaaacgtcttcacgtctttggaggtttctaccaacccaaatttatttctaataatcaaaatttcgttaatttggcaatggtcaagaattggtgtcccgacgaaaaaaatgtcaaaaatttggcag

SEQ ID NO: 75567 - DNA, 285 bp, Heterodera glycines
  Genomic contig location: Contig_ID=SeqID_12039; Location=777..1061; Strand=-
  SCN-specific regions: Sequence locations=1-177,199-285
atgcaaaccacctgtggttatgcttttcaaatcgcggacattggcaatgcttcttcttccaatccgtcgccgaattcggagccattggcgcaaattgtccgttggaattgggaccaaaatgggacgcaacaaatcattgaagtaagcaatttggggtaaaagtgaagaaatactgaagggattggaaatgtattttatcgaaaatcataaaaaaaaaactagccaacatttcaaaaaaaaatttcacaggggcgtctatcggctcctccggccctctgcttttaa

SEQ ID NO: 75568 - DNA, 83 bp, Heterodera glycines; identical to SEQ ID NO: 69364
  Genomic contig location: Contig_ID=SeqID_12040; Location=1112..1194; Strand=+
  SCN-specific regions: Sequence locations=1-83

SEQ ID NO: 75569 - DNA, 348 bp, Heterodera glycines
  Genomic contig location: Contig_ID=SeqID_12041; Location=312..659; Strand=-
  SCN-specific regions: Sequence locations=1-37,60-217,252-348
atggccgagtcggaggagaaaagtcggcgccaatgtgccaacaacaacagccacaacaataatgatggaagttccactgcagctaatgccgaagctggctgtgccgcggatcagcaccaacgacagcaacaatttgacgatttcatgtgcctggactttggcggtgatcagacgaagacggcaccagaaaggcaacaacgataaaacttcatctgatcacgcacaacaacaacaacaaatgaaaaataatcaacactgatcatctctttgatcattcgttaccatttggggggcgggggtgattgtgtgccaacatttatggctttggctgtcaaattgcttaataaa

SEQ ID NO: 75570 - DNA, 1517 bp, Heterodera glycines
  misc_feature (1456)..(1456): n is a, c, g, or t
  Genomic contig location: Contig_ID=SeqID_12042; Location=1..1517; Strand=-
  SCN-specific regions: Sequence locations=1-208,257-285,307-386,411 -615,640-960,982-1260,1282-1432,1479-1517
  Gene Ontology: Mol. function=protein binding; Biological process =negative regulation of EGF receptor activity
caaaaggctgttccatccgtggccttcgctcatcaaaaattggcaacttttggcagtcactcaccccgcctacatggcatttatgacttacgaggaggtcaagcagcgcctgcagcagttcagcggaaagcccggaaggtgtgaatggtcacaaagcaaaggcatttgcccgcgttttaacaatgcaaagcaaagcataattttttgcatttaaatattaataatttttggttaaaatttaaatgaaaaaataaatcaagttaaaacttttttgaattaactctgtttttgtctcctttgcttttgagttttcttctcttgttctgattatatctttttaaccaaaaggcatcaattttttgcttaatttagtcattttttacctctaaattattattttttatttttttggaattgtgcttaaattccaaaaccattagttatctgttccgactgagctgcactcggctgggccaatgggcaattggttacgtggcgccggacggaaagatttaccagacaattccgcagaacaaatcactcatccaatcattggtaaaattgtcgcggatatctctttttcattgggttgatcttcgatggaaatccttcccaattttttgtttatccaaaattcatggcctccgctcgttgtacgtttccatctcgacgttcaggtggacggcagcagggagggcttttacctttacccaaatggtcggaacaaaaacatggacttgtcctacgtgtcgcaatttcctcccgagtcgggcaaagttcaggtggggtttatgttatttagttgtcacattgcttaatcggactcaaccggcacgatcagcagggctgcaaaaaaaagcacgaaaaatgaccagaatatgcacataaatatgcaaataaaattgccaaatatgcacaaaaatcgcaaaatatgcacaaaaaatcttaaattaggggtgcaaaataaataaaaattttattcctcataaattatatcggttgtttttgtaattgtaaatcaaaaatttctcaaggttttcggcagtgaaactcactgttgacccactcgcgcatcaattcagatttggatttaattttaggcattttcgaaattttttcctaagagatagtgaaatctgaaaaatttgacgaaaaatggcaaaatatgcaaaaaatctgaaaatacgtacaaaaaatggcaaaatatgcagaaaaatccaaaatatgcaaataaaagtcccgatttttatacgcaaacataaaaaagaaagtgtttttcctgctatttagagcatggagaagccaggaaaaaaatatgcatttgcatattttttgcagccctgctgatcagtgaccgattcattcgcaatttaattctatcaaaatttcccaatccgcttgatcatttctgaataattctgaattttgtgccaaattataatttttagatttatgntcaaaaaataattattttatatgtagaaaatgatgcaagtaaaactcaccaaaaataaaat

SEQ ID NO: 75571 - DNA, 1115 bp, Heterodera glycines
  misc_feature (36)..(36): n is a, c, g, or t
  misc_feature (57)..(57): n is a, c, g, or t
  Genomic contig location: Contig_ID=SeqID_1734; Location=31..1145; Strand=+
  SCN-specific regions: Sequence locations=1-76,98-165,188-462,490 -1081,1114-1115
  Gene Ontology: Cellular component=chromatin; Biological process =chromatin modeling
atggatctgttcaaaagcgaagaaatcaaaaaggcncaaaaggacgatgaaaacaanaatcgaagaattttccaatatgaatattttgcaaattatacggatgagaaggcagcggctgcaattcgccggatgaaacaggtgttattttcaaattaaaaataatcctttaaaattttaaagggcggaaaaatcatttggccttcagaaaaatctccgaatattttgatgatcgcctggaaagtcactaatgacattcatcaagtgataaaagttgaggagaaggagaagcgacgtgttttcgaaattggcaaaaaactgttgatgaacggagaggtcggagcagggagagagggggggggggtgacacggggtaaagtcaggcggtgctatgactccggtttggagatgtaacgccaaatacgaccttttttgttcttaggacagccaaaaaaaattccgctttgttttaaaacaaaattccaaagaagagaggcttccgattatgccgggtcacttaaatttatagtcatccctcggggtgtctgaatttctcaaattgatacctgctaattgtaagatgactggattcattatttatttgtgttcaggttttcgaggacgtagatgagattgttacacgatgcattgaaccgatggccaattttgcagtcgatattttgcgctatcgttacttcatggagtcgggttacgcccaggaggtggttgacggttacctgcgagatcaaaagcgcgctgctcctcaacggatcccgtaagtcaatttaaacactatttcttatggttttgcctttgtcagttacgttatcactgccctccgggaaaggcccgggcgttttatgctttcttatttggccggttcaacaccacggaacgaatcaatgagcgtgactccggatgggatcaaattccgtggccatacatttgcttctacggaggactgtgtcaactggtttaaagtgagcaaaatttaacaaatacacaacacattcattcgttcatttttgaatttcagaatgaattcgctcgtcggcagcaagagatactgcaccaacaacgatagttttgcattttatttatttatttattcagaagaa

SEQ ID NO: 75572 - DNA, 84 bp, Heterodera glycines
  Genomic contig location: Contig_ID=SeqID_1734; Location=6913..6996; Strand=+
  SCN-specific regions: Sequence locations=1-84
atgcaccccaaactgttcctcgtcactttcgctgttctgcttgcgcttctgtcactggccaatgccattggcttccctccggag

SEQ ID NO: 75573 - DNA, 847 bp, Heterodera glycines
  Genomic contig location: Contig_ID=SeqID_1735; Location=1122..1968; Strand=+
  SCN-specific regions: Sequence locations=1-85,177-255,277-577,599 -652,724-847
atgactcgcttcaccaattgtctgatcactttggcttttctgctgatcacgatcgtttccaccattgatggctttggctttccaagtggtggtagcggctgtgggtgcggctgcagcggtggaggcggcggcggaggagggcacggcggatgctgtggaggaagtggaggcggtggacacggtcgcaggaagcgcgatacggacgcggttcaaccacattacatggcggacgaaacgccatgcccacaggcggcgtggaaagccattcttgaggaggtcatacagtcgtaaatcattcgtagggcaactaatgccgccaatttacagtcgattagcccggaagatgccattgtctctgtgggtgccatccaaactgctttgtaccgccgctataccaacgagcagaagttcctggtcacctgctcggcagccgacgtggccaaaaacggcacagcactggcaaccaataaagtgcacttcagttcatccggcaatggttactgtaacatggtcaaagagcgcatttggtgccaggcggtcgcattgcactcatgaacggattcgttgcgaaagattttcaaaattaataattttaaaatgtgagcaatacgtttttgtctagttagtgatcttctctttgtatgtcgcagtgtattattatattatgtatattattattatgtatttagttaaaattacttttaaaatttgataattaatatacattcccttttgttaccattttgatgctaattaaatctttgaaaaatgcatgtatttattacacgaaagttagagatgcttacaaattgattaattgctttgataatgcgaagattgagcatta

SEQ ID NO: 75574 - DNA, 1098 bp, Heterodera glycines
  Genomic contig location: Contig_ID=SeqID_1735; Location=2149..3246; Strand=+
  SCN-specific regions: Sequence locations=1-2,26-222,244-613,665 -757,779-799,822-943,997-1045,1069-1098
atgtctcaacttttaaactgtttaattgcgctgaccattctgtcagttttggtggccatgacagatgccattggcatgccaatgcaacaatgctgttgtcccatgcagcaacagtcatgctgtgggggtggaggaggcggaggtggcggttgctgtggccggaagaagcgtgaagcgacggcattggaagcagttcagccccacttcaaatcggacgaaacgccgtgcccacagacagagtggagacaagtcattgacgaggttggcaaactgatcacttatccaatcattggcatatccctaattgcttgctaattttgtagagcatccgcaccgacgatgccattggctcggtcagtgccattcaaactgcgctgtttcgtcgctatgccgaccagaagttcctggtcacctgctcggcagctgatgaggccaaaactggcaccaacaaagtgcacttcagctcatccggcgacggttactgtaacttggtcaaagaacgcatttggtgccaggcggtcgcgctgagcgcgtgaaaaggattaatccgatgaattttttcttagtcaaagttcaaaaaaaaatagattccattttgtaactgtgcaataacattttaattttcttatataaatttatttagtgtttaataatttttatttttctattgaactattatttggattcataactttgtgcctcacaaattagaaataggtaaatcatttttcaggcaaaaattgacacactttttttcaagagaaacaattttttggagtgcctaaagttttttatattagcttacaaaacccaaaaaattgatataatgcgttttttctgctataatttctgcctaatagagaaatctcaagctcttttgactagggttcggaccccgcccccgtcacccccgcacccgccgggggcgggacaggttttttggcctcacccccgtccccgcgactctgaccccgcccccgcgaccttcgcccccgcgagggcgaaaatacacccctaagaatggcatattcgtgggataaaatgcaaaaatttatacaattttgaattttttaaccatctttgacaatttttatgaaa

SEQ ID NO: 75575 - DNA, 219 bp, Heterodera glycines
  Genomic contig location: Contig_ID=SeqID_12043; Location=2214..2432; Strand=+
  SCN-specific regions: Sequence locations=1-219
atgttcaacaatgaaattctgtggagtgaaaaccaagcagaggcgggcgcgatacgcgagcatggtcagatgttcgtcgggggctttgaagtgacgccgggaacaagaatcggcggctttgagatggtgccgggtccattggttcgcggtcaactaatggcttttattaatgatctgaatgatcgatttcggaatgctacggattatgtggagctggcg

SEQ ID NO: 75576 - DNA, 600 bp, Heterodera glycines
  Genomic contig location: Contig_ID=SeqID_12046; Location=1165..1764; Strand=-
  SCN-specific regions: Sequence locations=1-432,546-600
gctgagtcattaatattcaaaatgtttttaaatgccattttaatgaaaaatggaatggttttcttgcgaaaaaaagtccaaacaaatgcattcatataatgaaatcagtctttacaaaagcaaaaagctttaaattcaacaaaaactgaataaaatttgaaaaaattctacattttcttatgaaatgataggagcattttttcgagaaaataattctcgcgagatcggacggccggctgaatcaataaattgcgcacaaatttattgcatgaatggggtgcgagttgaggagcattttggggatgggtgaatttggtgctgatgttaagtgaataaatacggaaaattgaacgatgaattattttattggtgaagtgtagggagaagaagtgcagcagctgtcggcggacggacttttttggaagttgtaacaattataaaaaaataaatatattataataaaaaattttttaaaaaatatttaaattaaaaaatgcttcctttattagtcaaatatttttattttaaaattttaatgttaaattgtcactattattctttttacgacaatatttcaaacatttatccataaaaaatgat

SEQ ID NO: 75577 - DNA, 267 bp, Heterodera glycines
  Genomic contig location: Contig_ID=SeqID_12048; Location=103..369; Strand=-
  SCN-specific regions: Sequence locations=1-203,225-267
atggcacaacaccaggaatcgttgatccgtcagaattttgcagctgaaactgaagccggcatcaacaaacagatcaatattgagctgtacgccagctacgtctacttgagcatggttccattaaatcttctaaatcgctcagaaatttcttttgttaagtccttttacttcgaccgtgaggacgttgctctccacaacattgcgaaatggttcaaaaaacagtccgacgaagagcgtggacacggcaccactttcatgaaataccaa

SEQ ID NO: 75578 - DNA, 1820 bp, Heterodera glycines
  Genomic contig location: Contig_ID=SeqID_12050; Location=1394..3213; Strand=+
  SCN-specific regions: Sequence locations=1-147,171-202,224-363,386 -414,437-473,495-1036,1058-1109,1141-1333,1355-1820
atgaagggaagaccatctaaaggggaatgggagcatatttatgggcgagggaaggaacatgaaatggaacagaaatcgattggcattatgtcatgtcattcaaactacggcggcagtgccccgaacaattttgtaagaagtgaacgctaatttgacaaaattcattagaaatagggtacaaaatataaaaaagtggcatttaaaacatataaatggtaaaaataacccagctgatttggcgtcaagaggaacatcaatggaagaactacaaaatagtgaaatatggtggaaaggcccaaattttctttcagaaagggaaaactcttggcccaaaacaatacgagaatatgacccaacgaatccaccagaaataaaggaaaaacaaaatgttatttttgagataaattcagctattaaggaaaaggatttttgtgaatttgaaaaacatttcgaaagattttcaaaatgggaccgtttaaaaaattcaattgcttacgcacttcgagcctttaaaaaggaaaaccaaaagaaggtttcccaaaaatatggaaaaaatttcggatatcaaaataaaaaaaatggaaaggagataacaaaagaaattattaaattaattaggcctttagaggctaaagaaatccttaaagctgaaaagctgattttcaaattaatccaaacaaatttgtctccaaccaaatctattataagaaatttggatttgttcaaagatgacgatgatttatggcgcacaaaaggaagaattttaaaaagtggtttaaattatgacactattaatccaattttcattcccaataattcatatattgcgactttattgatcagagatattcatatgaagacaatgcatggcggtcgcgaattggttaatagcaaattgagagaaaatttttggattcctaaaagcagaaggaaaatttacgaaatattaaaaagaaaaaacaaagaaaaatgcggaatttgtgcaaaatttgcaaataataaatatacatatcctaaaaaccctcccctaccagtgtttagagtaaaagggaaaggtgcatttgaacatgttggaattgattattttggacccctctccgtaaaaacattggatggcaataaaaaatgttggggagcaatatttacgtgtttaattgtaagagcaattcatttggagttagtttccgacataagtgccgaaaaatttcttttagcatttcggcgattcattaaaagaagaagagtgccaaaattaattatttccgataatggtacaaattttgtattagcaaataaagcactaaaacaaatagtactcgaagaaaatatacaaaataaattatggtcagaaatttatcgtgatccgacggtacaaaatttttcatcaaatttgggaattgattggcaatttaattcgccatatgcgagttggcgcgggggagcttacgagagaatgataggacttgtcaagacacatttaattcggagtttaggaaaacaattattgagctttgaagaattaatgacatatttaatcgaagtcgagaggattgtaaacgaacgccctttaagctatataacccaagatgaagtgattgaaccattaaggccaatcgatatattaaatccgacagatggagaacctttctcactaaaattggatccaacatttgatcggaaagacgtgaatgaatattttgaaaagaaaactaaaagagaataattatttgaaatttacaaaaaagcaatttttaaaagcgaaattttttggaaggaatggagtgaaaaatacctattatcgttaagagaaaagcacatca

SEQ ID NO: 75579 - DNA, 372 bp, Heterodera glycines
  Genomic contig location: Contig_ID=SeqID_12050; Location=3303..3674; Strand=-
  SCN-specific regions: Sequence locations=1-239,261-372
atgcccattccaactgctcacgggtgccacgcatgcccattccaactgctcacgggtgccacgcatgcccattcgccaagccctcgggttccaactgttcacgggtgccacgcatgccattcgccaagcctcgggttccaactgttcacgggtgccacgcatgcccattcgccaagccctcgggttccaactgttcacgggtgcacgcatgcccattccaactgctcacgggtgccacgcatgcccattccaactgagcacgggtgccacgcatgcccattccaactgctcacgggtgccacgcatgcccataagccaagccctcgggttccaactgctcacgtcagaaagaatttcgaaaatttttcctaa

SEQ ID NO: 75580 - DNA, 51 bp, Heterodera glycines
  Genomic contig location: Contig_ID=SeqID_12052; Location=3537..3587; Strand=+
  SCN-specific regions: Sequence locations=22-51
atgactttctctttttgattgaaaaaattcgagcaaagatggaggaaatat

SEQ ID NO: 75581 - DNA, 294 bp, Heterodera glycines
  Genomic contig location: Contig_ID=SeqID_12053; Location=226..519; Strand=-
  SCN-specific regions: Sequence locations=1-129,151-294
atgaaattcgttgtccaaatatctttttttgggtttgtaggcgaaatgaatgattttggttagtaggcgaaatgtatttacaccagggatgtgccgagccagacaaaatccgattccgattacgttccgatttttttaaaataattttttcccaaaaattttattcataatcaaaatcataaattttaagattgtgatgcaaaaataaaagtttgtccacattctcaggcaataaacgttttctcagatctgtcacaatcaacccagcggtggagaatatttccagatatttga

SEQ ID NO: 75582 - DNA, 613 bp, Heterodera glycines
  Genomic contig location: Contig_ID=SeqID_12054; Location=27..639; Strand=+
  SCN-specific regions: Sequence locations=1-242,300-383,405-613
atgtccatggcaaagattgtggcgaaaagcatcacagcgatggggacaatttgggatttggaacatataaaaagattgtaagattgccaattaatcaaaaaacagaaaatttatcaaaaaatggcatagaattcgcatcttttggaattttaaaataggctaacgaaaatgtgaattataaaaaaattttagattcagaaaattaccagtttttgtggtatcgtttgagaattttgtaccgcttattttttatacaattaattcgaaaatcaatttaattaaattttttgttattttttgtccattgaaaactgtattttagcatttacgtagacacaaaagctttttttgaaaacctagatgttactaaaaagcaaaatttgtaaatttccagaaaaaacaaatgaaaattttttttatttcttaataactttttcgagtaggctaggaattttagatatttttgaaatttttggaaaatttataattttttacggcgaagttatgtcccggtgatatttcggccggcgactttttccggtgacgttttgtcctgctcccccaaaaaacacacaaaatatgtcctaaaaaatcaaaaaagggaatattcaaa

SEQ ID NO: 75583 - DNA, 725 bp, Heterodera glycines
  Genomic contig location: Contig_ID=SeqID_12055; Location=677..1401; Strand=-
  SCN-specific regions: Sequence locations=1-277,299-345,429-725
atgaacagcaaaatatgccaaatcattaagagtaaggacattacgaaaatagttttattaattgagacttgaaaagagttgccattaaattctcctaaaaaattgacacacttttagattaaaaaaatgaaaatagcagaaagaaaagataaatatatcttcacaaattggggaaaatttgattaagaaaaccaaataaaaacaatttgcctgattaagttaagtcacattcatttgctttgcgagtgtcggcgccgtctcgaaacgaataatttgatcaaaataaataaatcaaaatgatcaaatttgacgaacgtaaaatgcaattaacacacacacacacacaaaaaaaatatatattttaaaagtacattaattaaattgaaggataattaatttaaaatggtagtttaattaaatatttatatgaccaccaaaatttaataaacgtaaaaattgacaaattaaaaaagaaaattgaatgagaaagataaattttgtttaatatgagaacctcaatttttctacatcaattagagcaattacagatacaaaaatgtatgtgtatagacggcattcagtacaaattgccgaagtgcgtgagaaaattcttggaaaatgtgggcatcatgtcaagagggaaaaagaacaatttaattaataatttgtaggccaattttatgtcccaattattgtaaacaaaaattcgaaaaaaaattaataaa

SEQ ID NO: 75584 - DNA, 102 bp, Heterodera glycines
  Genomic contig location: Contig_ID=SeqID_12055; Location=50..151; Strand=-
  SCN-specific regions: Sequence locations=1-102
aatttctcaaaaaaagagatagccatttttctgggatagagtataaatttacaaattccctcaaaaataaaaggtctattgcgcaccgccctccctatcatg

SEQ ID NO: 75585 - DNA, 322 bp, Heterodera glycines
  Genomic contig location: Contig_ID=SeqID_12057; Location=137..458; Strand=-
  SCN-specific regions: Sequence locations=1-97,120-322
atgacagtaagaaaaaaagtgacagacgggggcggacggtaatgggagggagagggacactttaatacattaattgctcaattagtaagtaattaacgtgaagggcgggcggcggacggcaggaggggcgacgaacgcacgtcaattaaactgtgtgtatgtgtaaattaaaagtataaaccggtccaaacggagcaagtggggaatataaatgaaatttgtcaataaaattttcattttccaggtgcgcaaatgaatggtggtgggctggtctaaatggaaaataataaaaacaaaatgggaaataattgggtaaaataaa

SEQ ID NO: 75586 - DNA, 1115 bp, Heterodera glycines
  Genomic contig location: Contig_ID=SeqID_12058; Location=406..1520; Strand=+
  SCN-specific regions: Sequence locations=1-94,124-137,160-165,187 -347,369-380,402-780,824-995,1051-1115
atggatcggaagggacaaaggggtaggtaacttttttttgttgaaaactgtaataactatcaattttaaaagcaataagagaccaatggaaagcataaaataaaataatttactttatttaatgtgtaacgggtttaattcaattattttggtttatttgttaacagtgttgaaaattattatcaacatcgcaattcccacccgataatccactggcaaattgagaaacagcccatcagaagggcaacatttcgacaatgttgaacagaaagtcgggcccgaaatttgccttgacggagtcgttcatgtccacgagagtacagcacgcatacatgttaaacgattcggcttgcaaaaattggcttgcttaagaatgaaacaattcgaatttgttttgttttttgaatccattcatttactcacaaattttgtggccattcaatgtgaaaaaaataccccggttgtttgcgtccattccgcatccgacaacatcaccgggaccaaactgtgcgaatccgtcaagcacatccggcacgcatggcaatttgctgtggatagacccgtcactccacaacgcaatgcttgcctcaaaatgcccgaccaattcatgcatcctcatgtgcgctggggcaagtccaactccaacgtcccttaatattatcaaacttattttaaaacattttttttaattcacgatttcatctgaagaacggtaatttcaaagttaaacaatccaaaagcactggtggccggcataaccgagcgcaccgacacaaaatcttttaaaaaaaataaatatttatttattttattaatattattacagttattttgcgacaaatgctcgaccaacaaaaaatcataaacgtaaattccctcgttgcaatgattaatgtcccagctgtttaattgctgggccgcgagaatggactgaaggcaaattttgatggcttcaacagttcgcgtcagattattctgaaaaaatgaagagggcgaataattaacaatataagaaaaaatatataatttttttattcaattaaatttaatgtctcaaaatcgtggccaaattttcttgcattgattaatttggaaaaatagttaagataattaaa

SEQ ID NO: 75587 - DNA, 2755 bp, Heterodera glycines
  Genomic contig location: Contig_ID=SeqID_12058; Location=862..3616; Strand=-
  SCN-specific regions: Sequence locations=1-157,179-186,320-440,611 -636,767-962,984-1569,1615-1924,2094-2161,2217-2388,2432-2755
atgtactcagtgttctccgaactcgtccgagatgctttttacaacgactcgcgctttttgaccgtcagagacaaagcatttcaagaaatggtgaacaacacggaagtgttcagattggagttggacccaaaccgaacgaaaaaggttgaaaatgcgcaaaagcaatttttaaaataaatactaaacagtggacgcacagcgaacatcgagtcaaagtgccagaattgctagcaaattattgcgatttgttgctcagaaagtcggccctgacgaaaaagttttcttctgaagagatcgacaagagagactgaacaacgtggtgagttagggcagggcggtccaatggttattttacatttgaagtacaaaacggaaaagaaatttgactttctttttggtgttgttacgtattccgcatatttcgccacttcgtttttttagcttttggtgctgaaatatgtcacagctaaagatgttttcatgcgttatcataagacgcacttgagccgaagactgattctcgagttggtggccgactaagaaaaggaggaaatgctcaacttggccctaaggaaatcgctggaaaatggcagctgcagccaaatggccggttgacggaacactgaacgacagacattcattttggtttttcagattgtgtaagcgtcaaaattctgaatgccggagcatggtcgaggagtcgagaccgttcgcacctgactttgccacgggaattggaggatttgaccccggaagttgaggacttctacaaaaaaagcagcactgcggaggaaagctgaattgggcccaccattggtccacgggggacggtaattagcaaattaacattgaaataaagttcacaaatgccaaatgttctgtcgaaggtttcgttcaccagcagagcgggaaggttcgacttggaagtgacctctcatcagatggccattttgttctgttggaacgacagacccaacgacaaactttcctttgcgacgagtcgtctcgcgactgaattgtccgagggcgaattggcgagaagtctttttggtccgttctccgttttggctgcttttcactgctttcctttctttcagactggtgaatttccccaaagtccgaatgcgactgatcctttgcgaaatcgcccaacaaccgttgaccccaaaaaagcttcaacgagccggcctcgggtgttgaaatgttggcaatgcttcacgccattgttccgaaaaagccattcctcaagggcgaggcgcgaattgcatgcggatgacgcactttactggtggatgttgactttggatcggatcgcatgcacaatcggagtagtcaattggaaatggcatttctaaaggcacgcgggccttaacttatgaggtgaatgctgtacggtcttaccatatctcatctttaatgattgctaataaaaaaagattaaatctttatttcgcgagaaatgtccgtgagattaagttgtaaagtccaaaggcaaaaaaaaaaaaaaaaggcttttaatgttccggcggaaaattttccgattatccgttacgacaattgctcatttccattttattttttatcaataaaatgtttaaatattttaataatttagaatgattttaattggcttaattattattgccttcgtgactttttgtcttctgttgagtttcattgggtttaggggtattttttggttatgctgtcacaaatgataatgattccttttttaagctcgttcgcgctctgcctctgtgtatgagcgctcccgtcgtgtttctcaaactggcactcgcgcacatgttattgactttgatgaaccaaatacaagtgccggagcaaaccctgttcgtggtggcggtggtgggcgttttccaattgacgatgcaatgtggttgtccatgtttcgccgcttggtgggtttaatttaatttaatttttacttaaagtttatatttttttttgacaaaaaaaattttgaaaacgaattttttaaaaaataaattctattttaaactttttttaaaatttatttatttatttttttaaatttattaatttatttttattaatttattttttatttattttattttaattatcttaactatttttccaaattaatcaatgcaagaaaatttggccacgattttgagacattaaatttaattgaataaaaaaattatatattttttcttatattgttaattattcgccctcttcattttttcagaataatctgacgcgaactgttgaagccatcaaaatttgccttcagtccattctcgcggcccagcaattaaacagctgggacattaatcattgcaacgagggaatttacgtttatgattttttgttggtcgagcatttgtcgcaaaataactgtaataatattaataaaataaataaatatttattttttttaaaagattttgtgtcggtgcgctcggttatgccggccaccagtgcttttggattgtttaactttgaaattaccgttcttcagatgaaatcgtgaattaaaaaaaatgttttaaaataagtttgataatattaagggacgttggagttggacttgccccagcgcacatgaggatgcatgaattggtcgggcattttgaggcaagcattgcgttgtggagtgacgggtctatccacagcaaattgccatgcgtgccggatgtgcttgacggattcgcacagtttggtcccggtgatgttgtcggatgcggaatggacgcaaacaaccggg

SEQ ID NO: 75588 - DNA, 1184 bp, Heterodera glycines
  Genomic contig location: Contig_ID=SeqID_12059; Location=99..1282; Strand=-
  SCN-specific regions: Sequence locations=1-5,28-58,87-555,577-1184
atgcgcaaagtaccagctaatgaaaagctaaatgcattgaatcttgctttgaataaggaaataatcaattattttaattataaaaagtctgttgagaaaaacaaaaacaatatttttttactcaaagagttttccgacagttatttaaagctgtgggaatttgtcaaagaactttactttggtaagcaatcgaaatttcaattaaattctttgtgtttttagagcccggacgggcccgggtgcccgccgtgctttgccgggcccggaaaattaaaaaaaataccgggcacggtaaaacgggattttttgacagggcggcacggtcccagtcaattatctaagcccggtcccggtactttcaaaataccgggctctagtgtttcacaaataaaaatttgttatttcatagatttgtcaagaatttgtgcttttgcacgggaatataagaaaaaatatgttgacggattaccaattttgaagggtttatggtttatgaaaacggaagcaaagagtgcgtttgattttacactagccaaaacaattgggcaaggaaactaccatgtttgggaagaggaatttggcaaaatgtattgggatcacataatgctgatcaatgcgcaaaaaatgccgaatttcaacgagttgaagcgtgtgccggacccatgtgaggaggcaaagatcaaagtgaagacgcgtgggacaattgttggatgaatagtgagtgatccgaccgaaatgggagaagagaagccttagggtttttctgagttttaatcatatttgttgattttaatatgatgatgtaaaatgattttactttggataaacagaattgctgagagccgagaatactcgtatgccaatattattgagaatttcataaatttgctgaaattttcttcaaaatttcagcagtatgtatttattttttaggcatgccaaattattagggatgtgcgagagtctcggttctcgactcgggaaatttcttggggttttcacttcttggttcccggtctcggatttttagtctcggaaaccgagaaatttttacactgttaggtatgaccatttcgtggtgggggacagggctgtgcgaaaatcacaaaaaaaatttttcgtatacgaaaacgaaacgaaaaagctcattcgatacgaaaacgaaacatgaaacgaaaaataaa

SEQ ID NO: 75589 - DNA, 463 bp, Heterodera glycines
  Genomic contig location: Contig_ID=SeqID_12060; Location=114..576; Strand=-
  SCN-specific regions: Sequence locations=1-271,293-463
atgtgcaaaattcctttcatcaaactgtcccttcttctgatcatcttgatcgaaattgtcaatgttgcgaatggaatgaactataaatatgaaaagttaaatgagccattgctagaaaaagaagacgactctgatcagccgcaatttgaagtgatcgaagatggcacgacggaggaggaagacatggaaaaagcaattaaaatcctcaaaagattcttttggcgagttataatggcaatgaattgcaaaaataataccattaaaaagccagaagaaattggattccaaaaatcttataaagaattggttgaaatttgcgaatattggaaaatgttatcaatagcagctgaagcatatgtgaaaagttgggagagatgcagaaaaggacaaaaacaggagaaggaagttgaagttggcacaagttcaacgagggcacaagaaacacttaagacggaagaaaatg

SEQ ID NO: 75590 - DNA, 1346 bp, Heterodera glycines
  Genomic contig location: Contig_ID=SeqID_12060; Location=656..2001; Strand=-
  SCN-specific regions: Sequence locations=1-28,50-269,291-383,405 -486,510-636,734-814,839-902,924-1065,1098-1125,1148-1173,1195 -1198,1220-1247,1272-1346
atgtgtgagtcgagcaccaaatttatggaaatttttggcaaggaatcaaattgctcaccaattgacgcaattgaacagttccaagaaatgaacagcttggaattaatgcccaataaaccgctccaaattgtgcttgaagaaagtgttggcattttgatagtggtggcaaatgataaagttcatgcaatgatgaagaaaatggacaaaaattccgacgagttgaagcagttgttggtgccggacccgtgtgatgaggccaaactgaaactgaagaagaaggagatgatgaacaaggctgatcagccggtttgacgaaaattctcatgaaaaagaaatgatcaaaatcagcaaggatggttggatcataggatcgcaagaaaggacatgggaggagaggattttcattgatcagtgatcaaactctttatattttctttgggcgtagactttagattgatttaatctctctgttggtaacttttataaactttcattttcaaaatgattttctttttttttattggaaaagtacaaatgagcggaacgggtaagctttgtgcctccaattccgtactagggaattttagggtcaattcttttattttctaattatcaattaataagtgaaaacaaatgtattaaaaaaataattaaaagcaataattatatattgaataacaattattcctatgcaaaaaattaataatatcaaaacttaatatatttaaatttacattgtatttttactcaattatttcaaattaatttcatgaatgtctaaaagatttaaatcttttaaggatattcgatttgatttcacagatgcctgaatttgagattggtaaatgaaaacggaaaatgctctgtttttaagatctgctgtcctgaatttagtactggcttttcctgttatttttaagatttataataaaatggagtttggcagtcggaaaatgtcctgattttttgaagcttgagtccatttccttgtcgttgtacgtgttgatcacgtgcaaattgttcaactctttgccgttacttagtcctcgtccagaaccaaataactttaaaaaaatttaaaaaactataaaaaaattgccataaaatttaaaattgactctgatgaggacacttcatcttgctggcaattctcgactccgtgcgattgtttggctgaaattttgtcaaaataacgtctcattttatttaaaaaataaagtatgacaatattttttgtagataaatgtaaatattattgataaaaatgaagttgtatatgtatttgtggcggacgtgaaatgcttgtaaaatgttggcaatttcattcttattgacccattaataaa

SEQ ID NO: 75591 - DNA, 614 bp, Heterodera glycines
  Genomic contig location: Contig_ID=SeqID_12060; Location=2257..2870; Strand=-
  SCN-specific regions: Sequence locations=1-180,205-466,488-590
atggagacaaaacagaagaatatccatcttctgaacttgacaagactggcgtttaaaggcgacccctattttgatggattcgaaaattcaattttaaaaaaacaattttctaatccgccggcacaaaacggacttaacgcattatccgatttacctgacgaacttggtgtattttccgatttgagtgaccaatttaagcaattaagtttaacattaggttgctttacatgctttattgatgaggaactgacttgttgcagcaatttgagctgtgcgttcaaaaaataccaaaaacaacagaaaaaattgaaaaatgaaaatttgaaggacgaagaaaaattgaaaattttgaaaaaagtcaaacgtgaaggtgataagctgtggaaaaatgcgcagcaacttggattaggtaattgaaaaaatgttagtgacataatttaatacttttgagcattttcaatagacaaaaattttggaaaattttcagggaatttcggaaccccaaaaaatacgctttcctttttcattttgcttgataaactatagttacttgggaattatgaaattttttattgaaaacttttaaaattattttcttccataaaaatattaaa

SEQ ID NO: 75592 - DNA, 1028 bp, Heterodera glycines
  Genomic contig location: Contig_ID=SeqID_159; Location=233..1260; Strand=-
  SCN-specific regions: Sequence locations=1-37,59-492,537-1028
atggctaaaaaaaaatcattgcttaagcttcaaggcaaaagaggtgctgaacaactgagaaaaaggcgagaggagagaaaagcgcagacggccaaggcgagacaagcctatttggccaagagaagtgagtttttccatttatttttcataaattcccaaattttccaatttttagccgctccccagccgaacaccgatgcagaaacaccacaaccatccgaagaagagccgtcgacatcagaggcaccggcgcgggacaacgacggacgaccaccatcaactccaacaccgatggcaccgctggaaatggacgtgccgtctgtggagatggtggacaccgatgtgcaaatcccttcaacgcctgccgatgaagaccaacaaattcaaccaatgccgtcaacatccacggcacgctgtgaccacatggcgacaccatcgacttcaaagtgcgccggtgcctttggtctcgatgatggtgagagaaattcaaacaaaattttagtttttttaattcatttcatttttattatttttaagtccacatgtttgacgagctgcgacggcgccacgtttggaccgaggaggaactgcagcgacagcgccggtcgaatgcctttctacggaaacagctcaaggcccagcgcgaccggtcgacaagcctcgagcgttcggcttcgtcatgtcgtcagcgcaaagccctttctgacgtgacgaataaccaacacgaggacaacaggctgagcgcggcgaatgatctgctcatcacattggacgcaggcatctcgttcaaggcccgtgaagcgttgaagcggtctttcgccggccaaggacatgatgtttgggcaccgacgagagcagtgaagcgtctgaaggcggaactgtgcgaggcggtcaatttccattggacgggcaatggtgagacgcgtgcgctcgtttccgtcgacgttcgtgcaatgatcgagggccgtcttcaggatttggtgaacagtggtgagagagagaaaaataatcgaattttaaaatgttaa

SEQ ID NO: 75593 - DNA, 6035 bp, Heterodera glycines
  misc_feature (58)..(58): n is a, c, g, or t
  Genomic contig location: Contig_ID=SeqID_161; Location=1..6035; Strand=+
  SCN-specific regions: Sequence locations=1-58,80-213,235-313,338 -472,501-667,691-770,799-915,938-938,968-1167,1190-1271,1294 -1333,1361-1507,1529-1764,1791-1807,1829-2226,2253-2347,2369 -2375,2409-2677,2864-2866,2888-2947,...
  SCN-specific regions: Sequence locations=...2973-3604,3629-3656,3681 -3903,4041-4216,4268-4344,4407-4444,4470-4839,4868-4986,5008 -5204,5237-5271,5294-5321,5363-5471,5496-5737,5759-5792,5814 -5938,5973-6035
  Gene Ontology: Cellular component=nucleus
gctgatggagacgccggaggcgacgactacgacgaccaaatggacgacgacatccacnggtggcagcggcagcggaggcgtacagtggcaacggcgcgtgccggcgggcggcgattttgcgcgcgaattgcgtgacgccggtgggacgggggcatcagtttataatagcatgaaattatttaaatcatgagaatgcggagcattctaaaagctaataatgaaaggacaaattaggcctcggataggaatcgaacccacgcctccacccgattcgcgtgggttgctctaccactgagctaccgaggcgtattcgaattttttaaatttaaattttattcgcttaaattgccatttgctttttcattcttttgagatagaaatgtttttaatggagctttaagtcatttatttgaatttggccaattaaagagaggtaatggcacaaaaaaactcgaaaaattggtcagaagggattaaaataaaaatttaaataaaaatttgtttagctctgaccgagcgccaaagggcggccaatttgcagcaaaaatcggcgctaaaacagccctttggctgccaattgcccagctcactgcacaattacgcttatcatcaggtgcagttatggaaattcctaatttaatttttttttcttattttttgctttaatttggccaatttctgtgccaaatttggccccttcgtcctttttttttttgttggccgtcggaaagtcccctcggggaaataagttccttccgccggcatttgccgtccaattaaaaaggcaaaataataaaaccaattaacacagaaacgaagaaaatattccccattttaggacactttaattggcctcattttttaaattttcttggcattttctttgttttggccctattatttatggccgagtaaacttctctttttcttttccatcgaatatttataattaataaatattaaaattgcatttttataacaattttagacggtcacttcatcgtctttgagcagtgcagcaacaaaaaatggcggtggcaccgccaacaaaaacaacggtggccaagcagtggacgaactgatccgggacatggagtttaaaatgcgcagtgccaacgcgtcaaacaaaggtggctcataagtcttttttggcatttgaaatggaatctgtccgagatcgagactctcgagcagtgacaagtgtgtctgaccccaacaatttcgctgccgccccccccccctcccccgtccaattccattgcttctcccgctacttaaaaatttggccccccgcggagtcactcactcaattcacggcatagcgcccgccgggtacaacaacaacaaaaaagaagcagcacaaaggaatttccgccttttccacatgctcttcttggccccttcgtcccctggggcgtttttggcttttccccatgcccccccccgttttttacgctttcaatttcctctcatgggcgccgtgccgtgccaatgcgccgttttaccgccctaaaagggcaaaaaattcttttccttttgtcagtttatgtacttttttcttctctccacaaaagtgtagtgccaatgtttgtgcttaagtgttatgtcgaaatttgctcagtgatctttggtcaacgacaaatttgtatttatttaacgtgcgaaattgctactttaaatgcccataaataaattcaaatttaaattcttaaagtggattaattgttaattgcttctcgtgtggcgaaagaccaaacttttaaatggccaaaaattctttaaaaaatcccataaaatacgttttttgaaacattttcatcacttttttatttgaaaattatggaactataaaaaccataaaatgcacattatttcaaatacctatttctgctttaacccccccccccctcaaattcgcaattcttcccattttttcgcgtccatgtttcatcaaaatctgtgcccgctctgtgcaaatataaaaaaaaccattcattcatttggccattccattcaacacatccacctcccattcattcatttccttactctttcttcttcaccccgtgggttttgaagtgtaaaaagtgtgtcgaattgaatgggccgggcaaaaaaacgggggttggcgatgcttttaagccttttgaacttttggcacattgaattgaatcaaaaattcaacaaattttactttgcccacccccctaatgcttcattttctcccatttaaactttttgtttagttttgccattctttgcctttgttaccccccgtttttgtcctctttccgcccctttttcccccttttttcggcattaattttgcctccccaaatgagggggttttgtcgagactgactttcaatggacaatttgtcttcttgtgtgttttgtgttgttgtcgagagtgaaagggccggacgcaaaagaaagcgccaaaaactttggcgccgctgcccccccccttttggtgtacatttttttcccggcggacggtgaaagccttttcgaaaacattcatccgccatgaattggatgaggaatgcgagtagtgaatgaatatgtgtcttccgtccgtccgtcgtcaattgttcgttcggcttctcgtcgtcgtttgtccatggagcacagctgcccggaggaagcggggaatgaatgcttcacgtccccccggggtggcggggcggggggagggggccggagagcggggaatgggagaggccagctgatgaaccatcgggcggggggagcaagggggagatgaagcatgcgaggaaaagctggggacaggggagcaaaagatgaagcatgggaggggggggggtgagtgagggatgaagcatggaggaggagggagaggccagctgatgaaccagtggggatgaggaggggaagatgaagaattggggggcgggaacggagagcattaccaccatcaccaccgtccgcttctcctcctcctcctttaatcatcatcatttgccggagcccgggctgaatcaagcggcggtgcttggaagagcacaaaacaaactttccctcccgccgcctatccccggagggaatgggcggcgggggggggaacatttgctaatgcacctccatccacagtcgtattcattttgtcactttttctccatccaaatctttttggaaaattttttcctatcccattttttcaacaaattcatcattgaacacaacgccaattcgttgtttttttttcttgacactgtcgcggtcatttgattccctcctctcagcttagcccccggcaaatgattaaaactcgcaaaaaatcaccggaaatcgaccttatgccattgctggacacccccaaaaccaaagcccgccgaagtggcacaatgttgaacagttgccccccccctttggtcggcactttgcttaacccccccccccaattcctcctccggcgcttttcacacggacccaaaaaatcgacgtaaataaaagtacgccccctcctcactttcaacgcttgttttcaccatctatcaatccaatcattaattttctcagctgctaattgcctgatcagtgcttcgcccttatgggcggctgatcaaacattgggacagcgaaaaatatatattaagatagggcaatttataagaccacacattccattagagaataataataataataatttaaaagcttattatctgcagcgaaattaataattagtcattaattaccacccaaataattaattaattgtttgccctctgtccgcccctaaaattgttgaatttgatccggcaaaacgcgtgtgaatggcggaagttggtgcgtattttaatagtcgaaacttgaaatttacagtaacaacttacagtaactaattctcaattttcaactcacattaacattcttggcattatttaatttaattgcaaattaaaatttaaaaaaaaacaaaataaaaaataattaattgaattttgaattcttaaaagcattggaaattaggaattttaattataattgtttaaattaattattaattaaaatttcaatttgctttcagatacgtgcacaaagtgccaccagcaaatcgggggcgaccccccgggggtcaccgcgctcggcaacccctaccacgtcacctgtttctgctgcgatgtgtgccaaaaacagttggccggtagttgaataattggccatgaaaaggcagtggggagagcgtcacattaaaaatattttatttttaatttttgaaaatatttttaaagaaaaaaaacatgacgcgactctattgctgataaaaaataatgaataattgtttgaatttgtggaaaatggcaagaaatagtgaacatttttaaataaacaaaatacaaaaaattttcatttattaaatttttactttttatatttttgccgctctaagcaaacactcgaaaatgaccttagggggtataaaatatttatttaaatattttctgtatgcttcttccgcttaggttgttccttttacgcggtggacgggaagaatttgtgccaagttgactacatgaactcgttggaaaagtgcgacaagtgcaaaatgccgatcactcagtgcgttcaaattggctgaaaattttatgggattcgaaaaagagtgggagagtcgcaatacgagagccaaaaatgccttgaaatctctcgaaatcgaaaaccgagactctcgaaaaaccctcttctacataccgctgaaatggtcatattttagccggcattcaactccctgttatcgttttttgcattttttgagctttgatcccacatgatatccatccatttgattaatctccctaagttggcattatgtattattatattttttatttaattttatgccaaattcccaggaaaattctccgtgccctcagccgcgcctttcaccccgagtgttttgcctgtccgatctgtcaaaaatcgttggacggcattccatttacagtacgtaccttttgttgtctgctggttactgtattattactttttactcaggtggacaaggagaaccaagcctactgtttggaatgctatcacgagtaattaatatcaattaattttatttgtattgggacatatcaatcaattttaaatgggtttgatcattcgctataaaatggtcgatcactctccgcggggttctaaatctcgaggacggtggttgggcattttggacctattaaattataaattaaaaaaaaatttttatggaatcaggcgggaaaataaacgtatatttccttaaaataattcccctccaattctttggcgaacaaaaaacaaaacaaaattggtaaataattcataattcattttttaaatttaatttattaaaccatcgcccaggcgcttctctccccggtgtgccgcctgtctgaaagtgatcgcaccaaatggcaatgagacggaggtggcgcgggtgatcgccatggtcagttagcgtgaaattaaaaaaataaaataaatttcaaaaatgcgcctggggcataaatttttataggacaaaagctaccatttggactgttacaagtgcgaagactgcggtctgaagctgaattccaaaattgagggccaaggtgaagttgcttttttaataggaaattgagttaaaaaaaggccttacaccaagtgatcagatcactactaactttcataatgatcggaattggcaaattgggggtaatttggaaaacaaaatgcccttttatataagaaaagactcggaaaagataaatccgtaagataaacaatattttctttgaattgccatttttataataaaatttcgatgaattgtcaccaataatttataaaacctcaattgatgaatcgaccattttactccttccccctgtccccataaaaaccggacgaagttcaaaattaaggcttatccaccccatttttttgctaattttttaaataaatttcaaatttatttttaaggctgctacccgttggagtcgcatttgttctgcaaaaactgcaatttgaagcgactgaagtcc

SEQ ID NO: 75594 - DNA, 1466 bp, Heterodera glycines
  Genomic contig location: Contig_ID=SeqID_162; Location=450..1915; Strand=+
  SCN-specific regions: Sequence locations=1-3,56-399,438-605,629 -657,680-727,769-1007,1042-1089,1111-1233,1255-1315,1337-1466
atgtttaataataaaaaatatgtacataatttaaattattttaaaatatttatttcaagctcgtcagtggtcatctaccgcatcgcttgcggcgaaggactttaccaagtaattattgttggagcagctcttttcctcgcccagttagattggaatttaaaaaacgaaatttaatttttcgaaatttttaaaatatttttcccataaccaaaaagaaaagcttttcgaaaagccccaaacaaatggtttattttcagcatcttttggcctacgaagtgccgctggtcaagcatttgttggcgcaccgttggcaaagccaagctgacactgactgtcgtcaacaaattgcggaacatccgatccacaccatccaacatcaatcagctaatgcgataaagccacgggtaatggaaaaattatatggaaatcatggatttaaaattacattcaaatttcaatgaaaaaaaatgttggtccctcagaccgaaatacccgactggcacactcatcgacaagggcgtggtcagccccaaatgttctgagtcctttttggcctcgcagcgtgcgttgcaggtgtcttcctctgttttttgaacttttaaatcaaaatttgaaattgtttttccccagggaactgctcgagtgccacggcacgccattttgatggacgacaacggatatccaacggacaaaacccaacaatcacatccgtatgtccaagcagacgaatataaattgtttaaaaatgtttgactatttcttaaaggccctctgttttgaacaccaaattgtctctccgcccatttcccctccctgcgccggcaggattttcccattatgtttagataattttggataaatttcattcgctttcatatgccatcattttaattcttttttgtgtgtttcatatatttttggctttttaggccaaaaaaggctggaacatcttcaacattgaccagcagtcggctgacaaatgaggcgaaggctgggaaagcttcgacactctgaacgacaatttggattttgagaacaaaagctaattgagcaaatggcgcgtcaatcaatgcctaaggggctcgaattgatttttccaatttaaactgatttcttcgcttttattatgtacaaatataaaatcatcttttttcttaattttttttctgtttctcattttgttagcaaatgttttctcttacgctttatcccttcatatcccattatcattacgtggttgtattatctcattgtcagcgttttctgctaattattattttttggactttattataacatatgatgatgctgttttccaacctttacggccaagtttaatgtacactcatcggtaattgtgtcggtgagcccatttttaaaatctttttcgcttttttaagttaaatcagaaaagggttcatcggcattttgattaattacataatcaatttaagactgataaacaa

SEQ ID NO: 75595 - DNA, 860 bp, Heterodera glycines
  Genomic contig location: Contig_ID=SeqID_164; Location=514..1373; Strand=+
  SCN-specific regions: Sequence locations=1-168,246-434,457-498,520 -601,704-747
atgcaacagcgggtaaaaggccgggctaacaacaggcaatagacagatggttgcccagatttatgggtgcaccacaaaaacttgttgagaaacaaatgaaaatttttctagccatttttcgattttcaaattttttacaaaaaatcgctagaaaggtttttcaaattcttttttatattttcttataaaatattttaaaatttttttcgtaaaaattttctgtttgtaaattttttttttaatttccggcggcgagattttgccaccatcccagattttattaccaacaatttgagctttttttagcgccaatgccaaaaattatgctaatttaaagaatgtttcgttagattttttccgaaatttttgaaaataattggcaaatttaaatgtaataattttctaattcttgaattagtccgttgttttgtttcactttttaaattcatttttatcgtgcttttccagctttgtgcccagcggccaaacggtggccagctgccagaatggccaattcctgccagccgtgcttggccaatgtgtgcagtcgagtgccgacgcgacaccgtacaccatgccaagcgcaaccacgacgacgacgaggaggagcagcaacagcagcactactgtagcctcgtcaacgacaacaagcagtaacagcaacaatggcatgggcacaacagcaaatgctacagcagcaacatttgccatcaacggaacaggaggtgatagtggcacaacacaaatagagcaagggaagagatagaagacgggagagacgggagagagaaatggaagagagagaaagataggagagaaatgaggtgaaaagagagaaggataagagagaatggaagaaa

SEQ ID NO: 75596 - DNA, 3359 bp, Heterodera glycines
  Genomic contig location: Contig_ID=SeqID_165; Location=147..3505; Strand=-
  SCN-specific regions: Sequence locations=1-646,670-706,744-765,851 -1557,1580-1628,1650-2295,2317-2481,2503-2800,2822-2977,3012-3359
  Gene Ontology: Mol. function=electron transporter activity; Cellular component=endoplasmic reticulum; Biological process=protein folding
aggcaatgctaaaatgacactcggcaattgccaagttcatcactaggtccgccaagtcgcagctgatcgtgctgaatgccgacaaatacaatgtattcttgtgccagattaaaggcgcaatttccttccatcccaaaaacttttgcagcaaatccatgacgaagtggcagctgccgacggcaccgccggcactctgtggctggtcgaccacttcgtcccctggtgcccgccatgtctccgcctgttggccgaactgcgcaaattgccggccgaaattgacgggcgcccgcttcggctgggcactgtgaattgtgaagcggaagcgaccatttgccgaagcgcgggcatcagaaggtgagggaagaagcggcagaagaaacacaaaaaatgagtcattataaaattaaggaaaggtcgggctaattaatgcctaatcccgattctcgaccctggtttcatttaaatgtgggcagaggatttttgcagaattgccatcatttcaaatcccgacagtttgttccattcccgaatcccggatcaggctcgaaccctaagttactcccaattccagtggactagtcaattcagactcgacccctcgaggctagagactaagtcaaaaggtgcactacgttcccctcctccgaaaaattaattttttttaattttcaaacaaaatatttcatttagaaaattgtttaaaggcaaataaaatttcaagaaaaaagtttttcaaaaatttctctggcgtttttaagtctgaagaaaattttttcaaattcttttcttataaaaaattttctagaatttttttaaaatttttaaagtttgattttttttttttaattttcacggggaaccgacagggaaggcgggcggggggggggggaaacgagctgctccaagtcaaagacttacctcaaccaactcgaaaatctccatatctttcttgatcatggcaatttttttgattatccctccgcccctcgttcagttatccccactccgtgctgttcacgccggacggtgctcggcatcccatcgtcggctcccattcagcggaccaactgctcgaatttgttgccgaagcattgaacccgtcggtgctggcgctgaacagcactttgttcatggaaagggtggtgcacaggccaaaaggccatttgttcttcgtcgactttttcggtccaaataaatattattacgatatttttaataatgcggtttttggagcaatcgaaaccatccaatgccgtaattctcattttttttttaaattctcgataaatcattttttaactggctgatcaatctttcttgctatgccatttcgagagtctcggctcagagtcgaatattcctcttttttttgtcccccaattcgatttcgtctcgagtttttagtgccctgtaatttaactaatttcccatttttagccccgtggtgcggtccttgtcaacaggtttgaaaaacccgttttctttgtcgaaaattacgaagatttcctcattttaaagttggcacccgaatttcggcgattggctcggcaattttcagtggtcgcaccacaggcggacattgtaagcgaccgttgaccttgaccattttggcatttgactgttcaatttttctaattaaattatcaaattgtttcaattcaccttaattcttctgtttgcggtgtcatgacaacccgtacaaaaggcaactcgtttaatgccttaggcataggcctatgctttaggataggcctaggcttcgacttgcttgggcctaggcttaagcttaggctttattttgtaaaatttttattatatgagttgttttttgtacgtgttgccattgatcctcatttgcaatttcttttttttcaaagggcaattgaaggattttgggttcggattttcctatttttgaatttatcttattagcaatttttgctgtccatgagagggaggtcccggggatggaatccactcccgacttctaattagaaaagggctctctagaaaggaactacctcccattgttttgggggaactttttcatttgtttttgttttttgggtgtcttttggctccgtcgactgcgaagcgttcccggacatttgcgacggggaatacgtgcacagttacccgaccattcgtctctaccggcaccggcacgacttgcaaccgtagtgagtgtgtgggggccgaaaatggaatgagtcattggcatctttccgaaattctcgacaattttgcgccaatgttaaaatcaattttgaagtgattatccgccaaattggtggcgaaatgcccaatccatggcccattggctttccgaaatgatgccgacgttggtccagcggttggcgggtgatttccattccaccgttctcggctctgatcagccgtttctcgttgatttctacggtaaatccctggcattttcaaatcccctacagtataccacagtgtcatttttgataagtttcagctccatggtgtggccattgtgtgcaatttgcgccaacttttgacaaactggcgaaggtaagtcaactttctcaaacatcgtttagtgtctgtccgctggccgatcattagcaatcaaagctctccgttaatggtcctatcatagttttttggattaattgggctcccaacaaactaagattcacattgggcccataaaataagcgattgtacccatcattagcacttgaaatgctccccgttcttcagcttctcgaaggcaaagtacgtcttggcaaagtggactgtgaccggttcggccacatttgccaaatggccggcattcaggcattcccatcggtgatgctctaccctggtaaaacatagttaattgcttttttcatttattttttatgttttattaaggcgttgatcggatcggcgaccgacagaatgccaatggcatttttgtacggcatggaaatgacgcgcaacgaatggctgaagaagtgcgcgaaatgctccgacaaagaggaaaagataagcattggcaggagagggacgaattgtgatcggatttggtgggtgatcgatcagccattcaatcgattgatcaatcgaatgctcaaaactgtgtgtaaatattgtgtctaatttattgtatgtattttttgttttgttttttttttagaaaaaacgctttgttgggtgtctaaatgaacatttaaattttacaatgccaatgccaaacattcacctttggccataattggctaagtatcggaattccatttgacttttttttagtttcggccggacttttttttgtatgggtgaacggttttatacatagctcatttttttatcaaaataaacaaagaaagaaaaaaataaataaa

SEQ ID NO: 75597 - DNA, 653 bp, Heterodera glycines
  Genomic contig location: Contig_ID=SeqID_165; Location=1040..1692; Strand=+
  SCN-specific regions: Sequence locations=1-150,172-653
atgacactgtggtatactgtaggggatttgaaaatgccagggatttaccgtagaaatcaacgagaaacggctgatcagagccgagaacggtggaatggaaatcacccgccaaccgctggaccaacgtcggcatcatttcggaaagccaatgggccatggattgggcatttcgccaccaatttggcggataatcacttcaaaattgattttaacattggcgcaaaattgtcgagaatttcggaaagatgccaatgactcattccattttcggcccccacacactcactacggttgcaagtcgtgccggtgccggtagagacgaatggtcgggtaactgtgcacgtattccccgtcgcaaatgtccgggaacgcttcgcagtcgacggagccaaaagacacccaaaaaacaaaaacaaatgaaaaagttcccccaaaacaatgggaggtagttcctttctagagagcccttttctaattagaagtcgggagtggattccatccccgggacctccctctcatggacagcaaaaattgctaataagataaattcaaaaataggaaaatccgaacccaaaatccttcaattgccctttgaaaaaaaagaaattgcaaatgaggatcaatggcaacacgtacaaaaaacaactcatata

SEQ ID NO: 75598 - DNA, 3211 bp, Heterodera glycines
  Genomic contig location: Contig_ID=SeqID_166; Location=2138..5348; Strand=+
  SCN-specific regions: Sequence locations=1-348,371-1293,1315 -1477,1504-2767,2789-3163,3187-3190
atgcggcttgaactttcagtggcagacaccgaagcgccgagcattatgggattggattggatcatccctttcgagcgtgccacccaacagccaattgccacgactttggagcagcagtcgctcattgtcaacagtgtgcaaccaacaaatgatccggtcaaattggaagggcaaatcaaggcttccttcccgaaggtgtttcaacctggcctcggacattgtgtgaagacgaaggccacgctgcatttgaagcaaaatgtgaagccagtgttctgccgtgcgcgacctgtgccgcatggagtccaagcagcagtcgacgaagaattggaccgacttttggactcgttagtgctgaagcccattgatttttcgcgctgggcagctcccgttttggcagttcgtaagaaaagtggtaatgtgcggatttgcattgacttttatacgggactaaacgatgcgctggagttgaacaggcatccccttccgcggaccgaagacatttttcatgctctgcgtggagccaaagtgttttcgcagcttgatttgcgtgatgcttatctgcaggtcgaactggacgaaagttcaaagcagttagtcggcatcaacacgcaccgcggactttttcaatatcagcgtcttccttttggcataaaatcggccccgtctatttttcagaaagcgatggaccaattgacgtccggtattccaggcgtgtttgcctatttggacgacatcatcattgcttcggccgatcactcgcagcatgttgctgctctcattgaactcttttcccgaattcaggactatggatttcgagttcaattggacaagtgccactttttgaaggctgaattgaagtttctcggacacgttgtctcgtccgatggtctgaagcccgatcccgctcgatccgatgccatccgtaatatgccgtcaccgcatgacattggcactttgcgctccttcctgggtgcgctcaactattacggtcggtttgtcaaggaaatgcgcgatttgcgtgcacctttggatctgcttttgaagaaggacactccttggttttggggtcctgatcagcagaaggcttttgatcaggccaaacaggttcttcaatcggatttgttgctgacgcagtatgatccgagtttgccgatcattgtcgctgcggatgccagccaatgtggaatcgtagctacaatcagccatgtttttccaaacggagtggagcgcgtcatcgagcacgccagtcgaacgctcactcccgctgaacgaaattacgcccaaattgaacgagaagcgttgtctttgatcttcgctgtgcaaaaatttcacaggatgatttacggtcgtaattttactctgttaacggatcataagcccctcttggctatattcggtaataaaaatgggatcccgatctacacggcttcccgattgcagcgttgggccctaattttgtccaattatgattttacaataaaatatgttaaatctgcaaattttggacaggccgacgttttgtctcgactgatttctgagcaccggacagacgaagaagtcattgtcgcccacacatcggacaacgacgtggacagcactgaagaagtcgaatatgctcttcttgtcaacttggagcagctgccagtcgatgcaaaagaagtgagcgaactgacgacttcggacgatttgttgcagcaagtggcacaattcgtacgttccgggtggccaaacaaatgcccagctaatgaattaatgcctttctattcgagacgtgatacgctcaccctcgtgggcggttcaattttgacaggaaaccgagtcattgttcctgcgccgcttcgtcaacgtgtactcaagacgttgcactttgctcatcctggcattgtgcgaatgaaggcgctggctcgcaaccatgtcttttggcccggtcttgacagtgacattgaggcaatggtaaagcattgtgcggaatgtcaattcgccgccaaaatgccgccgaaagcgccacttcgaccatggccaattcctggtgaagtttttggacgtgtccatattgattttgcaggcccatgtgccgatggaaacatttatctcatcctcgtggatgcactttccaaatggcctgaagtgatgcatatgcgcacgacaacagccaagggcacaatcgaagctttaaatttggtatttcaccggtatggtgctccaaaagaaatagtgtctgacaacggaccaccatttacttcccatgaatttaaggacttttgcaggcttaaaggcattaagcacaagttctccccgccgtatcagccgcactgtaatggtcaagccgagcggatggtggacacattcaaacggcaggcaaagaaaaacgcaaaatccaaaaatcaacaatggatttcggaatttttgtttgcgtaccggtcctcgccgagtccaattttgaatggtttttcccccgcagaattatttttgggaagaacactccgcacgcccttgtcaatgcttgaaccgagacagcacacgccgaacgagaacaacaaccaacgtggacagtaccaatcgaggatgtcacagcagtacaaccaacatcatggcacaaaaagccgttcattcaattcaggagactcagtcttagtcttgaattatggtaggagtggtaagccatcatggttggaaggtaaaattgtgagtggtagtggtttgatttggaaaatcgaaattccaatccttggaattaccgtaacgcgtcacgtcaatcaaatgcgttcattttccccttacatttcaagtaagattgtgtccgatcagattcaagccgctccgcaacaaccaattcctccaatggcgccaattcaaattgatcagacacctgtccgtgatcaaactcctgtccgtgaccgcacacccgaaccagtcaaatctcctcgtccgcagcgacagcgcaagaagccaatttgctattcgcccggctaattgccacggacggtctttccaaaagagggagatgttggatgtgttgatatttaatattattaagtttgacacgaatacttttattgattagttatttgttgatgggtcctctcccatcgactcattctttgcatttgtgttattttacatttcggtgtttattttcggactctctaatttgactccgtcgttattttattattattttgtgattctaattttattgtttattcattta

SEQ ID NO: 75599 - DNA, 1077 bp, Heterodera glycines
  Genomic contig location: Contig_ID=SeqID_1736; Location=422..1498; Strand=-
  SCN-specific regions: Sequence locations=1-289,347-818,840-1077
atgggaaaggctctcttgctggtattcataatgctaaggatagttagttatctgcagctaaggatttgcggatagggtagctgcagataaaataatctgcagataaaatccgtattcataatgctagcgctaactatctgtagctgacgatttttttatctgcagatgccatccgcagttactctcgtcacacatctttttttcggtgctgtgtcgaagtgacaaaagtgcgaatgattgagtgatcagaagaggcgggtcatttcagtacggaagagttattctaatgattaattaattatttaaatttataattgaaaaaaagctaataataataaatatatttggttctatttcagtttacacgaccacaaaaaaaacacgaccatataaaaatttgacaaatttaatgcgccataactttttctagaagaatccaaatttacgttcttggtatcattagatagcgctaagtgtcctttattttcctgtaaaatttcaaaaaagttatggccaaaaatgtttagaaaaacaatttttgaaatttacaagccacaacttttttataacccaacgaaattttttgaaattttacaggcaaatagaggacacttaaggctatcaaaagataccaagattgtttaattttgatgcttctacaaaaggttttggcactgatcaaaaattgatcatttttatggtgatcaattattcaaccaagtatatctttttatgtaaaagtcgtagccccattattcaaaattcaaatcagtagagaattttgtgctctttccagtgggcttgcccattttctctagaaaaaatttaccaaccccctagggattttttcgaaatttccccgattttcagtttattttgggtgtgtcccggtcactaggaaggagtgatctgatcaagttggtgtaagagccttttttgatcagcactaaaagttttgcaagcaagaattatttaaaattttaaatgaactataagacagtttttcaggtttgagtcaagacttttttggggcactgtattcctctcataaaaatgtaatttgtttgggaaaataaa

SEQ ID NO: 75600 - DNA, 3016 bp, Heterodera glycines
  Genomic contig location: Contig_ID=SeqID_1736; Location=2961..5976; Strand=-
  SCN-specific regions: Sequence locations=1-499,521-1091,1117 -1204,1248-1412,1434-1444,1466-1476,1511-1618,1640-2133,2155 -2235,2260-2438,2461-2511,2533-2808,2831-2834,2856-3016
atgaccatccctcagatcgatgccaacggaaccgaattggtggtgaaggaacggcacgacgcactgccggccatcaaaattgaaattgaaaaaggcgaaaaagggaaggaaagggccaatccgacaaaaaataatgacacgtcgaaaggggccgaatgcataggcaggtaaaattaattagcattaaaaggaaaatattaaatttaattagacgaaggcaaatggaattggtggattttggcggggaatgcctttccctttggctctccgaattggaccctttgctgaagggtagcaaattgatgtgttgtccgacggacgaaggtgccacaaatgcccttaattattcattttggcaattttcctcttcagcagcagttgctccttccaatttctccaataaggccaattttctgctgatttcccgcgcttcggctcttttcgttgcctcccgcgtttcgctcccttacgaaagtgtcgtcgcgcgattccgaccaaattttgtggtcgattttggaccaaattcgaagccatttgaagaggaaaacattgagcaattggcaattggaagtgtggagttttcagttaatgcaaaaaaagaaagaaaaataagcaaatttttcccttgagacggttggcatttgccagcgttgccaaatgatttgcattgaccaaaagagcggcgaaaaggacccaaaagtgttggtggcactaagaaatttgcactcccaagcagcagcaggtggcatgggaaaggtaacagaaaactgcggaagcaaactgagaaaggaactgggaaagtcggcttaattctttttctatttcggcaattcactccctttttcaaaatatttttgagttttcatttaaaaattacatttccgaatttttcttctcaattaagcatcaaacattgtctgtctcattttgtttacgattttaagctttcttttggcatttatcttgaacaaaaacaaaatgacgagaatgaaggagatgaacgaaagcagacgaaaacaaatccaatggcacgcaaaaaggcaaaagcaatggcacgtgaaatgcgtgtcggatgcgcagtgagcgtattaaagtacaaaaagtaaagaaaaaggcaaacagcagcagataaatacaatgagcagaagaaataaagtctgttatttctcaatgaatttacacgaataaacatacgcaaaattccaattttatatattttactcaaaattttagttttataatattttggctgggaccaaaattttgtgggcccattataatgcaataatctttgttgagaatagaagaaaataataaaaatgttggcaaaattatgctattaacactaaaacattatgcatttgctatttttacgttaaattattgatccatgaagtcaatgtaaattcccaaataaaagaataggaataattcatttgatattattatttcacattcatttattactatttttgcaaaattaaagaaaatttttattttattaattttagcagagaataaaaatgttcttttataaaaatattctttttttgcttctttttttgcaaagttttcaaaaggctttgtccaacgatgtgccaatagacaaagaaacgcgaagcattttgtgggaatgctcagaatttgcacaagcatttggccggactaagtctcgagaatgaatctcaacagcagacgcaaatgccctcccgagaacagttccaaagactaatttcggcattcaattcgatggcccaaaagctgaattatgaggagattgtgcagggcagcgaagtggaggcaatttttgcacaaatcgacgcctatttggtcactgtccacacggagcagcgacagaaagtcaccgaattggaggcgtacaaagacaaagacgaaaaacggctggacgaagcaatgcggagggagaaaagcaaagaatggggagaactaaacgaagtgttggaccaacaaaaggacaacgaagcgtaaccaattagtcaaactattaatcatttggggaaccaaaagacaaccaaaagcgactaattaggaaagcccggatcagaagcttgacattttccttttcctagtagcgtctgttgcatttgggaaattgttaagaattgttgtcccgatgaaaaataaagttagaatttcctttgcaaatgggataaaaaggggctggtaacgaatctgacctcagatttgcctaaaaccgaacggactcaaattcaatagttttaatttttaaaatgcatttaaaaccagttaatttgttcaataattggcgtaaactgaggttcgaacccgctcggatatgatttattattttttatgatacttctcacaaaccacaaaaagaccaaaattgaaaaaccaaatttttcaaaacaaaaaataaattttatatctttaagaattattcattttgtttctcacgaaatgttgaaaaatattcgaacaaaattagaagaaatcgcactgtttcactttttgacaaatgccgttgttcagaagaaatacaaagaatatttcaaatgtttttctaaaagagaaggtaaaaaggaaaataaagcataaaagagaaatgaattttaagaatttaaaaagaaaaaagcaaatgccgaaaaggcaaatgaaaaggaaacctttggctttggcgacgcttgtgccacttcaatgttagcttgttcgttgtgcaatgtctgcgaaagtagtcatgttgatggtaatgacattttttctttttaaaaaacttttgaaaaattaaacccatttgaaagtttcaataatttcggaaatttccattactcttcaaaagttgaattcctcgtcagtatttttgtaaaaatattcagcggtacgacatcaaaagactgattgaatgacatttacagctgggcacgatggaaagcggataattaagaccagggttaagcgggatgggattccgggacccacgccgtcgggataccgatcccttctaaccctaattaacgctatattttcccaatag

SEQ ID NO: 75601 - DNA, 904 bp, Heterodera glycines
  misc_feature (321)..(321): n is a, c, g, or t
  misc_feature (324)..(324): n is a, c, g, or t
  Genomic contig location: Contig_ID=SeqID_1736; Location=1716..2619; Strand=-
  SCN-specific regions: Sequence locations=1-13,43-295,318-406,438 -798,820-904
atgccaatgtgagttttaattttataatataattattttattggtgtaatttttgtttgtcattccaaatttaatttgccaatttcgtaaaatttgtcccatttttccaggctttggctgccttctttgccctgcaattttcagcttcactttgctcggttcatttacgacggccttttgttgcaaagctttaaaagggttgcgcagaaaaaaaatcgaattaatttcaaaacgaatcgagaaattagacgaagcgatgggggagcagcaacagcagaaacggggcaaacagcttttgctggagaatgggcagaaagggcnccngcggggaccggcacttcggcggaacgccccaagggacccgtgacaaatgaagagagcgatgagagaagaagcatttggtgtcgaattgaattgaattgagttaaatcaaattgcatatttaaaaaaggaaacttatgcgacctttgattttaattagtttcatttaaattcaaatcttccccccccttaatttgcaaaagcgttgtaacattcgcccattaaaaattgttttgtgagaaactggacacaaatttgcacattagtggaagtgatcaatctccaatgaaatatgctaaatggtgcgtgtttaatgggaaatttaaaaaaaagagagcacaaagacgagacgaaggactttgttagaaaatgaacaaattacctgcccataattcacttttgtcacagattactgaaaattgaccaaattgcctcactttttgccaattagcgtaaagagatcgatgagaggaagtaaaaatgaatttgtgatttaaaaagtacaccatgcgggattggagaatccgggaccgtttcaagttgtccagggtcgaatttaaagcattgcgaggcttgaaataaa

SEQ ID NO: 75602 - DNA, 604 bp, Heterodera glycines
  Genomic contig location: Contig_ID=SeqID_1736; Location=9115..9718; Strand=-
  SCN-specific regions: Sequence locations=1-386,500-556,591-604
atgaaatttttccttacttttttgcttctcgccatttcatttttggctataaaaacggctgccgatggctctgacgacagaaacggagacaaaagtttgccaaatccattagcagttgagggaaaggcgagcaaaaggtcagagagacggagtaaaaactgaccgggccaaagccttaaaagccggaaattctcggctagtcccaaattactcgaaatcccgactttaaattttgattatttttcgttttttcctaatttaaatgtacttcttgtacttttctctttagtaatcgccataagcgccattatggctacggttatggcggttacggtggcggaagttggggcggttatgagtcgtcgagatggggcggttggaacaacggcggatttggaggaggaggcatgggcggtggcatgggcatgggcggcggcatgggcatgggcatgggaatgggaatgggcatgggcatgggtggagggatgggaggaggaggatggtgatgagagggcatttttattcattcgaaattaattgttattttatgacaaagaaatattatttattttaaaattatattttttatacactttgaaataaa

SEQ ID NO: 75603 - DNA, 640 bp, Heterodera glycines
  Genomic contig location: Contig_ID=SeqID_1737; Location=718..1357; Strand=+
  SCN-specific regions: Sequence locations=1-490,512-640
atgagctcgaacagcagtgaccaccaaaatgaggaggaggaagcgaaagggacaaagtcgaaaagcggcgactcggtcagtcagaaatcatttgaaaaaagcaaagtgccaaatattggccgtaattctccccatttgtcacagtttccgccgcgccattcccacacttttatcggttcgaccttcgccatttggtcactgattttcctgctgttcgccacttttgcctctctgcagtactatttgcccaaggccgcttcctcttgcctttgcccggccgctgaatttgggcgactgaccgcccaaagagcgtacaacgacagcagttttgggaatcccaaggttagttggatgggggaaagggtctggaagcaggacattcaagcgcagaacccaattttctttttttttttgtcagattttgcccgacggtcgaatcgaatacgaattggcggtggtttccgatttggaccatgacagcaaaatggaggacagaaaggagacgtggcgtagttttttccgcaggggtcgcctcctcttccgccccgacattccttccgtgcaagtccaatgggccaaggacaagcaggacaacacactgtactcgcagctttcgtccggaggacgcgcgatggagtaa

SEQ ID NO: 75604 - DNA, 590 bp, Heterodera glycines
  Genomic contig location: Contig_ID=SeqID_1738; Location=72..661; Strand=+
  SCN-specific regions: Sequence locations=1-236,259-590
atggtccgacattcacaagaaatggtttttcttgccgaggttttccctccaattcccacaataaatactaaacatttttcagaagagcgtcaaacgacacttattccgaaacggaagatgagcacatgggcaccaatttattgctgatagccgacgaggactttgaacatattcaggtggacaaggaagttataacaaaaaatagagggatttaaaatatgtaaaacgttaatatttgaatcattgaaattggtttctgcaaaggtccgtcacattgggccccccggcgatggcttccgcggtttctccgccttccaatttttgccaaacaccgaagatgacatcatcgtcgcgataaagtcggaagagcgaggcggcaagccaatcgcctcctatttgttcgtcttccgtctcagtgatggccatgtgctgttggacgaccaaaagtttgacgggccctacaaattcgaaggggtcgtcgtgtactgacagagcaaattgggcaatattgttgtggagtcagagtttgttatttgtgtatttaaaaaagagcagacaaaacgccgtcggcggaggagaaaaagctgaca

SEQ ID NO: 75605 - DNA, 1056 bp, Heterodera glycines
  Genomic contig location: Contig_ID=SeqID_12061; Location=232..1287; Strand=-
  SCN-specific regions: Sequence locations=1-370,392-481,503-593,615 -1056
atggatgttagagtcgtggtccctgtatggttggtcctctcttttgtaattcattttggttgtccgagttacagtgacacttttctttgttacagtgatgtgccagtgatttcacccgctgcattgaagctggaggcgtggctgaagttgcgcaagtttactgtttacgtaagcacaatgctagaaataaaaacttatatacgtaagccatttgccaataggcattggccacgcccatatatacgtaagccatttggcaatagacattggccacgcccaccatgcagtggccaataggcattggtcacgcccaccaggcgggggccaatgggcagtcacacccaccatgcagtggccaatatgcattggtcacacccatcaagaaggagattgggcatggtcacgcccaccaggcgggggtcaatgggcattggtcatgtcagccctgactggtcaggccacaatgcaattagcattattgatctgttattaaaatacggtatataactcccctgtgtgtactgtacaagttgttgtttgatttttaattttcattaattttttctaagcgtgtaaccagtgggttcctgtttgccgatctgtttggccagcagcgtgtgccatttgtggagctaaacggcaagcaactgaccggcaccactgatcgcatcattgaagagttggagaaatcggaagtggccaaagaaaaagcccatttgataatggacgaggaaaatttgaaacgccatgggtacaatgagaaagctgaactgcgagagtttcgcaggaaagaacggttgatccggaggacatttgacgaaattgtgaccaagtgggttcagagacggtatcccgcgtgcaaccacaccccggggaccttctcgaatctcaaaaaatctcgactaacggatgtcgtaattctggcgtttttggatcccctgtaattacgcattactaattacgtactatttttactaattatgatccgtaactagaattttagattattttttggaaaacatcaatttcactcattgaatattattttccaataaa

SEQ ID NO: 75606 - DNA, 1270 bp, Heterodera glycines
  Genomic contig location: Contig_ID=SeqID_12061; Location=1515..2784; Strand=-
  SCN-specific regions: Sequence locations=1-90,121-148,216-242,266 -328,363-605,639-709,731-906,932-949,971-1134,1209-1270
atgccattggtccgcaatttggttggcgcaatacggaagatcagggaggatttgcagaacaaatttctcccactgttggcaaaaagtgagaaaaaaaacaaaaaataaaaaaatttttatcctaaaaccgcaggggaaattttggttgttttttttttttaaatttatgaaacttttttgaaattttgatgaaacttttttttatattattttttgaaccaaaatcttcatttttgtgaaaattttgcttttgtttttggcaacaaatgatcaaaaaatgctaggctcgagcatattcagaagaaaaaaaaaatttgcttttccttcccaaccccttcaaaataatttttctcaaatataattttcaaaaagtgccgatgagcgggccaccgggggaattttgcacatttggaaagagaattgatacgaaattaaaaaaatatataccaatttttcccgaaaactttttttcaaaaaagacaaatctttaaaaaagacatttaaaaatacctattaatgattcgtcccccctcaaaaaggaaaattcttttaaaaaaggacaaaatcactgctactctgaggcttgttttggtcagtgttttttcataaaaaatttaaaattttttaaaattaaatttccagtaaaatatggtcgaaccttaacaatttttgcactatataacacaaaaataagggttttctgtgttaattttcaaattcaaataaaattcttagtcgctttttccgaatcaattatcagaatcatcaaatgattaaagatcatttttgtcaaattacacgatttttaaaatccaaaattaattttcattatcaaaaacaaatttgcttaatcaattttcaattttgattctcataattaaattgtttttttacacactttttgtcaaaaattaaaaaaaaaaaattaatacattttaccctgaaattataaatttgttccacaatatttggctttttatgtcaatatttcagcgatttttcccttattttgccattttttcttccaccatgtttctttccacattaagaattttctttccgcgctctattaatttatgaatttgaagcgaaactaattagtgcaattaaatgcaatttctttgattgatagtgtatttttaaaatttttcttaatttattaaaaattgtaaaaacaaataacaaatatataattttaagaaaatattgtggagaattggaaagaagatgtgatttatttgatcacctatccacgccttagcgcaataaa

SEQ ID NO: 75607 - DNA, 483 bp, Heterodera glycines
  Genomic contig location: Contig_ID=SeqID_12063; Location=193..675; Strand=+
  SCN-specific regions: Sequence locations=1-483
atggctcttttgcaccccttctctccaaacacatttaaaaccactgaaccaatcgttccaatattttttgtgtgcctcaactttttcttgtccaagcacggttccccacatagtaccagtagtatgaattatcttgccaaggtcacttttgcgatcagggtgtggtttcaaaatttgtgaggagcatgccgtcaaccggttgttgtctttgcatgattcacttggtggggctataaattttttattattgaatatgcatctttttagctatattatagatcaggtcttctagagaccgagatcagagtgagaaaaactccaaaatttttcgagtcaagacctgagaccgagacttattaatagactaattctattattaattttttgcgaatttcgtgcctaatgctgggcacaaaatttttgtgcaatttttgacctctggtgcctttttcatgacttttcagtatttttcaaaaaaaaaaa

SEQ ID NO: 75608 - DNA, 497 bp, Heterodera glycines
  Genomic contig location: Contig_ID=SeqID_12063; Location=762..1258; Strand=-
  SCN-specific regions: Sequence locations=1-497
atgtccgacgcgcaaatttctgcaccctcagtttttataatttcatttcgatcattgaagatgttcacagaaacaaacgaccctgggtatgttggtgcgcacgtgtgtgaaaagagcccgcaggcacatacacagggttcgcagcgattttctgctgctctcctatgccttcagtacagtgactgtactatttctccagtaagagaatcagaatctgagtgcaaaagagagaagcgaaaaaatctcatacaaaagagaaatgaggctttttcgtttctcttgtttgtactcgagacacgcaaaggattctgtgctacgcaggattttgatttctcttactagagaaatagtacagtcactgtattgaaacaataggagagcatataaatccggtctcaaattatcagggaggcggggcgaaaaacaggaatttgtagcgcttttgcgcaaaaaatgaccaatttttgccatttttgggtcatatcaaaaaaaataaa

SEQ ID NO: 75609 - DNA, 1129 bp, Heterodera glycines
  Genomic contig location: Contig_ID=SeqID_12063; Location=1384..2512; Strand=-
  SCN-specific regions: Sequence locations=1-165,187-369,397-416,511 -732,808-848,896-1021,1043-1129
atggattttctatgcaataaaagaggtattctgtacgcttgtgatatagcagccattgaaaagccaaaaggttgtagattaactcatggtttctattggaaaattttgatacaagggacgggtataccaatttccaagggcctaacgggaaaattcattcaattcaaggacagttaaaaattttatcagatgaataaaaaatgattaatttttattctatttttgccggaatgaattttttcaaatatattttttgtttctactggtgagcatttttccccatttcggcgcatgcgcgctttttgcggcgtgtttttttcaaaaaactttttcggaatagggaatccggcggtgccgataggtgccgccgggaaaattttgaatttttgtgcaatttagtaacagattttgcagtcataaatttatttaaaaaattgatataaatttcaaaattatttaaaagaaagattataaaaataaatttattaaaaatagtaaaagaaatataaagggtaacatttaacagcttaaactattttaattttaggatattttccagcaatttttcatgggttttattgcgacgaaagggacataaagaccataataattgacgatgccgagtttgacgatgagctgggtcactgcaggaaagtaattaatcgaaaattaatcaaacaaataataattgaatttgcaatataaaacaatcattaaaaaagatactttgtcattaaaaattacattttatcacaaatataatataaaataactaatcaaattgtaaatttttaatacaatttataacaaagcgaaaaagttttatttcggctttccttatttttaccaaaaatttaaattaatagaataaataataaaataaaaataatttttagcatcgtaaatcagagcagccacctcttccaaaagtatggtttgcttttgttaaatgacatttacgcctcggacatttgcgcctatgtccaaaatcgggttcaaacttgtttttcaatcttacataatataaacggcattaaaataattaagaaaaatatagtcttcaagtttattaagggccttaattctgttgttaaaaatttgtgatttaaaaaaaattacttataataaa

SEQ ID NO: 75610 - DNA, 1851 bp, Heterodera glycines
  Genomic contig location: Contig_ID=SeqID_12064; Location=249..2099; Strand=-
  SCN-specific regions: Sequence locations=1-23,49-240,268-316,339 -969,991-1010,1034-1177,1200-1588,1611-1734,1773-1851
  Gene Ontology: Mol. function=protein binding; Cellular component =nucleus; Biological process=embryogenesis and morphogenesis
atgttcgacttcggcgaaaaatttgggaaattttatttccctgaccagacgaattttaatccaaatacgccctacgaccctgcaattttggctgaatttacgtaaaaattctgtatttctttcactctttaatttctactttcacttttcagcgcgtggcgacgacaatttctggcccagaacgtggtgccgcgtccagtagtgcccgatttgcccgacctgccagtgatcaaggaggaaccggaagaggaggaggaggaaagcgagttcggattaccgcctcaggacgatttgccgggtaaaataagtgggatccaaaaatttttaggggtttgaggaacacagattttgcttttacgaagcagaaactacttttccggttctaatggaatgagcaattttcagatgaagcggcggaaaatggcattggtccccatcacggccacgcgaatttggcccctttggaggcacagaattgggaggccttgcagccacaggcgcaacaaccaatggcgatggcctttgtgcagccgttcctgccacccatgggaatgccgccgcccttgggaatgccgctgcacataagaatgccaccgcacatggaaatgccgccgccgatgggattgccaccgccggttccgttcgcccccattttcgccaatccgccaccgccaatcgtataccctccggcgccgatcccacaggtgtgttttgggaacataaaattccataatctttgccattcgtaaagtacaaaaatctcagagttacagagaaatctttttcaggggcgggggtacccattgaaaattcttgaatttcagaaatttccagaaaatgggtcttttccaggcgggggacattgaaaatcaacaatattcttgaatttcagaaatttccagaaagtgggtcttttccagacgggggactttgaaaatcaacaaaattcttaaatttcagaaatttccagaaaaagggtcttttccagatgggggactttgaaaatcaataaaattcttgaattttagaaatttccagaacaagggtcttttcagggcgggggaatataggttacttgaaaatcaataaaattcttgaatttcagaaatttccagaacaagggtcttttcagggcgggggaatataggttacttgaaaatcaataaaattcttgaatttcagaaatttctagaaaagggcttttttttggggggggggggaggtacatctctcgattttaagccgattgccattcctccggctcgtcccctgtatggggcattcagcgcacctcagaggccgcctccattgatcaacatgccgtttgctccggtgagttttatttttacgaacctaaattataaacgattacattgttaaattaagcctgaccaaagaggtcattttcgtcaacaaattggccgccagccgcgttggcgtgaccgtttcagaccaccaacaccagggggtaattaacggggcctcctttttgtagctaatgatcattatctaaccgacatagtttaattgtttgcactttcctaccacttaaaatttttcgacctctttattcaatcgtagaccccatttttgaagaattaagaaaaccatgtccataaataaaaaatcaaaaaacgataataaaaacaataatatttaagtggaattacgtggccccaatcgtcaaaaccgtcgacgtgagctgttggaaattgtgcccgaagaatttggtccaaaaaataattcatttttttacaataaattataatttagttgttcgtcttccaccaccgccggagccgccaaatttacgacgatggcacgatcatcatgatgagccacccccaccgg

SEQ ID NO: 75611 - DNA, 1184 bp, Heterodera glycines
  Genomic contig location: Contig_ID=SeqID_12065; Location=1202..2385; Strand=-
  SCN-specific regions: Sequence locations=1-726,749-849,876-1072,1103 -1184
atgaatcgacggtaaggaagttaaagtaacaaattcttcatttatttcactaaacttttttcacatttcagctgggtttgcaacgacgtgtggatggacattctcccatcttttgaccatgctcaactcggcctcaatttggcattgctttcgccccgtttcaatgcgttggtggacaaacattttgatggcaaaagcgaattgacgctttggagaacaatcataatttgcaaacacgctgttgctgcggtgccaaacttttctgtgtttaccgacaatgccaattcggtggaatttccattgcccgaccgtccgctgccaaacaaattgcgctttaaaagccttcatatcaagtaattcaaacagttcaatatataaacaccgagcaatttgtttgtcaaattcaggtacatcgatcactccgttatcgcatttcttcgctccaatcaacaaatttgggacagaggcaccaatttgggtctgtgggtttcttcacccaccgccgatgttcagccgatatgggatttgttggcccgagaaatgttgcccttttttgcgacaaacattaaattggctggcctttaccgatgctgatcatctggacaatttgcgtcgcagcacttcaccccacaattctcactgatctcaacattaattcgataaattcctgttttctgttgcccgatacaattgctgattttgatggaccaaatgcaacttcagctggtcaattgttgtccaaatggttgcacacaccgagaaaaaatgaccaactgaagcgattgagttgccaatcatttgacggacaaggaaacttcaattgggtcaccaatttcaaggaggtgggcgtcacattttctgcaaaaccatttattttccgtttcaaaatatttagaaatttgtctgtgccatcacttccgtcagctacgaaattcatttttctgttcatgcgccgtcgccaacgtcaatggtgccattcgaattggtgaacgaacggaccaacgaacaaacaatgctttgggtgagaaatttaaaaaacgattgattttgtttaattgcgcttaattaaggccattgtcaccaccagcagcagaagaagaagcgggacaaagcatcgaaaaaggggtgtcttctgacaatgagtgacggacagaacaacaaaagtgatcagcagaagaaataaa

SEQ ID NO: 75612 - DNA, 763 bp, Heterodera glycines
  Genomic contig location: Contig_ID=SeqID_12068; Location=13..775; Strand=+
  SCN-specific regions: Sequence locations=1-200,222-468,505-539,568 -704,726-763
cccaacagaaggggcggctgacgctgaaaattgaaaaatttttctgtttttctcgcggcggagaatccggcactgaacgatacagcgatgccgtgaacatccgaggcttttcattcaaaattttggccaacacttacacaatgtctgctgacaagagcaagaaatgtttgggcttttttatcgaatgcaataaaaatggtaaaaaacaattggattaaattcatttaaattgcattcatccgccggcttaatcggcatcccgtcacgcttttcttgggttcccgagccagactttttgaaaaaaaaatgccggatcagaattctggcagtgtatcctatcgcgcgactttcccaactttttttttcaaaatgccgtgatttttccaatgaaaaaaatgccggaccgacgtgttccgccagacaaaattcagaatgtccttcatttatttatttgaataacatgtacacattttaaaaataaaattttggataaaaaaaatttttccaaaatccgaaaccaccaaatgcctatcactaacaattaattaattaatgttttttttaattgaatttgcccattttgttgtacccccgacgcccattattcacagaacccaattggtgctgtacatgttcagcaacgctgcaaattgttgtgcaaaagaaatacagaaactctaccggcggcaacaagcagttcaaggatgccaatttcagcgccgaaaagaaccaattgggtttccgagacttcgtgcctattgag

SEQ ID NO: 75613 - DNA, 884 bp, Heterodera glycines
  Genomic contig location: Contig_ID=SeqID_12069; Location=18..901; Strand=+
  SCN-specific regions: Sequence locations=1-38,88-223,270-353,375 -440,464-470,521-712,734-884
atgccgtttttggagaccatctttatactcggccctccaataattcattttttaagtaataaaatttttttcttataattttttatagtcctaactttgctctatttactcacgttttctcttttcgactttttggtcaaaaccaggttcggggttcgacctaggtcgaaatttgtttcttaattagtactgagaaaaaataaaaagcattattgtatcacacatatatttttagttgataaaaatttcaatttatttaaaataaaattgagccaaagttattaatctaaattccaacatttttttaaatttcgaaatttcattaaattttaaaaggttatagccgaaatcattttggctcgagatttttgagcttttatttagtctcgcaacatccttgttattcatttaatattcacttcccaacactgatcaattcctaaaaattttatttttaaaaattccgtaagcaaataagttttcaaaatttcttcacccataaaaaatgactgttttaattacactcgctcacagccccatcatttggtgcacgccataaaatgcgtcaatcaataacgtttaattggttaactaactaaccatatttaccacgcattatgctcatgcaacattttttgccctttcctcttccattctccgattgtatttttactaataaaattattaagcctgtttttttaataaaatattcagtaaaaaggaatttattcataaatatttgtatggcgagcaatttggtggatcggttgaagctgatgttgagcacggccaatggggcggacattcaatttttagttggccaaggagaagaaaaggaggcgagttggcccacaaaagaatttgataaaattactaaaatttaa

SEQ ID NO: 75614 - DNA, 422 bp, Heterodera glycines
  Genomic contig location: Contig_ID=SeqID_12069; Location=991..1412; Strand=+
  SCN-specific regions: Sequence locations=1-68,121-260,306-422
atgatgactgcttcgaatgtgttcgaatcgatgttccgttttgatgacaaaaaaccaaagactgaaagtaaaaatttagaaaagtttaaatgtttttcaaatattttaaattaatttttagctccttccgctaaaacggatagttcggtagaaattcctgacattagtgcgaatgctttcaaagtgatgctcagtttcatttatgctgaagatttgagtgaattgaacggagaaaatgccatggcagtgctttacgcgggtaaaaataatttttaaattattattttttactttaaaatattttagcaaataaatacaatgtctcttcgctggtcaaagcttgtttggaattcccaattaatgaactgtcaaatgtattcttcgcacatgaccaggctcgccttctcaacgaaaatgtataa

SEQ ID NO: 75615 - DNA, 165 bp, Heterodera glycines
  Genomic contig location: Contig_ID=SeqID_12069; Location=1477..1641; Strand=-
  SCN-specific regions: Sequence locations=1-165
atggtgagttcgtcgtcgattttcaattggtcacgtccaaaaatttcgcacaacatattctgatcaatttgtaaaaattgctcagattgtaacaaagtttcagcgttttggtcaatgtaatccaagcagcgacgagagaaatccttaaaacaaaagttaaataaa

SEQ ID NO: 75616 - DNA, 1058 bp, Heterodera glycines
  Genomic contig location: Contig_ID=SeqID_12070; Location=127..1184; Strand=+
  SCN-specific regions: Sequence locations=1-76,122-778,800-1058
atgttgagcttcatttacgcggaagatttaagcgaattgaacggacaaaatgccatggcagtgctttacgcgggtgaaaaatttaaaaaataaataaataattatattttaaacatttttagccaataaatataacgtttctctgctggtcaaagccttgttggatgttccgattaatgaattgccaaatgttttccttgcttttgtcgaagctcgtcttctcaacgaacatgtcagaatctggctaataatgaagcttttccctatttttaacaataaattttaggtaccataggttttcagaccccctccaatttttttttcttatttcactttttattgattcattttaaggatttctctcgtcgctgcttggattacattgatcaaaatgccgaaactttattcgaatcagaagaatttttgcaaattgatcaaaatttgttgtgcgaaattttcgaacgtgaccaattgaaaatcgacgacgaactcaccatttggaaagctgtactaattaattaattattcgattaaaaataactaatttcatttgttttttcaggccattcgttgggcagacgaaaagtgccgtcaaaatgccgtcgaatgttccgctgaaaatcgtcgttctgcgcttggtccggcactgttcagaattcgtttcccactgatcacaaaaagagacttttcgctaaatattggtagttttttgtgttaatccggttgattgttggttggtctcaagacttatttaaagtttaacgacaagagaatcgtgtaaacaaaaattatttcatttccccgcagtgacctcctgcgtcctgacaatggaagaactgctcgccgtcttccaattccattgccacccgaatctccgcggttggcacggacagtacccaatggaatttccgtgccatggacgcttttctgatcaaaaaaaagtgacatttgcgatggaaattgagaaattgtcggaatttgcgcgagaaggagtgaacagcagccgttacagcgaaggcatttacataaaaggattgccgtggaaaatatgggcacga

SEQ ID NO: 75617 - DNA, 485 bp, Heterodera glycines
  Genomic contig location: Contig_ID=SeqID_12071; Location=1014..1498; Strand=+
  SCN-specific regions: Sequence locations=1-91,113-320,351-374,397 -403,426-485
atgatggactacgaaatggacaatcaaaatgaagaaatttctaaactgaacagccaaaaggatgaagttaaaaaataccaaaaggatgaagttaaaaaatatttaataaaaagtaaggacgattttttcggaaagcaataaaatttatttagggaccagttatttttaggggtagattttcaaaaaaatttattttttcacatgaatctataattttcaaaaattctcaaaatatgtaacatgatgaaaatatttacgaaaaatttgcagaaattttgggtttttttgaggatttccaaaaatttctgtaaaaaatgctcaaaatatattaaaaaaatgaaaatatttaagaaaagagttcaaaatatgtgtataaaattatgaaatatgtaaaaagtccaaacttttgtaagcaagaaaaagaatgtttttcctactatttagagtatggagaagccaggaaaaatatgtattgtattacataa

SEQ ID NO: 75618 - DNA, 228 bp, Heterodera glycines
  Genomic contig location: Contig_ID=SeqID_12071; Location=1529..1756; Strand=-
  SCN-specific regions: Sequence locations=1-228
atggcacttttacgaaacgacctggcacttttacgaaacgaccacagtggcacttttacgaaaagtcccaaggtggcacttttacgaaacgacttggcacttttacgaaacgacctggcacttttacgaaacgacttggcacttttacgaaacgacctggcacttttacgaaacgacctggcacttttacgaaacgcccatagtggcactttttacgaaacgacctag

SEQ ID NO: 75619 - DNA, 597 bp, Heterodera glycines
  Genomic contig location: Contig_ID=SeqID_12071; Location=3281..3877; Strand=+
  SCN-specific regions: Sequence locations=1-8,52-108,220-597
atgaaatcatttattttattagttttaatattatttttaatcattatatttgatcaagatgaatcaatgaagaaaaagttgcaagaaaagtcttttgatgaaatatttggagaaaaatggcaagaaaaagaagaacaacaacgaaatgaggagaaaataagagaaataatcagaaaattttataaaataaaagagaaaataaagcaaaaaggaagaaaatattcaacaaaagaatggagtaaaattatttcaaaaatagcgaagaaattggggacaaatcgaagtaaaatttaccagtggatatcctccctttcctatgctggggatgctggaagaaattggggacaaatcgaagtaaaatttaccagtggatatcctccctttcctatgctggggatgctgggatagcacataggagaaggcgcgcgtcggcgccttacagtaggagaccggtgctgttgatgtgcgttatcctatggtgttgtactgtaaagtgacgcgatgtcctcttctgatacaacagaactttttgtaacccgatacctaaatactataatttttttttttgccgatatttccattagtattttataatta

SEQ ID NO: 75620 - DNA, 524 bp, Heterodera glycines
  Genomic contig location: Contig_ID=SeqID_12072; Location=972..1495; Strand=-
  SCN-specific regions: Sequence locations=1-524
ttccgaatcatgatttaaaaatataccagctagtgccagtctctgggcattggggtcaaaaggcgtcagctgacacatttctcctgtgtctatctcattttgatgcgtcagctgtctagcattttagtccttaatttattagagaaaaagaggcattgagtatcgtaaaaagagaggtattgagtatcgaaacgattcattcataattttatggaaattactgctagtacggggtataaattaagtgaaaaattcaatacaacctcatttattggccaatcccaaaaatcatcatgagcaatcgatcaaacaatgaacttagcccaccgaagcgccgaagaatgccaaacatcctcaaaagtggaagcaacaacaacaacaacaatggcaaaagacgcaatttttggcactatgtacgcgcgctgaacaccgacgtagcgttcaacaaaaaattcagactaatgaatgctaaaagtaaattcatgatccagactctaccatcaaatcctgagtcgcttttgcga

SEQ ID NO: 75621 - DNA, 991 bp, Heterodera glycines
  Genomic contig location: Contig_ID=SeqID_12073; Location=697..1687; Strand=-
  SCN-specific regions: Sequence locations=1-498,529-819,841-874,896 -916,938-991
atgtttattgacattcattctcttgacactgatgatgatgattatgaaaccgatttcactaccgttacaatcactcctaccaccctactcgagtttaaagagtatatgagacggttagcctccgcctcctcttcttctccaacgactacatctatatcaaggtcatcgttgtctgcaatattaggacagtctacaactaccgtgaaaccaaccattcagttgttatacagtgactcgcttgactctacatatggaggtggcagtagcagtacatggatcggagaatttattatatcattgtgcagcagtgttgccggctctgaggagggaggatgtggcggatcgcacgtgtgggtatggacacgtgtattttgctgtattgttattctacttacattgctgtgcggtatactgtacgccatccgctcaatttttatacttaaaacaaaaataaatcaccagacaaaagaccaagtcaccaactctaacgaagctaggaacaacaaaaacaacaacaacaataataacggaaatgaacaacatccaaatagagaggatgctttccacttgtcagacaacgagagagtgcttcagaggatgttttcccgtggatcggatccccaaaatgatagaattacaacagcgtcaccgaccctttcccgcatctctgatcatcaacacggatgaggctcgccaagagggtgcgcattgggtcgcactgtatattccgcgtttgaacaccatatggtattttgatagtttggcccttcctgttgcttttaacgtacagaaatttctgtcccacttccctcatgtcagtaaaaacaaaatggcatttcaatctcccacctcagacgtttgtgggcactattgcatattttttatttatttggcttcaaccggaatgttatatgatgaaattttgaaacaactgaaattgtattgtgtggattataattgtgacattgcaattaaaaactacgtgaataaa

SEQ ID NO: 75622 - DNA, 769 bp, Heterodera glycines
  Genomic contig location: Contig_ID=SeqID_12074; Location=9..777; Strand=-
  SCN-specific regions: Sequence locations=1-181,203-266,288-374,396 -706,728-769
atgcgggacctttctgcacgtatgaaacgtgtaacagccatttctgattcactgactgaaactttcgcaaaaaattgtgaaacggtaaaacgactcaatggagcaaaaggctcagttcaaaggcttgagtttttgatcaaagtgccccaaatattgcaggtgtttttgagtgaaatttctaacaataataaattttaatttcctttgagaattgtcttagagacggtgaacatgtgaaggctgtcgaaacatacgtcacttttaagccaaaaattaacaaatttggatatatcaactctctgaaaggaattgaaaaggatgctgaccagacaatgcaggatcttaagctaaaagtgggtatatcgtccaattaaaaaacaattattttcttttttagttatacgaattccttaaaggacgccttatttcctccgaagaaaccattgaggtgctttttgcaactcattgtcaaaatacttaaattgtttaggccgtcacacttttaaaaaatttgggcgagccagaaagtgaattagaaaaaattctattggagaattgggaatcggaaattgattcggaattggaccaattggccgccaattcgtcattccgtaacattggacgtttcaaagacatttttgagtttgttgacatcggatgttgccattttctgaccaatctttcgttgatcgcgtatacgtttcttcaaatttttgtaaaaccaggtgatcgaaaataccgtattaaattcaaaaatctaaaaagttaa

SEQ ID NO: 75623 - DNA, 481 bp, Heterodera glycines
  Genomic contig location: Contig_ID=SeqID_12074; Location=3504..3984; Strand=-
  SCN-specific regions: Sequence locations=1-481
aaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgc

SEQ ID NO: 75624 - DNA, 661 bp, Heterodera glycines
  Genomic contig location: Contig_ID=SeqID_12074; Location=3086..3746; Strand=+
  SCN-specific regions: Sequence locations=1-3,271-661
atgaagaaaaagaaaggaaagggaaaggaaaaggaaaagggaaaaggaaaagggaaaaggaaagggaaaaggaaaggaaacaggaaaggaatagggaaaacgaagagggaaaagggaaaagggaagagaaaagggaaaacgaaaagggaaaaggaaaggaaacaggaaaggaatagggaaaacgaagagggaaaagggaaaagggaagagaaaagggaaaacgaaaagggaaaagggaaaagggaaggaaaagggaaaacgaaaagggaacacttcctaatggtgcatgcgacgtaccggtaaaaggcccggttcgtatttgctcggtacactcgctcgtcgctccgcttcgctccgctcctcgctcgcgcacctcgaggggcagcttacaccattttttgctaggcttagatcacatgcgattttcggcactctgataattttagcgctcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggaagcgctaaaattgtttga

SEQ ID NO: 75625 - DNA, 3265 bp, Heterodera glycines
  Genomic contig location: Contig_ID=SeqID_12077; Location=1002..4266; Strand=-
  SCN-specific regions: Sequence locations=1-64,105-105,127-146,183 -331,354-830,881-1233,1269-1277,1304-1365,1402-1653,1675-1756,1780 -2079,2148-2218,2292-2312,2334-2576,2610-3117,3139-3140,3162-3265
atgtgtttttcgtgcttctctcatcaagtactatccgcaaaaaatccgggctctattgattttgaattaaataaattttattttattaaataaattcaaatttaggttgaagatgctttgttttctgaatttgtaaaaggacaaacaacaaatcttgagaaatttattaaattaactaaaggattaaataattttgaaaaagtgaaagaggatttgatgcaacaatatgaggcgcatcttggcttttcgtatttcacgaaaaacaatttgcaatgtgacaaaattgttggggaatccagagaaatgctacgtgaagaatgccaaaagcatcgaaaatatttgcaaattttgcacgaatattttttccgactatatgttgaaggtatggtttttcttttaaattatagtgaaaagttttggacaaaagggctgcatgtggcgagaaaatagcgtttttttcgaaaacggagatgtgaaaaaaatgggacaataagggcccatagcacacgcgtcaaagtcactcgcgcccgccaaaaaaaaaattactctcaatttgagaagggagggctggcttttttgtggtgcacataaattcaaccctcggaaatcccacggacacctgctggggaccttcctttgtcagcacctaacgaatatctaaaaaatcacacagtaactaaacctgtacaaataaacacagccaattcggacgggcgaatcactcttccccagttgttgggacttttatttatatatttttacatatttcgggattttatatatatttggtacatatgttgtattttttacatattttgaggatttcgaagatttttttttcaaaaaataaccatttaaaaaaattttatttacatattttcgtacatattttgggtttttatacatatttcgggatttttttttacatttttatgtacatattttgaccaatttttgtacatatttttgacatccctatttattactacaatacgaaatgggcaaaatgttaagcctcgggtgggaattgaacccactcgtgcaccctttccgtggccagctttaccattaagctaccgaggcacatccgccctttcttttatggatcttatcaatccccgctttccgcgtggttagccgaaagtgacaaaagtatgggtgtgggcgaagtgacaaaagtatgggtgtgcggcagggatggaattccgaggcaccaaaaatgtcggaactcggaataaatttaattattttaattgataattattttaccacttgtctataaattaaatattttaatatttatcaaaaacaattagaaaagtaattaaaccgaaaaaccacgattctctcattcattcgcttttgtttttttatatttttattttaaaaaagtaaaataaactgtgtaattaaggaagatttggagtgcacaaaaattggaccctcactttttaagcaaaggattaattcttccatctacttcattattagacatatacaataccatagtcaatcagttaaacagcgagatttggtgccaaaactgcgacggaaagttattaaaattgaatttggtggcacaccaaaaatggcacaataggaattttgttcgaaaattttccgatttaaagccattttcgtattttcttatcacttttgtttaggtaaaaaagctgaatttgcaaagaaattaccagcggtgaaaccaatatttaaagagggtcattttaataagagtttaatttatgctctccaaatgttgaatgaaaattcaaaatatttttgggaaaaaagcggaaagaaattggaaatttatttggaaaatgaggaggaattaaattatgcaattaatgaggagaaaatttggatcaacgaaaatgtagaaatggaaaaacaaattttgaacagccaaaaagggcaaaaatcgacaagtgaaattgaaattgaagcttttcgaagagaatttgagcaaaaacaaatggaaaaaatgagtgaaaaagtaaaagaaaaatggctatgaatagggctgccaatcaaggacatattttttctgttatttcggggttttcataattttcgtaatttataatatttgttatatattttggcatatgtatttttattacttttttttttttacatattttgaggattttatacagacatttttggaaatcctcaaaaaaaaaagtccaaaatttatgcaaatttttcgtacatattttcatttttttatatataagcatttttgaaaattatagttaaaaaaaaattttttttttgaaaatttacccatgaaaataccaaaaattaatttttaaaatactaaatgtgattctaagcctagttaggtcatttttatggcactttatgcctatttcatcctttacgaagaattttttccaaaaaatagccatttttaaaatttactcacatttttcgtacattttttgggtttttatacatatttcttacatatttcgagattttttttacatgtttatgtacattttttaaccactttttgttaatatttttggcagcctcgttatgaagattgacgttatacatttcactttatataaaaaaattttatttagataaattttgagtaagaaagtttttacaaattacaagccttcagtttttcaaaaaaaattctaaataataaaacagggtacggcatggcactttgcgcgtttcgtaaacccgcgaataaagtagaaaagatatagccactttagcaaattcacaaatttcactttagataatttttttttattagacatgtaaatgtgttgggtaaagtaataatattttgacaaattacaagtattgagtttttcaaaaaatataaacagggtacggcatatttaattttttttagagtgccacgggaccgggacctggtagcggacaactgagtacaactgagtaccaaggtcccggttttgaccgggaccgggactagtccctgttttttcccggttttcccagccaaaaattcccggtttttcaactcgaaaaggtcccggtccagggtttgcccaaaattcccggtcccgtggcactctaattttttcacaaaaaaatgaaaaattcccggcgagtgttatctttaggggtttgtttttaaaactggaaaaaccgaaaaccgggggtaccagttttcggtttggccgatttttgatccccggttttcggtttttggaccaaaaaagccggatttcggttcggttaaacgaccgtgaccaaccctaataaa

SEQ ID NO: 75626 - DNA, 762 bp, Heterodera glycines
  Genomic contig location: Contig_ID=SeqID_1739; Location=425..1186; Strand=+
  SCN-specific regions: Sequence locations=1-83,107-278,307-446,471 -514,547-558,592-762
gctgatcaacgattttctgaaggatcgaaaggcttttgaggaagatttttacgggtttttgctcaagttggttaagtgagttttaatttctaaaataaatttttcatgcattgttttcttaatttttaagatctccgattctaaaccaaattgttgcgtttatgcgcaacaatttcaaagtgttggcaaaaaggtgctaatattttgaaatttaagcaacttttcctgttcagaattcggcatccctcaattatgaaggtgggacaaaaaaaatatgcttttaatatattaatttgtaaaattattcaatcaaacctggcattattaattaattctttccatcggcaaatattcgaattgtcatattttttttttttttggttgttaaggttgtgctaacctacgtcacaaaatggtaattaattcttttttgagaattgaattggtttttccattcttctcctttttcccgttacaggatgcaaagcgaaaaggaactgcgcgaggtgtaactttaaaattaaatttttgaaattgctggatttaattttcatttgtaatgaaggaaaagggaaaaaagaaaatctaaatatccaaaagccgaagcattttttaatggcttatgctttcaataataaaccaaatattcaaaaaaaaagtaaactttcagttggaaatgttcgagcgagaaaatgcggcggaattgcgagacttgcgactgtcggcctatttgaaagagcttcggatggaaattggggctaa

SEQ ID NO: 75627 - DNA, 552 bp, Heterodera glycines
  Genomic contig location: Contig_ID=SeqID_1739; Location=1289..1840; Strand=+
  SCN-specific regions: Sequence locations=1-112,134-159,221-268,298 -439,478-552
atgccaacggagggaatagggggaaaagcatcggagaaagggcaattaagcattgaatcgtttgaaagttcaatgcccaaattacatattttgtttgatagacatattcacttgtatgtgtacatataatatactccttcctattcaattatttggcgcaattaatatcaaaaattaaaattagagttttaaatttatttgaaataaaaaaaaataattaccttcaattacattcaaaaggtaaaacttaaaaataccagcaaaatacaaaaaaataataaataaaatcaattaaatggtcattttgatcgggcaattgatttattttgcaggacaaatatcccaaaggagattatgtgcttcttcgactttcgcttcgccgttgactttgcgtgccaccaatgttcatttgaccattcgttcccttctcattaagtcgtcctttctttttatttatttatttgtcacaaagaaaaataatccacgaaagggaaaaatccacttacttcggggacatatgaaaacataaaatagtgcacaagcaaatggata

SEQ ID NO: 75628 - DNA, 2728 bp, Heterodera glycines
  Genomic contig location: Contig_ID=SeqID_1740; Location=425..3152; Strand=-
  SCN-specific regions: Sequence locations=1-82,105-176,198-476,498 -519,541-736,758-928,950-998,1023-1092,1115-1288,1310-1392,1436 -1491,1532-1681,1703-2005,2027-2256,2279-2510,2533-2699,2721-2728
ttagaagccaaaaaaatacaaatcttaacattaactgaaacttggacaatggaaaaccaggacatacctttttgtccttggattaaagaaaattttaattatatctttgcttcaagaaaatctaaaaatctcttacgtggcggtggctgtggtattcttcttagaaaagaaattaaattttttgttaaattttctgatactaaatttaatagtgaaattttggttctacaattacaaaatactaaatcaattaggcttatattaatatatcgtccgccaaggactacttttaagcaaacaaaaaatctttttaattttttacaaacctttttctgtgtaaattctataattttaggcgacttaaatttttctaaaaaagacctagtatggaaggaaggcaaaccattttccttgagtaattttggtgaaatattttgtgacttctttaacaggttttcttatgttaatgccactaatggaccctcaaggggaaattcttggctagacttggttttaccagcaaatgataaaattgtaacacaatgttctatcgaaggaggcattttttcgtcagatcatttagcccaattttttatattaactgttccggaattaattcctaaatcaaaaaacataaatattaggagatttactccatcaaatgtgtcacttttcaatgtagttattgcctcaaggcttagagctttatcatttaaactttttagcgtaaatgaaaaatatgtctcctttaacaatgcattgttagaaactttagatgagtgtattccaataaaacgattgaccaaaaatgatttggtccataaatatcctaggcatttattggcatccattaaagaaaaagcaaaattatataaacaaagtaaaattgacccaacaaaaaaaacactttatgatagcattagtttacacataaaaatacaaacaaataaattccattcacaaattgaaaaaacggctatttcaaagggaaaacaatctatttttaaatatttaaataaatacaaagataatccctttgaaataccgaatttagtcttcgaaaacaaatgctattatgatagtgcagaaaaatgtgaattatttgccaacttatttgcaaattcatttagtatttcttgggctgacccaaacctaaacttgagcaatgcccaaggtagtaatcaatgctttatatcagatattgattttaacatcattgagactcaaacactattaagaaaattgccaaacaaaaacggaacttctccggataacatttcctataaaattttaaaaaattgccattcttctttagcaactgttattactgacttgtttagattatccttagacagtggttcacttccagacatctggaaagaatcaattgtctttcctctttttaaaaagggggataaatttaatcctgaaaattacaggcctatttctttaacctgctctctgtgcagagttatggaaagaattctcagcaaaaatatttacaattttttattaaaaaacaataaaatttcagaatcccaatttggttttgtaagaaataggtcaacgacaaatcaattaataacagttgtcgaagattggtacgaagcaattattaacggaaaaaatgttgattgtatttatatattgactttcaaaaagcatttgattcggtacctcataatttgcttttgataaattgaaaaaaattggtatacagggtaaattattaaattggataaaatcatttttaagtaacagaacttttcgtgttaaaataggggatactctatcctctgttaaaaaagttggctctggcgtcccccagggctctgtcctaggccctcttttattcttaatttatataaatgaccttcctgatgttataccatcaggagcgaatattaaattatatgctgatgatgttaaaatatatatatgctataaagcaagagctgatacagaaattatgcataaaacattgcataatttattcgaatgggcaaataaatggcaaataaaagtttcaattcaaaaaacttttgtattatatttgggttcaaaaaacccaaaagaaacttataaatttgatgggaatacaataaatgctgtggatacaattagggacttaggagtaaacattgataacaaactacaattttccgatcatgtaaatcaaataacaaggaatgtgtatttacgtatgcgttccttgtttagaataattaaatctaaatcttctaaaatttggattacattatataaaacttatattagacctttattggaatacgctccggaagtttggaatccgtctcttcaaaaaaatattaaaaaaattgaaaagtgtcaaaaatatttcaccaaaagggtatttttaaatgcaaccttccaccaattccataccaaaaacgattagagtacctgcaactgccaacacttgagaataggcgaaagctatttgatctgttcatggcgcataaaattgtttatggccgaacagatctgaaactattttcaatttttaacccatcaacacgctttaacatccccttttaccgatttaacacaaaatataaattaggcaaaaaattcatataaaaactttcaaaaattttgtcataaattcaatcaatttaaattttctctctctctctctctctgtgagaaaaccttatcggatagattttgcacacaaataaaattatgaaaaattattctttcattt

SEQ ID NO: 75629 - DNA, 371 bp, Heterodera glycines
  Genomic contig location: Contig_ID=SeqID_1740; Location=5278..5648; Strand=-
  SCN-specific regions: Sequence locations=1-69,91-221,251-371
atgttgtcatctcaatcatttccatatttgaagatgcaactgatcgaccaaaagtgtgccgctgggctcgaggcggacgacacgcgcggcacagtcagtcgctactacacggacgacttggagttggacctggccgagtacggcgaactgctgaactcaacgcgacactttcctcggttttgcagcgcttttttggcacagcaaaaggtgggacaaaagcgaattaaaattcattttatattttaatttagaaggatgaaaatgtttttaagtcccttggcactgaatttgccgctgcttatggcaaagctttatcaatttttgaggaggaagtggagaagaaaaagcaaatgttgaagatgtccaattag

SEQ ID NO: 75630 - DNA, 725 bp, Heterodera glycines
  Genomic contig location: Contig_ID=SeqID_1740; Location=6616..7340; Strand=+
  SCN-specific regions: Sequence locations=1-269,292-725
atgggccatttgctggacgaaacattcgcgctgaacgcagcagcgacggttgtggacaagacgacagaatcgggacaaggcactcggcgaggaggacagcagcgggtcgatgggaaaatcgaagaattgggtaaggtaggagaggccgaactcctcctgaaagtgggggaacaacaaaatgccatgaagagggacattggcactagccaagcttaaattgcgaaaaaaaatgctaacggaagattattacggccgaaaattaaaattacgaaaagaatgccaatgggaaacgtacggattaaaatgctaaaaaagaatgccaaggggacagcatacggattaaaatgccaaaaagaatgccaagaggacatagtaaaaaataatgccaaggggaaaatgccaaaaaaataagaatatcaaggggacactgtacgtccttcgtttaaaacttcggcatgacatccattcagaatcattggcattattaatgaatgagtcacctcaaaatcgcgcgcgaattgtgcgccacaaagagcctcacaatggtactccacgtcataatacaaataattcggcgaatcattgcgggcaaaatttgtggcggaaaccgtcgaccttcgcctcctcagaacgactttctgctggggacgcgactgagctgaacaatttgttaattgcatgcaattattggacggatggataatatgcatttacttcccgaaata

SEQ ID NO: 75631 - DNA, 794 bp, Heterodera glycines
  Genomic contig location: Contig_ID=SeqID_1741; Location=616..1409; Strand=+
  SCN-specific regions: Sequence locations=1-214,236-352,382-592,614-794
atggtaatgcttttgcctcaccattaaaaagaatcgccacaccgcgccaattaaacggttctgtgccaagttaaatttagcttctttttttttttactctaaagttcattaattcattttgaagttggcgaattaagccgaaaattgtcatctcaaaaaaatgaattgccaaaaagtggtgaaagattgagcaaaaaatggtgccaatgcggacgatcagaaatagagaaaatgaaaccgatggcactgatcaattttgaagacaaaaagccaattgaacttttatatcaaaaaaagagacttggcaaagggtcgtactcagaagttggtaaaatgttgaaagagaaaagagaaatttaataaatttaatgaaaaattaaagttttagcttttaaatgatggcacttttaaggttttgcatgcgaacataagaaaaattggaaataaaatttacaataaatgcgtggcactgaaaatgacaaaaaaagatttgacagtcagtgactggcaaaagcatgtcaaggagtggaaaattcagagatcattcgacactttcaacgaaacgaaacgggcacacattgtcaaattaattgcatagtaatagggggtatttaagactaaatgagcataattatgagctaactttgttaatatttaccaaagtaaatttgataatgtataatatgtattgctagttaaaagctaaataattatatttgctcctccaaaaatgccgtactgacgttgcattcgtttgaattggtcaattaatattttccagcggatttcacaaa

SEQ ID NO: 75632 - DNA, 622 bp, Heterodera glycines
  Genomic contig location: Contig_ID=SeqID_1741; Location=340..961; Strand=-
  SCN-specific regions: Sequence locations=1-111,133-406,452-465,488 -489,561-622
tctctttcaacattttaccaacttctgagtacgaccctttgccaagtctctttttttgatataaaagttcaattggctttttgtcttcaaaattgatcagtgccatcggtttcattttctctatttctgatcgtccgcattggcaccattttttgctcaatctttcaccactttttggcaattcatttttttgagatgacaattttcggcttaattcgccaacttcaaaatgaattaatgaactttagagtaaaaaaaaaaagaagctaaatttaacttggcacagaaccgtttaattggcgcggtgtggcgattctttttaatggtgaggcaaaagcattaccattctctaaaaataaacaaaatttatgaatggaacaatttatttatacctctaaattcagcgaaaattatttttaaataaaagtataaaaaaagaattaataaaattcgctgtcctttgccataatttatttgttgaatcattcgaaaaattatattataaaaaatttaaaactatattaatgaaactaaaatttattcataaaaaatgtaaaaatgaaaatcatttggtattatagcatataaatcaatttataaacgttaaattaaacaggaaaaa

SEQ ID NO: 75633 - DNA, 1682 bp, Heterodera glycines
  Genomic contig location: Contig_ID=SeqID_1742; Location=657..2338; Strand=+
  SCN-specific regions: Sequence locations=1-721,759-770,792-903,928 -1157,1226-1241,1354-1370,1407-1456,1562-1623,1646-1682
  Gene Ontology: Mol. function=structural constituent of cytoskeleton; Cellular component=neurofilament; Biological process=N-linked glycosylation
atggacaaattcaaagcccatcttgaggaaaagcgtaaattgttcagagaagaactcgcaaaagcagaagataaaagcaaagaatcagttgaaagaaaaattgacgagacggagagacttttgtggatggcatcgctaaaggaatggaagccgagcgaaaggctttggaaagtgccgtgtgacacgggaaaagccaaaacgaagccgaacagaatgtggacgacgaggataaaggcggagaagggcgaagccaaaaaagccgagggggagaaaaacggtgggaaaaaaataataaaattgacataatccaattgaaacggataattatctcaatttagccaagtcgaacaaaatgttggccaatcttatgaagagcattggcctgactttgtcgccgagcattcaaaacgcaaatgattcaattgaaatgaaatttgaggggacttttgaaaatttgcaagattcattctataaccggagttcaaaggtatgtacaatacttataagataatacaatccaaattattacaattataagcaaatttcttcaattttattgctttggcacttacgaagggggcggggcgacattttcccaaattgtaagtgccaaattcgatttctaaccatgcccaccgtatgcagccaccgttcgtggaactttaaatccgaaaaagacctaaccatgaaaaagtttcatgaatatctactgacaaataagttataaaattttatattaattaaaataaatatttaatctttgttcattttaaaactttaattgcatttttcgccattttgttcaaaaaagcttaaatttatcatcgtaaaaggtgatgccttatgagatgggcatggcaagggatttatgcgaggcaaagctcgaagaaaccgattaagcagaaaaaaattatttaataaattaatgagaaatccaactttcacaattttgccaaaattttcagcagccctttgatcagagtaaccaaattgttagccttttgttagaaataggctacagaaatttattagaacatttgatttccataattgaacgttacgaaagcgatgccgaaatgctgaaaaaggttgtggtcatagtcagcggaaggttggactcggaatggaagaaaataaatgaattggcagccaaatacgaagaggaggaggcggaggaggaagaggaagaagaagaggaggaagaagaagaggaggagaaagaggaagcggaaagtgagaccgaagaagagaaagaagagagcaaaaatgaatcgaatgaggagatggaagaacaagaagcaaagaaagaaggggaggaagtgaaaaaggagcctgaggaagagaaagaagagggccaatttgtgttcaatgagaaggaggaggaggaggaagaggaagaagagaagaaagtggaaaatgagactgggaaaaaggtgagccaaaaggagggtaaagtggaggaggaagaggaggaagaagaagaagaggatgaggaggaggaagaagaagcagaagaggaggaagaagaggaggaggaggaagaagaagaggaggaggaggaagcggttgagaaatgctgttggtacacgaaaaccatcgaacagataaaagcagtgtatttgtatgagctgatttacaaacattttatcgctgaagtggaaaacaatgctacaaataattca

SEQ ID NO: 75634 - DNA, 2485 bp, Heterodera glycines
  Genomic contig location: Contig_ID=SeqID_12078; Location=973..3457; Strand=+
  SCN-specific regions: Sequence locations=1-40,64-539,561-642,664 -686,708-932,989-1072,1134-1228,1250-1269,1321-1360,1391-1420,1442 -1590,1612-1830,1863-1903,1926-2171,2194-2485
catttcgttgcgcttagtgagcactcgctcattatctgccttctgatcattttctttggaggatttgccttagggcttatcgcctccattttcttccgttgtatgctcgggaaggtgtgttatccccgttgtattaccaccaaatattatatttattagcatggccatagtccggttggcaccagcaaatctgctcgcaagggagcccgtgatcgggcggctttgcattctttgagctccatctccgttgtaagttcaaccaaattttgcagcacttccttttttttttacccaatgtttttttaagccccatttgatggcaactcctgtctgaggcagcggttcgtgccagatttattcgccacctcaagccttcatttgttaattctttattcacattccgttcacattttcctcttttttttttttttaattcaattttttcacttggctttaaaatatccccttaaataatattcatttaatcataaacgcattgcttattttctaattctttaataaaggcattaaataattagttctatttaaattcttccccatttttgccccgtggcgggacctccatgaatatgtcggatgccctttggcattcgttgtttagcccctccccataattacacgagtgggatggaataatatcctttattcggaaggttgatcaatacaaatatataatgtgtaatatatgtgattagttggggaagggtgaaccgattcgtccggggcaaatagggggagagggggaattggaagagttcgggattagccaattccccctcccgaaagagtgaaagagtacaatgtgctggagggcagctaaagacttaaagtgggcggggcctacatgatcagcttaggcatactgtacttagtaaatggtctacggtaaacacaaaataatgagctaagtcataattataattattatctcatatttattttatattttttgttatttaataatattggcaacaacagtaaaagaagaaaaacggacggacggacaaaatggcaatggaaaataaaaagtcaaaaaacccttccgaaagtgattttatttattttttattatttccaatttaatttaattctaaacaatattaaatattatagacaaagtttttgctaaaatcaaatctattcttttaatgtttggcaatataaagcgaaaaaagcagtaattcaagaaataaaattccaaatttaaggcctcaaatttgtaaactttttgagcaaaaaaaaagattgtttaattaaaaaatatatatttaattaattaatttctttatttatttataaggaaattttaacgaaaatgctgaaagctacaaaaaaaaacctgcaaaaatacattttttaaattttgtttgcaaaatccaacaaaaataattttctacaaattaaaataactgtttaaaatcagatgatataattttacattatcacaaatttggagggtttttagcagcaaaaaaattcgggccaagctcatgatttaggctggtaattataatggccataaatatgtacataaaattgcaaaattatgtgatacatgttccaattagagggttaaattttccaaaatttctttaaattcattaaatttaagcaaaaagttagccctactcatgataattaattttttcatcagccagtgagtgcgctctgctcagcccaagcagagaaccctcgccgcaattggcaatttgccatcgccgggcttctgatcgcctccaatttgttcgtcggcattacttttgcgtgcattgtgccctttttcccgatcgaagtttggcaacgggcagcaaaaaataaataaatattgtaaaataaaaaatgaacagtgaattaattaacatggactgctcgaacaggctttctcggtgtcagggctgggctcgaaaataacccaaagttccagttacggatcaaaattacggaaaatcagcaaaaattcaataaccggcatacgtaattactgggtccaaaaggccgtaatctccgcaattacccccagtcctgctcggtatagaaataatcgagtcgagaaagatctactttcgggtatcgtatcgaaagcaaaaaaaacaaaaattcaggctgaagcgaagggtctgagcacctcacaggtcggcttggtgatcggcatcttccaactgtgcagcttcttcgtttcgccagtcttcggcaaatacgtaaaatgggcgaataataattgggaactttgagaatacggaatagtgatgagagtgtttttgagagtgccaaaatacgaattatgacgggaggatttagggattaataatttttaatgcccctcgataaatctccggaattaacggcttacatcactgtttttccatttttaattcccatctctgcttcagttggttgtcctccgtgttcatcgtgcctttatcggtggtcttttgttcacttctctgtgcacaattgcacttgg

SEQ ID NO: 75635 - DNA, 235 bp, Heterodera glycines
  Genomic contig location: Contig_ID=SeqID_12079; Location=14..248; Strand=+
  SCN-specific regions: Sequence locations=1-235
tttaatggtcaccactatagcctttgcaatgctcggcattgtatctggtgctgcttatgtgcccgtgtttaaatggtgcgtcgacgctgcaaagtctgtgccgtggtggatggagtgtgccatttacaatgcaattagtgtaaatgccctaattaagcaacgtgggattggacggcacttcgcctgccatttgcgggtgtatctccggattcatacagtcggcacttgctctcag

SEQ ID NO: 75636 - DNA, 771 bp, Heterodera glycines
  Genomic contig location: Contig_ID=SeqID_12080; Location=1320..2090; Strand=-
  SCN-specific regions: Sequence locations=1-308,342-674,696-771
atgcctgcgctcaccgaaggtttgtgaagaaaacattttttataaaaataaaacaccaaaaaacaattattctaaatagctgttttacatttttttaaacgactttcacataaaaacttttttagtctataactgtgcgctttctttacggaacaagggcgcggcatgcaaagacatcaactggcttatcgctacttataagatcaaagccacagaagaagacgacataatcgatgttgttgattgtcctggcaatgtcttcatggggtgccagacattctcttgtttggatggttgtttcatttttcaatttaaatatttattaatttgatatattttttcaattcatgccaacttcagaacaaaataatgatatatttgtcttgaatggatgcgccgaaacaaaaagttgttcatccaaattggagaaaatctgtaaaaaatatgatggatttgcgtcatgtgttatttgcaaaggaccattgccagtgtgcaacaaagaaaaaattgagttaaaggagccctttccgcccttcaatgatggccatgcccatcgatggtttgtgtagtaaaaaagttttataaaattaaaacacatcaaaaaacaatttattctaaataggtgtttttttgcttcttttggatggtcggcatgctctacgcctttttgttatattttggaatgtaaggcgttgaaagtgatggagcacgcgtaaccgccctgacactgtcgcatggcaactttggcttgaaaaagagaagaataataaa

SEQ ID NO: 75637 - DNA, 57 bp, Heterodera glycines
  Genomic contig location: Contig_ID=SeqID_12080; Location=3460..3516; Strand=-
  SCN-specific regions: Sequence locations=1-57
atgattgtgtgggcttaacgaggcctgccaaaatgttaaatggtcgcccagtgaaaa

SEQ ID NO: 75638 - DNA, 170 bp, Heterodera glycines
  Genomic contig location: Contig_ID=SeqID_12081; Location=302..471; Strand=-
  SCN-specific regions: Sequence locations=1-170
ccgaaaaaccgttgctcgattttgacaaagaattttccgatcaatttccttttggcccatttttggatgattacgccggactttggctgctcgggttggacattctcccaaaatttgggccgaaaacaacaaatatttcaatggaaaagccgaagaattgccaattggag

SEQ ID NO: 75639 - DNA, 3135 bp, Heterodera glycines
  Genomic contig location: Contig_ID=SeqID_12082; Location=1513..4647; Strand=+
  SCN-specific regions: Sequence locations=1-755,777-989,1011-1101,1124- 1335,1357-2183,2205-2210,2232-2920,2951-3135
  Gene Ontology: Mol. function=transporter activity; Cellular component= membrane; Biological process=vitamin B12 transport
atgccattccagcaaaaatgccattccaatgaaatgccattttaaacgctattcttgacccacccccccgttcacctcattagcaccgacaattgtctctgcaactttctaaccaactgaacacttctctctcacgtgcccgtgccaaccggcgcattcggctgctcatcctgaagctgagtggtcaaatcgatcggcttttcaagctaatgagtgtggacgactgtttggcacatccctgcttgaatggtgccacttgtgtggacgggtttggcaaattccaatgcctttgtcctgcacattttgaggtgaatcagctgaatcgtcgatggtgtaaaaccccggcaaattattaagggaaaacactgcgaaaaacgggtggacgaatgtgccctttttgcgaacacagaagtgggatgccaaaacggcgccatttgcaggaataacccagtgagagaagcaaaagcgcaaaaatgggctaaagaaagtgatcaaagcgatcgaaagggcaattaggcatatgcttaaatcagctcaagactcagtgatcaaaatgccaaagtcattccttccgtctgtctcttagtcatttgccggcttcacctgcaattgcactgccgggtggcgaggacgattgtgcaataggaaggacaataaatgtgatcattcggccgatttgtgtggggagcacggacactgtgttaacaatgagcaatcagaggtcagagaaaaagaaaagagggtcggaaaataacggagagagagaggaagtcagacaaaaggggaataaccacgagactctcgggattctccggatttggctgaatctttctcattgtttggtcccgatgcgctctgatcccaattactcatttcagctcggctatcgttgcttctgcgagtcgggcttcgttttgggcggtgacccttcaaatccgacttgcgtcgataacgacgagtgcagcaccaacagcccatgccatccggcaagcattctgccaaaccaaccaattccgctcattttctttgcagggcgtcaattgcatcaatttgccgggctcctttaaatgcgattcgtgtccctccgggctaatcggtcggtctaagagcaaatcaagggcaattaaagggagagattcatttgataggtaacggaattaattgctacgacttcgacgagtgtgccagtgacctgaccaacgactgttccaaggagccacgggttgactgtgtgaacacccacggggcgtacaaatgcggcccgtgtcccccgggtaagaacatttcggctgtctaaatttttttatatcacatttatctagattttgtgggcgatggctttacctgccaaaaggtttcactgtgtgccgatggccctaacaaagtgtgccatccggaggccaaatgtgtagaagaaccggaattccgttgcgaatgtccgccgggcactgtcggagatggcctcgggccggacggatgcgaagcgaacaatcggacactttgccacggggacagctgcttgaacgggggcacttgtcaagtactgatcaaaataaccaatcaaatgatcggcaaaagctgaagctcaacccatcaacccattcatttcactgaatgcccttcaaatccccaggccatttccgtctctgtgttccgttgcaattgccccgaggggtaccaagtgagtcgggcggtgttgtgatttttcaaatggctatcacttaacgggttcaccacttcaaagggtgcccgatgcgaacatgccagtccctgtctgtctcggcaattctgctcagggcacggccgatgccgaaccagtcctttgggctgcgactgtttcaggggcttctacggcccgcggtgccaatttgaggaggacggtgggggacggcatttgcctttttgcgccaattagaataacttcttgattttaagactgcgattttcacacgaacaacgaaacgggcgaaattttgtacgaacaaatggccggacgagggccattgttgagcagaaaagtgtgcacgtggcacattcaattgctggacacgcgcaaagtctcaccagaaagaaaggacaagaaatggaaaacattgctaatctcttttgtggagtgctaattgcttccaaatgagcctattagcgcattgatcctcctccttaatgtccttccttaattgtcctccttaatgaccctctctttcgcttcttttcttgtcctccctttccttctccatttgacactttccctcttcttttgtcaggtgcttcagcttctatttatcaactactcggctccccgtctttttgaagtcacttcaaaggcattgcttatgatttgtttggcctaatgaatatccctttttaagggctgtttgtccgccttcgccaatttgagcattttcgacggggacgagccgggccaaagcccccaattgggacgctcccaaattgcgcacttttgccacggctcttcgccttctccgctgctcccttttcacacctcagggtgaccactctcaacaacattttattactcgtttattgctttgactcctcaggcacaaggcgaccgttcgactttctttccgtcttttaagtgccaacatttttttgcatttcaaatggacggcggagagaccgcgtaagtcaaaaatggaggagggaggggggtaaagcaaatctcaggaaatccgaagggagtgccaaatgaattactcactctcggactaaaactcccggagaatgattagccagtctttaatttcagatctcgtcattcttgctaatccatgttttccttttgctcaggttgtggtggacgactgtctaatgccaacggcggacgcattgaccatttcgatgtccggggtgacgacctttgcgtttggtctgtgccatgtttttccgctcgcgttggtgccaatctctgatttctctcctcaggttcattagtatgccgcctcaatttcacgtccgcctcagcgtcgatgtgctgcgtttgccttccgcccaattccacaattgttctgtcaattcccttgaggtcattcgaacatttctcctcaagcgttccttttttcctttctttcttatacgctcttttcctgttctcttttttcccccatttccttt

SEQ ID NO: 75640 - DNA, 755 bp, Heterodera glycines
  Genomic contig location: Contig_ID=SeqID_12085; Location=915..1669; Strand=+
  SCN-specific regions: Sequence locations=1-34,57-148,176-584,608-755
gcccaacggcggccactgtcggcacagttcgttacgccgcgcggggcggcggcggcacaccgtttcggcaaccatcgccatttgctgcacccgcaggggcagccggcggcgaattatcaccagcaacagcggggcgatttgttggcattgatcagcagcagcaacagcagcaaattgatgccctccgggcacggctggaccagctacagtacgaactgctgggccaagtacagtacgccaccagcgcggcggcgggtgccgaaccatggccacctgccttcttcaccgttgactacaacaaccacccgaaatcactgctcgcccgccggcatatggcatggcaaccgatgcgccgtggcatcattgaaaatgacgtatgtaccatatgcaagtacagtacccttaacccaaatttttgtcagagagatttgaattttttatttttaaacgaaatttcatctaacttttcatttttaaagctacagtatctatatatgtttaaatcattccacatatggccatttggtcagcataggtacacagtaaagacaattttattactgtaatgcattaccgtaacccatttttaaagaaattaaattttgttaaaacggttaaggaacaacagcacggcagcgtgtccccaaggcatatcagttggcagccaatgaagcgtcaacaacagacggaatacggtatcaccggcatgtacggtaggggagggggagacggtggaggagcacaaaaggagcagg

SEQ ID NO: 75641 - DNA, 757 bp, Heterodera glycines
  Genomic contig location: Contig_ID=SeqID_12088; Location=28..784; Strand=-
  SCN-specific regions: Sequence locations=1-8,30-184,206-705,727-757
atggcatgcgcagtcgctgcagaacgagccacaattcaccaagagctacagcgattcactctcatcacggagctgatccgagtcgaagagctgcaagagacacaggtgaacatcacgttcaggcaccagttgaactccgtggccgagatgatggacatgttgcaaatttgggaagaagacacggcaatcagctgccgcgtcgaccaaaatgatgagaccaagccgtgtgctcttggatttgtccgacgcattgaaaagcgcgcacttgacaacggatttgaggtcagagtcgaggtgtttttggcatttcaggatgccaaaggacagaaggcgtgggagcagttcgaattccttcgtgaaggggcgttggaagccgttgagcttcgtcccatggtttccacgcgtgcgctgagggaacgagctgaacttctgaccaaaaatggctgctccatcattgccaaggaccacgcatcgcctgccaatgtgatcatggccattctgctgggacggagggtgccccgggacgtggcattgcaaagtgttgaggaaaagatgaaaaagggtgccgttgggcttttgaaggcaggacagtgcgattcggcggaacggatgctcgacggagtgccgagggtcgtctttcaacaggcgggccctggtacaggcaagacctttacggcggcggcaatcatggctgccatcctgcgagaggacccgtcggcacgcatcctggctatggcaccgtcaaagattgccgtct

SEQ ID NO: 75642 - DNA, 1062 bp, Heterodera glycines
  Genomic contig location: Contig_ID=SeqID_12088; Location=885..1946; Strand=-
  SCN-specific regions: Sequence locations=1-25,49-675,697-1062
atgtcctccgaaaaagcctgcgggcacaatactgaaaatgaaatggaaggagaagctgaggaagtaccagctcaagcgcccgaagtggtggtgctggacgaaagcatcgaggagaacgcctgcgggcaaaatactgataatgaaaatggtgttgtggaagtgatgccattggtaaatccgagcgatccgctgggtttggccacggttgagccggtcaaagaaatggaagtggatgagcaaaatggggaccaagggggggataatttcgggaatggcgggttttcaggtgatgagtcatcgtctcgccacacctttttgtcgaaaaaggcaaagcgcctggaccaaacaaatgcgtcaaaatgctcttcgtcatcgcaggcatgtttggaggacggggctctgatagacgaattccaagccgtcggcctgcgggccaaagacaaattgacgaagactcgtgttcaggggccataccctggcaaaaaggaagacgaaaaggcgccgaagtggtacctggttgcccaaattgctgcaaatggcgtgattgctgcacgagttcagctgacagagcaatggcctgccctaatttgggtggacaatgacattgtccaaaagactcggccattggaagtcggcgattcggtcaaagtggtcagcgttgaatgggcacagacggcaacgggatgggcaggcgccggagattggctgatcatggtcaacaagcgcttgaatcaccaagccgtggccaaggaggtaagtgcgtgttatcagggacctttcagctcagcgttgggccttgttttgtatgtcgaacggcacgcaaagaaaaatggcaacaaaaccatgaaattcgccaccattgctgcccctgaattgcccaccatcatgcgcattcaacgacggcacatgtctgaagcgatggcaaacgaactgcactcgcagagcctggtgcaaatgcagcttgtgaccatcaatcgtccgcaaggagtgctaatttcacagcactatgtcttgcccatgggttttccattcaaaaaatggagacgagattttggcctttaa

SEQ ID NO: 75643 - DNA, 534 bp, Heterodera glycines
  Genomic contig location: Contig_ID=SeqID_12089; Location=2913..3446; Strand=+
  SCN-specific regions: Sequence locations=1-139,164-190,214-344,366-534
atgactccgtccaccgatgaaactcattttggtggcatggacaggccatttgtgcaagcgcatttggaccaattcaattgtgcattggggacggaggacgaattggacgaaacagtcaataaaagtaagcaaatagctcaattaaattattattttttaaaaacatatgttagacctaagtttccgaataatttggtcccaaattttctgggctaaatagcacaatgtcattcagtgttcgatggttccaaaaattccttccctttttgttcatctctttcagttaatgcgctttgcaaaacccattcaattggcgcattggactttttggacggattaattgcgtttatgaaaaatggcaaaagggcgaccgtttcgatgcaaattttggacaattatgagcaccaggtaagtgtgaataattaacgacgatttgttcatttcttcccattcttttaaggtccttttgcgaatgaatgacagcgaaaagcggcggaaagcgaccaaacggacggcgccgttggattatcggaa

SEQ ID NO: 75644 - DNA, 1062 bp, Heterodera glycines
  Genomic contig location: Contig_ID=SeqID_12090; Location=385..1446; Strand=+
  SCN-specific regions: Sequence locations=1-69,91-97,121-432,454 -801,823-851,873-993,1023-1062
atggcccattctgctgaccaatttgtgcaactgcttagtttggttgccgcctctcatgctaacgcattgattttggtaccatttttcaaagaaaaccaattaattttattttatttttttcattttcagttcggcccatttgtgccccagggtatggaactgatgacggattcgcccgaggcaattttctccgatttacttgccgaaattgacaaaaacattcccgccaatgtccgtgtgctcattgtgccaaactcgcagtgcgatcagctcaatgctttgcccagcttcccaacgccgccactgatcggtccgcaaaatgacactgtgccaaatgtacgttttggactgggggaaatgaggcaattaattatacctcattaagaatgtcacttttctgtccgaccccgcactgtttgagttggattctgtccatttcgctgtgtcttcctcagaaattttgttgcatttgtgcaagacggaaatttgcaagtcggccaatgtggagaatgaggaccgaatgcgccgcctcatttcgcatttgttccggtaatttgatgtcgtattggattggatcggtgccgtaaaggcctaaaaatttcggaatttccattgcctcccccttctttcagtgctcgctccctttacccgctgtgcccgtgtgaccaaaatttgccatttgcgccctctgcgagtgccaatgccaaactgcgcctgcccaggaagccgcacgtgatggttctgccttcgctgcttcagccagtcacaaaggtaaagcaaaccgtgacaattgaacacggcttttaaatattttatccatttgatattgttccatgctttatccaggtggtggatgactgcgtggtgctcaatccgggccgcttcgacagagggaagggcaccggcacattttccgttctcgacttggacctttcgagtgccattggcgccacttcggtctcaccgttttgcgaagtctcactcttttcaacccaacaacaacaatgacaaaaatcacatttttgagtgtcgcaattgcccattttaacatttttgacaaaa

SEQ ID NO: 75645 - DNA, 1212 bp, Heterodera glycines
  Genomic contig location: Contig_ID=SeqID_12091; Location=389..1600; Strand=+
  SCN-specific regions: Sequence locations=1-335,441-447,469-469,491 -583,607-854,876-920,962-1024,1068-1068,1115-1132,1161-1212
atggacgagcaggagatgaaccagctgttgttgaaccacgcgttcggcttccaacagcaaatgcaaaacgggcggcgacagggcgaagatgtacggggagttggtcaacaaacggaggtcagagcgaatgagtcggtgtcgtgtcgtccatcgtccacctgttcctctgtgtccttcttttttggatgctttcactgtttggccgcttttctctaacctagagtgcgctgggaccgggaattttgggcaaaaccgggaccgggacttgccgggaccaaagaagccgggaccgggacttgccgggacctaagaagccgggaccgggaccaaccgggaatttttaaaaattcaaaaaaatttaaaaaaatatcaaattttaatttatttcgagtgaaaaaatacaaaattaaatttttattttgttttttatttaataaaatccaaaagttaaagctaaattaaattaatgaaaattttcaaaccaaatttatttcaattatttcaaacaataatcaattttggacctaaatgatcgaataatattaaaattgatttacttttcacatcactttttttaggcacgttttttccaaaaaacttttggggaagaagggggtccggcggtgccgataggcggaaattttgaaatttgggtgtaatttgttaacagattttcaacaaaaaaggttggtttttgggattactaagctcaatttgtacggattttttttaaaaaatgataaacatgtatcaattaaaaaaacaatgaggaatcatattttgtcgatacgaaaccaatgagtatacaaaaagaaaattcataaatattttattcctgtagagggattgaaccaagggaaggaagaagggaaagtaaaggatactagccactaggccatttgcacaattgtcagtgcgacttttaaagaatatattaatgttttttttttaaattttttttctttaactccaagtttcgttcctaatttttcactcagacccccattcttaccagtgcttgtttttcccggttgccctaccgggaccgggacctgagcttttcaaaatccgggaccgggacctcggatgaccgggaattcccggcccggtcccggtcccgctctactctaccaaaaatgtccaaaacaaattttttagttcatctggccgtaccaggtgttttcgacagtgattgatttcgaaagtagttga

SEQ ID NO: 75646 - DNA, 2566 bp, Heterodera glycines
  Genomic contig location: Contig_ID=SeqID_12091; Location=1999..4564; Strand=-
  SCN-specific regions: Sequence locations=1-96,119-290,312-497,522 -628,654-1014,1053-1206,1228-1408,1445-1957,1979-1989,2012-2014,2036 -2482,2504-2566
caattctgggactgaagcaaagcgaaagcagaaggaatggcgccaagagcatggtcgcagagtcggttcgacgccaaaaagtgacaaaaattgaccaaaattaattttatttttaaaacactgcatttttcagggctaaagcagaccgaagccgtgccaacagcagatggagaggggacatcgacccaagccgccgaaagtgggccgtcaacgtcagctttggacctttgtaaatcaaaaaagtactattttagaagcaaaaattaaattaaggcccgcattcaagcccaaggccattgtcaaccactccggtcaggcgccatgcgcgtgttcgtccaaaaactaccgaaaacgcaacacaaatggaattgacaactgccgacaaagcaacacacatggactttacaactaccgacaatgcaacaaacatggatttgacaatgatggacaaggcaacggacgtggatttggcttatgaggacgccgcgacacaaaccgagcagttggacaaacagctgaaggagcaggaacaaacgatcagctttctacgactgcaggtccgcaacagagacgcaatgatcgctgatctgcgccgtcaattggaacagcaggcgcagaaggaccagccaacacttaaaattctgcagaatttttagagccatttatcatccaaattgtttttagctttaacttccacacggtgcaaaaagaatgcggctacattggagcggacctcacggcgaaatttggccgagaaaatcgttgatgtgatcgatcgagaccgctcccgatcagtgagccgatgttcgctgcaaactctacatcgtgaagtccgccacaaatttggacactacacaccaatgaagaaggaacaactccgacaacaacaaacaatccatgaagaagatgcactgcttctgctgtcacaacttgggactcaaaaagcgtatgagaggatgaaggcacttgcgtctgatcggtggaaatttgatgttttcccaccattgaaaaaagtaaaaatgttttttaattcaaataaataaataaattttcggtcactaaaaatcaaaaagactatctgcgccgtgctccgatatgaagcagtttcgacgccactcagaatcggtttcttttgttccgacattgccggggcactggaattcagattgtccgcggcaaaagacaatctgatcaacttcaaatcagacaaagtcattttaaaattgagtggggacaacgggcagggcttcactaaattgaccatctcattgccccatgcggcgcatgcaaattccccggccaacaatttcattgtggcagcattttccgcaaaagacacaagggcaaacctgagcaaattctgtgcaacatttgacaacagatcagccaaatgaatgaaattgcggacaaaaaaaatcaaattgtaaaaattaataaaaattttctgaaatgaacttaaatttccagctttctcggcggtgatctgagctttttgtgggcaattattggacactgtggctcagccgtaacgacgtatccctcgcctatttgcgaatgtcgtcgggaccaattgttggacgcggaaaagtgtaaaatgaggacgacggaggaaacggtgaatcaagctgagcagttcgggcgtctcgtgcaaaatggagagaaaccaactgttgctgcgcgagcgttgaccatgggaatcgttgatgagccacttttgcaatcaatcgaatttgagcgcataatattggcgccttttcatgtcttccagggcattggaaatgctctgatcaaagagctcgaaacatcaacagaaagcgcggaaattgcaaacgaattttttcggaacatcgggaccaggagggaagcgttcagaaaaaaggacatgacggggaactcaatcagaaaaattctgattcatgcggaccaattggagaggcggtactcagctgactggccaaaaatcatttgccaaacattggggcacttggcaaaaatacaaacttttacaaaagtgcttttttatttgatatttttgaaaattaagtataaatttaaggcacaacccctgtcgccacgggatttggacgaattggaaacgtcgattgatcaatttcggacattcctcaacgatcagccgcggatgcgcactttgctagccctaaaaccaaaggtccacttgctgttgaaccattttgtgccgttcgccagacaacaccaatttttggcacttttagacgagcagggtcaaaaagcattttgaaatttaagccctggattttttaggtgatgaagcattgcattcggtgtggaggcgtttggaacagttgtggaaaacaatgcccgacgaagaacaaatacgtcaattgttggaccatcattttgtgtcaaattggcttctgaacacaggaaagattgacgaaatgaagcgggtcagtttggtgaaaattgtgttcaaaatcaaattcccatgcctcaggaccgtgaagaacaacaagaagaaattggtgaccgacgggagacggacgaagatagcaatggagaagaagaacaattcgattttgaataa

SEQ ID NO: 75647 - DNA, 90 bp, Heterodera glycines
  Genomic contig location: Contig_ID=SeqID_12091; Location=1758..1847; Strand=-
  SCN-specific regions: Sequence locations=1-90
gagaccccctttttggtgactaactcacagaccacttagacgaaaaatccaacttaattgtacttggagcccaaaattgactcgccgtgt

SEQ ID NO: 75648 - DNA, 329 bp, Heterodera glycines
  Genomic contig location: Contig_ID=SeqID_12092; Location=105..433; Strand=+
  SCN-specific regions: Sequence locations=1-329
atggcatttttggaaacatttgcccgctttccgtactatgaatttatatggaaagttgaattgtctgatgaagatgccaaagtgtttgccaagtacaaaaatgtgaacccggtcaaatggatggaccaaaaatcgttactaagtgagttaaaaaacgaaaaagtttgaaaattcagttaatcattgatcacttagtaataagttcactaaaattaattacccttaatttctgaggctttaaattttttcatattcggtcaatgcctaaattcttggtatcaaacgaaagctcaaagtctacagaaattttttatttagcgaattgcgga

SEQ ID NO: 75649 - DNA, 405 bp, Heterodera glycines
  Genomic contig location: Contig_ID=SeqID_12093; Location=233..637; Strand=+
  SCN-specific regions: Sequence locations=1-99,121-181,203-405
atgtaccatcggaataaaggatattattccacgtattgtactttctgtggtgggcttatcaaaggtacgataacaccataatcagggtcatctcataacaatacaataacaaataattttttgacaaattcagcacatgtgctctctctaaagcatgagaggcacaatagtgtgcatcacaaaataatacattttaaaaaacgttggcaaatttcacttctgtgtctcatggattaaagatggggtgaaaataaggaagggatgcgatacgaatggggaccggtaaattggacaccggaaaattggacaccaagcggaaaaatggacaccgccggaattttggacactaaaggaaaattggacactaagatttcctttttaaaaaaaatcaagaattaggtgaaa

SEQ ID NO: 75650 - DNA, 547 bp, Heterodera glycines
  misc_feature (353)..(353): n is a, c, g, or t
  Genomic contig location: Contig_ID=SeqID_12093; Location=1480..2026; Strand=-
  SCN-specific regions: Sequence locations=1-512,544-547
atgacttcggtactcagttgtacgtgtttttcagtaccaggtcccggtcccgtaccactcaataaaaattttaagagttttttatttaggttttaaaatttgaaaatttattccgatttattgagaaaaaattttaggttttattgaaatgttttttaaatttttgttcgaaactcaattgcacgaactgccccataattcactcattttcgggatgagtcaattgaaaaagccgattgacaattttttatttatcaatcaaaactggcactttacgaaacgcggcgatttagcccgagtgatcatgaccaactctgatcaaatcaaccccctgccgatgaaaaaccataccnttgctgatcagcatgtacaatgtcaggcgttctcgagccaacctgtacattggaaaagcgcacaaaatcataaatgctatacaaatcagaaaatttgtcatccgaaaggcgtcgcgcactttcgacagaggtgacaacgaatttatgatagtgcaattcatttgctgttttttgacaaaaattaggttaataaa

SEQ ID NO: 75651 - DNA, 1812 bp, Heterodera glycines
  Genomic contig location: Contig_ID=SeqID_12093; Location=2248..4059; Strand=+
  SCN-specific regions: Sequence locations=1-448,470-599,636-640,665 -675,703-720,743-1262,1319-1392,1415-1444,1466-1812
atggatttttttgtgccaaatgttgtgttggattttcttgcaacgattgcattaaattgccagcaatacggtaatgtttgtattcgtttgcattacgttgtgatggcggcaaacagagcacatgcggtgctcttcccattcaattatgcacaaaacatcaccaaaaagtaaacaaaataaacaattcatacctcgagggataaccggttccggggatttccgaattatttgcttttttacatgaccaaaatggcattttatttatacatttcagtccattttttatccaaatttcggcatttcatggaaatattttttttttggaaacaaatcttaatttaaggaaagttttcgtccaatgtgtgattattcatctgatatccatcatttcaattccattttatcagtgtaagtttatgatatgcgtttcaagataatttttcgccaaatatttaagatgttttcttcaacacttcttatttgttcgttacttgtcttttttatttggcaattgtaattcgtctggcatggattaagggttaattaaggatttaatttcctaaaagattggcacatctcatttttgatagagaatttgcaaatttttgaaaaataaaaaaatttaaataataaatccaacaaaattttaaacataaaaatattcgattatggcctaattgcaaaaaattaaatccaatttttcgaaatttttttgccctgtagaactaaatttaaaattattcttgccgaaatcggttgggcttaaccatggaaatgcaacaataaataataatagttttttgcatgttttttatttcaattagaagtgaaattttcaattttttgctctaaatttatcattttcggtcaatattttcttaaattttttggcatgctttttcataaacatttatttaaatagttcagaatttttttttgtaattattcctcctcacccttttcataaatgagaccattaccagcaggagggttttaaaattttaagcacaaaagcgccgttggaataatgccgccactgatgcggcgacggcacaaaatcctttggacaaggaaagtgcgcgaatcactgtggtatgcattgctgtccaaatccatggcatatgttttgtgttacttggtaatctcaccattacgccatggtacacgatgttgacgatatgtacaaattacgacccaatcttgcaacaattgtattacccaatcagtgcgttcacatcgttgttttacatatcagacgaggcaattaatttacaatttaattatttggaatcaaaaaaatttaaaattaattaaatatcattagggtgcgatttttttgtttttaacggattttttttttgcggttttattccgctgttagagaactgcttgaaaaacacaaataaataaatgaattaatgaaatgctgtaagcatcatcggcattgaaaaaaggtttctttgcatgacatagaatttgttatttttggacaccaaatttgaatcgtctaattataaatttaattactttattgacactgagacaaattttcgaattagcccacactgacaatatattttttggttcaacctagcaccgttaaaacattaattaaaactaaattaattcgcccgtcaattgtccaaaattatttttgcagctctttttgttggccgtctgtatggacatgcgtgtgcaattcgcgcaaatgattcggaaaatgtttgtgccgtttcggaggcgtggaacttaaacaatgacagttcaaactgtacaggccaacgaatgcggcacaatgccaatgcgaattag

SEQ ID NO: 75652 - DNA, 205 bp, Heterodera glycines
  Genomic contig location: Contig_ID=SeqID_12093; Location=4461..4665; Strand=-
  SCN-specific regions: Sequence locations=1-24,46-160,187-205
atgaaaaatttttcagagtgagccttatattaaattttttttaaagaatttccttttaatattgtgcaaatttcagcatgacgctgggaagatgcaaaccaattagcctagaagcagaaatagaaacaaagaaaaagcttgaaggcgcgacatgatgaacattatttgttaaaataattgattatttaattgaaaaatgaataaa

SEQ ID NO: 75653 - DNA, 541 bp, Heterodera glycines
  Genomic contig location: Contig_ID=SeqID_1743; Location=674..1214; Strand=+
  SCN-specific regions: Sequence locations=1-363,386-541
atgcgcattttggtcaccggttatggcccgtttggtgcctttacagtcaacccgagtgccattgttgtggaccaattggcacaactgtgccgtgacggcacattgggcacggatgatgccgacgcaattggcattgagctggtgaccagggtggtcgaggtggactacgccggtgcactgggctgcgccaactgggcccgcgatgagctgaacgtggatgtgagtaattaggaagtggcaaattatgcaaacggtggtcattaaggataattaagggggaagtttccaaattcttgcggtatttttatgcgggatacgccagattttggttgattttttgagcggttaaaaaactttgagcgcgaaccttttaaatcccaaaaaattccgtcccaatccaaatttttcgttgccaagaaatcttttattttgttttgttttttgcagtttgccatccatatcggtgtgtacccaggaagtgggttcgtgtttttggaacggcgcgcatttcgggacggatacgtcagcaaggatgtgaaag

SEQ ID NO: 75654 - DNA, 2446 bp, Heterodera glycines
  Genomic contig location: Contig_ID=SeqID_1745; Location=528..2973; Strand=-
  SCN-specific regions: Sequence locations=1-225,247-292,317-372,394 -570,595-606,628-713,736-1420,1445-1448,1470-2258,2281-2446
  Gene Ontology: Cellular component=centromere; Biological process =mitotic chromosome segregation
atgggcagacgaagcacgcgcgagtttgccctcccgtctttcgttggccaatcgtcagagtggattccgggctgcaaaggccgtcgcttagtttcggtgccgaaaatgcagacaatcccggaccagcgcaaccttcgtgaccgtgtaagttttttaaaatcattcacggatttttgatactttagtttttaggaagttcaggcagccattatcagaaaaatcgtacactttttggaagaccgagtgaatccggcaccgccgttctccttcggaaagcccgactttctgcgctttcccagcaaaatcgccttccaggatgtgttccaatatttgtttcaatgcattgagccaacgtaccaagtgcgaaaactcgagacggacgtttgttttcttttcggttcatcttcacatttgaaactgtttaggcccttaattttctcaaccaattgggctatccttatgtgctgaagcagagcacaatgcaaacgattactttgccaacttcgtggggtctgttgctcggctcattggattggtttatcgatatcattgaggtttcgaagaaatgccaataatataaatatttattttttagattgaaaacgaaatgtaccaaaacttggacaaaattcgtgatgatcctcaatggaacctgctgatctcgtgctttaagaagttcatgtccaaaggccatggccaaccttacgaccgggaagaaacattcaaagaggcattcgaggagtatcgagcccagaaaatggcggagaagggcatcgactgcaacgcgtatgacgaattggtggcacggcgtgtggcccaggagcagaaaattcacaaactcgaggccgccattgctgaggtaggcgaatgaccagtaattttgacgctgtccattgagaccccttttacaggcgcagtgcgtttctgaacagcttgaaaaggaagccgtggactgcgagaatgacattgccagcatggaccgatacattgaggagatccaaatggttgcgtcggccaaggaacgcacattggtcagtttcgaggggaatacttgataaaatttgaccaaatccctctaattacagaatgaaatcacattggcgaacaaggaactggtgatggcacgggagaatttggccaacgaaaaccgggagagggagcgtctgatcagcacgcagcgaattagccggagaacaagcgcgtgcattggtcgcgaagcgtaaatcggtcaaattttttttaaatgtatataaaattcagttttcgagttttaggttcgcgaagagttggtgttgctgcgcgaaaacctcaacaaaacagaggcacgcatttacgaacgtcagcccatcattttcaagcagtccgccaaggtacttttggtggatgcacttatttcccccgcgtcgtttctccttcgccgaaaaattaaaaaaaaattataaaacgtttaggaagttttttcataagaaattttttttgaaaaaattacaattagcaatcgctgaaaaatttttcccttgaaatttctttatgaaaaaattcaataaaaatttgtgaaccacacatcattcagattcgttccgactacaacgcgttcatgagccgtcttcgcgtcatctgtgagccgttattcagtgaggaccaactgcagcagcacctggccgaattggaacagtgcagcgtcgatcaggcaattgtcgagtttcagcgatgccgtaacgacaacaaattgacacgtttgctcaaccagctcaaagggatgatggaatgccaaatccgtgctgtgcaacaagcagaggaatcaatgcgagtgaccaacagcaaattggtggacgaaatcaacgagttggagttcagcaaagagcaggccagttaaaatgaaaccgaaaatatttaaatccagtttgaacggatttagcttctgtcaaagcacaagcttgaactggaacgggccaagcgcaagtttggggacaatcagcgttcattggtcgacgcgaagcacagtttggatgtgatcaggcagaaacaccaggccaccgtcgacgaactgggcaaaattgacctgagattgggcaaactccatgacgaattggccgagaagcacaaaaatgtataataatcgcagttacagaccattacaatttcgaatttgtttagtatttggactacaaaaatcgtttggacgcacaatacaacgaattgttgacggcggtgctggagaaagtcacgaaactttgcgaccactttcagcagatcgaggtgaaaagggcagaacagttggtattttttgggtttctcattgaaaagtaccgtcttcacatttattaattgtttaattcaggaccagaagaaacgcttcgcagaattggccaatgaaatgctcacgaagaacaaggaggatttgaagcaattggagacgaagaaaaaggccgaaacggaagattaa

SEQ ID NO: 75655 - DNA, 692 bp, Heterodera glycines
  Genomic contig location: Contig_ID=SeqID_12096; Location=1107..1798; Strand=-
  SCN-specific regions: Sequence locations=1-390,412-489,512-692
atgaaaattaaatggggaatggaaaatgaaaaatggcggaggaggagcaaccacttaaggtaaaatgccgaaaagaaatgcacaaaacgtacaaagtgatttttgaagaaatttgtcaggtagaaaaattggatgaaagcgacgaaaagaatggataataatgaaaaatgacggagcagcaaccactttttatactaatttattttccaatttttacacgattttaataatcagtcgtatttcgacgcattgctataaaagccatcactccccttccattttttttcattcgctcactttttccttcctttttgcttccgcaaagaatttccttgcttttctcggattttcttgttttaaatgaaacattgattttacagtttttttctgtttttctaataagcaaattaaatccttcaaaaactgtgcttaataatttccccttaacaaaatgtcagacaaacgaaaagaagcggaggaaaaaatggcaaaagcaatgtaaaattaaaatgccaattttcaatttcatttttttttctccttttttcagtttcatttccgccgattgttggctttgtgtgtacgatctgcttccggcttcacaacttggccttggaattgcgatgatcagccaccgttttaacttctacgtggacgaacacttcaagacgcgcaaattcatcatccagtaa

SEQ ID NO: 75656 - DNA, 510 bp, Heterodera glycines
  Genomic contig location: Contig_ID=SeqID_12096; Location=1952..2461; Strand=+
  SCN-specific regions: Sequence locations=1-510
atgtctgacaaccgaaacgaagcggagcaaaagatggcgaaagcaatgtaaaattaaaatgccatttttaaaatttcaattttaaattttgttttcctttttttcagcttcatttccgccgattgttggctttgtgtgtacgatctgcttccggcttcacaacttggccttggaattgcgatgatcagccaccgttttgacttctacgtggatgaacacttcaagactcgtcgctggaatctgggatcgatgaaaatcaaaatgaagttcgaagcggatggcaccaaggaaatggatgttgtcaatgccaatttggaatcgtttggaattacgcaaaagccgttgccaaagagagtcgtcggattcaaagccatttcattgaagcgagattttgatacttttctgttttgtaaaacgattccatcatttttcacaggtacttcaacaacaatgtcatcacttttctcggccgttttcgtccaattttggccacccgtcccattcatttga

SEQ ID NO: 75657 - DNA, 685 bp, Heterodera glycines
  Genomic contig location: Contig_ID=SeqID_12096; Location=2524..3208; Strand=+
  SCN-specific regions: Sequence locations=1-354,376-612,634-685
atgatcgcgacaaacattcgtggcatccaattgtccaaacaaagtttccgcagtttgcgcaaattcgtgccgtcaattctcgacgactgtccatcgcttcgcgttgctgccaattccaatggtttcttcaccgattttccatgcgatgacagtgccgcggcttcgaatggacaagctgtggccaaatggcttttcactccacgtccggacaatgtgccaaaggtgttcaaatgctggttgaactacggtagctggcatttggagccagagattgaagacttcaaagcggtgatttcgatttgttttatttggcatttttacggtctttggcgcgcactgacaaaataattatgtatatccaaattggggcaccaaaccgtaaaattcatttatcatttcgtatttcttaaccaatttttccctattttaggaattttacacggcttcatctcccgtcaatttcatcgctgtcattcgcattgatttttcttatcatcgtcctctgccatttgtgctgaccaacgaattgacccgggagcaattgatgttgaagaagatgaacgatatcaaccgtgttcttctgatccgttgtccgattgtgcgcgacgaaagcaaatgggccaaatgggagaaggaagcgattggatggaactttatggaccagtggaatcggatcgacatttga

SEQ ID NO: 75658 - DNA, 1293 bp, Heterodera glycines
  Genomic contig location: Contig_ID=SeqID_12098; Location=219..1511; Strand=-
  SCN-specific regions: Sequence locations=1-354,376-420,443-670,693 -944,967-1110,1133-1199,1222-1293
atgaagctctattacataggctgtatttacatgtatgacgtaacacgtaacaaaattagacgaatggagaaaataaattccagtatttattggggctggaccaaaggaatatttagatgtaagctctacaaatttgaactttaataaacaaaaatgaaattaaagtctattcatatgaaattcatgtttttatgtaacatgtaaaaacgatagatggaatttgtgtttaatgtaacatgtatcatagacttgaaagaacaaaaaaggaaaaaatattatttggattttaatttacatgtgacaacatgtaacatgtaacaattgtaggattgaatgaacaaaaaatgaaagtttccagtatatttatagggaggaccaaaggaagttatatttacatgtaacatgtaacaaataattaattttgactttaatgaacaaaaatgaaattataatctattcatatggaatttctgttgatatgtattatgtagcaaattagacttgaatgaacaaaattggaaaaaatattatatggattttaatttacatgtgacatgtaacatgtaacaattgtaggattgaatgaacaaaaaatgaaagtttccagtatatttatagtggtggacccaaggaagttatgtttacatgtaacatgtaacaaataattaattttgactttaatgaacaaaaatgaaattaaaatctattcatagggaatttctgttgacatgtattatgtaaacaaattagacttgaatgaacaaaggaaaaaatattatatggattataatttacatgtgacatgtaacatgtaacaagtgtaggattgaatgaacaaataatgacagtttccggaagtaccaccagagctgaattagctaatattttctaaatccataattaagtgattgatggaccaaaagcgcacaatgaaaaagtgccattggaaatgggggagctgctgaattcgctgaacgatgcacagattgagcaggaattggagtgtgtgtgcagctttttcacaagcgattgatgtcatttgggggtgaccgattgttttttactcaacaaattggggacggattttgttgcgataaattctctgttataaaatttaatcatagcatttcttttcatagaaatctgaggaaacaatggtcgttacatggataaatggcacttcttgggccaaaaaaacgaattttattttattttttattagtcgacagtaaagcttgtttttaaaaaacttgttctaaatggtataagcctggtaatattttgtaaattaaa

SEQ ID NO: 75659 - DNA, 876 bp, Heterodera glycines
  Genomic contig location: Contig_ID=SeqID_12099; Location=46..921; Strand=-
  SCN-specific regions: Sequence locations=1-161,185-233,260-408,603-876
  Gene Ontology: Biological process=N-linked glycosylation
atgagtttcattaattttttatttggattttttgccgttatatttcttaattttacgactcaaaatgatggcaatggcacagttctcgctgttactccaaataaaaacccgcaacatttgaatagggctcctctatcttcaaattcgtcgcaaatgccaaataaaatgataaacagatttagcagtttgaaactcgtcgatgatttggattcaaaggaaattgaactgtttgctgaatatttcaagaaggaaaatattgtggcaaacgaggaggggagcggagaagcaaagacacaaaagatgagttcaaagaaacataaggggcagacggttaaagaaaagcgagacaccgaaacaattgaagaaagtattgaagagtgcgagacggagaaggaaaagacggttagaggaaggaaaggaaaggaagcggcaaaagaaaatgacagactgaaggagaaaatcaaggagaagactgttagagaaaagggaaagagtgttgaagaaagtgaaggacgaaaagagaaaaagaaagggaagaaattcaaagaaatgggagagaaaattgttgaaatgaatagagaaaaaaagaatggaaatgaagaagagaatgaaactgttagagaaacggacggaaaagcctgtccagtgcaggcatttgcggagcaggttgtcagagaaatggagaaagggagtgaagtgatgaaaagcgagactgttagagttaggaatgaaatcggagaaagtagcggcggaacagaggaggaaaagaacagaggtaggagatttatcaatagggatgccaaaaatatggatataaaatcaatcgcaaaatatggccataaaatatggaccaaaaatcgcggaatatggacataa

SEQ ID NO: 75660 - DNA, 612 bp, Heterodera glycines
  Genomic contig location: Contig_ID=SeqID_12100; Location=273..884; Strand=+
  SCN-specific regions: Sequence locations=1-612
atggcctgtacaactgagagcaacgggatcagctacagcatgttcaagactgcctactgcctctatgtcttccaaatgaccaatgcgcaggaggactcgccgggctttgagctgatcaaggagggctgtacagcggtgaacattcggtttgccgaagcggttccgaacgagggggtcactttaatagcctatgccgaggctgacgggctcattctgattgaccggaacagatcaatcactagtgaccttacagtatgaatggtgagaattattcctccgattttgttcaaatgccctcctccaatgctgcacacgaagggattgtactgtgttttccggatgtgatcgagaagtcgccaatcaacttttttctctgcctcatctacctgtttggtgcagcaggtactgcggctgcgggattttacctgtttttgagggagaggcggattcgtcgcaggaatggacaatcggttcatcgacagagctctctttgagaacccggcgacgagaaaatattttgttggcacatttccggccgaccgattgccaaagtgcacgaaatttccctgcagtctaattgtcaatttggtgagtgccaaaaaattacattaa

SEQ ID NO: 75661 - DNA, 938 bp, Heterodera glycines
  Genomic contig location: Contig_ID=SeqID_12100; Location=1423..2360; Strand=-
  SCN-specific regions: Sequence locations=1-150,175-472,494-622,670 -773,805-938
atgagccaaaaccgtgacgaaaactcgcagccacctgtactcgatggaccgtacccgctggcacaagagcgcaatgagtttgtggaagatgaagcaccggtgctgcttgagatgttggatcgtctgtcacaaggagtgggttttgttttgaattatttaaattttttaatttttccattttggtttatgctaattgttgattttgtttagggaatttgccaagccatgggcctgttttcgtttgcacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgctatacaggttgacggtgtggtgaagcaaggggaatttgtgatgagcatcgagacgatgtatctcgataagcgaaacggagttgatcacttttgcacattcctgcgcacttttggcatttgtttcttgatgtgccattgaatgtgtttatttgttgcctattcagagcagtaaattgtttgcataattctgtttaattatttttttgtttacaaccaaaatattgatccgcatttttatgttataattttaattcatttttgaaatttttatttaaatggcaaacgaagacttccgcttgtccgaatgcatccgttttattgagcgaacggcccaagagtatgattgtgttctgccggttccacggcttgggtttgtcacggaaaattttcttaataatttttatttaaaatagctcaaggcgcgatgagcacctggatgcctgtgttcttatggaatcagtgggctcaggccatcggctctacattttcgagtttgaggattgcctccaggtattttaaaaatatgaggtcaattaattaaataaa

SEQ ID NO: 75662 - DNA, 3004 bp, Heterodera glycines
  Genomic contig location: Contig_ID=SeqID_12102; Location=728..3731; Strand=+
  SCN-specific regions: Sequence locations=1-57,79-733,755-976,1014 -1620,1642-1850,1893-1968,1993-2085,2113-2218,2261-2385,2407 -2444,2466-2685,2708-3004
  Gene Ontology: Cellular component=actin filament; Biological process =nonselective vesicle transport
atgattgacacaaaaaccgacggagttggaaatgattcagtgaaagacttttcaaatatggacttggaagatgaagtgatgcgacagaagctgggaaatcagcaggacatccgtgattatttgacagagatagaaggggagctgaaaagggcggaggaactgaccatcgacgattgtattggccaagcggacagaatcgcggaattggcacgggaaattgacgagtgtgacggagcattggaagtgggcagggggtggcgcattggggaaggactgctgggaaaagcccgcccccgcagggcatcgaacgaatgttggcgacttttctcgacgaattgggcacaatcagtgccgacatgcagcacctgaagcagcagtctatcgagatcaaccatcagctgcacaatcggcagagagtgcgcgccgagctgagccaagtgaaaattgggggaagaaaggggaccgactgacggcaaaggaaaaaagagaggggggggggaacgctttacggtttttacagcttacaattaggttggctttgtgcttaaaatattctcattatgccactctcttcagttcgtcgatgatatggtcgtccctcacacgatgataaagtgaatatgttgtcccttttatggctgttaatttggtgctgctgaagttgctgcccccaccatttttcggaaactaaatttttaacgggtgaaaaacacctttcctataaggaacggcgtttttaagatttaaaatcctagttttttttcactaaatcggggggggggtggggtcagctccaattttacaccataaattcctttcttcccaggacaatcattgagagggaagtgaacagttgtgagtttctggagcagttgcacgaactgcagcacaaattgcaattcatcaagacgcagcagttcaaagacgccaaatcggtgggcgatgtgcacgacgtggtggagaatttgaagtataaagcgatggagaagatcagagaatggcttttgctgaagatttcgctcttccgaaagcctttgaccaattaccaaatcactcaaaatgccctcctcaaaaatcggtgttctgacgtcagatcccgtcattacattccccgcaccctttcagcttcttttacgaatttctgctcgcaaatgaccggcaagtggcgcgagaagtcaaagacgaatatgtggacaccaccagcaaaatgttcttttcttatttcaaggcgtacgtttcccggctgtttaaatttcaagtaaattagcggcctttatcacttcgcatcgcattctgttgagatggtcgactctgcgacaaagtccgatttgctcggggccgaggacgtggtcaaacatcccacgacaatctccgcattgccgagtcttttcacttccggcaaaacccaccaagtcggcattgacaatggcctgccgttcacttttcggatcggttccgttcctttcccatttagaaatgaaatttcactttaaaaggagcacaaaattagttggtttttttatagtgtcagggtctgatgcactttacacagcggcccaattttgggctccaagtacaattatgctggatttttcgtcttagtggtctgtgagttagtcaccaaaaggggggtcccaggttcaagtcctccctatgttgtgtgttaatttcaatttcttcttttaaagaagaaggcggaattattttttcattaataaaagttttcgtggcaataaaaaatcatattcaaaaagcgttggttacgtacaacatcgacaattttatgaattttttttagcttataacttggtgaatactagagcaaataaaaccattttatgctcattttgaagggaaaattctggagaatattgtaaattttatttggtttggccttaaattgtggacttggctaaaaaagaattaaaattattgaaatgtttgcccttgtaaaaaattttttcctattgtttaattttcttaaaattttgcataggccaatattttgacctcctctagcgattccaagtttattttatggaacttaagtttttaactcgagatcggctcttctaattttacaagggaaaatcccaaaaaatttttaagtttttgcaaatggcgttctgattactaaataaataataaacctatttgcactgagagcccaaaattgggccgctgtgtttacgagtccaaacgactttttatgagacccttccctaattatttttatttaacattttatgcatatttaaattctagacgcgaagtcgagcgacggttttttcattgggtcatcgccaaaatttgctgctcgatgatttgttggctccgctcattgtgccccacgtggcgcaggaaaataacgaaacggttttttatttatttagaattggtaattaattgttttactatgtctttttctaatttcagttccaattcgaaagtctttttcggagtgttcagtacgctttggtcgaccattgcagtcatgagtttctgttcatttgtgattttttcatggtcaatggtcagtcggccatcgatttatttacttcagtgatgggtcggtccatcagccttttattggtaattttctaattgttttaatggaaattaatgatcgtttttttctagaaaacgttggaagaaaaaattgctgccaatttcgatgcgatttcgctttttctgtgcatttgtttctgcgcgaaatttcgcgaaatgatgaccgaccgtgccgttgtggtcatcaatgggtgcgcatttcgtttgacagattcactgacttttgttcagttattgggatgctttggtcggtttcttatgggctcggttggatgccgtgatgactgcccacagtgacagcgtaagggcgatcgatgtgcgcaaagtgccggtggactcgcgtccccactacgtatgccgaagatatgccgagctgatctgttcgctgttggtgtgcagcgagttggcgtacaaagtgacggacccgcgacttcaa

SEQ ID NO: 75663 - DNA, 498 bp, Heterodera glycines
  Genomic contig location: Contig_ID=SeqID_12103; Location=112..609; Strand=+
  SCN-specific regions: Sequence locations=1-498
  Gene Ontology: Biological process=nonselective vesicle transport
atgcaaacccttcagaaaatcctttcgcgacagcaagcggagattgagggactgttgacccgacttgccacccaactgaaatcgaagaaggaacggctggtcttccagataaacaattacgacgtcgttctcaccgttttaaatgtgcgcaaaccaaaaaaagaacattttatttgctttcagaaaaagggttttggatttattttccttcaggaaagggttttggccgattccaaggagaggggcagtttttgggaattgcagcagaccaaaatgggcacttacgtcgaggaaattctcagcccgcactttgccccgctcattcaattcgtcaacgaatgtgagccgcttgtcgaacaaaaccacacccaactgctcgcccgttacacgggtaaatggaagaaaggcgagggaaaggcactgacattttgccagggaaagtcgtccaaattgtgcggacattcagcgccgagtggcgaagatcgatcgacgcaataa

SEQ ID NO: 75664 - DNA, 326 bp, Heterodera glycines
  Genomic contig location: Contig_ID=SeqID_12104; Location=2475..2800; Strand=-
  SCN-specific regions: Sequence locations=1-116,138-186,218-298
attgatttgaagaaaggagctcaaaaaacgcatttctgcattaaaaattttcgattctgatgtcattatcggtcactagaaatcactattttggcgacttcgtcactaaaatagttaaaaatcactattttggagttttgtcactattttttcactattttgacatttttgggcaaaattccttaacaaaaatgcaataaaaccaaaaaatacacccctaagaatcgacaaaaaaaatttcaaaaagcgctcctaagaaatgaaaaaaattttctcaaaaaggtatttttgtggcaagaattttaattttaaaaattattttttta

SEQ ID NO: 75665 - DNA, 2989 bp, Heterodera glycines; identical to SEQ ID NO: 12104
  Genomic contig location: Contig_ID=SeqID_12104; Location=1..2989; Strand=+
  SCN-specific regions: Sequence locations=1-194,469-591,621-637,659 -804,827-842,865-1617,1639-1717,1741-1776,1814-1837,1860-2319,2341 -2383,2406-2473,2503-2989
  Gene Ontology: Mol. function=helicase activity; Cellular component =cell wall (sensu Fungi)

SEQ ID NO: 75666 - DNA, 112 bp, Heterodera glycines
  Genomic contig location: Contig_ID=SeqID_12105; Location=300..411; Strand=-
  SCN-specific regions: Sequence locations=1-68,90-112
aggggttacacatttccctttctcctctttgctctctgttgcgctatcacaacacaattccaattcgtcaacagctttttcttccctcatcgacgagatgacttattcaaat

SEQ ID NO: 75667 - DNA, 2021 bp, Heterodera glycines
  Genomic contig location: Contig_ID=SeqID_12106; Location=1072..3092; Strand=-
  SCN-specific regions: Sequence locations=1-76,98-141,163-341,363 -504,526-834,857-909,931-1441,1463-1477,1499-1721,1751-1865,1888 -1994,2018-2021
atgatgcaaaataatgcggagcttggtaaaatattttatctgaatacgcttactgctataggttcttcaaatcctttacctcaaatatttgatggtgaaactgcttcggcattttatgagtggcaaattaaatttctggattatgtggatgtctttggatcaaattggtcggaagcagacaaaataaatcgacttaaattacacttaggtgctcatacgcgaacaatttttgaaaaacttttgccaaccgagaaggatacattaagcaatgctctgaaaagcatcaaatcaaagttggatagtccacatttcagggaattagcttataggaaattggctacttgctatcagaaagatggtgagtcagtggacgagttcataaaacggttagttcccctagtgaatacaacgactgaccaatttccatcaggagcgagggaggagatgctctgtaggtgtctaatagagaaagtgaggcctgagtatcagcgttcgcttcaaataatggctccattaatagggaaaaatgatttcaaaaagctgacgtcttacattcaggagttagagatttcggtagaaagtgaaaagcgcttcggcattcattcattaaaaataggtagatcagagtgcaacagaaaagaggatgaaaggaacgagcaggcaaaacactcgacttcggtcagacaaaattatacgagtagggagactcggctcttctgcgaattttgcaatcgaccagggcacattcaaaatgaatgttggtattgtcctcgagattttcctggtccctctaattcagaaaatagacaaaattgggaacattcagctgagaatcatgccaaaaatgattgtgctagtgaaacacaacaattgagagagatgattgaagacttagcacttgaagtacgcgaaatgaaaggtaataggaatttttcttaggaaatcatcagtaaaataaattcttttaaaattttgagggttcatttaaaggttgaggtaattgtgttgtttttttaaaccctaatctccctattccatttcagattgcgggcaacactgaagcgaatgaacgaaattggtgggatgaaccgagtggttctattacagaaaacaggtctaacacccctcttcccattttcaggactgtcggccgaccattggaacgcaagcgattggcaacggaggacattggaccggcaccaagacgcgatgaaaattggcgaagcacaagctggagacaattcacggggacgacattcacacgcggcgaacgaggaggaagcgctacaaagtgctacaattgtggacgaacgggacacgtggcatgtcaatgccaagaaagacggcgagatgaccggagttgattgagaggaataagagagatagtggaaaagggggctttggcaaggaaaatgagtgtgttttgattttgggggtctaggttttaaattaaaataatttcgctaatttacttaggtaattaaaaattttaaaatttcatgcttcataggcaaactttgggaattgttttttcatgtgcttcggcagtaaaaatgaaaaaagtcctgatcagttctcgcagacaaaggttgatggctgggcactttgccagtgatgcctgagtcttgaactggatcagggacgatccaatgtaaggttgggagtgagtgacacgaagcataaaattttgatttaaaattggaaaaagtgcatgaaaattagcaaaattatttttgaaataattttctttgcttatgcgaattttgaagcgaaaatcttggtaagagaccagggacggtctttggtaaggttggaggtgtaaggtagatccgggttttcttgtttgccggccgaagccctatgaatttcacattctcacatttatttcatttcgcatttaatttcccttttgcttattgtcgcccctttcccgacgataattgatcgatcacattttatttttcacgtgtatttaatgttcgccatttcaagcgaagtatcttcagtctctccggaataaa

SEQ ID NO: 75668 - DNA, 433 bp, Heterodera glycines
  misc_feature (340)..(340): n is a, c, g, or t
  misc_feature (400)..(400): n is a, c, g, or t
  Genomic contig location: Contig_ID=SeqID_12107; Location=1..433; Strand=-
  SCN-specific regions: Sequence locations=1-62,86-150,173-433
gacgataattgaacgatcacatttcatttttcacgtgtatttaatgttcgccatttcaagcgaagtatcttcagtctctccggaataaagccacttatcccagtgtgtccatcaaaggcgggatagaatccctgggcttgatcatcccatggggcccttccttcgggagtttatgagttccctcccaatgttccccatctgccctcccaaattgcccactcccaacgccagcacgtccaccgcgcacggccgcgctactggtagcaccggatggttctgcaatttgtagacttttcatcggcctgggcggacaaaggagcaatggaacggaggtgagtcnaagagggagactaaggaggcgcctgctgagagaggaaaagcgcttcggcggtataaaggncccccggggggagactcaaaaaaatacccaaaa

SEQ ID NO: 75669 - DNA, 1806 bp, Heterodera glycines
  Genomic contig location: Contig_ID=SeqID_12108; Location=197..2002; Strand=+
  SCN-specific regions: Sequence locations=1-1806
atggacaacgacccaatccacaacaaccacaagtcgtccacgcacaacgacaacaaccgcgactacaacgactacacacacaacaaattggccaaccagatcaaccacacggccaaccgcacgcacaaccacgacaacgccaatgccatggtcaatggaccaccgaacgacaacagtatcgcgggtatggcaacaacaacggccccgtccaggaatcaaattgattcgctggcccaagagcacaatcacaaccgaaaaaggacgcgacgtcttctggtgctcgaatcacggcagcactctctgggaactgaaaggtccggaaaactcgccattctgccgtccaccaccggcacttactgcgcaatggacaccactaaccatcacgctgtacaccaagatccaccggccggaaccaatcgcaacggcatggcactgctccatcaaaacgacgacggaaaattattacacaaacatcgtcggcgataagttcgtcgaaatcaacaaagaatttccgttggtctccaaacgactctgccaacgaatggcacatcagcaagaatgcccactcgccaaaacggaaatgcaccacgatgataacaatcgtatttgggcaacaaacgaccaactccaagtggatttccctggaccaatcaccggactcttcaaagggaaacaaaccagctcggcaacaaattgctttgcgcaaccagcaacactgttcgtcaaatggcacagtctccaactcctgtcgccaatccatcgcgcagaccactgcaattacgcctccgagtattgccaactgcaagacaacagctcactcatctggacttcagcatgtccaaacgacaactgcttcatgtgcgacttccaagaagccgaagaaatccacggagaattcaccaagctcaacggtcaaacaacagcattttggatctcggaagaccgacaaaaggcactgaccttcaccgagacacatgcagtccaagcatgcgacgggagacaaatcgtcctatcggagcagaacttcggcattccaaaagagcaatatgacatcatcatgagcaaccacacaagagagagacgcaacgtgcaacccgagcaactcgcttcgcagctttcagctgctcaacttgccacaacaatggcactctcgcagctctatttgaaggaatgccagcgcaatgtgcgtgtcagcaacccaacgcttcaggcacggaaactcctcaagcgcgataatctgcaagcccgatggatcagcgaaacaacaatcgaagtgtttccctgtgttccaatctccctctccaacatcagctaccgaacaacaaaggactgctacaagttcattccggtcacaatacatttgccaaacgcaacaagagacgcattcctcgacccggagatgcgcatcctctcactcatctcaaaaatcgcaagttgctcaccatttcgctaccatcaccttcaagtgcaacaaaaccccaacttgtgggtgcgaatcgactcaagaaatggaaacgtccaacgactggcacaaacagtcatccatgagctttacgagacgatcctcaacaaaacggacaacgatttggatctccacccactgatcttccatcagtggcagctcgacaacgacaccgacttcgccagccttccgcacatcgacgaattcgaagattcggaagaattcaaaaacaagctggaagagcaaacgacgcaacgagcggaagcactcggcgccttacccggcggaatcgaaggatggaccgtcagatggctccaagaacggctacaggaagccatccaatg

SEQ ID NO: 75670 - DNA, 1704 bp, Heterodera glycines
  Genomic contig location: Contig_ID=SeqID_12110; Location=659..2362; Strand=+
  SCN-specific regions: Sequence locations=1-131,158-346,368-611,634 -654,677-981,1003-1152,1174-1247,1278-1406,1428-1681,1703-1704
atggccagtgaacagatcagagaggaaatgtccgggagtaagttttctaatccaatttaatgctataaataactcatagtttttcgagttttttttcctttatgtacattttttaaggtacggctgttgcggtgctaatcaaagacaattttatttattgcggttcttttcttttttgtacattaatttttctctattttttaagcaaatgctggtgattcgagggctgtcgcttctgttgatggcaagaaaattataaattttaacgttttaaaatgaatttttttaaggcagggcaattcctttaagcattgaccacaaaccaagtgagtagaatcttttatggattaggaaaaaacaaacaaaattctctcatttttaagacaatgaggaggaaagtcgaaggatattcgcagccggcggatatgtaataattatacaatttttatgcttttttatttcactgttaaggtggaatttggccgagtcaatggcaatttggcactgtccagggcatttggcgactttggtttcaagcagaacaattccaaatcggcacaggaacaaattgtcactggtatgaatattttgtgactaataatagaacgcgtatagcaaatagaataaacagtaaaacttgaaataatttggtattttgtaattattaattaccatttttagcatgccctgaagtggaaataaatgccatcactgccgagcatgagtttattttgctcgcttgcgatggaatttgggacgttattggcaatcaggaagcagtcaatttttgtcgggaacggctgtaccgtggggttttgccagaaaaggtgaatttcaactgttaccacttagaaaatggcaaaggcatagattattttatcattaaaacgatggtgctttcatgggactttaacatgcattgaccctctctctttttatacatcatttaactgaaccccccccccccccccaattgtcagatttgtgagcagctcctgcaaaagtgtcttgcaccggattgtgaactgagcggacttggctgtccgttttcttaattttttagttacatattcttgtttactttaggtgacaatatgaccgtcattctcgtctgtcttttgcaggtccccctcccattttttgcattgatttcccctttattttgctatgctttcccttttattaggattactctttcgacgattacctcgccaaactccgtgccaatgggacgggcttcgaattcgaacatgaagaggaagaggagggtgaaggggtggacagatattccgacgcccacccacagtccgactcagacgagcccattgaagaggaagttttctcaacaccgccaagccattcgccaccagtgctttcgtcggattcagtgagcagggagggaatgacggagcagcaggaggatggaccagtgccgaagttggagaagcaacggaacggcaccgggcaaaaaggtgagcggcacagcattttggttttctactggcaaattgaattacttccgttagttggtgtggaagatatcaccgaggatgtccatgtccctccttcacccgctggcgccgtggaatatacgcaacctgttgattcctctcctggagcacaaacgacttccaatgattcgacacaacagaggaatatgtgaaatggattatttatatgaagattttgtttttatttaattaa

SEQ ID NO: 75671 - DNA, 1362 bp, Heterodera glycines
  Genomic contig location: Contig_ID=SeqID_12110; Location=3430..4791; Strand=-
  SCN-specific regions: Sequence locations=1-379,419-466,488-549,571 -1362
aaattctttgccgaatttgacgtgctcgaatcatttttcgacaaagttgaactgtcagcaaccgaaagttcgcaaaaggcattcgacgcgaattcgttgttgaaagtgcgcaatcggagtaagttcaattgaagcaattaaaggtggtaaacaatccaaatattatcaaattttgctttcaggattgacttgtgccgattggtcccgagttactttcaatgttccggctgaactcgttcgggagggcataacgcacgaggagttcgccgccacgaagcaacacctccaaatttttggggatttcgactgcccacagatttcgacacgcgttgaattgtgaatttttgaaaattaagcgaatattcaaacaagttgaaattgtttttctgtcatgttttttctttcccatttggatgaagtgggcatggcgacttcatcaatgccagctatgtccggggaggtccgcttctgaacacgttcattcttgctcaggcaccgctccagcagaccatccctgacttttggcgcatggtaaattagattcctttcctacaattaaattacaatggaagatttttatccatgatcattgccaaacaatgacataaaattgtgattttgattgttgttattattagtattgaggctttgtttccctctgtttttgattgtaatgttcttatccccaaaatttaaagatatggcaggagcgtagcgaatggattttcatgctttgtgaagcgaccaccgactcactgacggagagcagtgtcgtcgttggcagtgcggccaaaagtcactgcccattcttctggccaaggcatgaccatatgttcaattttagttagccgttttttaagatttgagggagaaatccgacgctttggccaacttcgtgtgaaaaatgtatccaatgacgcggccagcgatccgctgttcaccattgttcacttggaactttggctgaacacggatgaaccaaaaacggcggactatggtcatgcaaatgaaacagggacagagggcatcaaaactaagcggggaaagtgatttcagacgatggagcggcaattccctcatcgactagatcggcagcgggggcgacgcattgtccgcacaattctaagtcctttcgtcttcaactttggcactgcgattggcgcagttacaccgacttccattggcccttccgtgtgctgatacggtaattgtcatattatgccgcatatttaaaaataatgccatttttgcagggcgcgtcattccaagaacccaagtgtgattatgtgcgccgatgggtgcggacgttcgggcactttggcactgattgaggttaaaaaaaccagcaacacacatatgtaa

SEQ ID NO: 75672 - DNA, 578 bp, Heterodera glycines
  Genomic contig location: Contig_ID=SeqID_12111; Location=77..654; Strand=+
  SCN-specific regions: Sequence locations=1-134,170-218,252-392,415 -440,463-578
atggagggctctcttggccttggagtgatgagcggcctttttctttccggccaacttcgacagtacgaataagtagtaatcattcacgttaattaaatcaaagatacatttattatgcctcttcaaaaattacatttaaagataaacccaaattgaaattgccaattaattatttgccatttttcttgccccccccttctgttacaaattctttgctcatcttttgccatttttcccaaaatttcagttttttcggttaccctttggtgttccttctgctcgtcctcctccatttgcttattcttgccattgtttttctgtttttccgtgagctcgcctccgatgagatggaaaggcgacggacgacggacagccgacgaaggcgccaatcgcttcttccgcctgcggacgaagcgcaagcggaagacagagacgccgccgccgcagcagtggcggcggagggcgaaaacggcgaaggacggcaaagtgccaacaattaaaatacaattaccatatttcctaaaatacagcccctctctcaactaaattacaaccccccttttgaggagggttgaaaa

SEQ ID NO: 75673 - DNA, 831 bp, Heterodera glycines
  Genomic contig location: Contig_ID=SeqID_12112; Location=1617..2447; Strand=+
  SCN-specific regions: Sequence locations=1-105,127-295,318-480,502 -551,575-831
gttcagaatatatttaaaaaatgacacttcatttgttgcttgtccttcccgttttggcgatggctttcgcttttggcaattgccaaagtcaaactataattagcggttccggctgtgtgtaccatgtgagtgtttactagagatgcgccgtgagtgaaaaaacccgtgaaattcacggtagccgtgattcacggcgcatctctagtgtttacctaatttgaatattttgaattatgccgtcgactcagtagcagcaaatggcatttctctccactgattagttgctatttgaaaatgatttttataaattaaaattaccgttaattgtcatcgttaattatgtgaacagaacggatgggtgactgaaagtggacgctcgcggccgttgaccaccaacgaacgcagtcaacttgacaattaccagcgccaatcgcaaagtgccgccgctgctttttccgccgcatttcgtccgccctttccttttggagggccaattaacccgcagttgaatttgccgcaggttataaaccgtttcaaattaaataaattgttaaaatagtaaaatagttttaaatctgctcttttgaaagtggttgatcgatcctcgcgctttcccatcacttaattaatttgccatgcttttcctgtgctttcagatgccatgtttctgttccgctgcctcatgcgcgggcggtgtgtcatgggttgacaattaatcagtgggccgatggacagagggaattaattattcactaatgaaacgaatttgtctgattcacagtcgggggattacaataaagcacataaatattgcggataaaatgctttcta

SEQ ID NO: 75674 - DNA, 1147 bp, Heterodera glycines; identical to SEQ ID NO: 1746
  Genomic contig location: Contig_ID=SeqID_1746; Location=1..1147; Strand=+
  SCN-specific regions: Sequence locations=1-532,554-1147

SEQ ID NO: 75675 - DNA, 494 bp, Heterodera glycines
  Genomic contig location: Contig_ID=SeqID_1747; Location=384..877; Strand=-
  SCN-specific regions: Sequence locations=1-62,109-270,292-494
atgaaatttgttctcccatttactttcttctgctgcctcgcctttccatgcatttgctacggtaattttaaaatttcaaaattcaaaaaataattaatttttaaattacatttcacagggatccattgcaaagtcggaatgtacgacacgtcgggcaatgctgctattgtggcatcagaatgtgctgctgatcaacaattctgttctgcgattggttgcgcaatcggtgggccactcactaattacctaattaagacaatttgatgaatttaatttccgtcttaggcactgaacagatcaccgttttttgggcttgtgaagaacaaaatgacactcaagtgctcgtcaacagagcatcatcattcaacaataacacgtgccttgctcatattggtcataagggtgccaacatgtccaatgaacagttcgattttcgcgagttggaaaaattgatcaattgaagggtaataagccaaaaaaaaattgaaattaaa

SEQ ID NO: 75676 - DNA, 499 bp, Heterodera glycines
  Genomic contig location: Contig_ID=SeqID_1748; Location=388..886; Strand=+
  SCN-specific regions: Sequence locations=1-67,136-215,237-267,297 -471,493-499
atgttggcattttcacggatggttcggccggtcggaattggaagttcattgaattcaatttgaactgttttataaaaaaaggaaaatataaatttaattttttaataattttcatccatttaataatatattattgttgccaccaaaagacagaaacgcaaaaaaaaaaatttgaaatttatgaaatttttgaggaattttaccaaaacggcacattttttagtcaaaaagcaggcttaacataattaaacaattaagtatcttttctaatattattattattatttaatttttttgcgctcactttttcccttcatcggcaaataattcgggttgtcaaaattaaaattggccatattctctcccttggcaccaaattggcaatggcacttttggccaaatgccaggaatttgctcatctcctcacaatcgttgtccaaggaacaaccccaaaaggtaaaaatttcagagagtgtaaaaaagggtgattgacaatcaa

SEQ ID NO: 75677 - DNA, 622 bp, Heterodera glycines
  Genomic contig location: Contig_ID=SeqID_1748; Location=895..1516; Strand=-
  SCN-specific regions: Sequence locations=1-99,121-346,378-527,607-622
atggccaatgagcaagttaaactgcccgaaaaggagaagcccggcccgattccgaccatttcgccggaggcacttgagaaaagtgagggcaaaatgccaaaaaatagttttgcataaaaaatgacagcgaactgtggcacaaaaattatgagggaaaacaatgccaaagggaaaaatggatggtaatgagtcgagaattgtgccataaaaatgagggaaatagcgccaagattgcaaaaatgccacgaatattatgccataattggaattgcatgaaaattaatttatatccccgattagatcgaaattgttagaaaaggagaattgaattttaaatagatcgtcgaaaattaaaaaaataaacatttaaattataaggcatccagtgcaaggcgggctattttcgtggaaacggatacggtactacagcggccagagaatgccgaggcggagagtactgttacacggtcagctgcgaaataggtccaatttatgtatgattttatttttagcctttgataattttgatcaatctcgatcaatcaatcgatcaataatcgattttatatcaattgttcgattagttagaccgatcgataaatcaatgcggcgatctgattga

SEQ ID NO: 75678 - DNA, 620 bp, Heterodera glycines
  Genomic contig location: Contig_ID=SeqID_1749; Location=520..1139; Strand=-
  SCN-specific regions: Sequence locations=1-59,144-209,241-266,288-620
atggatgtgccgtgggcagctgcattggcgggtgagtgggacgcgccgacggaagattgggcggcggcggcggacgcggcgccggccgttgagccggcgatgccggttgcggacgcggcgttggcggcggttggggcggaggcttcgtaagtggacgcggtgtcggtttcttcggcattagcaggaaaaaataaatgccggaaaaatggattttaattattattaaaaatcaaaaaatttgttaatgcacatagtggcaattagagaaatttaattaaaaaaaatttgtgtgtaggtatcgtaaccggaaaatgtgctagtgatacagtgtccttttgaaaatggcatgcggtacaatgaggaaagaattcatcaagacacttaaattcatcgcgctccccttctcttaggatgggtgcctcaaatcttttcaggatttagggttttccggtagagagaccggatttgtgggccggaccctgccagaatttttcaaatgatttttcgaccctgatcaggcaatttttcgaaaaatgcatcaaaatcacaggaggccgcgaaaatataattttttcttttgaatccaatccaggatttaattatcgaatcctagcaataaa

SEQ ID NO: 75679 - DNA, 315 bp, Heterodera glycines
  Genomic contig location: Contig_ID=SeqID_1749; Location=1348..1662; Strand=+
  SCN-specific regions: Sequence locations=1-9,32-33,56-138,179-184,208- 279,301-315
atgcgtgtgttcaattcaaaagcattgttttatggatttgttccaacaatttcagtttacaatgacaattcttgcttaaagctcaaactcattgtgtggcaattttgtcgaaataataaacaaatattacccagttacaaataaataataatttaattatttattttttaattattatgcatcactatcaattaaaaaatttattgtcagctgaagagccaattctgttgtgaataatatgcataaatcaccgatgctgagaaccactaattttttgctttcattttcaaccaaacaaattacttaaatttttga

SEQ ID NO: 75680 - DNA, 2419 bp, Heterodera glycines
  misc_feature (1567)..(1568): n is a, c, g, or t
  Genomic contig location: Contig_ID=SeqID_1749; Location=2981..5399; Strand=-
  SCN-specific regions: Sequence locations=1-474,496-666,690-825,847 -910,933-1098,1126-1204,1227-1287,1317-1464,1489-1520,1542-1667,1689 -1766,1788-2155,2184-2228,2335-2374,2396-2419
atgtcaatttgcgttgatttgcgtctgtcttctgcggatttgccggtttgtggtcggcatcggcgtgtgccgtcccgcactctgctgttcttctgctcaatttttgaggcactgaacttttggacccgactccgttgggtgacacttttgcgccgacggttggccatcgtcgacggatctgtgagcagtttttttcgatggcatttgtgtggatatcatttcggattttcacacattttggaactctgctagaatttcggacacccttgaaagaatttccgaaattttgaggcttaaaatttgaaatgcaacgggacggatgtgatatgattaattacaattaatgtctttcccctcccctcacttttgggcttcaattgtgcgactttcccttcgccgtcggcggccgacatcaaagaaagcgacggactttcacattgacaagcgctggtgataattgcgtttattcgccgtttaaaaatatttaaaaatgtgcctctaactgttttttatgtgcgcgtttaatgacttttggcttttttaattgcctaaaaacagggaagaggatggaagcgcatttccacttctctaaatctcgggatcagatttcgaggctcagaaaaggaatttggagttgatatatctgggtcatccccccccccaaactaatttttttttaaatttattatgacgaatttgtaatcatttttccaaaatttttcaaaaaatcgccgaaaataaaaaccgggcttggcacccttctccgaatacgtaaaatatccctggccatgggtggcaccactggcaaacacacaggcaattattaaaaagtatttcctttaattacatttttcagggactcccgtctctcggcactcgtacaaaagggtaagcaacaaaacaaattttgccacaatttcccaattttccccctcattttcagttctgcatgtcgagaccggtccgttgtaattcttgagcatcgcctatctttatgtacttaaattatctgtcttttcaccctttcttaagagctttggcgcctttcaacgcttggcggcgctgtgtccgcaatgggcttttttagtcggaaatttgtaataaattatatattttttttaatttgggggtggtcgggattctgcgatttggctggactggtgccaaaatcccgacttttttcatttacatcatccaattaaggggagctggggtgggagaaggtggaaaagcctggcgcaaaaaatagggctacgtttacccctctatctgtcccccccccccgagaattttttaaaaattttaaaacaaaatttctctaaaaacagacaaaaaaaaatgaattttgaaataaaaaaaatttcgcgattttcaaaatttttgagaattctggattttcaaaaaattttgcagaaaaacgctgaaaattttaaaagactttcttcttggatttacttattaaattttctaaaaaatttttgggggaaacgatttctcccgaaaaatcgagacggcaagcgatcccataattgtttttaattgtttaatcgccaaaatccttcccccnnccccccccccaattcttcccacagattcggcatgcctttgtgatttccattcgtcagctccgtttggccatcgaaattggtgacccggtgctgatttcgcgctgcttcctttacatttcactcgcatttgcccaaaaagggcaattccttccggcactcaaaattgtgcggtacgttaagccaataaataaaaatgccaaataattttcaaaaaatgttccctttttcagccaggaatggaacagaggcactgagcttaggtccgcttttttgctgaattgcacccgcggcgtttggtccactatcaaatggctgatgatgaacagaaaagtgatgatgcttaaataatttcgcacacatattttttccttttaatttattgttttgtgttttggctaattaatcaaattaattgacaattttatgtctagaatataacatgcagatgaaaactaccaattgttgtggtcaaaaagcctcattaataatgagtagagctcgcaaaaaaaaggcaccaaaaatagcgaaaaaggcactataacaggcatgaaaaaattgaaaaaaggcacgaaaatcccgaaaaaggcattaaaaattttttattaaagatttttagtgagcaaaactcgtaaaacttaaccaaaaaacttaattttgctcatttaatgattattaaatatttataatgttttcgaaaaagaaaatttttaaaactaaaattttttaccaagaaaaaaaaattattttttgagaaaatttttaaattcttagggggcgtattttcccgattttattgcattttaatggaatttttggtaaaaaagccaaaaggcaccaaaacggcaaataaa

SEQ ID NO: 75681 - DNA, 1139 bp, Heterodera glycines
  Genomic contig location: Contig_ID=SeqID_12113; Location=1374..2512; Strand=-
  SCN-specific regions: Sequence locations=1-605,656-676,701-1139
atgcgaatgaactgcgatgattatgctcatcaagattcgcaatggcgctgcttcgttcgttcggccacttttcgaattgtctcacaaaaagatggggcgaaggattccattgggatattttgtgaccgtgctttttacaacaaatcaaccatcaggggatttgaaaatttcttttcctttacggtgagttccaattggaattattattaccttaattgacatattatgattaattaagaaattgatggacccgaaaagtggttttcacaacagagaagaggacaaagtgacgttggtcattgatgttatagttaaaaataaaaaaacggagaaatttgtttctgatcccaacaaatccaattggacactttcgatggaaattgaaaaactgtcggaatttgcgcgagaagtcattaagagtgaacgtaaaagcgaaactgtgcgcatcaaaggattttcatggcaaattttggcagaaataagtgagggaatggaaagcactgacaatgtgaaatgtttgggcattttccactcacgacaatttttaacaaatatatataattgaaccgactttactaatttaactctttaaaaaagaaaatgtcaaaaaattgaaaaagaaaatttaaatatttttggtttttaaaaattaattcatttcttttttgtttctgctgaaaagaatggctctgaactggttcaccaaatttgttgcagtcaacggcagaatcacacttcaaatctcggcctcataagggtgcattttgttttaaaaaaattagcgctttactttaaataagtctgttcaataattattagtgtcggggttgtatgaattgttttccttggttctagtctgcatttggcttgctaacgaaaattcgaatttttgaaaattctcactattccataaaattgattaaaaaggctaaaagtagtcacaaatcattgaaacagcaaaaaaatgatctatcatattcgtgatcagcgacctcgaaaacccccgggtacttggttacaggactttttaaagcgaaaaaaaattgaaaaaaaatttaaaccaaaaagaagtgcaaaaaattttcaaaagaggcctctttttaagtagcgccatttccctttcttgtcaagaaaataaa

SEQ ID NO: 75682 - DNA, 1215 bp, Heterodera glycines
  Genomic contig location: Contig_ID=SeqID_12114; Location=511..1725; Strand=+
  SCN-specific regions: Sequence locations=1-18,40-515,548-582,605 -849,871-1178
atgtccaagcctcgaaatgtccataagggtaaaaacacgaaatgtccaaaactcgaaaaagctcataaaaacccggaaaaggagtctaatttagggttttcggggtcgctgaatacgaatacgaccttcatatcgccccttgcctaacccttgatccacccgaagaagaaataagttcaaaaatttttaaaatatgtgctgtactgacgacttagatttttctattcatttagaccaaatgataagtaataagcttgaaagtctacaaaaactcggaagaagcgttatatttcagacatttcaaacacaaatgaggatgccgtgaatttgggagtggagctttgcgaaccgaatgccgtgataattttctacaacgttgaacaacagactttgaacgaggttgaagttcaataatgaacctttgagcgcggaaaaacaaattttgggagacattgcctatggttgaatggtacgtatgaagcgacgcaaaaaaatagactaaaattattccttttcagaagtgttctttctttgccacttttgccttccagcgatttgttttcgtattttttcgtcgatttccaaaagtttaattatttttaagctgaactagtgacaacaatttcgaccatcaattcagaacacagctacgcggctactccaatacagctcggcatcggctcaccggcgccttgaactctacatggctaaccactgtgactccacaagaacagcctgttcaatattcgttgagctcgctatcgacttcaacagcgccttcagccatacattttttcacgaatgtcgtttatattaaaaatttcaatggactggaggcaacccatctgcattttatggttgttttttaatttactacaggcaaatttaaaaaaatatgtttgaaaggtctctgccaccaccctgccctcccggacttcatctgtaaaattaatgaaaacaccgactgatggatggacgctgcccgatctgagctgctcgccatttcattcgcatgtgacaaaagggatacaccatacaggacgccgtcattatgcgaattttgccggacgagtaatgcaacaacaatggtgaaatccatggccaggtgacgccgatcggtcttcaaattgaaggacattcaagaaaattgaaggatttcgagaattttgaggattcgattgtccatgttccgttataaattttattgtattttta

SEQ ID NO: 75683 - DNA, 3413 bp, Heterodera glycines
  Genomic contig location: Contig_ID=SeqID_12116; Location=25..3437; Strand=-
  SCN-specific regions: Sequence locations=1-808,830-868,890-1189,1211 -1562,1585-2167,2189-2609,2631-3042,3064-3095,3117-3413
atgtcattcgaccatccacttcggcatggtcatctcccaattgtgcttgtccgaaagcctgatgcctcctatcgaatttgtgttgactaccggaagctcaaccaattgacgaagcgatcgacatattatttaccgaggattaaatcgatccttgacgaagtctctgggaaaaaatatttctccgtggcggactgctcaagcggattttttcacattaaattggcgaaaggacacgaagaaaggagcgcattcatctgccacatgggactgttcgaatggctacgttgtcccttcggattggcgggagcaccaacaaccttccaacgagccatggaagaagtccgacaaatgtgctcagcgacatttcttgtgtatttggacgattgcataatcggctcaatgactgaagatgaacattttcgggacatcaatacctttttaagaacgatgactgaagttggattcagactgaaaccagagaaatgcagatttgcgttgggagagattcgctatttgggacatttaatttcggctaatggcgttcggatagatccaaaggatttggagccaattcacaaattgaggaaaccgaaaaatatcaccgaactccgatccttgattggaatgctgtcatattttcgaaaattcgtctacggatttgcagaaatacttcaacccatttatgagttgacaaaaaatgaaagcacgacagaatggggaccaccacatgagaaagccttggaggaattgaagacaaagctgatgactgctccagttttggctccaccaaaattcggacaaccattcgttgtggaaacagatgccagcataaaagcaattgccggatgtcttctacaagaaaaccgtgaaggcgaagtccatccgatttgttacttcagccgagtgctaacaaaacatgaaaagcgctattcggtggtcgaattagaagccttagcaatttgtgcttccctcaaaaattttcgaccatatttggaaggagctggaaaatcaacagtgatcacggataattcggctttgacatcattattccggcggaaggacttggaagggcgactcagtcgataccaattggctatcatggcattcgatgttgaaatcattcatcgccctggaaaacggaaccaattttgtgaccatctttcacgatacttggacgacaacgacacacaaattaattggctgaaaattgaaccaaaaatttcacaaagtgaaatgcgcgaggctcaaaaacaggagacggacacacaaaagagacgggaaactttgaagaaggatcaaaattcagaggagccaaatgaatttactggaaaatggagaattactgaagatcttttgtgtgcaatggaccgaggcgaatggaaaatttatgtgccaagcagtctgagacaaagagtgatgaaggaataccactctgaccctttccaaggaggtcacctgggcgagaagcggacaaaagacaaaatccgacgaaatttgtactgggaaggaatggaaaaggacattcaaaaatttgtgagaacctgcgacgcgtgccaaaaacggaaaataattgggaaccaaatgagctctgagcccatttgtccaattgtaccagcgtcacagccatgcgaaagacttcacttggatttgatgggaccattgaagacggcaaaaggcggatttcaatacatcttgatgataatcgattcattttcaaaatatatgacggcactaccactgtgggaacaatctgcgacgacggtgacaacagcattcgttgacaaatttctatgccaatttggaattccaaaaatcgttgtgacggactgtggaacacaattcctcagttcgacatttgagtcacttgctaaaacttggggattcaaacaccaaacgaccgtgccataccaccaatcagcgaatggacaagtggaacgattcaaccgaacacttgcggacatgctagtcaccacgactggcggaaaagattgggctgccgcgcttccgatgctttgctttgcatataatacatcgattaactcacaaataaatcattcgccattctttgtgcttcatggatttgatccacggcttcccagtgagatgctactcgaaaaagacggcgaagagtacaatgacatggccatatacgtccaagagctgaccaaaaggatggaagaagcaaaatctcggatcagagaaagtctgaagaagtgtgctaatcggatgatccagcaacaaaaaggcacgaaagaagtccgatggacggaaggaatgcttgttttgagacgcagaaatgacaaaaagaataaattggaaccaaattatgaagggccatttcgcgtcatcaaaattgagaagccaaatttgcaaatccgagaacttgaccccgatggacaaccattcactgtacacatggaccaatgcaagccatacttcacaaacgaagaagcggaacaggacactgaatcattggagaatgagaaaccaaaacataaaaatgggaataaaaagctgggagattcaaaattggaagaatcggacgaagaaatgcatgatggggaaacaattgtggcatgtataagtgaagggaatccactgggccaaccaaaagacaaggaagaaatggaaacaccacatcaaattgagatccgattggatggcacaaattttttcgcttatctcagcacttcaaattttcccgcaacttccaccatttccgaaaatttaatcaaaaatgactgggaaatatttgaagatgacgacaaatacgtgataatgtggatttttgatgaaaatttcaaactccgaatttccaacggatgggacgaaatgttttttggaacgggagttcgaaaatttctaaaaaattcgggaaatttaacgatggaagacgggaaagcattttatcacgaacaatttattaatgaacaaaaccaaattttcgcccaaccaataataccggatgtttggatcaccctgcgcgatcacacccctgcgcgacaaacaaatccatttaaccccttttttgagacgatcgagccccaaaatattcaatcattttcatcttttaatcggacatttcattcaatcagccatcacactcacacaatcaattcgacaaatttacagcaaaaaatgtctcgattcgactcccttcttacccactcaaatcattctacatcaaaaaattcgtctccaacaccgcctgccattttaatttcttccgactcggactccgaaggagaatctgaccaacaacaacaacaaaaacataacaacaaattccaaccccgcccctatgcaccaatcctcacgccgttctcagtggatcaggtccaagtgattcacccggaccaagtcgagatgtataagaaggactaccgattggccgaagaagatcggcaaataca

SEQ ID NO: 75684 - DNA, 833 bp, Heterodera glycines
  Genomic contig location: Contig_ID=SeqID_12117; Location=156..988; Strand=-
  SCN-specific regions: Sequence locations=1-58,111-179,201-212,283 -528,605-833
tgttttggagaaccagcaaaaagagcagtcaaaaggtgaggggaagaaaattaaaacgaaaataaaatttatcaatttaaatgcttatttacatttattaaaaattaattcgattttaagcaactcaaaaaattcaaaatgatcagaagaaaattgtggaaacaatcagtgcattagagcagaaccaaagcagaggaaggtaaattaaggggtaaaaaaatatatttaaataataaaacaattttattttaaaatggattattttaaggcattttcaaatttccgacaaaattattgggatgccaattttcgtcatgagaacctccaaatcattggcaacaaaagtctcattgtccattataagagaaatttttctggtatttttataaataatttactttactaatttctcctcaaaaggttactgttcttctgcctttgcaaaacatccgattttgctggacaaaaattcgtctgacaatttttactacgaaatttcaattggaaatttgaaatggtaagagagagattttttattttttgaatataaaatttttcagaaatattcaaattttaattattatttctttattattattaatttctcagttggatgagcttcggatttgcagtcaaacagcagaacaaattggatggaacaattcgaagccgaaagggcacttatgcaattgacagtgatggaaagatttggattaatgggaaagaaacaggaataaatgtcgaatattcctacggtgcaggcgataccgtaggaattggcgtcaattctgttattcggcagatcactttcaccaaaaatggaaaacaattgg

SEQ ID NO: 75685 - DNA, 489 bp, Heterodera glycines
  Genomic contig location: Contig_ID=SeqID_12118; Location=199..687; Strand=-
  SCN-specific regions: Sequence locations=1-84,107-489
atgtcaatttcgaccaattcaataaattgtggagatgatttcacagcaacagaaaatggaggtatgtaaatgaaatgggagaaaaattgaaagtttgaaaactgaaattaaatgaatatttcaaccaaaaaagattaaattatggtatttttagaagtgaatggcgctgcaattaatttggaaaatgatggacaatttgatggaaacaatgaattgattgctgatcaacaacaacagcttaaggtgggcgaatgacataaacaatttggataaatttgaattttatgtgggacaaaaaaattttttggtactatgtggtttataccagggatggcacagaattccgacttccgatttccgaaaatttttggggcctcggaatgccatccctggtttataccccataagaaaaatttttttttgaggcataaagatgcctccagaggttttcggggtcgctaagcacgaatctgaactcatatcaataaa

SEQ ID NO: 75686 - DNA, 722 bp, Heterodera glycines
  misc_feature (27)..(27): n is a, c, g, or t
  Genomic contig location: Contig_ID=SeqID_12118; Location=2153..2874; Strand=-
  SCN-specific regions: Sequence locations=1-130,152-722
atgggggataatggagactggggattnattttcaaccctttcctagactgggggataattggagattgggggattaatggagattgggggataattagagcaaatacggtaattgcattgggtgagcaataaaaaggggatttgtttttatacatatccaaatttgagatttgcgtttaatttattcgggccgggtcagtttagtctggccgttttagtcagagggtcggtttagtctggccgttttagtcagagggtcggtttagtctggccgttttagtcagagggtcggtttagtctggccgttttagtcagagggtcggtttagtctggttagctctttcacccacaaattaattactttttataaaatatcattttttgtcgagcatatacttatatataactttaaaatttctgttcacctacaaagaagtgtttgcgttgcgaatttttcggacctaataacaaatgcaaaggtgtatgcaaaaataaaacaaagaatatttttttaaattcagcctacacattgacattaatgctaatgtcctcaaaattattggaagccacacatgcgacatgagcgccgagcagtggagtgtcagcgacgtgtgacccagctaaaacggcgtgcagttgagacgtggaaagcgccggctacaattcgtgtacaagtcttgcagaacacaacaacaccaatgttagctgcttttccgaataaa

SEQ ID NO: 75687 - DNA, 610 bp, Heterodera glycines
  Genomic contig location: Contig_ID=SeqID_12119; Location=113..722; Strand=+
  SCN-specific regions: Sequence locations=1-3,133-164,204-231,260 -260,284-323,358-434,456-468,490-610
atgaatgcatcagtctggaaaataggtctttttgaaaaattaaaagatggcaaaatggcggagtgccgcgaatgcaaagcaaatggaagagccaaatatgaatttggcctgccagacttcagcaccaaatcgttcaaaaaccatctttttcaacaatccatgctaattcggaatatgtcaagaattttgaagaactggagaaggcgaaaaaaaaatccaaagaaaaagttgagaaacagccgacgatcgaaaatttaataggcacgaatttgaccagcagcggtagttttgtgttggtaaattttacggattttggttttttaggcattttgtctgtggctgacaaacgaattatcagcatgataacctgtaacaatctgtcatttggtttgctatctgacccgacttttaaagctcagtgtaaatatgagctgaaggatgaaagcgattatcggtaaaagtcaaagcaattaaaaaataattttttaggaaaagagttctcccggaagcatacaaactcgtcaaggcaaaaatactcaaggatttagatgattgcgaattttcaaaatttgattttattgacgcgattacatttttgattttcaactca

SEQ ID NO: 75688 - DNA, 1302 bp, Heterodera glycines
  Genomic contig location: Contig_ID=SeqID_12120; Location=267..1568; Strand=-
  SCN-specific regions: Sequence locations=1-842,864-868,892-1143,1165 -1302
atgggccaaatgtggggaagcgagcttaatcttttttcgaaagataatgatggatgactccttttttcagcaatctctgcgacgacgtttggttggacacattggcatggatcaatcgtggagaagtcggcatgaagttcgcgctggtcaatgctcggttcaacactttggtggacaggcatttcgagcagaggaagtggtgcttcggcgagtttcacatctgtgagcggatgacggaagaatcgggcgcagaaatcatgacatcgatcgacggctccgacttcagcacgttgccattgcccaccactccgctgccggacagtgtcgtcggcttccaatcaatctccatttggtggccatttgctttccaaattgaccttaaaacatttgcctcctttctgcaggtacatcaacgaagaggtcatcaattttctgtgcacaattcgccgtctcctcgccgaagacattgcgctggaattttccacttacttcacagaatatcgcagttggaaagtgatggcacgacacatttggccgctgttgcgggatgggatcagcactttgttcctgaagaagtgtgacttggccatgctccgtaaacacgtgtcgcccaccgtgctgttcgactgtgccggcctgcaccgaatccacacgcaaatgctgcccgagtgtccgtctgctgacggtgctgtcgatggagagaatgctgatgttgacccgacatgccgtgaattgtacacgtgggttcacacgcagcgcgaggaagggcacggaccggtgtcactgaagctgaacaaatggaaggaaggcaaatggaacgactttgtgaacaacttgttcaaggtggtgctgtgcatctttaaatccgtcattttttattcatttccccaaaatttcagtccttcaccactgctgcgttcccggtcaattacattgtcatctcgaagttgcccttccgcttcaaggagtgtggtgcccaaatggagaaccatcagacgcaagaacggctgtccatgtcaagtcgcgtttacaaagtgaagaatggtggcggagcattaaaaacgaaagtggctgttgtacgcttcccgatggatttcggtgatgaacagcttgaagcttggcggcgcattgcgaagattatggacgatgttcctgccaatttggtccacattggcttcaacgacaacgaaattgggtgagtcattggacggggcggggaatcggtccgattcgtacgtaatttttctatgtttttagggaactgccatctgccgctgcatccgaattgagaaccaaatcgtt

SEQ ID NO: 75689 - DNA, 862 bp, Heterodera glycines
  Genomic contig location: Contig_ID=SeqID_12120; Location=845..1706; Strand=+
  SCN-specific regions: Sequence locations=1-839,861-862
atgtcgggtcaacatcagcattctctccatcgacagcaccgtcagcagacggacactcgggcagcatttgcgtgtggattcggtgcaggccggcacagtcgaacagcacggtgggcgacacgtgtttacggagcatggccaagtcacacttcttcaggaacaaagtgctgatcccatcccgcaacagcggccaaatgtgtcgtgccatcactttccaactgcgatattctgtgaagtaagtggaaaattccagcgcaatgtcttcggcgaggagacggcgaattgtgcacagaaaattgatgacctcttcgttgatgtacctgcagaaaggaggcaaatgttttaaggtcaatttggaaagcaaatggccaccaaatggagattgattggaagccgacgacactgtccggcagcggagtggtgggcaatggcaacgtgctgaagtcggagccgtcgatcgatgtcatgatttctgcgcccgattcttccgtcatccgctcacagatgtgaaactcgccgaagcaccacttcctctgctcgaaatgcctgtccaccaaagtgttgaaccgagcattgaccagcgcgaacttcatgccgacttctccacgattgatccatgccaatgtgtccaaccaaacgtcgtcgcagagattgctgaaaaaaggagtcatccatcattatctttcgaaaaaagattaagctcgcttccccacatttggcccatgcgtcgctgctgttgctgatgataaataatggtgttgtcactgtgccgtttgactggtgccgttgcgcccacttctgcgtcggttgtttcgactgctgcgtcgttgcccagaaaaggaggaaagtgaaatgaaaatga

SEQ ID NO: 75690 - DNA, 2327 bp, Heterodera glycines
  Genomic contig location: Contig_ID=SeqID_12121; Location=408..2734; Strand=+
  SCN-specific regions: Sequence locations=1-90,112-213,273-438,492 -585,608-762,792-807,830-840,863-933,970-1264,1286-1555,1577 -1825,1847-1965,2002-2107,2129-2256,2278-2327
atggccaatttggacaactacggcaatgatacggtaattaaatgccaagataattatatcatagccaaatttgcagttttatttggccttcaaagatgtccatcccagctggtcactgattggatttgcaggaatttatggaatcattgcactaattggcatcattttcaatttttctgtaatttttatcacaatcaaaaaaaagttggtttgattaattttaatttatatcaatttaaccattttttttataattttacaaatttatttttggtcactcaatggcacaaccaattatcttttggcactttgctgcttttttgaatcgctttttcaacttggccatttcctttttgtgtacaacgcattttctggccagaatttcattgagtgtcgcctagcagcaaaaattttatttattcctttcattggaattggtaattttaatataaaaaattatagaaaaatattttttaatatatttaaatttaggtggaattgctccagcaatatttttcactggcattgatcgactgattgcaattgctttttcggaattgtatacaaattacaatattatccaattttgttaattacagtaattttaagccatgacaaacttaaaaagcaactgtatttggcgctgctaacaattctttgtgtgttctatggtttctgctactctgcttcggtgtaccaaaattcaaaattgggtgatcagatgaccacgggatcttttgattttttaaaggtttgattttgtttattttatttaaaactatttatttttagaatggatcattattaaatacagttggttttttgcttgtttcaatgactttcattatttatgtttgtgttggaattgtgatacgtatcaaagcatcaggtaaaaatccacgctaaattatgcatgccccaatttgcccgattgatggacaaaattgtttttattcatgttttaaattttagtgtttaaaatttttgactaattaaatcatgcttatctgggatgggccaaattgaaaaataaaaagcgaaatttgcgaaactgaaaaatgcgaaatgaaaaaaaagcaaaatgcggaaagccaataggtgcgtaaatgcgaaaggcgaaaagcgaatttttttcaaaaatttaccaatagtcaaaatcatagattttgaggttgtgatgcaaaaaacaaaacaaaatttctgcattttccggttaaatccttttctcagatcacaaaaaatgacaaattctacccattttgggattaaaatttcataaatcaaggtaaaatgagggtcaggcagtgccgacaggcgccgccggaaaatttttggaaattgtaattaaatgtgatagaaaaagttgcaaaagtttcaaaaatttacaatttttttaaaaaataccgaaaaaggcatgaaaaaagcaccatacgtcaaaaaggcacgaaaattacgtgcccggaataaggcaccaaatcgcaaaaaaaagcaaaaaaaatgcaccaaaaagtttaagatagaaccttctgcagcccaaaataataataaactgtaagcattcgttttaaaaatttaacgctccaaaaatattcatttttaggggtggaattttcgcattttgcgccaaaaggcgaaatgcgaaatgccaaaaaatgcgaaaagcgaaacctaggcccatccctgatgcttattgtcttggattcataattgccaaaaatttgttttaattaactctttttttaggtttgccatccgctgattcgatcaatcgtcgcacttttcgtgcactttttttcattatcactgtgaatgtcggcggttattggttttctgcaatttcccatttgctgttaattcccacaatttcatctccgatcactgcttggtttggccatgcaattgccgcattttctgggattattggcgcagtgtcaaatggaccaattttatattttacaaggtatgaaaatttaattttttttttaattattttcaattttagtacggagtatcggcaagcattccaaacggagtttccatttgttttcagacgaatttcaaaccaaaatcaagtggttccactgcagaatacacaattatgagaatttctttgtaaagataaaggaaatttaaaacttactagtatttaattgaaatgacatcagtttgtctaattgttgtcaataagtattaaaattacaactaattaatgaattttcatataactcttttgttgaaattatgaaaatttcactgaaaaatttttaaataatttttctttgtccatcattaatttatagataaaaggtaaatttataaattcgaaa

SEQ ID NO: 75691 - DNA, 863 bp, Heterodera glycines
  Genomic contig location: Contig_ID=SeqID_12123; Location=115..977; Strand=+
  SCN-specific regions: Sequence locations=1-121,163-198,236-319,396 -739,770-863
tcaaatgccattgatgaaattggcatcgatgatggcttaaatgagctcgaaattggcgagtcttttctgctcagagtgccgttcccacttcggctcccattttgtcacattattcttacggtaattaaatttaaaaaatataaaatatttaattaaattttagttttacgcagcggactctcagcaaatgatggtttgaaaaattttattttttgattttataaaatttaaatttcagggattttgcaaattgggacccaccggaagcataagcagagggacaatccaatggagacaaatgatcaaaaaattgggtatgttttattttaatagaataaatatttgtaattattaatattaattaaaaaaattaatttttagattttttaaaaattggatagctttttttacttataaaaatcgaaaaaaataatttaaaaattgaattttcggcgctccaatcgcggcttggcatcagctgattgtgtccgatgaatgcccttcttcgtctgccgttgcacctgccacgggcagtggccaccgttcgccgccaccgccaccgtcggacgaacgccgacataccgtaccccgtcggcgtaccaccgtttccgtgccgccgcttactgttggaacgctgaaagcacttaccgcggcggcgcaacaacgactccgtgtaaaagcaattgaaaataattaatattaattcccgcctcccttgatttaattgatttggttagggtaattattaattattttttgaaatttaattcattctaattcatttaagaatgaaccaaagggacatcataacaatgccacgtcgggcaaagaatgtgcaccaattcgggcataaatttccaaga

SEQ ID NO: 75692 - DNA, 129 bp, Heterodera glycines
  Genomic contig location: Contig_ID=SeqID_12123; Location=2274..2402; Strand=+
  SCN-specific regions: Sequence locations=1-9,33-65,87-129
atgtcctcccatcttttgttttccttcttggtcttttgttcgctgctcatttccgccattttcgcctgtggaggtggcccggcactgccggctgaccctttcgacccattgggcccgtggcatcaacgg

SEQ ID NO: 75693 - DNA, 513 bp, Heterodera glycines
  Genomic contig location: Contig_ID=SeqID_12124; Location=238..750; Strand=+
  SCN-specific regions: Sequence locations=1-78,119-175,197-513
atgccggatggtttgaaattcgtatttttcaagtcgcgcagtgatcagtgcaattccggaagaggtgagtgatcgaaaaacatttatacaaaacaaaaatgagtgaaaatatttggaactttcctagattctggaaattttcggagatcgaaattatgaatattttaacttccttttatttcgaattttaattttaatgcgtttcaaaatttgattaattaaaatcagccgatcactttttttgcttacaattaggttcgaatgcaaacattcaaaggcgtttgtgggccgggctttttgaagaacgaaagtggcgaagtggtggacaaaattcgccacgtttggttcaacgacgaactgaacgttgagcagaaacaggcggaggcaagaaaaaaagagggagacaaaacgccaaatttaagtgccaaaattaaaaccattgcccatttcagttccgcaaaattgccaaagaaatgctcaaaggcgaatcggttggaatcggagaaatttaaa

SEQ ID NO: 75694 - DNA, 1275 bp, Heterodera glycines
  Genomic contig location: Contig_ID=SeqID_12125; Location=79..1353; Strand=+
  SCN-specific regions: Sequence locations=1-893,917-1275
atggctgcgaatttacttcatggtgaaggaaacatcactgatgcagatgttttgctcgttgatgaaagcactcaagctcagtgggcggtggtggttcacctagttgcgcggatgcctaagctcaaggcattgcttttgacgggcgatcggcatcagctcggagtgcatcttcaagaactacctgacattttccactccggatatggattggaaagcgtcatccttcaagcagaggcttcgatagggatgaactacacattcctcacaaagatgtacagaagccatccatttttggcaaagctcatcagctatgcctcatatgaattgcacaatgagcaactcattccagcaagaagcgctgaagaacgctcactcatcacgggctcagattttcttctgccggttcaagaatgtcctgtgggactaattaatgctttctcatcattccgtgtggacccaaaaagcgattcgctcacagatgaccatcaaacagaagtggcatcgttcttggtacaagcacttttggaacattttggcaacgatttttcgtcaagaataatcgttctgtgtatgtacacgtaccaaacttcggaaattgaacgaaagctgaagcactgcggtgttcgtgcactcacagttgatgcctaccaggcacaggagtgcgatgtcatcatcatagtgacaacaagatccaagtattccgagatgggatccggaagaacggacaacatgcacttctttgaagacgatcaacgggctactgttgctctctcaagagcccgccacgctgtcttcatcattggagatttggtttcaataagtgcaggacaagtgtggaagcgcttcatcgaaatggcgataacaagaacaagcgtagtccgagccgagtatgttttggcacttttgggacgaacactcgtgaggtcgtcgacatgcctatttgattcggccaaaagagaatcggtggaggatgaaggctttcttgaaagttgggcattgaagcatgggttgcgcctggaccgaacgaatgcctttggacaacaacaatcacagcagccgcgagctccctcattccaattccagaatcgccactttcctgcactacagacgacagggccctcagatcaagccggtccatctggcaacggtggtcaacaaagaggtgcgcctactttggcaccacagtatggaagaggtcaaggaagacgtggcccggacaaccagtggatgcactacggcggaaacccgaaacgacagaagggtggcagacgctga

SEQ ID NO: 75695 - DNA, 1556 bp, Heterodera glycines
  Genomic contig location: Contig_ID=SeqID_12125; Location=1847..3402; Strand=+
  SCN-specific regions: Sequence locations=1-1264,1286-1556
atgtttcctttctctggtggggatccacctaatcgaagcgctgcggcgtcaaacaatgcactgacagaccctgaggggctctccaatgatttgcctgagttatcagtagttgataaattaatgtttgctggaaagattttaagcacaccagcacggttgtctgatgtggacaagctccatacggacttagttcggactgaggatggtgtcaatcgcatgacacgtcaccttaacaggaagataaatcaaaccaatagggacttgactgaactcaaggatgatactcaaaccttgataactcaagtaaatactcttgcaaatagttatggtacagttcaagtgttgcaaaaccaaaatcagtcaccattagtcaacaaccctcctgtcttaaattgggcaactccctctccactcaggaatccaaataatagctttggcaatgctaatacttcggtggttgaagccatacatagtgaggaagaggatgaggaatttgaattaaatccttcgggattccatcatgttaacatgcttttcgctgaaagcagtccctctttcacgatcttctccggaaattctccattagaattcgatcgatgggcaagaaagttcatggacctgcttgactgcaatggcagaaagtgggatgattctgaaaaggtggcacgcctcaaggcatgccttgatggtgaaccaagacgtatctttgataatttaatgcctgcccacaaagcaacttcttcggaagccattcaaaaaatcaaggaaaaccttgacactccacaaaataaagaactcatctatcaggcactaagcatgtgtaagcaaagggaaggagaatctgtagatgagtttagtgcacgactgattcctctaattgaggccaccacggcggaccttacaactaatgctagtgaggaagtactctgtcgagcatttttggaaaaattgaatccaaatctcaaatttctcactcgaaccctgagtgggcccgtcagaagggattttcaaatattgagaatgaatgcacgggaagcagaaatgatgcatagagagattcctaaatctattccagcacctcttttcccaatttcggaacaacaaaatccgagattcaacaacaccgagccgccgaaccacccggaagccaactttagaacatgggctcccacaggctctaacagagagcctataagtcccagacagaggaaccggaacaattgggataacaatgcccaagcctcaagaggctcttttaacagatcaaataatcatcctcaaaatgacagaagatggaacaatcgcactttcagaaatgaaagacgatggaataatcaaacccctcaaaatgaccgacgctggaatgctcggccagtttgcaactactgtgggaaggttggtcacctcgcgtttaaatgttttaaacgtcgtgaggaatttacccaaccatccaagaatttgaatttcatcagagcaattgatgaacaaaacagattgataaacgatctttcaactaaagtcaatagtttaacttttagaaacgaccaatccgctga

SEQ ID NO: 75696 - DNA, 254 bp, Heterodera glycines
  Genomic contig location: Contig_ID=SeqID_12126; Location=66..319; Strand=+
  SCN-specific regions: Sequence locations=1-155,178-254
atggattttattgctcaaaatgccaatggatttgaccagaaaaacgaatatttggaaatagtatgttttgctaattcatttggtaagtgaataattcaaattttacaaaattcctatagcaaaattttaagaaagccccaatggacaatatgccgaatgaattaatttgaaatggacagacgatgatcaaaaaagtgatcagcttatggtatttcctatttcaacattattttaaatcatatttctcaggacta

SEQ ID NO: 75697 - DNA, 695 bp, Heterodera glycines
  Genomic contig location: Contig_ID=SeqID_12126; Location=353..1047; Strand=-
  SCN-specific regions: Sequence locations=1-40,107-264,286-400,430 -584,607-615,647-647,683-695
atggtgttcatctttttcctcttcattttcctcgcccaggtaaatttaattttaattttaatttaataatttttcattttcattcatttttaaaattaatttttatggtgttaaggtgtgtattttttgggccatgtttttgaacatgccggcccgtggagccggcattcgtcgtcgccgacctcgtcgcccggatggagtcaatgaggacaatgcgcctcgccctctccaggtgttcagcgtggtgcgcgaggtaatgtttgccttttcctttcctgccccctatttttagcatttttctttttttttgaagcgtcgcacggggcgagagtcgccccagcgtttcgggctgcgcgttgagcgcgttggtgtggaggaggtagagagggggggatgggaaggaaatattttgtttgtttttcctttgcccaggtctcgaaggaccctcccgagcgtcgcaccgaagaggcgggcgccaaagtggtatgggaagggggggattgtgtgcataaatgcatttcatcataatcttttttgcagggagtggaggccaaatgagcagcggcgaaaaagaatgagggattttgaagagaatgaggaattttgaagagagtgtgaagaattttaaaaggaaaaattaaaggatgatttttaaaaatcacatttaaatttttaaaattttcctaccaaataaa

SEQ ID NO: 75698 - DNA, 472 bp, Heterodera glycines
  Genomic contig location: Contig_ID=SeqID_1751; Location=512..983; Strand=-
  SCN-specific regions: Sequence locations=1-139,161-472
agatgagatagaaaaaaaacaacaataggcttggagagcccttgaagagctgcaccggatgcaagtgccgccgttgctgtacgtttagcggttgctgtgcaatgacggaaaattgctaaatcagaaaaaaccaaatattatcaggaatacactctcccatctcacgcgtagacaaaccgaatggtatatgttcgaacggcaagttgactaccgtacctaattaatatttttgggatgccaattgttaagtgcgtaactgttatgaaaaaaggattcgaaaaactgtgataaccccattcagagactagctaaaaaaatcagaataatcagaataggattggatttgcgtaccaattattatttttataatgggtaggttaaatgcgaaacagttgacaaaagttgttataactccattcagagatgagatagaaaaaaacaacaataggcttggagagcccttgaagagctg

SEQ ID NO: 75699 - DNA, 464 bp, Heterodera glycines
  Genomic contig location: Contig_ID=SeqID_1751; Location=1353..1816; Strand=-
  SCN-specific regions: Sequence locations=1-139,161-464
agatgagatagaaaaaaaacaacaataggcttggagagcccttgaagagctgcaccggatgcaagtgccgccgttgctgtacgtttagcggttgctgtgcaatgacggaaaattgctaaatcagaaaaaaccaaatattatcaggaatacactctcccatctcacgcgtagacaaaccgaatggtatatgttcgaacggcaagttgactaccgtacctaattaatatttttgggatgccaattgttaagtgcgtaactgttatgaaaaaaggattcgaaaaactgtgataaccccattcagagactagctaaaaaaatcagaataggattggatttgcgtaccaattattatttttataatgggtaggttaaatgcgaaacagttgacaaaagttgttataactccattcagagatgagatagaaaaaaaacaacaataggcttggagagcccttgaagagctg

SEQ ID NO: 75700 - DNA, 184 bp, Heterodera glycines
  Genomic contig location: Contig_ID=SeqID_1752; Location=540..723; Strand=-
  SCN-specific regions: Sequence locations=1-103,125-184
agcccttgaagagctgcaccggatgcaagtgccgccgttgctgtacgtttagcggttgctgtgcaatgacggaaaattgctaaatcagaaaaaaccaaatattatcaggaatacactctcccatctcacccgtagacaaaccgaatggtatatgttcgaacggcaagttgactaccgtacctaa

SEQ ID NO: 75701 - DNA, 359 bp, Heterodera glycines
  Genomic contig location: Contig_ID=SeqID_12128; Location=896..1254; Strand=+
  SCN-specific regions: Sequence locations=1-193,216-322,344-359
atgcccgatgaacgtgttttacacctcgaatgttttaaaagcggcgattatggtgtaagtaactgtgatgaattccatataaaaaaattttttcctcaattttaatcagatgatggaattgtacgggccggaccgtgctaaagagatgctgatcgatttgcgcgactatgctgaggcgtacggaatgccatgtcagcatgtgaagatgctgttgtacaaaatggacaaaggactgatcaaatggaagggaaccaagccatgaaacggatgatgagtgatcagagattttggctactggacgaaaggggggataattgaactcattggtgctgggggtgatggatgcgatataaaaaaaa

SEQ ID NO: 75702 - DNA, 620 bp, Heterodera glycines
  Genomic contig location: Contig_ID=SeqID_12128; Location=3656..4275; Strand=-
  SCN-specific regions: Sequence locations=1-166,188-360,382-423,445-620
ggtgcgacttttggtcgtaaataggagtcaaattttgatggttttagctcaaactttgttggcttttgttgtttaggctctctcttggcggtaggacgtgatggtggtggttcaatttttgctttcgcacgaggcgggagcggaagccggggaggtgaaggtgggtaatgaaccctgtattttttgtgttccaaatcatcatcatatgcttcgtccttttttaattttcttctgatggcaatcctctgctgagcagtgtccatctgctcaatttcacgttgagcattgtagggcagcacaggcaagtcgccatagtattgtgatggcgctggcagcgctaacccactctccaacatataatcatcatctgtatcactttccggtaagggggcagcagctgcttccgcaagaaggtcccgcacaactggttgccgtcgttgtatatcatttcgccttttctcccactgctccaaacgaccatctctccgcgatgccctagtcggtctgggaggacgttgtgggcgaggcggaggacttcctggcggggatggagcgcgacccggaggacttggtgggcgccgatgacctctcttagacggcggtggtggatgtggtggagg

SEQ ID NO: 75703 - DNA, 703 bp, Heterodera glycines
  Genomic contig location: Contig_ID=SeqID_12128; Location=1901..2603; Strand=+
  SCN-specific regions: Sequence locations=1-142,219-703
atggcagatgccatgcaggacggcgcacgttggaagaaggcgaaaacagcaatcaatgtgctcggcaaccttcttttggcggaatcattagacaacacttccgctaatgacacttcgctgaaaaatgataccgtagacatcaaaaaagaagaagaagcaaatatggaggaagaaaaggtgcaggaagagcccaaagaaaaagaggaaaacaaggaggaccttggagacattgacaaaaccctcgatgagttcttcaacagtattaaagcatccacttcaaacatgtagaccatcattgtgtgtaaaaatgttaaacacccaagcattcaacgataaagacattggctttaaattaccatttggtctaattatttcgggcccatcgtcgtcgggaaaaactcaatttctgctaaaattcattgccgaatcggaccatttaatcaccccaaggcctgtatcgatgctctattgttttggtgaaatgaatgcggcggtgcctgtacttcaaaaggcgggagtcgatgtgtacgcgggagtcccatccgaggaattaatcaaacgtctccctaagccccttttgctcattcttgacgatctgatgttgtccatcgatgagagatacctatccgatttgttcactaaaaaggctcatcatcaccaatttgcagtggtgtttgtcacacaaaatttgtttgagcgcaaa

SEQ ID NO: 75704 - DNA, 2787 bp, Heterodera glycines
  misc_feature (2757)..(2757): n is a, c, g, or t
  Genomic contig location: Contig_ID=SeqID_12128; Location=3079..5865; Strand=+
  SCN-specific regions: Sequence locations=1-60,82-524,551-753,775 -816,838-1010,1032-1385,1407-2787
cgattaataccctatgtgagcactgtacgccggatgagcagaacgaaaagtgagcggggtgccaggcgcgtacttgtccagaagggcgcaggatttggcggattgttcgctgctcttttaacacccgttttggttgaattggcaaagaatgtcgtgagcaaaaatgcataaatacccccacatcattattgttttttcatgcaccattcattcatcattcatggcaaataaatttttacttgtccctcaagaaatttaccggggtctcacctccatgtcggacacgggcgatattaatttggatgccgttaggcgtgacttagaccgcgccagggtcgtacgaacacatccttctcgcaaaaatgtcaactacaaccagcagcttaggcgatatttaaaaatgcggcaagagttaacagacaaaccggccaaagttgagctcaccaaagggataagcgtgctgttgaggcgaggcgctgaagatgaggagggtgaagttgtggacactccaccccggcctcccgctcctccaccaccacctccgccgcctggacgacgtccatggcgtgggccaattcctccaccacatccaccaccgccgtctaagagaggtcatcggcgcccaccaagtcctccgggtcgcgctccatccccgccaggaagtcctccgcctcgcccacaacgtcctcccagaccgactagggcatcgcggagagatggtcgtttggagcagtgggagaaaaggcgaaatgatatacaacgacggcaaccagttgtgcgggaccttcttgcggaagcagctgctgcccccttaccggaaagtgatacagatgatgattatatgttggagagtgggttagcgctgccagcgccatcacaatactatggcgacttgcctgtgctgccctacaatgctcaacgtgaaattgagcagatggacactgctcagcagaggattgccatcagaagaaaattaaaaaaggacgaagcatatgatgatgatttggaacacaaaaaatacagggttcattacccaccttcacctccccggcttccgctcccgcctcgtgcgaaagcaaaaattgaaccaccaccatcacgtcctaccgccaagagagagcctaaacaacaaaagccaacaaagtttgagctaaaaccatcaaaatttgactcctatttacgaccaaaagtcgcaccgccgcctcggtcgaaaaaagaacctgaattcccgcttgaccttcggccatccacatccaggcaggctggacacttgcctcccccagcacccaaaattataccaaaacctgaaccgacaaagaggcctgtgccataccgtatcccgaaaagagagccaaaaattgttgaacaacagccacagccgctgcaacaaccccttcctgcttctgccgtcgaagaagaaatgcccaccgttcctccgcctaggcgggggaccaaacgccactaccccgtaaatggtgagaatgatggtgaggtgcgcattagaaaacgcgtgaggcaagcgcgaagggtgagagtacagtactcacccgaaccgggcccatcaacttctgcacaaagggatgagcaacaacaacagcgtgaactgtttgccatcccgtcaaatcagctgaccatgaatcagcgggttgaacgactgtacatcaaatgcaaccgttatgcggatcgtatgggcgttcgaggaaatacaattaacacagcaaacggcaagccgttggcacatagcaatttgcgaatgaccatcaggtatataattgacaggagagcgggccgccctaccattaagccacctggagcggccatatttgaagagaggcttaggcaagatccaattttgtattcatggacggctcctccaaagaaaacagcacagagcaaaacaacccggacgccgcagacaatcaagaaggaatttcgcccgaaaaagtggagttgatcaactccacgcttgacaagctgtacaacgacccatcctccccagcggcgttcgcaggtgttacagcgttgtggaaagaggcgcgaaaaaagttgaaaaatttacggaaaaaggatgtgcagcattatttggaggggcaccgcacctacactctgatgcgcccccgaagggtgcgctttccaagagccaaaactgttgcggctgggttcatgaccgatgttcaagtggatttggccgattttcaggcgctttcgcgccacaatcggggtcaccgatacctgcttgttgcggttgatgtgctgtccaaacgcctgtttgttgtaccgctgaaaaacaagagagccgacgagatgttggaggcattcagacaactcatcgaccaaatgccaatggtccacatcgcatcttctccgacaaaggcacagaattcaagaacagattgttgaaggaattcttcgatgagcaggaaattgagaagcatgagtcagtgcattcatcagtcaaggcatcggttgctgagcgggccatccggaatgtgaagcagcgactgtaccggtattttgctcaaaaggagacgctgaattgggtggatgcagtacagaaaattgtggacggaattaacagcgctccaactcgtgttcacgggatgcgccccattgatgttgacttttcaaatgcgcagaaagtgtggaagcgattgtacggacaccctgcccttcaaaagcggacgccacgcttccgtaaagatgaatttgtgcgcatgagcagagagaaagggcaatttgagaagggatatttaccanaattatggagacgaaatcctggagattgat

SEQ ID NO: 75705 - DNA, 1334 bp, Heterodera glycines
  Genomic contig location: Contig_ID=SeqID_12129; Location=41..1374; Strand=-
  SCN-specific regions: Sequence locations=1-701,723-865,888-961,984 -1121,1143-1196,1221-1334
atgaacgcgcaaatgttggcgggtcttaaggaggagttcgcggcgtacaaggtttgttgcaaaagggaaatgcaattccaccttataatcgccactgaaggaacgtgccgagttcgctttggccgaatccaatgttggcacttccgcggcgacgacaaatggtggcggtggcgctgctttgtcttcggaatgtcagcaattgttcgacacgctttcgacacgtaacgcacaaatggcggagttaaggcaagccaatggcactcgcattcactcaatttcctttttattggcttccaaatgccctctccctccctttgctttggcaattattaatttgcgtctctttcagtgcaaaatgttcctttttggaggaggagttgcgcagtgggcaattgcactcgaaaacactgctggaggagctcaattcgctgcacgaccaacagcaaacgcaacgccaacggtgggcgagcgaaaggcaacgaatgatgggggaacacgcggaacgaatgcgagcggaagagacactgcggactgagttgcggagagagttgcaggcaaatggagggcgaagcccccgggggggggggggaggagggtcaaggaattttggggctgaggtaaaactatttttgcgattgaccattttttgtgctctcttgctcgttgtcagcagttattttcgggctactttttttgcggcatacttttcctaaaaagaaaaatggggacagaaggagtccgtcgctgatggtgccgctaggcgccgccggaatttttttttcgaaaatttaatttaattaagacattttatcgaccaaatttgaaatgtttttttaaggaaaatagctaaaaagcgtgtttttaaaattcttgaaatatttttaaaagggtaacgcccaagccgcgtaacccttggcatttgtgttttgtgatctttaaatcttgcattaaaaaaaaccatttttattttcttaaaggcaacacgcgaacgcgaagcagccgcagctgcgagccgacaaatggagcaacaaaatgggctccaaaaacagcagacggagatggacgaattgcgcagagagtgcgacagactttcacgcgaattgggcgaagcgaaagtgggcgaattggaattggaatttgaaattcaaatttcgcttttccattcgtttgcctttgtttagacattgctcaaatgctcttcagcttcaaaatgcccttctcagtcccttctctcttttcggcccaatcagctgaccaccctaaagcatcaatcgaagccgtcgccgctcaatttgggttacccatcgcaactgttcaccgccacgacaaataaa

SEQ ID NO: 75706 - DNA, 908 bp, Heterodera glycines
  Genomic contig location: Contig_ID=SeqID_12130; Location=167..1074; Strand=-
  SCN-specific regions: Sequence locations=1-677,699-736,766-806,828-908
atggacattaatccgccgaaaatgaatgggccaaaggatgaaactgacaatgaatcggagtcaagaaaggacgggacgaaggaaaaggacggggacggaccaatggccaaggaccaaccaggcgaagtgccggtgcagcaacagcacggcacggggggcggcggcacggcgttggcgaaggtttgccttttcggtgccatcgcccaacggcgccttttcagttggatttgctttctcgcgaggacctggtcaaattggcgaagaagcaactgatcatgctgaaggacactcgcagacagctgacaaaggccaaaaaagaggcaaaaaacgaattgtcattattagggcatttgcaaagactgtccccacaattagcctattaatccccttttttgttcagtccgaagaatacgcggtccaaatgcgccaactctctgtcaaagtgtcgtcggactcgaactccgctccaggcaaaggcgacgcaatgatcgcaatggaattggcggactataaaaatgcgttaattgcggcacggaaggaattggcggacaatgccacgaaaatgggcgagaaggaagcaattgttgaggtggacaaaatgacaaacggagacgggaattggtggaattaaattccaatcagaaaagggcttacaagacaggcttatccagggggagggagaatttgccccaaatcccaaaatcaaaagtaataattttcaaacaaaatttggtgcatttttaaaatttaatcaatttataaattccgttattttgaaaaactttcaccctgattctgaatgtactcaaaattttgtttaaatattttacgattttcccattttaattctgaaacttttaaaaatgggtgaccctttagcaaaaacaactgaagaaacaagaaataaa

SEQ ID NO: 75707 - DNA, 527 bp, Heterodera glycines
  Genomic contig location: Contig_ID=SeqID_12130; Location=1709..2235; Strand=-
  SCN-specific regions: Sequence locations=1-116,139-348,375-527
  Gene Ontology: Mol. function=ARF small monomeric GTPase activity; Cellular component=cytosol; Biological process=intracellular protein transport
ttcatttaatccctccccaaatttttaagctcttggcttacaagcggtcagccgcgcttccgttccatgtgggagcgttactgtcgcggtgtgaatgccattgtttttatggtacattttggtggccatttttactttcatcacgacactttcgtcattgttcaggtcgatgctgctgacaaatccaaactcgagccggccaaaagtgagctgatgcaattgctgagcaagccccaattggaggccatccccgtgctggtgcttggcaacaaaaaagaccttcccgacgctctcgacgagggccaactaatcgacgcgatgaatctcgagtccatccaaaaccgggaaatctgctgctattccatctcctgcaaggaaaagtcgaacattggtacggcaccaaattacaaataaacatcgccactattttgatttcaaatcctattttgtcattggcatccgccatttatttgctgttttcagatatcactctgcaatggctgatccaacactcaaagacggcacgt

SEQ ID NO: 75708 - DNA, 264 bp, Heterodera glycines
  Genomic contig location: Contig_ID=SeqID_12132; Location=2309..2572; Strand=-
  SCN-specific regions: Sequence locations=1-208,230-264
atggcagtgagttgtcccagaagccaggagcgccacgtaatataaaaaacagctctcactcaagaaaactaactcaattcacaacaacttcacactttaattcaagtaaaacagaacattacagaagacaaacacaccaaaaggagaccaaccaacaacaactcaatgaatgaggaaagggcataagtcagttacaaatcaataagataaaagggagacaaaaacagacatgcacacaaacaaaatgccaataattataataaa

SEQ ID NO: 75709 - DNA, 943 bp, Heterodera glycines
  Genomic contig location: Contig_ID=SeqID_12132; Location=2779..3721; Strand=+
  SCN-specific regions: Sequence locations=1-332,355-602,624-943
atgactgcagtgcattcgtttttgagttcgaattcgcctttgaacgtcgtattgggaggcaaccgagggcttgaaaatgatgctgtttggagacacagtgaaattttggatgaacgagaaatgcgacgccgattatttgcagtgagtgccaacaacaacaacctgctcagatgtatgaaagaggagaataaacgtagagagatggaacgaccgattcgatcgaataattttctgcaaaattttgaattgagaaatcctaacaccacggcatttgctcaggtgtaccctcccgttcatgaatcggcacctccaccaaattttgatcgaaatgaaggacaaatgcagtacacacaaccgcgggtcgacaacaaccaagacccgattttcgtgcggcaaattgcggtccattcgaaattaaccgcaaggcatatcacagcaaatccccaacatcatttaactatgttggagaatgaagcttctcaaggccaaatttggcaaaatgatcgaattttggcccatgcaatcaaaagtttggacaatttctcctattcgatgacattgaattcattgccagaattgaagggaaattcgggctcagatcaagtgagatcatttttccaacgcttcgatatcgccactgaggaatggcctgaagctaaacggctaaacgcacttcggtcgaagagttcgggacgcgttgagcgggcacttaatgttgccgtcgcaaacaatccatttcagtacgaattcattaaacgagcattgattcatcagcttgagtcgacagatgcgcgacatatgtcagcttttgatgaattaatgaatggcgtttttcgccggaataacgaagccattgatgactgaaaccaaaaggaggtgttggacaaattctgatcgaaagcggaagaaagttgaaaagaaaccatcaaacactgcgacccaa

SEQ ID NO: 75710 - DNA, 1208 bp, Heterodera glycines
  Genomic contig location: Contig_ID=SeqID_12133; Location=272..1479; Strand=+
  SCN-specific regions: Sequence locations=1-123,145-334,356-417,440 -505,539-740,772-835,1014-1127,1151-1152,1175-1208
atggtcaaccggacccgcatctcggaaggtggacgaatggaagaccgttgccaagttcgggaagccaacgccattgaacaaaattcgattcaagaccccaccttgtcccatccccccatttctggctgtttccctggacagtctctccacgtccattcacaattccgcgccggcagtgtcgcaaatcgcgacagaggagagggtcctggtaattttggaacacaaaattgttcatacactacagtgttaatgtattgtgatgataaaaactttatgatttaaataattgtcgaaattattcgtcgtgcttagatgaaagatgcaattgagtgataccaatattttaaaattaggctcattataggcgaaagtatgagtaattttctgtccaaatttttccatttgattaagcattttaaaatttgtctcacttttagattagtatattacgtaaaaattaatcaaatcacatcattaatttattttaacgtcatgaaattgttaatattctaaatggtttttatttgcgttattccttgtaatttgtatctataaaattttatttagatctcacgcaaaaaatacagatcaatgtatcaagtcacagatccatatagaaattgtttttttctgaagtattgcgtgtttgaacagttatctatttgtcaaatatgtatctttcaatatttttcatctgctaattaaaagaccatatttatttatggagtttttatcaactcttattttaaaattttaaaattaatattttttcacatgtgttcattaaatagggttttatttgtttaagtcgcttaaatttattatttggacaatcaataaaaatatttataaaaaattttcgaaatatttttatataataatttattttcgtttataaaatattatgttgagtaaggttataatagagttttaatagcaaatctaattattcattatctttaaaagttttgtttttaaataattaatcttaaaaaattaattttttttaaattgaaatcctgaaaaatattatttaacctaaaaatttaaactcttctagtagatttattgcaatcacttcagttaattagattagctctgattagactaaactttgtacatgttgtcaaaaatagaataaatattcaaattatgttttagaacaattaaccagttttagaggtctattatttgctaactccttttaa

SEQ ID NO: 75711 - DNA, 1233 bp, Heterodera glycines
  Genomic contig location: Contig_ID=SeqID_12138; Location=147..1379; Strand=+
  SCN-specific regions: Sequence locations=1-134,156-159,326-460,569 -599,729-779,801-889,926-1033,1069-1128,1153-1233
atgacaaaacaaagacaatctcattcagttcgagtgccaatgcattttgctcaaatgtttttgctgtttatgatctcaactttccatgctcaattggttgctgttgataatttaaatccgagacttgaaaaattgtcaattaaggtaataaaaacattctattaatacatttaattatctttcatttatttttttaattaaaatcattttgaaaatatattaaaaatgttttttaattcatttttgtattatcaaatttataataattcttttaatatttaaagcataaaattttaaaataattaaattattttgtaatatttttgagtaaagccattctgatctgagcaaggtagaagaattaattgcgaaaaaatatttaaacaataattcttttttttcttcaaagagatgcattaatttaagatttaatgattgtcttattataaagggttaattgttatttatcaatattttcaaaaaaaaatatttcaaaattttcaaaaattttttacaatttatttaattactgaatcatttcgaattatttattatttttttaattttaggagccagaatttataccaacttgatacatcaatttttaaattaaataattaacgaattaatttttttttcattttattattatttatatattcaattttattctctgtctcactccctctctttcactcttctctctctcactccctctctctctttctgtcaaaaatgatgcatctcattaacaacgatcgcgttttttgttatcatcataaaaatgatattttatcattgacgattttcgactattattttattactttttccacgacagtggcagcccttttcaatcaatgctaacaatgatgaatacgtgaatggcttatttatttatttttttgtatttttaaattaatttcaagttttgctaacctcgtccaaaaaaatttagctgagtttgttgaggattttacgaatactgttcgttcttttccttggtgcgccaccacattagactccgtttatgaatattttatttcttttttcaaaatttttttttatctattcgggtttaaaatttatgaacagataacaaacaaaatttatttgtgatcaaagacctttaaatttttattaaaaaaattacattgaattgaatcatatgattaatattgaatataaagtaaatgcatacaaaattttctcatttttaaaataatttcttaa

SEQ ID NO: 75712 - DNA, 454 bp, Heterodera glycines
  Genomic contig location: Contig_ID=SeqID_12139; Location=2223..2676; Strand=+
  SCN-specific regions: Sequence locations=1-255,277-426,448-454
atgttaaagcatctgggtaaaatggtggtaaggaatatttccgaatttctctcgattttcctatgggtttttcgtttacctaactttgtcatggctgatgtcggacgagcacttagaaaatctgtaatcccaactacgggtcggggtcgttttcgcgtggggcgagtttttgaactataacttttttctttgtcaaccaaatccaataatcttggtatcattcgatagccctaagtgttctttattagcctacaaaatttggaaaaattttgttaaggtccaaaaaagttatggtcagaagagttcaacaaaccaaattttccaacttttttggctcgaactttttttatactgaacgaaattttttggaattttgcaggctaatagtgcatctggagggctttcgaatgataccaagattgttggatttggttggcaaagaaaaaagttatag

SEQ ID NO: 75713 - DNA, 1183 bp, Heterodera glycines
  Genomic contig location: Contig_ID=SeqID_12140; Location=2404..3586; Strand=+
  SCN-specific regions: Sequence locations=1-134,156-274,299-376,400 -818,840-1183
atgcctcaaacagaaaccttcgctatcttaatcgtaggattaatgcaacaaatgaggcaatctttaaactttctgaggaacttaatactgggctggcaaccatggcatcccggattgattcccttaactaatcaattccggccccctagtccccctcgatttcataatagaaattggcagcaaactcccaaccagaccccctcatgttattattgtaaaaagcctggtcatgtaatcagtgaatgtcggatcctcgcctataaaaatcaaaacagaaattcgcaaaattggacgtcccaacctcctatgttcacccatagcaaccccaacagtattccaatctcccgaccccctccctataacagtggtagaggaaatcaacctcatcaaagaggcacatggcggaaccaacagtcttttcatcatgatcaaaggggtgcatggagaaatcagcaacccttccaccatgacaatcggaattggaatcgctacccaaatcccaaccagccttatggccgaggacgacaaattaattcccttaacacctatgattcccttcccccagactcattccaaaatctttcaatgtctgataatggtccccacccttcatttaacactcttacattctctgaccaagtccaacaacccgttactgcctcaccatctcaaatcaaagaacagctcgtgtgctctggctctgctgataagcaaccaaatctcacggatgctttaaaatccgaaccaaagcctgtttcccccactcctattgtcacaaattgggaaccacacccgcgcagctcaaatttttcaatagctccctttctaactcgttttaattttatcttgtgtatcattactctttctctaagtgcttctttggtatcatcctctcacagtcaatcatccttaaaagtcctccctatggtttgtcagacacacgttgagggcacaatttggtctcttcccatttggctaccatgtccaaaattaaagcatactccttctgacacccctatcaaacaacctattcgccttttccaaccgaacccattcgaacaaaaatccaaggcatgggtgtgcaggaaggtaaagaaatccctgattgagtacaccaatccatggaatgatttaatcattaagcaactcccgtccgaaaatctcccagtattattagatgaat

SEQ ID NO: 75714 - DNA, 1204 bp, Heterodera glycines
  Genomic contig location: Contig_ID=SeqID_12141; Location=2539..3742; Strand=+
  SCN-specific regions: Sequence locations=1-152,174-234,261-293,337 -563,593-993,1016-1204
atgcaattcggtcgcattgacaacgaatcgttcacaatggacgtggtcagtgttaagcattgaacatttagcaattaaaaaattaatttattcgtttgcttattagcgataccctctctcaccggttcaagcctttggaattggtcagaatattcaatttcaaaatgaatttttgaatctgttttttcaattaagcaatgagcagcttccatggcaaattggcatgcgaatgaacagagaaatgaaaaagaagaaaaagattatgatgaagccaatgtttacaatttatttggaaaaataaaacaaaaacaaaaaataaaataaataattatatttgggagaagggaattaattaattgttcttttaacaaatagtgtaaatgtgatcatttgctgccacctttcttactgtatgtaccataggtaataagtccaatagaaaaaattccaaatggcgaaaaccatcggaaaaagcagccgcgaatagcggtcaatttgaagtcctttgcgtgaaaaataaatgctttgtcgcagaaagtgatttgtgatcttgtaaaattgggttttttataaattattaaaatttaaaaatgcaataccaaaggattcgaatcaaaatctttgatttccttaatattttcattaatgtcaatgcgttccggcggctttaatgatgcgcgaaactgaaaaattaacagaaccgtttaagtttatttaataatttcaattcgtgagtgattatccaaagcttctcgcgtgctgctgatcattttgtttcttctggcgaaatgtgccgacgacatttattcgtggaggacgcggcacaaaatccaacacgggaatggtcagagtaattttgttttattttgttcagcaatagaatcagtgaataaataagtaattaacagtttaatccaatattaagtacatatttatgtaccaattaagtctaggaattgcagctggtgccgataggatccatcggacaaataattttttatatcttgttaagaaatggtaaatacgatattcaaaaaatttccatatttttgatcctttatacagaccagataaacagcgatttcaattagtgcatgttactatttttttatattttcaggatccattcactggtcatccggatgaaacacgttctcgtggtcagcaacagtcctcgcatatctgcagttgcggagcagttcag

SEQ ID NO: 75715 - DNA, 346 bp, Heterodera glycines
  Genomic contig location: Contig_ID=SeqID_12142; Location=61..406; Strand=-
  SCN-specific regions: Sequence locations=1-2,27-133,188-346
atggaaattaaggaaaaatcaaagaatacttccacaagtgcggtgcttccattaacggcggaagaacggatgaaacgtcgacaaattatgaggacggaagtgttggttggattttcattttaaaaaggccggcttttatttatttttctatatattattaattaaggaaaatgtggaaccttttctcaaaatgaagaaaaaaagtttggaagatgcgcaggaggacgagcgcgagaatttccgccgttttaaaatgtttgagacgagcgcacttcagcaaaaggcaaagtcagaaaagaatggcattttggatgctggttgctatgaatttatggttcaggattga

SEQ ID NO: 75716 - DNA, 801 bp, Heterodera glycines
  Genomic contig location: Contig_ID=SeqID_12143; Location=1059..1859; Strand=-
  SCN-specific regions: Sequence locations=1-801
  Gene Ontology: Cellular component=nucleus; Biological process=pattern specification
atgcagcagaacattttggctactcgattagttcagcaggagcgtgagcgcgaggctgtcaataatttctaccaacagcaacaacaacgggctgttcaacagaaccatctggtgcgaccgctcataatggtgccgaggttgtcctctcaactcgacttggtaaggttttagttttgccttactaataattcgttgactgtaggccaatgttttgttgctacataacccggaaagtgttgacgatgccgcaactttggttttgaacgggggttcaagtgtcacttccgcccttgcccatgcggcaaatccccatcacattgtggccaatgcgatggccactgctacggcccctgagccacagccgggtgagtcccttggcaaatggttttttctgttcaaactttctcctccgacagttggcgtctcccttgaacaaatcaagaaacactcacaaaaactttcgtatgtgaaggaccccgatgtgccgtaagtccctccataataaaaaaaaacctatcgactcattggcttagggagcaagaacgcgaccgatgcacagtttgtctatgcgatttcgataccgacgacgaattgcgagcgttgaactgtactcatttgtttcatacggaatgcattgaccggtggttgcaatacaacaaaaaatgcccggtgtgccgtgttgacatggacaaaggcggtgcgggaagcagcgccatggctgccgaagcagccgtcatgctcaatgcttacgctgctgctgctgctgcagcctcgacaacgtcgaacgcgacctcttgttga

SEQ ID NO: 75717 - DNA, 821 bp, Heterodera glycines
  Genomic contig location: Contig_ID=SeqID_12144; Location=66..886; Strand=-
  SCN-specific regions: Sequence locations=1-87,118-197,219-252,275 -496,599-764,791-821
atgggcaaaaatgatcaaaccggagagaccgaatacggactcaaacaggtaattaacgaaaaaattatctatcatttaataagagtcaattaaaaattactataattttaattatatgatttttcgggcaaaagcttgtgttgaaaagtcgactccatggagaggaaattctgggaataggggggagggtaactcttttctgacttttccgattctgaggtggtcggctagggataaaatataatcttaagattgaagtgaacattggccaagctggtggcttcgtgaattcagcaaatatcacaaaattgcacagacggacgatggccttggccgggtttgacacgtcaaaagagaaaatgccggacaatccgtgcgataccatgctgatcaatgcattaataatggcatggtaagtccaatctggcattagcatctatttaattttatttagcaaaaaaagagttgtataaaatggaaaaaataaaagttatggattaattaattttataaaatggaaaaaataaaagttatggattaattaattttttaaacatttaaaattaatttaaaatgaaaattaaatacaataattattccttggttatataaggcttattattagtttatatatttattgattgtttaatttcttaatcaaattaaaggaaaaagtttgatgacaaagatgcaattattttaattgtcgctggtaaattataccgagactatgagcaatatcagctgaattatttgatggaaaatgtttcaaaaaatgaaataaaaattgttcaaatgtcattaacagaagccgctgaaga

SEQ ID NO: 75718 - DNA, 263 bp, Heterodera glycines
  Genomic contig location: Contig_ID=SeqID_12144; Location=1518..1780; Strand=+
  SCN-specific regions: Sequence locations=1-263
atgatacatagaaaagtaattatagaaatctccacctttaaaatactgctaatttcagttcctaccgtatgcactgactgcgcttgttcaaaaattacgcgtggaaaagccgttaggaacagtgaaaatggcttaaaagcggcaatgtcaggactaaagcaaaaagaaaaaaatgaaatcaaaatgccaaattacagagtttattttcaattagaatagtgaagtgggaagcaaatgccctttcgttaatttattcgattgga

SEQ ID NO: 75719 - DNA, 1366 bp, Heterodera glycines
  Genomic contig location: Contig_ID=SeqID_12145; Location=877..2242; Strand=-
  SCN-specific regions: Sequence locations=1-207,229-357,382-490,558 -575,605-1366
  Gene Ontology: Mol. function=acetyltransferase activity; Cellular component=membrane
cagcctgggctagtttttttcttccaaccatttttgtttcacctccattacacatacaattagaccgagttggagcagaacgagttttggcttgctcgcttcaacgccgcgctttcattgccggtgacggaacgcaacaaaattctcagagaacggcttggccacctcggcgaagggagttcgattaggccaccgttcttttgtgatcacggtgggtaaagtgaagaaagaacaaatctaattggacaattagtcgacaggacagtaaaagaaaaaccaagcctaaagcccaatcactcggttgggcgggggggggggggaaactgcgtaaagccatggtttttttttggttttgacattttatataatttaatttttaatctttgcactaattcgtgaaccaagttcctctaacataacgaacacatagtggctaaatcttcatcagtctttctttaatttctgccttggttcgaaccccaagctgaagaaatttatttattttattaaatttttttaaataaactactattttaatcatcaattaaaatttaattgcttttaagtcttgctacaaataaaaattatatacaattaaatatttctttccttttaaaacttagcttaaaaatccgataaaaattttagccaaaaaattctcattttttttggctttaaggccgcaacattttcctaggcgaggatgtgttcctcaattacaactgttgcgtgttggacgtttgtcgggtggaaattggggacaaatcgatggttgggcccgcggtgcaaatttacgcggctgaccacccccgggaccgagcagttcgggaccagggctgggaatacggaaggccggtgagcattgggcgcggtgtgtgggtcggaggcggtgcggtcattttgccgggcgtgacggtgggcgacggcgcaatcattgggtgagtgggtacacaaattggcaaaaaaaagaagcaatgactgactgataatttattgttcaaaaaaacccgccactgggcgtttcgtttaaccgccaaagagtagaaatgaaaaataaaatcgtaaaattgcttaaaaatccggtccgggtcttgaaaaagccgggtaccggaacccgtccaacctctactataaatcagcgatgttccggcacgtcccgaatccttaatcttagccccgatatctttctcgtcctgaatcccgattcgtctcgaaaatccatgcaatgagtgagaggtcttagcgcaaggaaaatgttcattcaatatttagagcgtatgccgtggtaacgcgcgatgtgccggagggtgccaccgttgttgggaatccggcacgtcaaatcaccaaaaaagaagagcaaaccgaa

SEQ ID NO: 75720 - DNA, 1199 bp, Heterodera glycines
  Genomic contig location: Contig_ID=SeqID_1753; Location=58..1256; Strand=+
  SCN-specific regions: Sequence locations=1-2,49-128,150-414,436 -458,495-784,806-1140,1162-1199
atgaccacctcttcctcctcctcctccttctacattgtgttaccttccaacacgcaggtggagggcaaccgtacaaactcctttcgggtgcgcctgccacgcaaacttcagttcggctcacaatggagtgtgggtttggcggtgttgttgtacccgcattcatggccctcactgggcacaacggaagagcaatttgtccgtgtcgaatggcaaaccggcgagcaggtgcgcatcccggtgccggccagcaatgtgcgaaatcctacacaactgctgaacagcttgcaccacgcactgggcgagggcagtgaggagctggccagccgattgcgtcaaatccagctcagctaccatcagctgaccggagaggcagagacaagcgccaaaaaggaggtggaacgtctcggttcattggggctacaacaacaaccaagaaatcagaccaaacggattgatgaagaaaaacagcaacaacaacaaaaatctgatgaaatgttgaatcaacagcagaatgaacagcaagaggaatggaaacggacagagttcaatgcccattatcgtcgcacactggacacgcttgtcgctgaacgaatggaggaggcggagcgcaatttgttgaacaaacatttacccttgggtctggagctgtgggtgcagtcatatcgcaaggcacgcctgtcctgccgcttcagcttggacgtggagcagcaacggttccgactacagattgacccagtacggatcaaacaggtggagctgtccgagcagcttgcctacatactcggcttccacacgcgccacctgtcttcaccgatgagtgtggctcgctaccagccggacatgaagggcggcgtctcatccttctacgtttatgcacccggactgattgagccggtgatcatcggtgacgtatgcgtgccggtgctgcgcatggtctgcattcgaagtgcacaaccggacgacatggttgaagaggcgtacaccgctgttcagtaccatcagctgatcaccaaagagattgccgaaattttcattgagatcagaaccccaaccggcgcactgatgccctttcaatacggcacctgcacgttgacacttcattttcggaaaactccatatttttgagcacacacgcacatatattgtttatttgtttttcttgcattcacaccacatttatttatttttttgcgcgtcca

SEQ ID NO: 75721 - DNA, 1537 bp, Heterodera glycines
  Genomic contig location: Contig_ID=SeqID_1753; Location=1826..3362; Strand=+
  SCN-specific regions: Sequence locations=1-101,125-497,522-617,639 -655,677-698,723-1220,1242-1537
atgcacgtggatttcgacccattggcggtggactggtcccactttgcggaaccgccgccacgcatggacaccatgttgatgagtggtggagggagttcaatgggtggagggggtggtggtggagcggcgccgtcataccccgtcttcaccggacttccctatcaacgcggagcgggcgggattggctcaatgtttcgcagcttccttcgcttcttggtgccaattggtagacaggcgggcgcggcgatcggtcgccagggacttgagacaggatcacgtgtgctctcacagatgcttgaggggcgtaatgtgaaggaggctatgacggaggagggacgtgccggacttaaaaacttgttggacaaggcggcggacaatctgagtcggcagcgctccgtcgcagctgctgccgcgaccaatcacgggggcgccggcagaagtggtcgtggtggtggtggaggactgtttgactttaaacgttatcgcaagattgtgagcaacaacaacaacaacaacaacaaacgcaagtcgtcgtcatcatcaacaaacaacataaaaaggaataaaaaacggcggacaggcatcttacaatcaactgttggcccctcactgtcaacgccagcagcagcagcgatcgccgccaaaacaaaaggcgttcgttttgacgcattgggttccttctgaccaaagtgtggtagcacataaaaacaacagcaacaacacagcaaaaaaaaacaaaagtaaaaaatgagttgtccaaaaaaaatcagtgagcagagtgcgcttgcgttcaacagcgcactgaacgtgtttgccgttccgcccaccaatgtgtcggtgtcgcgttccttcttccgtgagctgttgccgctgtccaccatcagtcaggagggaccgtatctgttccgcatgttcaatgacaacctgtgggccgacatgtctcgtgtctacctgtttctggagttgtccatccaaaaggaggacgctggcggacgatgggtaccaattgaagcggcagaccaacttgtcggacctatccaatgcattggacaaacgtttattcaacaactcaaggtcacacatacaacatccgaacactcttcacttgcagaaaattaccaatatttaggttgaagtgcaaaacactgagttgtatgacagcggcacattgtacccctacaaggcgtatctgaccaatgagctgtccttcccaaacagtgcaaagggtcatttcatggccagcgcgggctaccatccctcgctgaagcatgacaacccgacggatgccggcttcttggcacgctgtgctcgctttgagggaggacgaaaggctcgcttcctttcccgcctggactttgacctgggcaaccaggagctgtacctattaaacaacatggacgtcctgttcaccatctaccgtgcaaagaacacattcctgttgcaaaacctggcgccagcgccggcggcaggagtagcggccaggcagcagtatgccttgtatctgcacgacataaagctgtacatgaaggtggtggag

SEQ ID NO: 75722 - DNA, 883 bp, Heterodera glycines
  Genomic contig location: Contig_ID=SeqID_1754; Location=485..1367; Strand=+
  SCN-specific regions: Sequence locations=1-846,875-883
atgtcaaacctaagctggatgattttgtacgagccacgtgagggtggtcgtatggtaccccatccgctgttcgaccccggtccggaaatgtcggcgcgcgtcattgccaccgcaccgcttttttcgacatcatatttttgtttgttttttattatcttttaccttacatgtcatgacaatgcgcgcatcacaccgctccgtgaataataataatttttaagccacccaacacgctaatgaatcagacgacagcgtggcagatgctgtcatctccggcggcggtagcggtgtagcatacactgtaacagaagctgcgttgctgaacaacaccaccagcacactaataggcacgacgtcagccgccgccgtgacatcaacgacggcgatgaccgcggcgggggcaagagtggatggggctgttcagatttggtccaccctgttccttttcgccaactacgcaatcgtgctgccaatgttcctactgtgttggatgatggttgtacactggctccgccgctccggcctcatgccgccgcctcatcagtcaccgtcgacaccccaacacccccaccgctacggtggccttcacaccatatttgaggacaccgttgagcagaaggcagggcatgagaaagacgtacggcaacaaaaagaacaacgcagtcacacttcatcagctgctactgtcaatacagaggccatggtgcgtgaggctcaccgggtgacctcccaacttgctgccgcaattccggagcctatgcgtagcgctgtgacctcctccgtggccattcccatccttgtgtcggcggcacaaagtggcggtggtcgaaaagaagcaacgcaacacaacagtgaggaagaagaagaaaaggaacgcaattga

SEQ ID NO: 75723 - DNA, 1303 bp, Heterodera glycines
  Genomic contig location: Contig_ID=SeqID_1754; Location=1610..2912; Strand=-
  SCN-specific regions: Sequence locations=1-159,181-1303
atggctaagaagcataataaggacggcaacaagcaaaacagtgggtccaacgacgatgaaagcaaaggcagcgacagcagcagcgaaagtcggtacgatgatgccatgtcggacacaaaaagccatttttctgtaagaattttaacaatttatttacaatatgattcatctacaaaaaattttaagcgcatggacaaaaataatccgagggtttgccgcttgctgaagaaaaaccgaacggccagtgaaaaggaagaagaggagcgaaacgtgcgtgaatatgatcagctaatgggctacgcgtacgacgacctcatcagcagcctcaataaagagtgggtacggtctaaagtggttacaacacagtcaacactccggaacacgaccacgacaaggatgggatttagcgtttcacagcatgttagcaggacataaacaacctcgcgacagcgggtgcggtctcactcaaccaccaaaagaaaagaggatggttcttcttatgggaaagagcgcaaatgttcaaattgtgggtccgctgagcactggttgtcccaatgtcccgaaagacaggttgtaactcgtgttttcaacccaaaaaattttgtaaacggcatgttttagtagttctttctattaaggaactgcagcgggttcggtcgcattcaaccaccaaaaaaaaggacgattttccatattggaagggtgaccagcacaaatgttcaaattgtgggtccgcttggttgtcgcaatgtcccggaaaacaggtcttttttactcatgttttctgtaaaaaaacattttatggcatattatttgttaaggaacagatgcagtcccatgggctgtatccttcagaagcagtagatatagggcgcactctttgcgggccctattcgactttttttagctggaccttggggttggttggccagcggtgttcactgggcctatttgcgcccaccagacccccgcccccctccgccaggcgtgcatcaacataagcgtatgtgtccccccaccccctccgccacctctgcccatttgtcttccttggcactttgcgggccgtatttgactttttttagctggaccttgagggtgggggttggttggtcagcggtgttcactgggcctatttacgcccaccccccgatccgcaccaacacaagcgtttgccaccccccgcccctctctgccccgtttgtcttctttgacactttgcgggccctgttccacttttttttgctgtgtatatttgttcaacgttttttactaggcgaaacatttgaatgaaaaaaataaa

SEQ ID NO: 75724 - DNA, 747 bp, Heterodera glycines
  Genomic contig location: Contig_ID=SeqID_12147; Location=138..884; Strand=+
  SCN-specific regions: Sequence locations=1-7,29-349,371-379,401 -542,564-613,636-725
atgaaggtgcacgtaatgattgatcaaatcttgatcattttggttttcattgggaccatatgcgataacaagccttcgtattgcctgatcattaatcggcggattttaagcgaaaaaaataggtaaataaataagggcataaaaattgcgaaaaatggtaaaataggagcgaaaatttgaaactcagtgcgttttttcaatgaaattaaattaaaatcgatgaaaataacttattgagaaaattaattacaaaggaattgaatttcattcttttttcgaagcaaaaaaataattggggtttctacagaaaattctttttttcagttttttgttagtttgtattcttaatcattttttcatatctttgatgaacctattcaatgttaagcttttaatggttaaaaaattgaatgtcaatctttgtgactagtaattttttcgaatttgtaattagttatttttgtcgatggcttatagttttagtaaaacttattgataatagtggaatttttatgaatataatatttttgacagcgcggcgcaaaagtccatttttgctgggcggtgcaaatgtcgcggcgcaaatggagcggcgcaaatatccgcggcgcaactgtctgcggcgcaaatggcgcggcgcaagtgtcgactttgctgagcggcgcaagtgtccacttttgctgtgcggcgcaaatggcgcggcgcaaatgtctcatcacgcaaaaatacatataaatatgtatgtaa

SEQ ID NO: 75725 - DNA, 186 bp, Heterodera glycines
  Genomic contig location: Contig_ID=SeqID_12147; Location=1189..1374; Strand=-
  SCN-specific regions: Sequence locations=1-186
atgaaggattattgtagagaacgagccagaccggatcctggcaaaaattcgccggaccggaccggattggcactttcaaaagaccggattctggatccggtctctcataatccggtcaatccggtcaatccaggtttttctcgccggaccggattgccggatccagaaaatccgataccggatccg

SEQ ID NO: 75726 - DNA, 773 bp, Heterodera glycines
  Genomic contig location: Contig_ID=SeqID_12149; Location=630..1402; Strand=-
  SCN-specific regions: Sequence locations=1-773
atggatttaaatggtccaaccatttcaggcccacccgacgaccatccgcacgcgtcggatggtcaagcgttggccaaatggctgcacacgccgcgcgcggacggcaggccgaaactgctaaatgtggaggcgatgacgggccaattccacgagcaaattgaacgactcaaagaagtgagtgatgatgagtgggccggtcaatttggcatcattttacttgcatttaaaaaaagaaaattatcaattaatgaattttaccccccgaaaattatggatttctttttaaatatgggtgaaatatatcgaatccatgtcccgacatttgcgcctttgtccaaaatcgggatcaaagtcaagttttttcaatccctgatcgcctaaacagatgttaggcgtaagggatttaaacattccgttttatggtgcgctgaaaaatttagaaatttctaaagaaaaaaatttgttagccgatttcgtcaatttttttttttttggattcgaatcctcttttaaagttctttttttaaatctctgatagtcacccctcagaataagcaaggggacggccgaaacaagtccaagacgccgaaaaataacttttattggtaagtttatccctcattttttgtgccattttaggcctttttgttcgcctcgtcgcccgtcagtttcgccatccgtttgtcgatgcatttgcccggtgcgtacgttccattcgccgtggacaatggccaaacgcaggaacggctgacattctgttgcattgacaaaag

SEQ ID NO: 75727 - DNA, 59 bp, Heterodera glycines
  Genomic contig location: Contig_ID=SeqID_12150; Location=477..535; Strand=-
  SCN-specific regions: Sequence locations=1-59
atggcccagcaaatttggcccctggcggcgtccaatgtgtgccagctgagcgtggacag

SEQ ID NO: 75728 - DNA, 1346 bp, Heterodera glycines
  Genomic contig location: Contig_ID=SeqID_12152; Location=1..1346; Strand=+
  SCN-specific regions: Sequence locations=1-98,122-243,265-507,529 -814,836-918,940-1000,1022-1048,1081-1346
  Gene Ontology: Mol. function=metalloendopeptidase activity; Cellular component=membrane fraction; Biological process=prenylated protein catabolism
tcagattttgacaaggcacgcgcctaccagctggacaatatgcaattgccatttgttaacgacgcattcacttttacgacttattcggtgccgctttattctataaatttgagattattttactaaagttatctccaaaaaaacacaattttttgctctaacgcagcctaaaagtatgtattacgaaagatttaaattccccccccccttttatttttcaaaaaaaaatgcaataaaattgaaaaataggcccaaaaagatagaaacaattgtaggaatatctgagttgacaaatttgtattaatgcctacctttgtttagataatcattttgtgcactctgtacccatggatttggagttcgtgcgcacaaatggcctcatgggcttggccaggtggcgccgaggtccccccgaatttacgaattttctcaaatctttttcaatttccagatttggcactccatcgttttcatttgggtgtcttccgtcgtggagacgctcatttcgttgccattctcatattaccacacatttttcattgaacaaaagcacggatttaacaacgaagtgatccaacaattttttgcccactttttgccatgaaattcttttcagacagtgccatttttcttcaaagaccgtgccatgaaattgggtgtcagtcttgcgctcagctcaccggttgtggccctgttggtgtggatcattcgaaatgggggcccgaacttcccgatttatgcatggcttgccctttcgctcatcatttttgtgcgttttttcgaatttttttgtcagttttgatcccagacacgcaaaaattctccccgtaaatttgcataaaaatttggaggtcagagcacgcggagttctttcgttttttgaccctttccttccgttttctttaaattttgctataatctcccaactttgttcttttgaatttttttgctgtctttgtaaacatttgttcttctcactcgtaaattacggtgttttctcgaaaaacataataatttatcataaaattccaaaaaaaaaaaatcgcggaaaattttttaaattttttttctttaaattttgttgtgttcaggtgatgatgtttgtttaccctgaattcattgcgccccttttcgacaaatattcccctctgccggacagcgaattgaagcgcaaaattgaggcgttggccgaccgtgtgggctttccgttggccaaactttacgttgtcgaaagttgccatgaaaaattattggtttatccgcttttttgcattttcagattccaagcgttcctcgcacagcaatgcgtatatgtatggcttttggaacaacaaacgcatcgttct

SEQ ID NO: 75729 - DNA, 301 bp, Heterodera glycines
  Genomic contig location: Contig_ID=SeqID_12154; Location=1393..1693; Strand=-
  SCN-specific regions: Sequence locations=1-98,122-301
aacacttcctcagccaatgacaacgcacagtcaaaccaacagaaagaacaggttcagaaggttggtatctcatttccttctgtctgactttcttttcattacttttataaatttattttttcagtggaaagtcggtgatcaatgcatggcactctacgaagtggacggacagtggcactcggccaaaatcgagcagatttcgcctgaggaaaacacatgcactgtctcttacattggttccgaccggaaggccattctgaagttggagagcattgtgtatgtttttttttataaatcataa

SEQ ID NO: 75730 - DNA, 762 bp, Heterodera glycines
  Genomic contig location: Contig_ID=SeqID_12155; Location=449..1210; Strand=-
  SCN-specific regions: Sequence locations=1-116,163-305,327-584,608-762
agttgtcaaggacgccgccaaggaggcgggaaaaaggccgaaatgcctggacgggacaaacgaaacgacgacggcaccagcaacgacgacggcaacaaattggctgttgtttggaatcgtcgccgccgtcgtcgttgttgtcattgtggcggttttcgtcataatctggctctgccgcagaaggaaaagaggtaatttaacttaaaatacgtcgggtttaggttactcggcacaatttaaaaagaccgaagctgcaaaaatgctttcttttttcgggatcatgattttttcggcggggcataaacgaaaaattccattaaatattttaattggccattatcaaaacattacatatttaattaattattttaggtagccaggttttggatgacaccgagtttggtaaaatgtatgatcggtcgacttcgaaaacattggtacttctcccttaaattgctgattttaaattttaatggtcctattcagaacacttcctcagccaatgacaacgcacagtcaaaccaacagaaagaacaggttcagaaggttggtatctcatttccttctgtctgactttcttttcattacttttataaatttattttttcagtggaaagtcggtgatcaatgcatggcactctacgaagtggacggacagtggcactcggccaaaatcgagcagatttcgcctgaggaaaacacatgcactgtctcttacattggttccgaccggaaggccattctgaagttggagagcattgt

SEQ ID NO: 75731 - DNA, 539 bp, Heterodera glycines
  Genomic contig location: Contig_ID=SeqID_12158; Location=1513..2051; Strand=+
  SCN-specific regions: Sequence locations=1-19,48-70,115-127,150 -150,172-177,215-229,258-321,364-428,453-480,502-539
atggttaatgcggaggttcttaaaaataattattataaaaaataaaagatagcacaaaaagtcgcttgtataaataaaatctaacaaatgattaaaaaatgtattataaaataatgcaaaaaaaaaatttctgtttttaatcttattacgttaaaaccaataaatgaaaatgaaagtatttaaaatatcttataaaacaaaaatcctatttttgaagtaaagtgtgtttaatcaataaaaaattatctaaataaaaacacttgataaataagggaataatatttatattggttcaaaaatttcaggtgaacctatcaattgaaaatataaattataaataaaaaattttaacaaatataaaaagagatgcacgaagagatattaacaaaaatttcattgttaagaatgatggaatatcaaaatgtcttaaaatgaagaaataattaattaaacaaaatatgaaacgagagcaccaaatgcatatttaaaacatagtaatgataatcaagtaaatgagagtttaaactacgagaatataa

SEQ ID NO: 75732 - DNA, 1048 bp, Heterodera glycines
  Genomic contig location: Contig_ID=SeqID_12159; Location=581..1628; Strand=-
  SCN-specific regions: Sequence locations=1-12,36-105,128-253,286 -295,317-631,653-809,841-1048
atgaatttgtgctatttaatatttttaataattttcattgcttttaaaattgaatccgggaaaatccgaccaaattttgacgaaatatttggcgaagaatggaataaaaatgaaagagaagaaaaggcgattaaaattgaacaaaatgagacaaacgagaaatcacaagcagcagttgatcaaatgggtgaagaaatggcgacatacccaaatgatcaacaaaaaagagaaataattcgaaagtttgaaacaattaaagaaaaattgagagaaagaggaaaatatcaacggaaagaccgacacaaaattgatgtgaaaattggaagaattttaggagcaaaatactataaaattaaaaaatggaaaaaagaattaaatttaaacaaaaagaaaatgaaaaagagctttatgaggagaaaaagcgcgaattcattggacgatttgatgaatttaaaagtttatataaaggcaaacagaaagaatttgtgaaggaattgggcatttcttatgacacgtttataaaatggaaaaaagaattggagccaaaatgccaaaaaagtaagaaaactatttaatcatttaattctgttatttttattcaagcatcacataaatattccgataggacaaattaagaaaagtaaagcaatatttcaaaatgaatgaaaaaataagaagatgagcaacaaaaaattgcccaagaattggaaattggaattacaacttttttcgatggaaaaaggaatttgctacaatttcgaaactttgatttatattttccatatttattagcatgattcattcttatttatgaagctgtttgttttctttgtgtcttctgatttaaattgggtcattttaaattaaatttgttgatttgaaaaaatgttaaaactcgaactaatttgcttttttaagtaatttaattcattgctaacttggttttatattttttttagtcataaaaattaatttcttaaattgtaacaaattgaaaaccgttgatgaaaacaatttctttgtccaaatgcaaggcatttaaaataaa

SEQ ID NO: 75733 - DNA, 826 bp, Heterodera glycines
  Genomic contig location: Contig_ID=SeqID_12161; Location=894..1719; Strand=+
  SCN-specific regions: Sequence locations=1-553,576-826
atgctcaaccagcggctttactcattgtgccgcatcgattcgtcgccgaaggatctgaaggaggccgaaagggtggactttgtgcgaaccattctctcgccccaatcaattttccgccaaactcctgaagtctctcccctcattttgtttttaatttttgcttttatttcatcttttaaagatcgcccgtcttttggtttgtctgatcgtcgacaatgacattgatgacctgacaacacttggcaaagctgcccaacgtctcgtccaacttcgtctgtccgtccctctcttggaattgctgaaatatttgcgcaacatcaagggaaaggacatcagaaccatcccaaacatttcggcattttttgctaagacctttgaggcactctttgacaagatcggtccgctttattcgcttgtctaattatgacaattaattaataattagtcctcaatttttatcagatgcaccagcaactgatcggaaggaacttgcttcgctcgttttcttcttgatcaggtaggtactcgttgaaaaggctgtttaaaaggaatcttaaaattattttaacttcatttaatcgcaattttttctttttgcgtattttcagctgccccgttgagggcgatggtcatttcgctcgctccgtttctctgctggcgtcgagtggtgccaacttcgcctcttcgttggtggccatttccgataattcaacgggggtaccgttcgtaatttaatttttctcgtattagttaattacttttttcacaggaagtaaatttggccaatgaaagtggaaagatgactgatttgtgtggtggaaattga

SEQ ID NO: 75734 - DNA, 504 bp, Heterodera glycines
  Genomic contig location: Contig_ID=SeqID_12162; Location=454..957; Strand=+
  SCN-specific regions: Sequence locations=1-159,181-223,272-360,382 -418,454-504
atggccccttttggcaaaggtgcagaattgtggtcccgatgggaattgggagccctgctttttatgatgaataactggtgatttgtattgattttatcgagcaaatttttgaagaaaaaaataacatgctttaaatgaatgaaatcattattggatttttattctctgaaaaataaaaattgatgtcctatttcaacacttttacagcatgttttatcatcggtaaaatagaaaaaataaataaatttttagtttttaattaattaattaagaagcatttttcgcgcaaaactcaaccgctacagcgaacaatgaaaaagagaaaagtggcgaaaattgcgctgacggaccgaaagttgcgacaacaattgaaagagaagaagcagagacaccaaaaagtgacgatgaaaaagaaacgaaatatttaacaaaataaataatatttaaaatttagttcaaattagaaaaacggaaacgccaagaaaatcgaaaagaataattcaa

SEQ ID NO: 75735 - DNA, 1228 bp, Heterodera glycines
  Genomic contig location: Contig_ID=SeqID_12162; Location=1087..2314; Strand=+
  SCN-specific regions: Sequence locations=1-298,325-376,398-483,506 -1228
atggaactgctgctgctgacaaacacagcagttttgcgtgaaattgtccaatgcaatttttatttcgttggcattccgtcggtcgacgaaagtgacgcgattaaatcggcaaaaattttgtctgagaaaattgaccaattcgccgaaaagtcgacggagcatttggtgatgaaacggattcgactgaacctagcatttatcacaatgtctttggaaaagtatttccaaaattattccacctttttcgaagcgttgaaagaaaaaacgactaaggaaattgatgaactttttcgcgattttggaaaaatggcacaaaaatttaacgccgatggcacggcaaacattctgaacttggaaagcgttaagccaaagctgctttattacttctttttcagctgcttttaccgcaacttgatgctaagaacaaatctggtgattgtttctagagccaggacgggattgggtcccgacgaaattggaattaatccccgggtcgggaggtaatcctatcccggtcttatttcaatactgagtcttggttcggcgaattagagtggttgggatcctgacctgatctctacatttgatctggaactgtcaattttttagtcagatacaatggccaacaaacaattgctgagttggctgtactcaatggaaaaggcaatggacggtcgaatgagtgaaatcattggccatcaaaacccatcgcattccgttccaaaaaaggcaacaaatgaatgaggagagaattgaaaccgtccactttatacctttttaaggacttagtttaaattcattttgtagaaagttttgctctcttagaattttcattgtctgttaggtttttgaagggacaacggaaacgaattttatgtatcttttgtattttacggtattattagagataaagcgtagcaaacaattttaatattcgaagatgaaaaaagtgattatggggctaaaaaagaacgcattgaaagcaaaaacagtacttgaaaaggaagaaagagcaaattaaaacccaaaattcaaggacaaaagacttttgcactttcaatcacacagcttgagattcaagaattgtcgttgcaagataattaaaaaaacataaagcatgtttaagatgatttccgcattgggacttcgaattccacggcaatttccgactcttgaagaaattttaacaagaaatgccacgctttttcttgtggggccggaaattaaa

SEQ ID NO: 75736 - DNA, 1506 bp, Heterodera glycines
  Genomic contig location: Contig_ID=SeqID_12163; Location=565..2070; Strand=+
  SCN-specific regions: Sequence locations=1-231,254-545,585-776,798 -1109,1138-1506
agggatccggacagcgaggaaacgaacaaagcgacgaggaaaggggcgccgatttcatcggatattccccgataatcccaggcgtatgtgaacattttgtattaaaataattaacttaatcacgaaaattctataaaactctaaaatattttagcaacgaattgtcgatgtgaaaatggcggttgacttccgaaggcaaataacaaagtacgccttcacatacaaaatggtaatggaactgtttgagtttgaatatgtgagcaaaaatgaattggaaaatgcggacgaatgcgccgtttgtttaaatgaatttgaggaagaagaaaagttcgtcatgatacataagaatgagcggcaacagacaaagccagtaaagaattgaaattaaaattgaataattaaataagcattgattaagcatgtgtttcatgaaagctgcatctttaaatggtttgtgttgataataaagtaatgagctcataattatgcattgataggtttgagaaacaccgaatatgtccaatgtgcagaaatgaaataaaagcaaaaaaagtaaaaagaaaaataattttttaaattataaacttctttgattagtgatgtaaattaacaagtttcttttaccatattggcaaactaaattttaattttcattaacaaatgagagtgttaaggtgatggtggattttcaatgaaattttgtaggtgggtagacagaccatccctgggttatattacaaaacaaattttcctaactgcggaataaatttaaatcataatttcaaaattagttattttcaagtgtagaaactaaacattttttttgtattttttgactttaatttgtctaaagacataaataaaaaaactaaaaattaattggaatgcaacggattagaacctcaaacctaaaaaaccaggggtggtggtcccctcccacaaatttcatttggaaattgcaccatcacctgaacactttctttgtaaattcagcagataaccttgttgccgctgttgcaagctgaagatgagcagcagtaccaaactgagtgtgaaaatgcctttgcctgtctcatcgaaatggcggaaggcaacgatcaaaacgaaaattccttcaaaagaagccaagcaaaaatcgcattagatgaaatgacaaaatttgtggacaatatgaatagggaagcgatcattttattcggcatggaacgagaagaaatatcctacggagagcgaatgatcggaatggaaaatggtcaaattgtgctgattagccggcaaataccgatcaaagagtcgcttgagataattgtgcgcaatgctccacttcaagcactgatggagatgaagaaggaaagtgccatcaaactgcttaatgaaataaattgtgccgatttgaagtttcggaatttggcactgcaaacgatgcaaacaattgaaataatgacagaaaacgaaactgaagctgaggaggaaataatggccaagagattgcgattgatttattag

SEQ ID NO: 75737 - DNA, 2452 bp, Heterodera glycines; identical to SEQ ID NO: 12164
  misc_feature (1161)..(1161): n is a, c, g, or t
  misc_feature (1183)..(1183): n is a, c, g, or t
  misc_feature (1185)..(1185): n is a, c, g, or t
  misc_feature (1204)..(1204): n is a, c, g, or t
  Genomic contig location: Contig_ID=SeqID_12164; Location=1..2452; Strand=+
  SCN-specific regions: Sequence locations=1-2,25-239,262-995,1017-2452

SEQ ID NO: 75738 - DNA, 614 bp, Heterodera glycines
  Genomic contig location: Contig_ID=SeqID_12165; Location=418..1031; Strand=-
  SCN-specific regions: Sequence locations=1-278,307-424,447-532,555-614
atgtccgtccgcaaatgtccgtccgcaaatgtccgtccgcaaatgtccgtccgcaaatgtccgtccgcaaatgtccgtccgcaaatgtccgtccgaaaatgtcccactgcgagtcaaacaaattaacgggggcggagtcattatttatttttggccataacttttttgagttaacaaaaaatttttttttttgaatttttcaggcaatagagaacctttaggcctatcgaatgatattaagaatgaaaaatttggttgctttagagcaaagttataagaaaatttttttttttttttcaaaaaattcctcaccgtctgttcattttttgcggttcaattagcacaacaatttgccgttttacaactgatcgatgtcacaaaaatgctgaataataattgtctttctctaaacaataagcaacattttctttctgtattatttttatagtcattgaaaccgaactaaaaaattcgggtagaaaaaaagcaacgaaaagatgtaaaaaatgcatcggttgtgttgaatttgtgcgcttttattgttgattttttaaaatacacgcccaattcgtgatttcaaaaaaccaaaaatatacccctaaaaaccgaataaa

SEQ ID NO: 75739 - DNA, 586 bp, Heterodera glycines
  Genomic contig location: Contig_ID=SeqID_12166; Location=88..673; Strand=+
  SCN-specific regions: Sequence locations=1-281,303-420,442-586
  Gene Ontology: Mol. function=nicotinic acetylcholine receptor -associated protein activity; Cellular component=membrane; Biological process=synaptic transmission, cholinergic
atgaatcattcgatgccgacgcgggtcaatttcacgatgaggcgagcaattggggaacagagtgaaattaatgcaaatttaagcctttatcaagtattggcgatcaatgaaaaggtgcaaagtgtggatttaaacttgtggatcatccaaaagtggaaggacgaattcctcggatgggacccgcacaaatacggtaaaataccgaaataaaacggcatatctgatcattaatactgctgtttccaagaccaatttaattaatttattcttttctactgcaccttaattatttattactttttgagagggacggaagggagggggtaattaaattaataaatatccaattaccctgcttgggatgagttgccctttctcggctacgtgtgccattttcccgactgtatcattcaggtggtatcaatgccaccatccttccctatcaccgaatttggctgcccgacacgtatttgtacaattcgatggtgatgaaccgcgacgaagtgagcaaaaaaacagcagagaaacagtgcatttttaaaacatttttagagcgaacgttacataaatgtgatcgtgagcacag

SEQ ID NO: 75740 - DNA, 982 bp, Heterodera glycines
  Genomic contig location: Contig_ID=SeqID_12167; Location=1591..2572; Strand=+
  SCN-specific regions: Sequence locations=1-93,115-299,323-658,681-982
atggcaaaaggacaaattggcattgaccaatcatcagatgaaaagtcagaaataaataaaaaaaagtcaccccgaaagagaagaggaacagttaaataatcaaaaaattcagaaaaatggtgccgaaaagaaatttgacggctggaaatttgctgcaaaagaggcggattagcagcggtggcggaggaaatagcaaaaaatggaaaaagccatggacagcaaagggaattgacgaagaaatggcagagccaaatttgggagagtcggcgggcgaatgggcgatgttggaacggtcaattgaggaggaggacgaggagagcgaagcggcgacggaatggcgaagtgccaacccaaacagcggactgaacgaggaaagggcggcgaacgcgcgacagaattggcgacgcatagcgcagaaagcgtgcgcacaacgtaagaggaaaggaaaaacctcgtaaagccgatcgaaaggattatcggacaagcaaaagccgaccaaaaaagattggcaagattagctatgccattaatcagaaaatgatcagcagatcaacaaacggacgaattaccatttaagtgatcagatcgaataattttgggctaaccgacttggaaaaaccggcaaatcctactcgtttatagtgaccgaagaactgattggttgatgaaatgcttccctcgagattcagaccgagatgctcttgagcgggctcagcccaccaattctgccggaggccgaattcccgaaagagagtcggaagagattccattcgcggatttgtcaccgggccggctttccttggcatcccccgcccgtcacttcagcccctcctcaccccacggcatttcctcgtccgttctgtcgccgcggctccttccgtcgcttcccaatgcttcatcatcattaactgctgcagcttctgcgactgatcgtcctcgtcatcctcccaatgcttcatcatcctcagtaccaaaagcaccc

SEQ ID NO: 75741 - DNA, 2735 bp, Heterodera glycines
  Genomic contig location: Contig_ID=SeqID_1756; Location=668..3402; Strand=+
  SCN-specific regions: Sequence locations=1-397,419-637,699-849,877 -880,902-931,953-1041,1064-1119,1143-1449,1481-1492,1514-1662,1692 -1842,1884-2295,2317-2435,2457-2470,2508-2532,2554-2688,2729-2735
atgaattctaataaatcagagaaagctaacaccgttttagtggaagctgctaaaaaagagacagagagagcctggagggatgtagaggcattagcagaagaagttggtgattttgccaaatcttcgcgggaaacacttaatcgtgcaataaaatctagggaaaaagctcctaatgctaatggggttcgggaattgtatcttaaaatgtcagattcaatttgggaaatattcacaatccttgaccaaatcaatttggagtcagaaaaagccgaatctacgtggcgtgatttcgagagatgcaaaacttttgaccaggcaacaaagctcgaggaacaatcgcaaaattcattaattgaagcccgaagattacattttgagtcccgaagggtgcagagccaaatgttaaattatgaaaataggctccaaacaattgtttgggagcatatgggtatataagaacaaaaaataatgatataacaaaatggaaaattgtgccataattgagacatattgtcataaaaacttaaaatttggctttaaaaaacacaaaaccaaattttattttgtcaatccattttttgttaatgctgagcaaaaatttaaactaatactcacatcgctaatcgatgaaatttataaaaaggaacagggaaaatttaaaagcattttgaagctttcttttggttttgaatcattttattgccctcttaaatgccctagcgaaaacacagccgaggctttgttccaacatgtcctattaaaagaagaattatattcgcttttctatcctttggatgatgtcataacactagaagtaactataatcccagatgtcaacaatagaccaagaaattaattttataaaaaataaaattacgagaaattggaaaatttctggaaaaatacttaaacgatcaaataatctcgaaatttttgcaaataaactttttaaactggcgaaaaatttttatattttagcctttagtgccgctgaaatcgaaaatttatatttttcattcttagaaatgctcgataaaattcaaaaattaccaaattttattctgcatgaatatagaaaccaagccttagctatgcaaaaattggaaattggactcagagaaataaacatatttaaatgtcaagaagccgagaatttatcggacctttctttttcaaagatagatgaattcagaaaacgagtgcaaaattatcgatttgacacgagaatgttgtataataaaatcagagtaacagcactaaggcatttatttaaacccgaaaaggaaatatttctctcgccttttagaatttctccagggaaagaacttttttacagcatattccgtacagaacccaaaaaaagaaatttttaattctacattttacaattatatttagcacaaccaatcttgcgtaatttgaagatcatttacaaataatcacaccatattcttttttgaaaattttttaatttctctttagaaggaataagtaatttatttaaaaaaattttccttggttatgtgctcccaacagcgataaaaaagaaaaaaacaatcgttccgcctaatgttatttcggttgataaaaaactaatgattgtcaatgccctaaggcaatttgcgcaaaataaaaaattaattaacgaaaccataatataagtaagaataacatgtttattgaacaaaaaatgttgcggagggtgttattgtatatgaaaaagtaataaaaaaagtgaaaaaaagtaaaaaatttcatcataaatagctgggactagtcagaataaactatcacaaaaatggcatctttgagcgtttcacatcatggttcccatccaaatggtttttattttaatttattttttataaaagtttaataaaatagacatttgcacaaaaacattcgggccaattatccaaaatcatcaattcccaactgtccaatacttcgaagcgaaactcatcggccacgggtgattatttttgctttaatcatttaagttttaatattagcacatatgggatcggctttgcaagccgggaatatgcatcaaatgaattcattggttggagccacgactccatcggttgggactcgatgggggatattcaaggttagatcatttggggtaactgggatacaaattccgggcactattgttaaaataatttagggctggacgcctttggcggccctgaagtgctgaagtggcacacaatgggggctgaagatgtcattggcgctggttttctcgaagggcgcccattttttactctgaaccgggaacttttccgtaaaattttcacccgttttttaaattgaattttttcttaggcattgacgaggtctgcgtggaacccggccgctttgccgcatttccaactgtttcaatgattggcgaggggtcttccgcgggcgtgaatatgggacccatattcatgtttaatttgaaaaaattgttcatgccgtagccaaacaaaccaaaattttttaaaggcgcaaaaattgatgagcataatttccaagaattttgaggtacaatttttcaaaatttgctcccaaaaaaattggaaatcattgtgaattttttaattttaaacatttttctcgagtttttttcattttgtgtgtgagcaaaggatattccctatcccttgcccattagtaccggctacgattttaattatctgttgttgttgattatttttatttgtattgtaaaacattttgttaaa

SEQ ID NO: 75742 - DNA, 1221 bp, Heterodera glycines
  Genomic contig location: Contig_ID=SeqID_1756; Location=4080..5300; Strand=-
  SCN-specific regions: Sequence locations=1-153,175-175,206-407,455 -462,892-895,933-1005,1098-1221
  Gene Ontology: Mol. function=cytoskeletal protein binding; Cellular component=cell-cell adherens junction; Biological process =intercellular junction assembly and/or maintenance
atgaaaagctgggtgttatggatatttgtgagctggtataaagctagaaagcaggggatggtaccaggattttggaagggggtggggtgattagccttccgggatgaaggccttttttcataccatttttgaaggtgttctcgaaattgttgttttggtattttttaatttaccctattttattttaagttttaaaaaataaaatccaaaatccagaccgtattttttcaaaaattttcattaaattatgtcttggggctgaatatctttgttactgtgaccatccctgaacaaagtgaaaaaaccaacaaatcatgttttcctcattgcacagtccaaatccgccatctatagctatgatcgagcttggtgcgaaagtctaggcaagaaaaaagaacaagatcgacaagaagaagaagcagaagaacaaggggaagaagaagaagaagaagaacaccgaccagaacaagagcgacaagaacaagagcggccagaagaagagcgaccagaacaagagcgacaagaacaagagcggccagaagaagaacgaccagaacaagagcgacaagaacaagagcggccagaagaagagcgaccagaacaagagcgacaagaacaagagcggccagaagaagagcgaccagaacaagagcgaccagaaggagagcgaccagaacaagagcgacaagaacaagagcggccagaagaagagcgaccagaacaagagcgaccagaaggagagcgaccagaaggagagcgaccagaacaagagcgaccagaaggagagcgaccagaagaagaagatcgaccagaaggagagctaccagaaggagagcgacccgaaggagagcgacaagaaaaacagagacaagaggatggggaagaagaagacggggacgatgatgatgatgatgatgatgataatgaggatggcgccgtccagtgcaaagtgattttgcgaagaggaggcgaaggagacgatgatgacagtgctggagggaattcgggagggaatggtgcaaaggatggtggagggggagatggagaaaaaaagggaaatgatgggaaaaagcaggaagaaagaggagggggaggagagaaagcaaacgagcaatacaaaaatggttcaaccgaaacagccggaaaagcgagcgaaccgtacgaggaagcgaaggtacaaaccattctgagcgacaaaaaataagtgcatgaaaaaataaa

SEQ ID NO: 75743 - DNA, 1225 bp, Heterodera glycines
  Genomic contig location: Contig_ID=SeqID_1758; Location=17..1241; Strand=+
  SCN-specific regions: Sequence locations=1-392,442-811,833-982,1004 -1098,1120-1225
atgcaccaattgttgaccatcccgatgccatttattgaacactttctgcaccgacttggcacatttgttgaaaggtcaccagttgggtgattaattaattgatggtcaccaattgtcttaggacaattaaaaaagacgggggacgaggccccgcccacaatataagaaacttctcaatttttttttgaaaaagaaaattataaattcgattacctaattttcttcttaccaatgaattgatcgaaaattttggaaagaattggacttttcagggatttgggaattgagttttgtacaaaactaaatttattggcttcatagaacatgaaattctgaataattgggtaaaattaaactggaacaatttaattcaaattgagatcagttttgtgaaaaaaaaaatttaaatatatttaaagaataaataaaatttattttaaagaaatttggatgaaagcgttaaaacagccgactgggactttataaaaacaattcaattggttgtttcgatggaaaatgatggacaaaaattagtggcacaaaagcggcaaaaggctattgggccggatgttagcattgactgtttcaaattgctctactcattggccattcgtttgtgcttgcaaattggccaaaacgaagttgcgcaaaaatatttgccaacattttcatttgcatggaattttaccgacaaaagggcgacgaaattgtatgtttgtacataattttaaaaaaattgtccaattatatattcaacccaaataaaataaagattgaaaaataatattaaaaagaaatttgtgggttggccttttattatttctttaaaaaatttgtttaatccgaaatttgcctggtgttaaactcaacggattacctattacgattgttgaaattttgaggcctaagttatctagacctaaaattttcaaattacataccaaaatactgttgtgagtataagacgtctccgtcgctatagtttattcataaaaattaaacaattcaattttttctaatttagttatacaaaatcgaatttcttcgaatacaaaatgaatattgcaaatgaaatggttgaaataaatttgccaaattgggatttgccatattttgtgtatttggacaatgaaaaagagtttaaagtggaaaatgttaaaggtaatttgatatttgtacagctaattaataatgaatagcagagcaccaaaattggcaaaacgca

SEQ ID NO: 75744 - DNA, 1136 bp, Heterodera glycines
  Genomic contig location: Contig_ID=SeqID_12169; Location=645..1780; Strand=-
  SCN-specific regions: Sequence locations=1-70,95-332,354-429,451 -674,697-906,928-957,980-1091,1114-1136
atgtccaaaggtaaaaaattaaaacgaaaaccccttggatttttcggaaatttcagtacctaccttaaccctaataaaaattttaaactttagaatccgagcggaaaaagaagacggaaaagcaaatttccgtgcccagcaaatgtccattcaaagaggaaattttgatggaggcggaacagaaacggacggaggcaaaggtttcccaaaaaaattcattagtgccgtaaattgtgcaaaatttttgattttttcattaatgccatactcggattgccatcccttttttgttgccagtgaaaatgttatagagcctctcattcaagctaaaaattaagaaaaatgcatttttctaactccgcttaaatttcaaatttgactggatgcgcgcgattgaccctaaaagtcggaattatttctgaatagcttaatcctatcaaaaattgttgcggtaaataatctagcaaccttaatgcaccataacgttttatagaagcatccaaattaaatatttataggtagcccaaagggagccccgacttttgcggcccagacatttgtgcctatgtccaaaatcggactcaaagttgaattttttcaagccctgtcagattaaacagcattaaaattaagaaaattcggtcttgtggttcattataatcaataatttgttgttttaaattttttttattttttgaaaaatccattaacgatcaaatgatcggataaaagcactttaaatcacttatttatggctgtttagtggatcaggaattaaaaaaaaaacttaattttgaacccgattttggacatagccgcaaatgtcgggcatggcccaaagtgacccctgaaattaaaaaaaatttaatggcaattactgtttcaaaaaaaaaaaaatttcgaacaaatcggtgaaaatttttctagattttttttcttcaaaaatttctacgttagtaaaaaaaattttttttaaaatggcaaaatgatcattttcggcaaaaaaatggctataaattcctgctttttgctcccaggcgctggaattttttaaaaaacattgcacaaaaaatagaaatttttttttagttttcaacattttttatacctgtgagtttaacattgtttcgaataaa

SEQ ID NO: 75745 - DNA, 177 bp, Heterodera glycines
  Genomic contig location: Contig_ID=SeqID_12170; Location=542..718; Strand=-
  SCN-specific regions: Sequence locations=1-58,80-177
atgccacaaaatgtgatggcggtggacacgctgtacgacgcggcgtcggattcgtcggccgcacttcaaaaggcggcacaatgccaaaaaagcggcactgttgttgtcgttgcgtccacaaagcccgtcgaggaaagcgaagaagcaaatgccaacgaaatggatatggcgacgacg

SEQ ID NO: 75746 - DNA, 1434 bp, Heterodera glycines
  Genomic contig location: Contig_ID=SeqID_12171; Location=2030..3463; Strand=-
  SCN-specific regions: Sequence locations=1-74,96-210,232-469,510 -1132,1155-1360,1403-1434
atgctaacggcatttatgaaaggtcaccaagaaacgcaattgagtgaatattcaaagcagaaatgtgaagcgcatcttgggattttgtattatatgaaaaacaattggcaatgtgacaaaattgatcaaaaatttgtcgaatctgaacggacagaatgtcaaaatatcgcaagtctcgagaccgaaactctcgagcagcactagtatttaattgtcaacatttttatttaaaaaacgcattttccatggtaatccatcggcttctgtaagtgttttttcttattctttttatttttcattgatattccttctgtctccacttttcctttgcttttgttggttttataaatttcactttattttttgatttttggttaaaaaaattttgggtaattaatttaacacattttttccgatttgttgccacttttcatttgcttcagttccgccgattttggcattgctcgcctttaaaaatttaagattttaaaaatatttatcttaatattgtcattttacaccagggctcggatctgttctttttttataagaaatattctgatttcgggctattgttctaattttgttcttatttcttaaaattcttcagaaaatttgtaattttatggcgtaatgtcacttagattttcaaaattttccacggcggtgccgaaccggttaggggtcaactccgtctggccaactccgtctcagcaatgttcaaaaagctataacttttttctttgttggccaaacttcacaatcatagtatcattcgaaagccctagatgtttagagatatttataagctatttatcagtgattaatcagctctcaaaaaagttgtcagttgaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactaaaagttagctcagacggagttggccagacggagttggcccgttccggtgccgaacgggaccgcctaaccccaaaaatactttttttttcttaaaaattggctcagaatcccaaaatttggacaatttttggtcaaaatctgttaacaaattatactcaaattttcaaaaattttcccggcggcacctatcggcactgccgccttccgccccgcttgttccctaaaaagtgtttgaaaaaatgtaccgcaaaaaaatttcgtaaaaatctgattttttgaatgcactcaaatttatgacttgcttatttgctccccaaaattgttaaaaccaataatgggagactaaaaatataatattttaatacattttcaatcaatcaatcatttatacgcaaaagcgtgacgccgaaaaataaa

SEQ ID NO: 75747 - DNA, 1223 bp, Heterodera glycines
  Genomic contig location: Contig_ID=SeqID_12171; Location=752..1974; Strand=+
  SCN-specific regions: Sequence locations=1-94,116-425,448-742,764 -1034,1056-1223
taatttgttaccaaattgtcaacatggttttcgtaaagcacattctgttaccactcaactttttgaagtggtggtggatgagttcagttttgctttagaaaatagaaaatcaattgatgtaatttattttgatttggctaaagcattcgacacggttccacataaccggctaatatctaagctaaaaagcattggtataaataattccttattaaaatggattcaaaattacttagaaaatcgaaagtttttcgtcaaaagcgggtctgatttctctgatgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcaatactgtaaatttaacggccttaaaatcgcttcaaataaatgtttaactttacatttaggacacaaaaatcaaaaaataaattattttattgatgactttcaaattcctaaaaatcccggaaacgaaccagtcagagagaccttggcatttattttactaatgatttgaaatgggcacaacatattgacattatctcgaaaaaagcattacgatctgctttcgctatactaaagtcaatcaaaactcgtgatacgaaaatacttgtaaatttgtttaatatttattgcagaccaattttagaattcggatctccaattttcaatccttatttaaaaaaggatatagaaaaatcggagaatgttcaaaaacttttttgagagtaatatttagacgtaacaattatactgttgatttacctaattatgctgaattgttaaacatttatgatcaaaagtcgcttgagagtcgtaggttaaaaatagacttaaaactttttcatgaaacaatttttggtaaaataaatttacaaaataacgaatccttttctttttccaaaaaccctgtaaaaaatgaattcattataagaacagcttattgctcaaccaatgttagatacaactcgttctttattcgaacctctcgtctctatagacttttacctaaagagacgagattactaaatccaaatgagtttgccaaacttcttgaaagatctgatcttaatttgttgatttctttgcca

SEQ ID NO: 75748 - DNA, 658 bp, Heterodera glycines
  Genomic contig location: Contig_ID=SeqID_12172; Location=86..743; Strand=-
  SCN-specific regions: Sequence locations=1-174,196-245,267-472,495 -545,567-658
atgggtcgtacaaagtgtgtcgaatcgtcattggtccttcgtggctccggaaaaggcggcaggggcaccaaagacgcgcgaggtgtccaacaaactcagcagacaaagacgggcttcgatggacgttctgaggcgccgatgcgcaaaactgcaacagcgtttagacaacccgtcaccctcgtgcacaccacgtcaagacgaagtcacaaggcaccggagcggaagcagacgaacaacacggccaaagaggagagcatcgaaaaggcggagaagggccgacaggtgggagggcgggctggagacgttcataccaaaaaccgtctccacagatgttttgggcaaagtctttggaaggtcttcgtgcaatggtcccactgagattggccgacaaattctcggccgaagacgattttaacattactcaacgcatggaattgccgcagaaaatcgaagcaatggtaaatccaagcgaagatattcttgcgccatccattttcaggtcccttcgatgtcggaggacgcagcagccgcaaccttctgttcttctttgcatacttttgaattaaatggcagtgaaatcgtcgggcagcaggcaacacgcaaacagattgaagagaaccctttcgacacactcaaatttgtgcagccattcgtacag

SEQ ID NO: 75749 - DNA, 851 bp, Heterodera glycines
  Genomic contig location: Contig_ID=SeqID_12173; Location=325..1175; Strand=-
  SCN-specific regions: Sequence locations=1-604,626-715,811-851
atggaagagcgaatcaaaactgaattgcgtggtatgttgttttgattatttttgttttccttttttgtcttataattccttcgctttttaaggtagacaaccttctgaagtccaagaccttctgctcgacagctgcaaagcgaacacaattagcgggctgacagaacaattcacaagtctcacaacactttcgctgataaatgttggattgactacattggatggtcttccgaaggtatttaattataattccttttatttcattggcagaattttaacatttcttagttgccgactttgcgaactatcgacctcagtgacaacaaactcagcggtggtcttgataaattggtcgaatgttgccctcgtctctaccacatcaatttatgcgcaaacaaaattacggtgggaatttttctcttttttttgattgtttcttttagtccatggaggcacttgctcccttgagcaagttggaggaattggcggcacttgacctgttcgactgtgctattaccgtaagaatttattaaaaaatcgttttgattcaaagtaaattattgcaatttttctcaaggagggaccggaatatcgtagcaaagtgtttgctatgatcccacagctgaaatacttggacggatttgacataaacgatggtttagtttgtcactaaaattacttttgcatttttcgctttagtcgaggcagaaatttcggatgaggaagaggaggagggagctgaggacgcgctcgaagatgaagacgactcagaggaagaggaggagggagtggacacggacgacgaggcggcgcttgcctatttgaactcatcgaaagctctcaatgtttaa

SEQ ID NO: 75750 - DNA, 1569 bp, Heterodera glycines
  misc_feature (31)..(31): n is a, c, g, or t
  Genomic contig location: Contig_ID=SeqID_12174; Location=7..1575; Strand=+
  SCN-specific regions: Sequence locations=1-633,656-737,759-864,887 -1431,1454-1569
atggctgtctgcgagtattcgcatccgatgnaggcggttcaggcagtttcgatgctcaacaatcagcgcctgttcgatcgtacgatctccgtccgcatggaccgttatccgaaggaagtggaacgccgcgagggaggactgcctgttggtttttgctttccgaaattgcattttacaatgaaaataatttgatatcgaacgagtcttggtaaaaaattgttttgaggtatttgtaacaattaattgtaattattcgatcacaattaaagtaaatgtcatatccgtttccattttcagtttggtctgcgtgctgttggaatgggtttgggggcgaatggcgcgcctctaaccgatgtggccagcgtgatctccagtattagcccttcgcagacacaacccgggatgaatggcacagctggcgcaccgatcactccattccaatcgcccccaaatgttgcccaatttggccctgtagctgctcaacctgtggcagcggggcctccaagcggatttcaacagggcttgcctgatcatggcatcagtggacatttccaggttttgatatctgccgttaccggctagttaattattaatgtcttaattgggtcttttgcccaatagtttccaattgctcccttttcagtctcctcaacccacctaccaaccacaagctaccagtggcttcttcaacccccctcagccctctccacagaaccgtccatccggcggaatggccttcggcggtggaggcgcaacgccacaatacgcaccgacaaagcaaatgggcgttgtcggaggagggacggcgagcgctgcagtttatggacacccaccacaacaacaaactcagaaggtgcgcgcagaatacaataccacaataataagacaaaatttaagtacgagcacaaagtggagccgaagtttgaaatgggcgcgtacccggggtacggaagtggcgcggcacagccagcgatgagcagtggggcaacggacaattaccaaccgtcgcgtgtcattttgatcaaaaatgtaaaatttggtcgtataattgaaatttttttgtccgttcagcttcccgttgattacacatggcaaattgtcagtgaccgcgtgcaacagtttggcgatttggagtcagtggaaatgataacgcccggtgtggcaaaagtgcgttttgtgaagctgcgagatgccgaacatgcgaaggccgcgttgcagggaaccacagtagaagggagggctattggcatcgaatacctttgaaatgcgacaagcggaggcgcgacgtaaaaactcaacgctttttcatcttacttccctgtttggtcacaactatccttcttttcggtataaattttcaattgggaactgaatactcatgaaatttataaatgtttcctcgcaaagtagaatgtcataatgtttatctagaatttttccaattatttacaaatataagatcgggagggggagatgctgatgcaatctgtcccatttcccgtaaaaacaattaattcctcgaaggcgagtaaaaagctaagcatttcatgagtgtttaagccacatgaa

SEQ ID NO: 75751 - DNA, 1227 bp, Heterodera glycines
  Genomic contig location: Contig_ID=SeqID_12175; Location=827..2053; Strand=-
  SCN-specific regions: Sequence locations=1-445,482-617,674-1227
  Gene Ontology: Mol. function=RNA helicase activity; Biological process=RNA processing
atggcacaatacgtggaaatgttccaccggcaggcgccaattgaaagccaattccaaaggcgtatactgaacaatttgaacgccgaaattgcacggggtgcgttttttttatttttcaaaaaatagaaagttccaaaaatcgatttcaaaaattttcgactttaattatgtttttttcgcgtttaaggtgccatttcgaatattaaagaggcggttgaatggatacgattcagttacttttacattcggctccgcaagaatcccctaatggtaaaattttgcaaatttccattttttcataaaagaaaattattttagtacggtgttgaatggagagagttgcgccgtgaaccaacgctggtttcgtttttaaacgatttttgtcactccgcggcacgtcgcttggatttgaatcggatgatccgttatgatccagtgtaaacaaatatatattttttggctatttattatttatttcttgcatagaaatgaatttgtttctgccaccgatttgggccgaattgcttcagtaagtgtcattatcttttttgaatgacaaaactatcatttacttaatgagaactacctaccaatttcggggaaaaaaattttgtgtgaatttatacaaatatttttaaatatttctataaatttatttgtcatatttttaaatcggcagtttacgggcaacgtttgtgagaatgttagtccttgacacatatccgaatccctgacccgaattcgaataaaaggtcatgtcgaaaggtttgactttcaactttttcatctaaattattattttttgtggcatttcacatcagcagatcaggacacacccattccctaaaataaacctctaacgaaaaaaatattccagcatttctacatcactttcgaaacggtggaactgatcaacgccgagtcggggccggtccgtttcactgaactgatgaccgacgaaatgatcatctcactgatcgcagcatcaagcgaatttgcgcaaatcaaagtaaaaacacaatgtgcttgttgaccaaaatattttgatcaataaaaatggaataatttgatcagaatcgggacagtgagatgaccgatctggacgagttggcctcatttggtgcggcgctgaaaatacgcggtggacttgcgacaacggcgggcaaagtcaactgtcttctgcaagtgtgtgccacaaatgctatttctgaggcgtttgttaattga

SEQ ID NO: 75752 - DNA, 1067 bp, Heterodera glycines
  Genomic contig location: Contig_ID=SeqID_12176; Location=12..1078; Strand=-
  SCN-specific regions: Sequence locations=1-135,158-251,312-415,441 -518,540-549,582-1067
  Gene Ontology: Mol. function=ATP dependent RNA helicase activity; Cellular component=spliceosome complex; Biological process=mRNA splicing
atgaaagcgttggccagcgaaatgaccacaaattttgcaaatcgtctggccaaattgggactcaaagtgcgcgaattgaccggtgactcgcagttgagccgacgcgaaatcagtgaaacgcaggtggcccaagcaatttattgtaataattaactaattatgacgttaattgaaagccacaaaatattacttccccaatgggagcagctcatctccctcaccgaaaaatctataaacaagattcttttttgtttaaataaaaaaaattaatttttttttgaaaaacttgaattttaaatttttttaataatgaaagaaatttttagaaaaatctttgaccgattttttaaaattttgcttggaaacgtaatgtgcgggcgtaaaacgcaaacacgttcactcttcgaacaccctcaaaaaaaaaaaattattttttttttgtgtaatttgatgctgggtcattgtaaattctatttcatttttgcgaattatagtatttaaaaatgaccaatggagccaaattttgaaataaatatgaattatgtgtttatttggcttcaattttttaaaaattaattctcgactaattttcctattttctgtcagatgttggtgctgacgccggagaaatgggacgtgatcacgcgcaaggcggacgacgaagagctaagccaactggtccgtctgatgatcattgacgaggtgcatttgttgcacgacgagcgaggccccgtcattgagtctattgtggccaggacacttcgacaggtgcgttgtctttttttcgaaaacaccaaatttttgagaaacgcccggggaaaatttttaaaaatccttacaaaaaaaaatttttaaacgaaaatttcaaattcattttttttctctcacaggtggagctgtaccatcagaacttgcgcattgttggcttgtccgccacattgccaaattatgaggatgtggcccaattcttgcgggtggacccgacccgtggactgttccattttgacgctcgctttcgtccccgtccattggcacaaaggtggcgccctgctccccaaaaaaattga

SEQ ID NO: 75753 - DNA, 735 bp, Heterodera glycines
  Genomic contig location: Contig_ID=SeqID_12177; Location=82..816; Strand=+
  SCN-specific regions: Sequence locations=1-415,437-458,493-643,665-735
atgccgagtttaaataaattaacattttatgaatctgaaatggtactcgtcaatgtgttttgtgctcagctattagactgtcccgtcaagtcactgcgcgaccgacttaaccaccccgaagatcgtgtaaatgcgatgaacggattgatggggaagaaagttcgaacaacctacaaagatcgcaatgggatgcacaagacctattttgtcggcggtatcacggagcgcggtgcagctttcgttccggcttatggcaatctacgggcaccatacaacgtaaatgtggcagcttatttttatgcacggcatcgcataaagctccatttcccttacgtgccttgcgtaattgaacgcttttccgggagagctgaggaccgtttctacccaatggagttactgggaattgtggatgacgaaaacaaagggagattgtttggacgaatgtttatggaaattggtgaagaagcagatgatgatgataatgacgaggatgtttcaacatcctttgactcaacactacgatttgatatgggacgagacgagtgttcccaattatggcgatgatcaatatttgcaatattcatcttctattactaaactatgcacttttctacctaaaaattacattttaacactcttaattatttaatcaatatatatttttcactctattaattcggcatttttctacccaaaacagacaacttctttttttcatttattcaaattcacaaa

SEQ ID NO: 75754 - DNA, 1497 bp, Heterodera glycines
  Genomic contig location: Contig_ID=SeqID_12178; Location=5..1501; Strand=-
  SCN-specific regions: Sequence locations=1-11,33-48,71-306,332 -442,464-512,534-809,831-855,877-1150,1173-1497
atgtacgagatgaaagtgaagaagcaaaagaaccggaacccaaacattgtgttccacgactcattcaacttgatgccctgcgcattggctcagctggtgccatcctacggattggacgtcgaagacaaaccctttttcccgcatttggccaaccgtccggagaactacggtaaacacatctacccaacccctgacgactatttggccaacggaatgatgccagagaagcgacgacaattcgatcattggtacgagcagcaccgcgaagagccttttcaactcgatgaagcactagcgaggtaaaacatttttaaattaaaatatttattttggactttttcagttattgtacgaatgacgttgaaattctaatggcagctctcgtcgcattccgccgcgagttttttgatgtgtcgaagcggaacgaatatgtcgacggaatcgaccaccgggaaaaccacgatggcattgatgttctacgggaatgcatgactgttgccggtgcgtgcatgaagcacttcaggttgaaccatctgccggcggagcaccttgccattgtccctgaaaagggctatgacaacacccagaaccagagcaagctggctctccgctttcttttctggtatgctgaggaaaacaacgtacaagtgcagacagcctactcacctgatggagaaaaaaagattgcaaactacactgtgaacggttggattgaggcagaagggcgtgtaattgaaattaatggtaatttttctatatttttaagcaattaaaaaaaagttgtttgcaggttgtgtttggcacggttgtagaaaatgctctccctctgacaacatgatgctgcccaacgggaaaactgctggagaacaaagggagcgcgatgccaagcggttacagttcttgaggactcagtgacacgagttgatgtcttctgggagtgcgagaattcacgaatgttggacagaagcagggaatgcggaaaaatttgcagaaatatgtggatggtggaccgttggtgatccgtgacgcgtccaccggccgggcggacgggaccactaaagctcttcacaaaggcagccgtcgaccaaaaaatctcctactttgactttacttcactctacccatacataaagtttgtcatttacataaattttattacaatttttaattttcagtttcacaacccgttatccagtgggccacccgaaggttcacgtgttgaacgaggatgtgaattggacgagcccagctgacaacaactttcctttggcactgattaaatgttgggtgattccgccacgaaagtgcaccattccggttctgcctgtgaaagttggtgaacgtttatgttttccattgtgcatgaagtgcgcgaaagactaccctactggaggagttgacgacgaatatcactgcagacataatgaccaacaacgcggatgggtcagcaccagcacttcaattgagctcaacgcagcgcttgaagagggctaccgc

SEQ ID NO: 75755 - DNA, 732 bp, Heterodera glycines
  Genomic contig location: Contig_ID=SeqID_12179; Location=1060..1791; Strand=+
  SCN-specific regions: Sequence locations=1-2,24-398,420-732
  Gene Ontology: Mol. function=receptor binding; Cellular component =extracellular space; Biological process=cell proliferation
gtgtgggattggcggttcgggcacgccaattgatggaattgacatgtaaatgttaaattaaacgaacttagtttgcttctcatttgcaccgtcataaggtgttgtaagcttcatgaccaatgctatgatttggccgtggatcggggcctttgttatgacacttacgtcgaatacgctgacccttattcttggacttgtcagcagggggagccgaactgttcacaaaagcagttcgggtgcaaagcagcgctgtgcgagtgcgataagtgagaaatattaggggattcatttgatttgcaaaaaaaaaaattgtcataaaaagtgggaagaatattcccggagtttttcggacgcactggtcaaaatcagctaccttgactaattcggatccttactcgaataaaaatgcaaattttaaatcttaagaattttgcttgagttttgttcggaattagtcaaatgcatgttcagccgttttcacgactaacaccatttttttaaattgctaacgaaaaaggtcttcccttattttttttaaataactcaaaaacgaattttttttaaatagcccgaatttccccctcgtggggttgagcacttttttgtttgccattgccattttctctgtttttaagaaatgttgtcaattgttggtcgaaattcaaagtgccttctaaacgggaaaaatgcacaaaaacaaaagtgaacagaacatatgaaacggtttcttat

SEQ ID NO: 75756 - DNA, 306 bp, Heterodera glycines
  Genomic contig location: Contig_ID=SeqID_12180; Location=431..736; Strand=+
  SCN-specific regions: Sequence locations=1-211,233-306
atgccggccgtagtaatgagagagaaggtgggcagaattcgaatgtgaaaatatgatggaaattgattaattgtgaggaaaattctgatgaggttttcattaaaaatatgattttttttaccgaggaccaattttttatgttaggtaatattcggaatttcatctgccgacgagtcacgaaattctaaagaagaaattcaattgatcaataattggggcagaagacttggggacgatcaatgaataattgggatttaattgtatttgtttgatcctgcaaatttcaatttgcaaaattaggagtta

SEQ ID NO: 75757 - DNA, 1870 bp, Heterodera glycines
  Genomic contig location: Contig_ID=SeqID_12181; Location=1302..3171; Strand=+
  SCN-specific regions: Sequence locations=1-65,87-333,355-453,478 -502,535-580,613-950,979-1144,1169-1194,1220-1347,1369-1599,1632 -1782,1811-1870
atgagcagcagacatcactggagggcggctgcttttcatccttttacggcacaattggaacgggttggttttgaaaatggagaaaatttaaatacactgggaattgtcccaaataggactcgagaattggggcatttgtcatcattttcgggataagatgaacattttgagactgatgagtagggcatagaattatatgcatattgcatattttttttcctggactgtgggaggcctgaaacgcatgaaaaacatgtttttagcctggtttgaagcttctaggatggatttccatatgcatattttgcatatttgtgcatatttcgcgatttatgtgcatatttgtgcatatttcggcatttcatgcatattttatgtgcatatttgggcattttttcaataaatcctctattaaaacgaccccctctattaaagcggccatttgtgctctaatgaccaaaaatttttcaaaaatatcagatttttgggtatattttctgataaaaaagtaactttttaaaaaattggaactttatgccaaaaatagtcagaaaaatagaaaattctccattttttgctcaattttcttcaaaataaataaatattacttttttggttctaaaataatcattcatactatttttagctattttcgggatttttatgcttaaatttaacaaacttgaagagatttgaaaatttgccctcaatttggaaaaatttatgtgcatatttttcactttttatgtgcatattttcatttttggtgcatattttatgcgcatattttgcgattttatgtgcatataattctatgccctactgatgagagttgccttttctaggctttgtcttgcaaaaaatccaatgacgaattcgcaactgttgagttgaaacaaaatttttatcacgggagtcgagagtcaagaaggttgagaattttctcaagaggaaatataattttaaaatttctaatacacctgaatttcttaatattttcgtaatagaaaacatttttggtttcctaatcctttttttgctctattttcaaaaaatccttgtaaaaataagtgcgtttgttagagtttgcagaaaatcactcagtgatcaagatgatccgggaacggccttttcgataacaaaaaggaccctaggagtcctgaatttcgatcttttccatactcttgaaaagcaatgaaatattttttaaatgtcaaaaaatttagtgccattgttgtaatggttggctccctctcaacgcagttgtgcctgcttctgatcagcttcattgcatgtcacttgcttctgatttgcctgtctccccgttctcatccgccactgatcagcccttttttatccatccgaccaaaggcgcctatggcacttcaattttgttcaacaaccattccgatcaaatggcaccaattcccgatcactctacgatgcttgatccgtcggaggctacatcattcattaatcaaccattgtgatggcagatggataaatggataagcataaatgacaaatatactacaatacagtgcaaattgatataattaatctcgagactcacggaacttgactcaattacgaattacggaaaatacggcattgctcagaattttttaaatggcccctgaaacttagggcatggtttcgaaaaccgagaaatttttcttgccaatttactcattcaaaaatcggctttaaattgagtataaaaaaatcgccggaattccacgaaattgtcggataaaaattaattaccgagtctcgagcatcaaatatttcatttattaatttaatttttgttgtttagataagaaagagctggtcattcattcaaaatgccttttgaaaaaaattttca

SEQ ID NO: 75758 - DNA, 314 bp, Heterodera glycines
  Genomic contig location: Contig_ID=SeqID_12183; Location=192..505; Strand=+
  SCN-specific regions: Sequence locations=1-159,181-314
atgaacacatttggaaagggatgtaagaatttctattttagcttaccagagttttttttgactcaaatgaggtctataaaattttcggaaaccacaaattttcaacttgtctgaaatactttaaaaaaaagtcaaacttcaaaaaaaaaatcgaaacgatgccttttccattctcaaaatttgtttttaaacctttgaaaaaagtttcctttaagggttaaaattgtaaaaaatggaaaaatttcagtcagaaatcaaatgagaataagctgatagcttatagccaactgatacataacagcagcgacaagcaa

SEQ ID NO: 75759 - DNA, 620 bp, Heterodera glycines
  Genomic contig location: Contig_ID=SeqID_12186; Location=5..624; Strand=-
  SCN-specific regions: Sequence locations=1-70,92-344,369-525,549-620
atgacggcaatggtaagtgattggtaaagtaactttgctttttttattggactgatcgaatcgaaaacgtcgggggggggggggggggggctaatcgctgtgagagtcggtgttggtcgtgcggagctaacccccgccggtggatttccgatcacactctctcttttctgatcagtttctttccgatgtctacgacttgtgcgtccacgtgcggtctgtgcgcgacgggcgcgtgcgcggacactcaggacggatgcatcggactaaggcacatgtgcgaccagaaggagttcgaggaggacatgcaaaagtgcgcacgcacttgcaaattctgcacacgtaggaaataaatatttaatttttaatttggaaatgattgaagtgagtgatcactcttccccacagcaaaatgtgctgatctgaccaacgattgtcagatcgccgatgaaagttcgtgcgaaccgccaccgcccgatcacttggaagtgaatgtgtgtgatttgttcagatttaatcacaattgattcaaaattcgaatttgcacatttcagccctattacgaggaaatggccaaagtgtgccgcaaacggtgccatttatgtgacaaagcaatcccatga

SEQ ID NO: 75760 - DNA, 591 bp, Heterodera glycines
  Genomic contig location: Contig_ID=SeqID_12187; Location=205..795; Strand=-
  SCN-specific regions: Sequence locations=1-163,342-365,536-591
  Gene Ontology: Mol. function=calcium, potassium:sodium antiporter activity; Cellular component=outer membrane; Biological process =calcium ion transport
atgctcagagtaaaattatggcaaattattgccctgtcattggcactttttttggccggcattcaaaagagatgggctgtacaagcacaggatgatcagcaagacgaagaagagactgacccgggaggagaagacactgacgggaatgaaaatggggatgatcagcaaggggaggagggggacggggcaacggaggacgacggcggaggggacgaagatgaccaagcgacggacgatgaaggcacagaagcagagggggacgaagacgagggggcagacgaagagactgaaacggagggggaggaggaaaatgatcaggtggaagaggatgagggaggggatgaaacggaagacggaaacaatgcggaggatgaggaggagggagaggaggagagaaaggatgaggaggagggagaggatgagggggaagaagaggaggaggaagaagagggaaagggacaacggaagcgcaaaaggaaagaggaaggggaggaagaagatgaagaagaggagggggaagaagaagagggagaggggcaacggaaacgccaaagaggcaacgaaagcacattggaacttctgcgctgtcag

SEQ ID NO: 75761 - DNA, 3660 bp, Heterodera glycines
  Genomic contig location: Contig_ID=SeqID_1760; Location=121..3780; Strand=-
  SCN-specific regions: Sequence locations=1-15,37-1280,1302-1400,1423 -1639,1663-1875,1897-2172,2194-2242,2272-3195,3217-3396,3418 -3437,3459-3660
  Gene Ontology: Cellular component=secretory vesicle
atgaacagagtgagcgagacaagatgggaaagtttggcgccaattcgaaaagagtacggatggtacggcgtgaattgtttcaacaatgtgcaaacagtgattgaagaaggaaaagcagggattttggatgggaaaagactgataacttcgtggggagactctttaaaagttgataaaagcctgggggaagacggcagctggatcagactgccaggagctgtggaattgctcatgtggaaaattccatcggatgaattttggcattcacattttgtgattggcccagtaatcacggaaatttggccaaaaaaggcagtgatcgtggatgagctccaatacacttttccgataagcagaaatcaggaaagaaaatttccggtgttcggagtgcccgacgatgcattgaaaacggacaacaatgtttttgtgcatgtcattggtaaagtaaactcaaccaagcgagcgcgccaaagacgagagaccgtgagtctaaaacctggacaaagaaagccaaatgtgccgagaattgaaccaacaagaaggccgaatttgcgaagaggccaaattgctgaaatcgccatgacaacccgcccaactattactaccactaatattccaccgacaattcgtccagtttctacaacacatattccatcgataattcccacaatcgccactcatactccaccgacaacccgcccaatcacaacgacacatattcctccgacgatccgcccaatcgctaccactaatattcctccgacgattcgcccaattactacgactaatattcctccgacgattcgcccaatcgctaccactaatattcctccgacgattcgcccaattactacgactaatattcctccgacgattcgcccaatcgctacgactaatattccgccgactattcgccctataactactacacatattccacccacaacccgcccgattgctactactcatattccaccgacaattcgaccaattactactactaatattcctacaacaatccgcccgacttcaaccattcatagccctattataatcaaaccaacaacgacaatcccgacaaccactattcaaacgccaactaaattaatctctaccacggctacaccaaacaccgtttctcctcacaccacaaagagtgcggatgacaccgctccgaccactgcgtcgtatcattccattcttgatgagcttagaggattggccgaagaagctgatgaggaaggcattttaatttctccaacgataaaagtgacaccaactccatttgttctcccaaatgaaccaaatgaagaaagtcccaccactgtcgttacaaaaagggaaatcccggatgatgatgaatcagaaaaactttggaaggaagaaaatcttgaccacgaaaattctcgtcttaattatttgggatggaagacacatcggacaaacatccaaaatgcgcgagagaaatggatgagcgactgtcacgaacgaaataatgcactttccatcgcaaaggcattagctcgtcagatgccggaagacgcagcccgctctctctacaaaagagatgacataacggcattttggaccagatcatcacaacttgaccaaaaatggtccattgctctttgcaaacaactgaaggctgaggatgtgctatgggatcagaaaattggaaaaaaatgctttcgcgagctacccgtgctggtggcaaggcgcacacttttcgtcaagccagggacgcgcgacttgagctataacgggactgaaactcactgtgatgagcagggtaacaacccttgggcagctgacttcaacaacaatgacactgaacttcaacaagccaattcaaaacatcgatttgtctcaaaacaacagacaaattttcaaaatccattaattttcttcacacgcggatcaatttttgaatctgaacaggcacgcctggaacagaatctcaaggaattgacgagacggatcactcggcctgaattgaacttccctgacatagggacagttgacattaatcagaccgagattcacggaagcacggtcacagacattttttccatcggcgaaatactggtggaaaagatgcaaaaagagggcgaaagtttcagaaaaaaggcagaagaaacgattgaaaaaggaaaggcatggatggaagacccaattggaatcatcaaatacatcaaatggatcctaatcacaatcgctattattttaatcgtgattggatgcacagttcttttgtggaaaatcaaaatttattccactctgtttttggcgccaattcatttactacaatctctgctcaacaccataatgaattgttttaattccggaagaagattggccgaacaagttcgatatccgatcgtgatggaagtcgaactccaagaccgagccaagccatcagcaccaccagaggaacctttactcgaccaaaaagcatacgtgctcaattatcttcccaacatttgccaaattgaacaaacaagacgaaaaaagaaaagatgttacgtcaattttttcatgaatggagtgaaaacgaaggccttattcgacacaggagccgacatcacgtacattggccactcaacggcacaaagatgctttatgatggtccgaaaaggggactatccacaagcaagagcagcgaactcaactcccattcgttttatcggctcggcactcgccaacataaaactgggagattttgaaggcaaattcccaattctcgtcagtgaggacgatagctgtccatgcactgccataattggaacggatttgatggatttcatcagtgaacaaggcgaagaagaaattggattgaacttcaaaagaggactcgtacgtgttggaaacacgcaactaccaatgatcgccgctgtcagcatcgagaagcaaccgattgaagtacaacttattgagacccaaacattgccaccgctgtctgattcgctcgtttggggaaaaattaaccgaagtttgggaccagacgaagttttcatcactgttgagcgagagcacgattatttcccgctgcgagtcgggaaatgtctaacaagtccaggctcaacgcgaattgtgccactacgattacttaatttcggaaacagcgtaataaaagtgtatgagggatcgcgacttgcgtggctggaaacaatagccgatggcactgaaattaatgcactgaaggaagatgagaaagaaaacccggaaatgataatgactgacgaggagtggatgaaattcaaattagaaagtgacaaaatttcgccagaggcggactggacggaccagactttggaatttccaaagaaggaagaagcagtcgcacccatactggaaagaattcgattaaacgacaccattctgagtcgagacggaattgaaaagctgaaaaacatcatccgacagaacgagaacgcttttgtgaaacctggagaagtcggactcttcaaaggacaaacgatacaccgcatcgacctaatcgatggcgcacggccggtccaacagagaccctatcgttatcctgtcgcacttcaacccgaaatagagcgtcaagtcaaggagttgctgcgtcaaaatgtcattcgaccatccacttcggcatggtcatctccacaatcatgcactgcagttaatcctagatga

SEQ ID NO: 75762 - DNA, 2285 bp, Heterodera glycines
  misc_feature (2269)..(2269): n is a, c, g, or t
  Genomic contig location: Contig_ID=SeqID_1761; Location=128..2412; Strand=-
  SCN-specific regions: Sequence locations=1-241,308-382,404-546,569 -2285
atggacaaggacaaggacaataaggacaaaattgagcccaaaggacgaagcgatcatccaaatcggccatgccactccgctggtacaaaacgggatggagtcggcacaaaaaacgggattctcccactcttcgaatccaaagcaacggcggctacagtttcggcccgcacacgatacacgccacagttcaagactttcgatgtcttaattgtttaacttgctttagttaataacaatttaatttttctctttttctctctctcttttcttatttctctctcttttttccctcccatgtttttcttttggccggcagaaggaaaactttggcctgtctcatttgcctactgtcgctaccgtatacccgtaccacaagtcccatccctcccactccttgttttgcccatcccgccattttgtgaattttgttgcctattgcctaaacagctgcctcaattcccttccccctcctacgaccaggcagggccccatccctggacgtttggagtttttgatctgagctcattaattaattaatcacaggggaaaaagggttggggaaaagaaatttcagctaacaaatgccagtcccgggacaagacgaaaataaacacaatttggcaaatcacgagaaaagactaacaaataatgaaacaaaattgccaaaacgaattcgaagaatcaaatgaggcaacaactgacgggaaaaacgaagaaaaaattgggaaaacggggaaaacggacaattaattaattgctttcggagggaacgaaaatggacactaaatgcacatcaaagagggacggtagacgatcacatttcgatcacattggcaaatcatccaatcaccgacgaccaattgtttcatcactattttattacgcctgatcaacgacaaattctttaattcattcactcatcttaaaattctcaatcatcaactgcagttaatcctacaatattttctattctttctggcgaacttcgacaaattatttcttaataaaacatctctcgactacactctacgaagtctagtactattttctaaattctggtgttaatcagcgaaacatattccgacaattccatcaaaaacggccgacacgcggagaagaccgaatcctttagaggaagaaggactaaacgaaggacaaaccgaaagggataaaaggctttggctcatccatcaaaaaaggcagttgcgtaatatggatttagacgccctgcggcgtcgaattgtgactctcgagcaagagatgcgtgaaaatggtggaactcgctctgggctcccgatgccgaccacatttgacgggacgacagatttgcaggattatttgaagtcctttaatttaatcgcgaccgcccacaactggacacccgcgcgatgtgtgcaagttctcccgctgttcctcagaggatcggcaagggcaatttacgagagcatcgaaccggatattaaagataattggcgaagtctaattgatgccatggctgataagttgaaacaaatgtctccgagtctgacagcaagacagaaattggcacaacggaaacaacagactggagaatcgctggaagaattcgcgcaagcgatccggaacctcgtcttacgtgcttatcccgacaattctctcgagatggactttggaaatttggtgctcggtgctttggaaaacgatgttaaacatgcaaacgaagcccgacttcgacaattccgttcggaaattgcgcgagacttttttcgggcaaatatggcaccacgactgaaggaaagagtgatgtacatggaagaaccgcaaacgctcgaggaagcagtggcccaggcaagacgtgtggaacaagttcaaggaaatttggccgatgacatgtggaaaaatacacaagatgcaaaagccgaagttgctttagccgaagttaatgcagtgcgaaccgaattaaatgaaattcgtgaacaacaaaggagccgagagaatccaggacgagatcaacgagaatggcaaaatcaaagcaattcttggagaggaaacaacgccgaaggacaaaatcaatctaatttttggagaggcaatcccgaatttcggacaattcgccgagggaatttcacgccaaggggattcacaggataccccaggggactcaacacataccgaggaggatttaatccgcgcggcgctaacttcacaccgcttggcaacaacttccaaggaacaaacaacaatggcaattttcaaccgaacttcaaccaaaatcaaaattggccacgangggcgcggaccaacag

SEQ ID NO: 75763 - DNA, 350 bp, Heterodera glycines
  Genomic contig location: Contig_ID=SeqID_1761; Location=2210..2559; Strand=+
  SCN-specific regions: Sequence locations=1-350
acatcgaaagtcttgaactgtggcgtgtatcgtgtgcgggccgaaactgtagccgccgttgctttggattcgaagagtgggagaatcccgttttttgtgccgactccatcccgttttgtaccagcggagtggcatggccgatttggatgatcgcttcgtcctttgggctcaattttgtccttattgtccttgtccttgtccatttggctgtggtccgtgtccgccgagtctttccatttgcctcatttggggtctgtgaccaatgtcagcgccgtgttagtgttttgtccagtcgtattgtctcctcaatgtaatttcgggttgatcgttggcacggccttaacacatca

SEQ ID NO: 75764 - DNA, 2282 bp, Heterodera glycines
  Genomic contig location: Contig_ID=SeqID_1762; Location=365..2646; Strand=-
  SCN-specific regions: Sequence locations=1-194,216-627,649-680,702 -841,866-1033,1069-1096,1121-1166,1192-1252,1501-2282
  Gene Ontology: Biological process=protein biosynthesis
atggaccaatgcaagccatacttcacaaacgaagaagcggaacaggacactgaagcattggagaatgagaaaccaaaacataaaaatgagaacaaaaagctgggagattcaaaattggaagaatcggacgaagtaatgcatgatggggaaacaattgtggcatgtataagtgaagggaatccactggaccaaccaaaagacaaggaagaaatggaaacaccacatcaaattgagatccgattggatggcacaaattttttcgcttatctcagcacttcaaattttcccgaaacttccaccatttccgaaaatttaatcaaaaatgactgggaaatatttgaagatgacgacaaatacgtgataatgtggatttttgatgaaaatttcaaactccgaatttccaacggatgggacgaaatgttttttggaacgggagttcgagaatttctaaaaaattcgggaaatttaacgatggaagacgggaaagcattttatcacgaacaatttattgatgaacaaaaccaaattttcgcacaaccaataataccggatgtttggatcaccctgcgcgatcacacccctgcgcgacaaacaaatccatttaaccccttttttgagacgatcgagccccaaaatattcaatcattttcatcttttaatcggatatttcattcaatcagccatcacactcacacaatcaattcgacaaatttacagcaaaaaatgtctcgattcgactcccttcttacccactcaaatcattctacatcaaaaaattcgtctccaacaccgcctgccattttaatttcttccgactctgactcggaaggagaatccgacgaacaacaacaacaacaacaaaaacgtgacaacaaatccgaacctcgcccctatgcgccgatcctcacgccattctcagtggatcaagtccaagtgattcacccggaccaagtcgagatgtataagaaggattaccgattggccgaaattgatcggcaaatacagttaatgatggacgcgaaggctaagatccaggcggaagaggaagaggaagaacagataaaggaacgaagagcacgttcggagaaggccaaacaagaaaggaaaaaagaggaaaaagagcaaatgaaggcgaagtctgaggccaagcgaaaggaagcagaagagaaggccaaagcaaaggccaaagccgaaaaagaagaatggaaacgggcactccgacgtccggcagccacgccggaagaaaaagcgaggaaagaagcggaaaatgaggcgaggaaggaagcggaagaggcagcaaggaaggaattggaagaagaggcgcggaaggaagcggaagaaaaagcacggaaggaagcggaagagaaggcggcgaaggaagcggacgaaaaagcacagaaggaagcagaagagaaggcaaaaaaggacgaagaagaaaaaaagaagtctgagaagcaacaacaaaatgtggaaaaaagagcggaggaaaaaggagaaaaaacaatgattgccagaggaatcaaaaagaggcgcttaaccgaagaggaaaaggagaaaaaacagaacatggaaaaaatggaggaagtacacagagaaataagagaaattgtgaagcaggcagaagaagatgcaaaaaagagggaaataagggaaaaaatcgaaaaattgacggcaaaattaaatagggaagaagatggaaaaaggggcgaaaaggacatagcggcgttggaaagagagcgcgaggcattcgaaaaccccccggcgccgccaaaggatcggatgcctttctattccagcacagtggcacgcttcgaatgccaaagcgatttagactcggcacccaaaccgagagaagaaaaaagtgaccgcgaaagaagcagcctcgggacgagcgggaaacggctgttcagaaacactctgaagtcggcggtgcaggcggtgcatgagaaaccgtgcataccgccagaagggctggggctcagacgaagagaaagcgccacggaggaagccccaagaggaagaaggccaacaccaaccccgggccaaagacaattggagaggagcccgattcgaaaaaacaattcctacctgaagcgagcactggccctggaaaagcccgaggagacaatctacaaaatcaggaagctgctgttggaggccgccgaccgactgtcagaattggccgacttactgtacccctacgaaggcggacagaaaacgaaaaaggacgagaaagagacggtggaagagaatctggggatgggctgttcaagcagttttat

SEQ ID NO: 75765 - DNA, 425 bp, Heterodera glycines
  Genomic contig location: Contig_ID=SeqID_12189; Location=369..793; Strand=+
  SCN-specific regions: Sequence locations=1-238,261-265,288-425
atgtcgtcgtcctcaaagccgaggaattcgatgggtcggatgaagcatttgctgagctcggctgaggacgcggatgtgcactttttggttgggcagaaaaaggaggcgagatttcaatatccaattttgattttctaatttttttaagttttcagcttctacatgctcacaaattgattttgaagcacgcttccgaagtatttgaggcaatgtttcggtttgacgcacagaaagtaaaaacagaaaatggtgagaaaaaagaaacaaattttttattaattttttttgaaattcagcctctgccgaaggtgtcgtggaagtgcccgacgttgaagcagcggcgttcagagtgatgctcgccttcatttacgcggacgatctgagcgaattgaacggcgaaaatgctatggctgtgctttatgccg

SEQ ID NO: 75766 - DNA, 911 bp, Heterodera glycines
  Genomic contig location: Contig_ID=SeqID_12191; Location=702..1612; Strand=+
  SCN-specific regions: Sequence locations=1-40,68-301,331-411,433 -542,566-655,677-833,858-911
atggaaatgcaacagaacgagtcgctggtcattgtgaacagtgacggggaggaggaggaggagttcaccgatgtggtaagttttgccaactaattttttgagttatttcaaaaggtattaggtcactacaaaaaacatacttagctttttcacgaattttgtctcgaatttaactaagtaaacaaattttgagattgagaaattacatgtatttttatccgaggcgtgaaatatttcttttaacggattgccatccttttgccggtgtgaaaagttttaataacgttattttgttatgagcaatattattataaatctaaatatttttaacgccctcccgagagaaggcgcagttccaaaaattagtccacactgttccttacaggaacgaaaaagtgttacaaaataggcaaatatatgttaatttaaaaactaatttatgatgggtttaaaattgaggaaggggagagagaactgatcctttatatttctctttttgtacgccttcttttccccctcgcccgtctcttgctcttagttcactttctctctttttcctcttcttgtcaaaattgaggaagagagtgagacgcaagggaagagagagaaatgggtcgcggtcgttttcgtacgagcacaagtttttggctataacttttttctttgccaaccaaatccaacattgttcatatccttcgatagccctatgtgtcctctattagcctgcaaaatttctaaaaatctcattaaggtccgaaaaaagttatggccagaagaattcatacaaccagattttccaacttttttggcccgaacttttttaaaacttaacgaaattttttgaaagtttgcagactaatagagcatctgaagggctctcgaatgatatcaagatccttggatttggttga

SEQ ID NO: 75767 - DNA, 1663 bp, Heterodera glycines
  Genomic contig location: Contig_ID=SeqID_12192; Location=1007..2669; Strand=-
  SCN-specific regions: Sequence locations=1-61,118-180,260-412,488 -537,559-779,815-1039,1061-1081,1103-1663
atgttaagtaattatttttgtttcattatcagtgcgtgcaaaacaaaaattgcaactgaagaaaattttttagtttattttcataattcaaataaattaataaatattattttttaacatatgtaaattgaatgggaaaactcatggttttaatggaaataaattaaacataaagcctgcaattaataaaatcaatttatataataattattttttattttctcattcttaattaattaaattcttataatttataattgcctattaaaattatagcaataatacataatcaattaataatgtgttgatttcaatgcgatcaacaatgttgtcccagcaaacaaacatacacagcaaaggataagctgaaaacggaggagcagcaattctcacggaacaaaaatgtgaaatgtaaaaaattaaatacattttataaatattaaaataattttaaatgattttttaaaaataattttattatttaaatcgctgtcaaaaggaatagatgcaattaaattttgaataatttttaatgacaacacaaaatcatttaatttactggtgcaaaaattaattaccatatttttttcaattaagatccactggggggcttcatttttggccataatcgagagggggcaggggtggctttattggagggggaggtgggctctaatcaagagggggcggggggctaattagaagaaacacacggcaattaaaataattaaatgagggagagggggctctattagagaaaatacggtaataataacaacaattaaaattttaaaatatatattttttaaatattgtttcagttttctcgcccgactcttctgatgaaagtgaggatgacgagcatcataatcatcatcatgacaatcatcatctgctgcggaccaaaacgaacctttcgaattacaactttttacaatcatgcgaagacaattttttccgatcattcgatgccacaaaaattgccgacaatttttgccatgacagtgactcatcgctgtcattatcatcagcagcaactgaggaggaggactcggaggagtacaacagccagcagagtgacagtgaggaggacagcagcaaaacaacctcatcatccattgacgggtcaacgacgacgttcaaactgaaatccattttgtgagcaattattaactaattaataagatttgtggcctgaaattgatcggggagtttattaaatatttcatcagggagtgatcactgatcaggtttcatgaatgatcaggatttgtagaatttttgtccggctgctctgaccggatttaagaaaacatgccctactaggctgagtcagaataattttgccacaaaaagtgatcaggatttatcggtgaacatttatcaaggaatgatcacgagggagggatcaggattagccgaatttaaaagaaaattgttcctctaattacctgttgaatattggcacaggtcaacaagtgccaagaggagtccaacagctgagaagcatgcttacgagaggcgtgtcagttttgcggaccgctggggcatgcaattgacatcgtttcgcacaattccgaaccgttttgctgatcggttttatgacgaattggagctggacttcaatgaaggtggatcaattaattattaatctattaataaa

SEQ ID NO: 75768 - DNA, 1080 bp, Heterodera glycines
  Genomic contig location: Contig_ID=SeqID_12194; Location=206..1285; Strand=+
  SCN-specific regions: Sequence locations=1-151,173-182,204-504,526 -596,646-747,791-948,972-1080
cggagaaagatatcaaagcaactgaagtagcgttagtcacattaatggcaaatattcacaaacaaatttgtatacaatttgacaaaaatgcattccctgttgaagaaattgcaaaaattactgttgaaaaagtcaatgatatgttggtgggttaaatttttataattaatttctttgccagctattttttgggcaaaaattttacatttttaacgggaatgggggccgttcgtcacagacgtttttggcacagacgattcggcgccagcccaagttttttcattataccgaacttttttctttgtcgaccaattcgaaccattttggtatcattcaaaagcttttcacaagctttattaggcttacaaaaagcataaaaattttctagaaatagaaaagttattaagaaaaaacttcaaaattttgagtttttcgcaattttcatattagaacttttgtggtaattgtccactcacaaaatttaataaaacatcactatttttagtaattaattacgtaattacatatttaatttttcaactcaaacttcgtttgattttttttcatatttagcagttttgttgggcttaaaagccattttttattattatttataaatcaattttgaattttattcaattttttgcattttttttgttgtttaaatccattttctggcaatggcctttttatgacattttttttggcattttgcaactctttttgccacttttggaggcttcattgaaaatttctttaaaaatttacatattttttaaaaaaatttttaggaaaaatgtcatcaaattgtcaacattcgtcgtgagaaagcagaaaacacacaggcacaggcacaaaacacaagcaaaaagagcaaaatgtcagggattagcaaaatatttggcggaaattcaaaaattaaaaaaaaattggcaaatttaaccgatgaattaaaatcattggaacaaaaagagcagcaactgtttcgagaaattaaaagtgcagcggaaacaacacaatttgattggaggcatctcgaattgccatgcacaaaagtgacgacgaaaatttagggaaaaa

SEQ ID NO: 75769 - DNA, 1131 bp, Heterodera glycines
  Genomic contig location: Contig_ID=SeqID_12194; Location=1578..2708; Strand=+
  SCN-specific regions: Sequence locations=1-4,26-139,162-257,314 -537,596-850,936-1131
atgtcctttaaaaaggacatttacaagttaccaacttgcttctccataccaaatgtgcgtccttcaattcaagggcgctccattatggcattttgtgtgctaaaaactatatggtttagtgctaaattttgatgaaaacaataaaaaatatatattttaatgccgtccttaaatttaaggacggtccacctccattaggattttgtttcaaggacggtccatctctgttagtgattctgtgggtcaaaaaaaagtgctaaaattattttttataattttttattttttaaataatttttcatttattttttttctgttacagaaactcttcgatcagatcaaaacactatcaataacaattactttgaaaaagaatgcaagtacaagaaaatattaattgaagttttatttttgtgtatgattttttccttattaatttttttaaagtatgaaaattggtgatttaaatgataaatttttgatcgattgtacttattttaattgttgataaaaacacgaaaacggcgattttatgtgattattatattttattaattattgaaatttaaaaattagtaaattattaaaaaaaattcatgggacaatgcagttacgaattttgctcaaatttttccccggattttttttttaatttaaggacgaaattttaaatgatctattaatatcatcaacatggtgaaataagtaattttgaaggatttaattaaaatttaccaagtgactattggcaattctacaaaaaattatgaaatatacttagtaaataacaaaaaaaaaattgtgtttggtgaccaacccaccttaatagtcaagtctgaactagtattagaaaaattttaaaaaaaatccatttttttctttaaattcacaaatttttttgaaataattttatagtaaattcttaatttttaaaacatttttcatcgcaaatttcatataaaaaatttctattggcaacgccggcctaaaacctaatcattattttaattttgaattgcaaggagttctggaagcgactttttggtcatttttaggccaaaatctgctaaaaaaaatcggaacaaaatttcagtcatacttttgttttttgtaaaaattttttaggcaaaa

SEQ ID NO: 75770 - DNA, 410 bp, Heterodera glycines
  Genomic contig location: Contig_ID=SeqID_12194; Location=3256..3665; Strand=+
  SCN-specific regions: Sequence locations=1-410
atgaaaattggcatcttattactaccatgtctattgatgatcaaaaacactgttgatcagactgtttctgtgaaaataaaacaatcgaaaggatttgatcaaatatttggcgaaggatgggagaaaaatgttgaggtaaatggaatgggtcaaactgatcaaaatgggacaattggacaaagacaaaatgacgacaaaaataggacaaaaaatggcaaaaaaagtgagtcaaaaatattggcaggacaatttgatcaaaatttggaggtgaaagaagaatcggcaagcgaatgtgatcaaatggaacaaatgtcagaagacagtggacaaatttctgatcatttttcaagtgaaattgaacaaatcaaaaggaaatttacaaatggaagagagaatttcgattaattaaa

SEQ ID NO: 75771 - DNA, 882 bp, Heterodera glycines
  Genomic contig location: Contig_ID=SeqID_12194; Location=3775..4656; Strand=+
  SCN-specific regions: Sequence locations=1-127,151-161,183-302,324 -339,373-412,435-829,853-882
atgccaaaaataatagctaaaaatttgggcataaatattagaagtatttataattggaagaaagaaataaaaagtggaacatttataaaatttcaaaaaattgatgatgaaaaaagagaaattgtggaaaaatatttaaaaataaaaaaagaattcatgcaaaatggaaaacattcacagaaggaatgggaagaatttaatgcaaaaattaaacaaatgtttggagtgattcttcagacaattgaaaaatgggccaagaaattaggcaataaacaaaatgctaaaaaaggttaaatttgagtaatttcactcgattttaaaactttaaaatttttttcaagtttgaaattatttttagagcaaaaaattttgacaattgctgaaaaaagggaaatgatgaagcaatatcatcagatgaaaaaacaaaatccaaagctcaccgaacgacaaattgtggcaaacttggaaatttcaccgagctcattctacaaatacaaatccgaattaatgggcgaagcaaaaaaattttgatagggatatattggatttaaaaattatcaaaaaatagagaattctgaattttaagccgataattttctttagtgtttttttatcgttgataatttaaaaaggtttttttttctttttttttaattggcatttaatccacaaatattttgcattcaccttctaattttatttttaatgtgctttaaactaaacattttgctgacgggatgtccactgacagaatatccattagtgatcgaatgtctgggaaccaatcgaatgccaattttacgcacattttataccaatgcctcatccaaatttgttttttacactccatataatttttaaggcattccttcgtttagccaa

SEQ ID NO: 75772 - DNA, 1499 bp, Heterodera glycines
  Genomic contig location: Contig_ID=SeqID_12196; Location=188..1686; Strand=-
  SCN-specific regions: Sequence locations=1-336,473-484,506-921,951 -1037,1059-1201,1225-1308,1344-1356,1380-1499
atgcttttgctgtatttccgcatttcaagtgattacgcatttttgaaagatgcacatcgcgaagtgctgaacagtgagcgtaaaagtataatccagagtcttatcagaagacttgacgatttgtacaataatggctttcaacagcccgtgacaatgttttgccaacgcgcggttggcattttgtaaaattcaaaatgtttttttttcaaatataattaaggattatatggcaagcgaagatgacaacggacaaattgtgcttaagcaggtgattattataaataagtatttttgtataaaaatgtgcttttgggttccgaaattctgctaagaatcaattttttctatttagttatttttgaatattaatattttagaattttaaatttaaatgatttattaatatttgtaaaggaaattttcaatataaaagtaatataagcataaaaaattttaaaaaatttataaaaatcaaaaaactaacctaaaaagcgatctatgtttttgagacatcaaaaaaaatgaaattttaaaattgtcaatctagaaagtaaatttttaatttttttcctttccaaaatttttgattttaaatttttcaaatttgaaatcttctgcacttgaaacataaaaaaaatgtatatttttttgagtatttctaaaaaactttaattaattttccattttattcccttggattagttaagaaacacataaaatgttgtacaatattctttttaggttgaagtgaacacgggcgcagttggcagcttcgcgacaagcccacgcttctcgcaacttcatcggcgaatgatcgcaaatgcgggccttgacgcatccgagacggtgacaccggtggaccaatcggacaaaatgtatgccgagacactgtactattcgtggtaagaaaattaaacaaacaaaataataataattattattattaaaaactggtcacatttttggccaaaaacggctataaattcctgcttttggctacggccttgttcgaatatataggttgtgtttttgaataattgaacctttttaaggaaattttcattacagtgcggggttttatgctgtaatacgaattttaggcaacaatttggaaatgatcaagcagtgatcctttttgtacatggaagtctatacagtcatttgatgcttgagtctcgacaaattgtgaacacattagaggaaataacatcaagaaaaatcaaaaaccgcttcattaccctaaaagaggctttcagtcggtcggtaacgaagccaaaaaaaagccacattaaaatggcaccatttttcaaatataaatttattagtaatttagtttaaaaattgaccccgttgacaaatcactgatttttgatgataaatatgtggtggctgttctggttgatcgcattggtcgagaaatttccgacgcagaattggcactttgtgttgaatttgagcgttcaacagccattgtgaaaatgggcatttatattttttaa

SEQ ID NO: 75773 - DNA, 648 bp, Heterodera glycines
  Genomic contig location: Contig_ID=SeqID_12196; Location=1973..2620; Strand=-
  SCN-specific regions: Sequence locations=1-125,147-283,305-648
atgcatataaaattcgggaagggactgaatgggggagggggtgagtcagtgtttaaatttgcaaaggagttccattcatggaaaccctatgattttttgtttttcagacagcttttttcggcgcgatttttctaaaaacttttgggaactgatgggagggggtggatccggcggtgccgataggcgacgccgggaaaaattttgaaaatttcagtgcaatttggttaaagttttgtaaaaaatgacctattttgtgatttagagccaatttttttaaagaaaaattaaggttttgtcagctctgacggggaaattggaattttaaaatgaatttttgagaaaataatacaagttttcaaaaaaaatttcatttaaattttgaatattcaaaaaagacatcgtttcaaaaaattttctttataaaaattttacaaccaaaaaatgcgcggcgcaccgcgcaacaaaaaaaaaaccgcggccgcgcaccgcacattcaaattgccgcggccgcggatcgcgcaaaaaaaaacgccgcgaatcgcggtcgcgctccagccctggtccggtggcgccgataggctccgccgggaaaattttaaaaactttacacacaatttcttagcagatttaatacaatacttcaataaa

SEQ ID NO: 75774 - DNA, 747 bp, Heterodera glycines
  misc_feature (14)..(14): n is a, c, g, or t
  Genomic contig location: Contig_ID=SeqID_12197; Location=84..830; Strand=+
  SCN-specific regions: Sequence locations=1-145,188-747
agaaactataaagntgagtctcatgtctggtactcaattacatgcagagatggcgcggattccgatttccgatttatggggttggaattccgattctcaaaagactggggccttggaacaccatccctgcttacatgcataggccaaaattaaattataaaatcatttcatataattatttatttttcaatgactttttttttttttgattaccgtctcgtccaaaattaacaaatttaatgcaattgccaccattcgctgctgcttctgctccgcccaccagcagattttgcagctgtacgcctttaaaaccacgtcaaatcgaatgtttttgtcctcggcccacactttttcgggaattattgcacataaatcgtccgtataagagcgtcattagcaccaatgtttttacttttacgtaaatgacccgtcaaatgaaacaatacaatatttgcaaaatttaatgcatttggtgcgctttttatgcgaaatttgacccgatagtccttgagttcgcattggccaccatcggcaactaaacaattaattaatactgcctttggtgctgggtcgttacttaaaaaccataataatgggcgttacttaaaaaaccatcataataagaaatcaatattcctttaattaattatatgattacaatttgaaattacatgagttaattgcaatttgatatttatcccttttatattttattgctttcctcaaattcacacatttttatttgga

SEQ ID NO: 75775 - DNA, 1457 bp, Heterodera glycines
  Genomic contig location: Contig_ID=SeqID_12198; Location=32..1488; Strand=-
  SCN-specific regions: Sequence locations=1-92,123-366,415-664,709 -825,847-1156,1179-1221,1244-1457
  Gene Ontology: Mol. function=GABA-B receptor activity; Cellular component=integral to plasma membrane; Biological process=negative regulation of adenylate cyclase activity
atgcgccttgaggatgtgatgctaatgccgattctcgaattgtgccaaagcaatcggcacgaaatgtggaccggtaagagacttttaaacacatttatatatgttttttaaaatattttttagtcattgttctcggccacaagggacttcttctgttgcttggtcttttcctggcctatgaaacgcggcagctgaagccccgctatttgagtgaccttcgctcaacaattttgtccgtttgtaatgttggcgttttgtgccttttgaccgggccaatcattgcgtttttcctgcgcaatcagcaaaaccctttcttcggctttgtttctgtcacgggtaaaaatactcatcaatgaatggacttggattattaataaaatattattaattaaaaaattatatttatatttaaaacgaaataattatcagggctcgcaagttttttttcaaaataagacaaaataggtgaaaaactaagattcggaccgcaaaaataagattttttcgaaaactaataatagcgcgaaggaaacgcaataaaaacatgaaaaatgacttgaaacaatattttattagcctaaaaaccagggctgctaattgaaacttttcaaaatagcattggccaataggaaaatcatcatttggcgtcaaaatcagcattttgataatttaattcaaaatgaaaaaataattgaaaaaatttttttacggcgcgctttttccaaaaaacttttggtgaatgggggggggggggggtgtccggcggtgccgatagatgccgacgggaaaattttcgaaaacttgaatgcaatttgttaaaatattttcaccaaaaatgaccaatttttgagattttgagccaattttgaggaaaaatagacattttgactattttttaacagattttctctgaaattttggttattttacactcaagaatgaaataatctcttaattcttttaaaaaacgaattaattcaaatattcgcttcaataaaaatagtcaaataggtcattcaaattttgcatttttttttattttcaaatccaaaaataagtacaaaataagcacgtaacgctgaaataagcacaaatcttagaaataagcacacttgcaagccctgtattataatcaacccttaattgtttatttccgattatttttgtttatttgttaaccaattaacagaaaagaattcccgtcaaaaatgaattttcatctaaaatataaattataatttttgtaatacaatacaatttgtcagtgctcacttgccttttcgccagtttgggcttagttatcgtgcccaaattgctgttcatttaccactggcccccaatttaccaaggaggagcaacagcaaagcacgcagcgccaattgttggaggagtcagcgccgaaccgtagcgaacagctacgggatccgcaactgctaaaggaaaatgcggagattaaa

SEQ ID NO: 75776 - DNA, 375 bp, Heterodera glycines
  Genomic contig location: Contig_ID=SeqID_12200; Location=3629..4003; Strand=-
  SCN-specific regions: Sequence locations=1-144,200-233,272-354
gtctattgtaaaaagtattcaaggatcaaagtttggatacaaaaatcagcttactcaaaatccattaataaatgctaaaaagaacccataattatgatacgttttatatacatctcaaaaaaaaatttttttttgctaatttggtataaattttcaaaaaaattttttgataaatatttacgttttttatttattttttcaaaaatccatactaatttattctgtgctgataacatattttttgactgtcatttctcctcctccatctgctgagtgttgctgctgttgaattaaaagaatttttctttttctttttttggtaatttttgcataaaatttgtgttcatttttcccatccaaaaaacagaaaataaa

SEQ ID NO: 75777 - DNA, 1822 bp, Heterodera glycines; identical to SEQ ID NO: 12202
  misc_feature (1775)..(1775): n is a, c, g, or t
  Genomic contig location: Contig_ID=SeqID_12202; Location=1..1822; Strand=+
  SCN-specific regions: Sequence locations=1-175,198-572,596-802,826 -1124,1158-1287,1310-1409,1432-1443,1478-1480,1502-1514,1536 -1724,1746-1822
  Gene Ontology: Biological process=embryogenesis and morphogenesis

SEQ ID NO: 75778 - DNA, 290 bp, Heterodera glycines
  Genomic contig location: Contig_ID=SeqID_12204; Location=496..785; Strand=-
  SCN-specific regions: Sequence locations=1-290
  Gene Ontology: Mol. function=cytokine activity; Cellular component =extracellular space; Biological process=skeletal development
ccggctacgaagcctaccaatgccgtggccgttgtgcccatccattgccggccaaactgaacactaccaaccatgccatcgtccagtcgctcatccactcaattgacccccactccgtgtcggccccgagttgcgtgcccgttcaggtcattcccgcgcaaaacatgttagaagttcttcctttctcgcttcagatgagtgccatttccatcctttacaaggacattaacaatgtgattgtcgtgaagacttatgcggatatgcgcgtggattcttgcggatgccattga

SEQ ID NO: 75779 - DNA, 725 bp, Heterodera glycines
  Genomic contig location: Contig_ID=SeqID_12206; Location=80..804; Strand=+
  SCN-specific regions: Sequence locations=1-59,81-378,404-627,650-725
ccactgaaattcgaatcccttccaccgcaatgagttcattttcatttccgtgggcgacttttctgtttttctccctaatttcttgcctaatttcgctgacagaggccaacccgaagtttctctgtgagttcgccttcttcatctgatcattttttgtcggactttcttctctccctttttccattaatttcccccattttttggtcattctttccctccccccttttttcagtgtcctgcaaagtaatcgacggcatttgccaaaatgacgaactttgcttggaagaaatgggcattcgtttccccgactgttatttggagcgcaaaattggttaataatttcccaacagatgatccttccttggtaaattttcaatctaagattttctccaaccccaaaaaagcgcactaaaatccacgccattcactgaaggggcaaatggaccacaacgatttctgaaaaggactccagcgatgaaactgatgaaggtgctaataagggggaaagtgaacggcataatgtaattaatgccaataaaggtgctaatgatgaaagatcggattccggtgggtcggagatgagcggagaatgccaaacgaataaaagtgaggatgagacgagcaaagacaaacaaataataatcagaaattgccacctcaaacagtccattcattctgtgcaaaaagacatttagaggcgaatgtttaataaatggaagaatcaa

SEQ ID NO: 75780 - DNA, 591 bp, Heterodera glycines
  Genomic contig location: Contig_ID=SeqID_12207; Location=656..1246; Strand=-
  SCN-specific regions: Sequence locations=1-49,71-303,325-504,543-591
atgcacgcgttcgaaattgacgagcggaccttccaggacttgaagctggacgacgaggcggaggatgacgcagcgacgggaggagcccagaatgtacaatcatcatcagcaacaacgacgacgacgggcaaagttgtcgtttttgatgctgaactgttccaagacgaggcgggcatggtggacgacgacgacgacgatttgttgcagtcaaattcgtcgacggatgatgatggtggtgatcaacatgatgatgatcagggtggagacggacagaagtgacccctctcctagccctaactcccgcttaattattggtaattgcattgaacaaggaaaaaacagaaattttttattgccctatgaattggcatgtgtttttttcattggtattgtgcgtgcttttttttgttcggtttttgctcattcattgatttgtttggttggaacatcagcagcagagccaatgtttgtatgtgtcaaaattttttgcgtgttaattgttggataaatattttacagataatttttttaattattaaaatctctcgtttttttaaaggattggaaaacgtttttaaagaaaggaataaa

SEQ ID NO: 75781 - DNA, 1946 bp, Heterodera glycines
  misc_feature (763)..(763): n is a, c, g, or t
  Genomic contig location: Contig_ID=SeqID_12208; Location=255..2200; Strand=-
  SCN-specific regions: Sequence locations=1-20,42-489,512-659,691 -1098,1120-1184,1206-1208,1231-1417,1439-1517,1539-1946
  Gene Ontology: Cellular component=nuclear pore; Biological process =protein-nucleus import
atgtatcggttggttcattttatttggtttttgcttttagatgtcgaccccaagtcggttctctgcgttttctttaagcaaggcctttgcaccaaggggtaatttctacaaacgtttttttttaatctaatcgtcacttttcggaatgtttaggcattttcttagcctaaaaaaactaaatccctaactcagactcaaaaaatctgaatttttttttgttgtgtaacttacaaatttttttattatttttcccccaatttccagcaacaaatgcaagttcagccatgacctgtccatacagcaaaagacaatgaaaaagaatttgtacgtggacagcagggatttgggcgataaaaaagacggtttgtttttttttattgcggaattttttttatttgagggggtctaaattcgaaaattttattaactgaatatcggtcgatgctcatcaaactttttttgtttcaaatagtttccatttttcaacgcttaggccttgaaaaatttttagagaccaatgaaaattgggacgaaaaaacgctgcaagatgttgcggagaaaaagcatggtgaaaaggaccggaagaggcccaaccaaacagacattctctgcaaatatttcctcgaagcaggtgagggaggcgaacgaggaggaggattggggttttttaaaatttaaacaaaaaatttgccaatttttgcacgatatgggtctactgggcgccatactaccacgaaaaatttccttgcgattttttttctanattttttccaaaaaaaatgctaaagtttttttttattgaaaaacaactcgaattttaatgagattcggaatttgtttcgcaatttttgttgatttttttttgtggtttacgactagaacccggatgggatcgccgggattttccctatcccgtcgactttttcaaaatttcggactctaattgctgaaaaaatttaagtggagaacagcaaatacggatggttttgggaatgcccaaacggcgacacatgcatctacaggtccgttttttttgcggaaatttttaaaaattccgcaaaattttgcttaggcatgccctgcctcccggctacattctgaagaaggacaaaaagaaaatggaggagcagaatcggctgacccgaatcacgctggaagaattcattgaaacggaggtaaaatggatttttttttaaattttaattgggtatttctttaaaaatatccaaaatttacccaattttccgattttaacaaaccataacgctcattctatacaaattcgagcagaaaattttggatcattttcacgaacataaaaaattttttatagaaaaaaacgggagtggcacggagccccgacatttgcggcccgacttttgcggtccagacatttgcggctatgtccaaaattggattcaaagttgtgttttttcaagccctgatagcttaaacagcatttaaattaagaaagcactgtattctagtttattagaaaatttaattctgttgtttgaaaattttattattttttcaaaaattcattggagatcaaatgatcggatacaagcactttctatcgctttgttaaagcttttaggcgatcagggattgaaaaagcttaagtttgagcccgattttggacaaaggcgcaaatgtcggggccgtaaatgtcgacgaacgcttagggtctcaggaatttaaaatgttagaaagccttacggacatttgcggacggacacttgcggacggacatttgcggacggacatttgcggacaatttctgagaaaaaaaaaattaatggaaacatttttttctaaaatctaatggaagagtgggcctcgtcagtgcggctcttccaaaagaaaacaaaaaatgtaaaaaaagtgtgtttcggccctaccgcagacacacaaaactaaaaaagcacacatcaacaaataaa

SEQ ID NO: 75782 - DNA, 1976 bp, Heterodera glycines
  misc_feature (341)..(341): n is a, c, g, or t
  Genomic contig location: Contig_ID=SeqID_12209; Location=715..2690; Strand=+
  SCN-specific regions: Sequence locations=1-40,62-100,156-178,200 -468,508-571,593-819,854-1011,1036-1119,1165-1473,1497-1508,1537 -1572,1600-1622,1654-1859,1881-1976
  Gene Ontology: Mol. function=potassium:chloride symporter activity; Cellular component=mitochondrion; Biological process=embryogenesis and morphogenesis
gtggattgtacaagatggtggcattctgatgctgatcgcttatttgttacagcagcacaaagtgtggaaaggctgcaaattgaggtgggaaagtgaagacaaaatattaaatattattttatctttttcaaaattaattttaaatatatttaaatcagaatttacgtgatcgctcaagagggggagcaaaatgaagagatgaaacatcgcctgcaacgtcacatttacatgcttcgcattgatgccacggtgggttaattagcgcactaaaaggcgtacaattaatatgggattaagccccaatccaatgcgatgaattgcgaatttttgaaaattactcncctgatgagagtgttgctccccgatattttttcaatttatcccagccacccccgacaaatttttcgagaatttcatcccctatcccccacttttctctccccgccgaggatcggggaatttaaatcgtaaataataatttaactgattttttaaattaattaattagcagataaaattgccttgtttaatcactcgtcgctaattaccttttaatgaatgcatttctttctttgcaaggtgttcattgtgaatatgattgagcccgaaggtgttgaggacgacgcggtgcagaagacgctgaacatggagcagcggacacggacactaatgaaggcaattaacaaattcaaaattgagtttttaatccattagtgagtcttcagaaaaatttgtccgccctctcaaatgggggactgtccaacggcggcttcacgcccgatgaacgcttccgaagtggcacaaagtgagagaagcaagaaatttatataaactattatttttaaatattttaggctatcatatttcctaaaccccttaaattagaccccccctagaaataaagcccaccttttgagggcaaattgaaaaataaaaccctcggaggctctattttaggaaatacgatattttgattaaaatctacattgggcaaaatggtctatcaatttcaattaaattttattttattattttggaagaaaaaagtttaattatcaacgaaaaaatgcttgtgagcttttctttttaatagtccgctttatgactgactaattttggttttattaattgaaattaatttaaaatttaatttctttattttttcacagttcgcccaatggaaatacgttggccgtgcccaataccgtatgccgaccgccacgagacagtgtcatcgagaccagctttatacagtaagcttttgaatttcgggaataatttatttgcttttttagaaaaactttccaagaagaaaacaacgacactgtaagcagtaatgagataagcatcaaggacattgacgacacgaaggtggagggaggaactaattaaatcaaaacaattaaaaaacctaattatcagattaattagatatttaaatcgtttcttataatgctaattaatgaatcaaaattttatttgttcattaatttaatatatcgcacttcaatttatttaaaaatatttattttttttcaagaaagctaaatatttttttatgaaaaattggttaataattaaaaagaaatcttttcaaatcgctctatttctatattattaccataaaattaataaaaagaataattattatttctcaattgtttttaggttcaaaaaatgaatgccgccgtccgactgaaccaagtcaattttttaataatcttttttcacatttcaaccaatttcgctcaggttattctcgagtattcttcggagagtcaattggtgcttttgtcgttgccaaaaccgcccaaatccatccaggccctcgtcgaaaattatttgtcatatgtaagaaagccaaaattttggttttaaaattccaaatttttcaggtcgaagccctcacggaaggcttgccacgcgtgttgctgatcggagggtcgggcaaagaagtgatcacggcagattcataa

SEQ ID NO: 75783 - DNA, 1368 bp, Heterodera glycines
  Genomic contig location: Contig_ID=SeqID_12209; Location=3303..4670; Strand=-
  SCN-specific regions: Sequence locations=1-419,481-675,747-988,1016 -1182,1317-1368
tttttcccggacggtcctgaaaaggtcgacgtcgcattttcatccggtcgactgacagtgctggtcaaatcgcgcatgctgttcggctatgagtttgatcagaaaacggcccaattcacgtgagacaatttttgatttcattaaattattcgaaaagaaaaaggactgagatgctttctcgagtcatgactaattatcacccgagaatctcgaacatttgcccttcttttcgaggttagaataaaaacggaccggggttgggattaacgaattcaaaataaatttttattcgacaattttcgaaaaataatcctaatgagaattttggaagtccaaatgggactcagatcacttccaattccgctatttaaactcatttatatcattaaaagaaaaatcatatgttcgaatatcatttctaaaataaataattttaattatttaaatatttcaaaatgttttatttgtatttaatttttaggcgtgaccaccgttacccccgcgaattgcacagccgaattcttttctaccccgagggcgcttttccgattgtcaatggaagcgtaattttgttcaaagtatggcaaaaacaaataaaaaataaatgttctaaaattgaaattcaggacgatgtgttcgccacttacaacgtggagagcaacacgccgcatttggtaattagttaattaattcattccaattaattgattgattagaatcattagttacgcaattaattaattaatgagtaaaaattccagttcggaagcatgtccgaatttttccccggactgccccaaaatttgcgcgccggttttgccgccacgcccgattttaccacctaccatatgctgaccaatgattacggtaatttgctgccacaaacaataaccgatcgattttgcatattgtgccctcaatttcaatgaaaatttacaattttgaacctaataaaaaataaaaatgaacttttatgccaaaattgggcttgatttccaaaagctctttcttttccgcattaatagggcaattagcacaaataattaacaaatgttttcagcatttttgtacgatgttcgcgtggcacgaacagtcagctcacaaagcattggccaatttgttggctgtgaggggaacaaattaatggtgaaaagcaatttattaaacattctatttgtataattaatttataattaatgtttcttaattaacactttaaattaatttaaattattatttttattaattttaattattaatttatatttttaataaaaataatagttttaaatttcgtttgttaattaattaaatttttagcctcctggtccaccgatgcctcatcttttcttcccataccagccgtaa

SEQ ID NO: 75784 - DNA, 1285 bp, Heterodera glycines
  Genomic contig location: Contig_ID=SeqID_1763; Location=2585..3869; Strand=-
  SCN-specific regions: Sequence locations=1-286,308-517,539-676,700 -1285
atgcacgttgctttttcttttgtgtttaggtgtcgtcaagagcaccacccaaagtgcaacattttcgggcgcaattgtgttgggtgtgtgtacctctacacatcgcagaaatgcgacgtggtggaggtgcggtgcagctgctactactgttgcgacccacagtacgccgcgacgtgtccggacggatgcaaaaattgcattaaggacggggaagggggatgctcgcagaaatcggcagaccatttcaagactttacagtatttggcaatgagaatccgttttaatgatctaataataatattaattagaatcccgatcagtagaaatgagttgtctctttcgtcattggaaccgatggaaaaagttaacgcgcactttgaaatggtaattagcataattaagagtgatttactcactcacatcaattccatatttataaacagatcgatgcggacaaaaatgccggaatttcgccagaagaggccatcgcatttttggttaaaacaaagaatggcacttcagctgacgatttggccaaaaacatggcctggttttcccagatggacagcaatgggaacaaccgaattgaacccggggaatttgatcgatcactgacggagtgaaagatgcgagggcgagatgatttgcttaccggaaagaaattcacaaaccaaacgaattccatgaaaatatgacaatttaaaaaggttttgttaaattgaaaattaaccaaaaacggcaaagatgtttttgtacaactgttctggactgtattgtcactgtaatgatgatatagtggtgtcatggcagttcgtacaatggcgtttcgtacaatttcaaatgggaatggccataactttttgttcgtcagttaatttcctgaaaattggtataattcgaaagctctacgtgtttagaagctatcattaagcagaagctaagcgattaatcatctcaccaaaaagttatgatttatagtttacaaaaaatagctttttcttgaatttttaattcttataaatcataagtttttggtgagatgattaatcgtttagcttctgcataatgatagcttataaacacgtagagctttcgaatgataccaattttgaatcaaaaactgctaggcccggcgaaaggtagagagacccaactattttccgagtttcattcggaatctttatcaaaacatctttacttgtgcaaaagagtttacactcgttgcattaatttgttggattagcagtcctgttcaccacttaagaaggtggaacgttataataaa

SEQ ID NO: 75785 - DNA, 981 bp, Heterodera glycines
  Genomic contig location: Contig_ID=SeqID_1763; Location=1..981; Strand=-
  SCN-specific regions: Sequence locations=1-17,40-79,103-250,289 -386,408-562,605-627,649-774,796-814,854-981
aggaatcacttatggggcaaaacaaaggcagcctttaaatacgcatatgaccattatttagtaaatttaattaccaaccatttttattaaaaataataaattggtaatttaagaatgactttgattggtttctcaagactgacgacgacacttttgtgattgttgagaatttgcgcttccttctgatggctcattcgccagaagaacccatttattatgggtgcaaattcaaaccctttgttgaacaggcaattaaatgaaattaataataattaataaatttaaaatcgattagggctatatgagcggcggagctggctacgttttgagccgaatggcattgaaaaaatttgttgaagaaggactccccgacgaaaagaagtgccgggtatttttattccgaaaatctaaaacaccaattactaaattcaaataatttgaatattagaaatttttccttatttcttgaaacattaatatgtaaaaaatcagattatctattttaagcatttaacattttttaaacttgaattatatattttttacttgagttaacttttgctttatatttaaatattcataattaaattacatttaaatatttccatcttttaaaaaaaattgatatttggaatgaaaaaattttttatttgattatcgctagggatgatatttttagctttttatctattttttcctgagttaccaataggcttaaaagcatgaaaatatgtttttttcggtcgttgttaagctacttttcgtgtttttagaacatattttctatgttactatttttagaacctaaaactcaaaactatttggaaaaatattttacgtattttggcgtttcccaaacatattaaacaaaatgcaataaaaacgaaaaatatacccctaaaaccgatcgcttcagaaaatacatctctaaaatcgacatattttttttcaaaatacaaccctaagaatggaccaaaaatt

SEQ ID NO: 75786 - DNA, 2322 bp, Heterodera glycines
  Genomic contig location: Contig_ID=SeqID_1763; Location=7775..10096; Strand=+
  SCN-specific regions: Sequence locations=1-5,31-449,471-702,725 -1071,1093-1121,1143-1206,1232-1672,1695-1773,1795-1844,1873 -1914,1952-2322
  Gene Ontology: Mol. function=ligand-gated ion channel activity; Cellular component=integral to plasma membrane; Biological process =signal transduction
atgatcagagatggccttgcccacaggtccacgaaggtgccgttctccaacttttccaagcagtactccctgtccttctattggtcctcgctgactctgaccacgtcgggtcagcagccgtaccccacggcggcgatgcacaattttctagaaatattcgacacaattatcggtgtgctcgtcttcgcagtcattgtcggcagtgtgggcaacgcggtcggtcaccagtaaagacaattggccggtcaaaaacaaaacaaaacccaagaccaaaattaaaagaatttgaccaaagactgttgccggcccaagagtttcctaaaatcttgatgggcatccaaaaatccaagtttattttatcaaatttattgttcttgtttcaaacaagcatgtttgtggcgatttaatctctattttttcgggttttattgcatatttgccattttttaggattcttttcagattttagggtttagtgtctaatttgtaattttaggtgtctacgatgaatttgactcgttctgagcttcaacagttgaatgatggcatcaaattttacatgaattaccgtaacgtaaaagacgcaatgcaaaagcgcgtgttggactgtatccattacatccgacggcacgcgcaaatgcatgacgaaagggtggacaaatcattaagacaaatttgaaaattaaacatgaaattaatgaaacccaggccatccttggctccattttgcccgcccgactgcgcggcgaattggccgttcatcttcactttgaaaccattgtaaaatcacccgaaattgcttacaacaatgaatggtttgaatgattcccttccaattaagagccgagtgcaattgtttgcccattgtgagacttcgcttctctacgaattggtcttacgcttaaaaatgcaaatggtaattaaatcctaccggattataaaattgacataaaattaatcctgaatatcagcaaaacaaaattcaaagattcgtgataaggtcggggtttaattgattgtcagaattgttaatggctaagtccttctgcatttttctggtcgagctcggtctgtttttggtctgaacaccttcagagtgcctgggcccgaccaaagtcgggatttcttatgctgctcaccaattaatcgcaattagagaatggcaaacagaaatgcctaattcggccactgattttagagcgtattgttaaaataaaactaacaacaaacgtaacgggaaatttaaattttttcgatcggcaattacttttccatcattaagttcgcaccaaatgattttctctgtcgtcgcggcgatttagccaaagttagcgtttcactttttcgactgtttaaagagttttgaaatttttgtaggaaatgtttgtgttgaagcgtggtgttcttgagattattgacgagaatgaacgcgtagaacatttggaaagcggcgcaacatttggcgaaatgtcaattttgaaaccgatcgggccgttgggcaaattgttggcacgacgcaggttggccaaccctttttctatttggcatttggaattggccattctttgttaagccattcactgcgatcgttgggctattccgaggtgtatttgcttagccaggaggacgcgctcgaagtgttcgctgattatcccgaacagcgccaaatgcttatccaccacggtggggaagcaaagcaaaaaaacacttaatttggaagctaattaaatatagggaaataattattagcattgaatagccaaataaaattaaaaaatggattcaattaatgtaaattggttgcctctctttcttcttttgtcattccgtctttccattaagacaaaaaaattatatttaaatgaatttttagtcttgaaaattgagctcatttcatttaaaaaaatgaatttcataaagacaataaggaaaaaatataaacaatataaaccttgaaatattacttgtttatgaaaaaaattattattagccacacaattgttgatggagcgtggcgaggtgtgcggtgccgaattggtcgagccgggcccattggaccctttggaactgtgtggtactgaaaattcggccgaactgcttcaattgctcggcaacactctttgcggcttggacgccacactggacgcactctatgacaaatttatggttagtcgtttatttttcattttatggtattaagctggcccactttaggtgaatagttcagagcttaagcaacagctaacagtgctcgagggaacctaccaaaggaaccggcagaagctgcgaaagaaatggcacaaaaaattgtgccaaaaatag

SEQ ID NO: 75787 - DNA, 635 bp, Heterodera glycines
  Genomic contig location: Contig_ID=SeqID_1764; Location=171..805; Strand=-
  SCN-specific regions: Sequence locations=1-68,91-189,211-353,375 -434,456-635
atgcgatacggtaggaatcgaacgacaaacgaaatcctatggcattttcattttgtttaccttgcccaacaggccattgaatgtgccaaggccgagaagacaaaggaaaagcaaaagaaaaatgcaaaaacagaaaaagcggagaaattgccaataaaatttgaggaaagtgagtcatcactggatttgcctttgaaattcaaattcagcagctaaaaatcattcataaatgaagtcattagccaaaaggataattaattttgaagaatttagataaatgtgaaaattgtgttaaaataagaagcaccttttcaccttttcaacgagaatgcgaattatcccccaaaaaaatattgaagtaaatttttgaaaatcaatgagaataaaaatttttgaccaaacccacccactgagaagtgattttgtaggaaaattaatgcttaaaatgaaaaagacgaaagtgtgggattattggagaagacaaaggcgacaaagaatattaatggtactcgaaagagggcttttcccataagaatttaaatttgtaaaggacaaaaattttgaaatgggaaaattgaaatgaaagtgacagaaaaaagatgcaaacttttgcagaattaatgccaagaaataaa

SEQ ID NO: 75788 - DNA, 529 bp, Heterodera glycines
  Genomic contig location: Contig_ID=SeqID_1764; Location=846..1374; Strand=+
  SCN-specific regions: Sequence locations=1-213,252-529
atggcaatgaatggcgcgacttttacgggacgacgcgcacttttacccttggggcgaccatgtaatatgatgtttttttcattttttcatccaataaatgttatttagccttttttggccccaattttggtccgggccgagtgccgggatttcgagcgccgggaattggccgttccgtcggaaaattcggcccaaacgcatatagaagtcaccttttttaaaataaagttaattagttaattaattttttagccaattcgatcatttcaccaatgcgttttggacgcggaggttttcggtcttcgggaagtgaatttggtgaattgttatgttattttcataattattttaaatagtttcagctaatccgaacagcccatttggcgctggcagacctttgcccgttgttggaccttatggccaatttccagtcgcgagaaggcaaatgccattccgactttaattgtctcaaatgactcattcattgaatggatggaaataactcataaaaacccataaaataatttta

SEQ ID NO: 75789 - DNA, 412 bp, Heterodera glycines
  Genomic contig location: Contig_ID=SeqID_12211; Location=186..597; Strand=-
  SCN-specific regions: Sequence locations=1-58,119-278,301-412
atgcgtttcattcattgctttgtttcaatgcttatcatttgggctggtgcacagctggtaaaattaaaaaatgaataaattatcaaattttaaaattaaaatttaattaaattaatttcagacttttggcaccgattattccccctattccccctccggcgcctattcggaaaaggcgggcgattacgaatacgcctatggatcgccccatcggctcgtcgacggttaggataattacctccattccccgccactttcatccattaaatttcaattgtttggttaattaattaattggtcattatttggcagattacgtttgcgaccttgacgcttccattttggtgttcgtttttttgaatccattttatttgcctcccattttatgcatttaattttaatttcagagtga

SEQ ID NO: 75790 - DNA, 575 bp, Heterodera glycines
  Genomic contig location: Contig_ID=SeqID_12211; Location=1194..1768; Strand=+
  SCN-specific regions: Sequence locations=1-6,28-238,509-575
  Gene Ontology: Mol. function=protein binding; Cellular component =axoneme; Biological process=N-linked glycosylation
atgcgtcttcttctttttcccaactttggcctttttttgtgccttttggctgcagtgactgtttttggcattgaggtcaaaaggacaacggaagtgagcgaacgaaaaattcaaaagaaaaaagaaaaaaaatttaaattcagcaaacaaattcaacaaatccaaattctgtggataaaatcaaaacagaagaagcaccgccgtcgacggtgacaaattcgaagaacgaaacatcgacaaaagaagcagagaaaacggagcacaaagaagaaacgttgaagaaagaggaggaggaggaaggaaaagagaaagaagagcaaaaagaagaggaggaggaagaggaaggagaagaggaagcgggggaagaggaagagggagaggagtttggagaagaggaaggagaagtgacagaggatgaagaggaggaagagggggaagtgagagaggatgaagagggggaagtgacagaggatgaagagcaggaggagggggagggcaaggaggaggaagatcagaaaagaggagagagtgaagaggcgaaaaaggaagaaaaaggaagggaagaggaactgtaa

SEQ ID NO: 75791 - DNA, 772 bp, Heterodera glycines
  Genomic contig location: Contig_ID=SeqID_12212; Location=1328..2099; Strand=-
  SCN-specific regions: Sequence locations=1-19,46-102,214-284,306 -478,500-587,611-772
atgaaattatttcctctactattattaattattttatttttaattgacaaaattggatcagaaaagaaaaagttacaacaaaagtcatttggcgaaatatttggagaaaaatggcaagaaaaagaagaagaaaaacgaaatgaactcaaaaaaagagaaataattggaaagttttataaaataaaagagaaaattaagcaaaagggaagaaaatattcagcaaaagaatggggaaaaattaactcaaaaatagcgaagaaattggggacaaatcgaaattatattcaaaaatggatcaaagaatttggtcttcaaaaaaagaaaagttacaaatcaaaaactgatgaagaaaaactaataattgtgcaaaaattcgttgaaatttcaaataaatataagcaaaaaagaaaatattcgccaaaagaatggaaacaaaattatgccgaaatttgtaagaaaatcggagttaactatggaacaattgaaaattggaagaaacaatttggaattaactgtaaaagaataacggaggaacaaaaaatagaacatttattgggaaataaaaagaaaaaatccaaaaatgagtgataatgaaattgctaaaattgtgaacacttcaaatgcgaatatttgtaattggaagaaacaatttgtagaagaaatgtttgagaattgaaaacggatgattttttaagaaatttcgttgagtccctctccgatcgacgccttaaaagataggaattttttgtttgaacaaaatatcggaaataaa

SEQ ID NO: 75792 - DNA, 1499 bp, Heterodera glycines
  Genomic contig location: Contig_ID=SeqID_12216; Location=194..1692; Strand=+
  SCN-specific regions: Sequence locations=1-39,61-234,260-320,360 -464,510-564,595-729,751-761,783-959,1108-1192,1214-1499
  Gene Ontology: Mol. function=transmembrane receptor activity; Cellular component=plasma membrane; Biological process=transport
atgcgcggcgtccacgcaaatagccgccttctggtgagtggacaagatggttggctggcaggaagcaccgacgaagcgtggcaagcgcaagaccagccgccgttgatgacacaatgaatggatcaaggccttgtgcatgctgttcaatcagatggcgaaaacggatgaccgactctcgcagaatggcaacgtcgttgcagcagtacatgatcagctgctcacgaagctgaaatctgttgccgttgttgttgttgttgttttcagtgtgccagcgaaccactcccccccccctctaatagagtcactcctcttcgcttctgtttttttttaaatttgaactaatttttatttattttttacttaagcacatttgttccaataattttcaatatttcaggacgaaaagcgtcgcaaagacctgcttctgcagcgaatgttgcccatttcggtggcccaacaggtgttgtaacaaaaaataataacaaatgaaaattgaaattgaaattttacgtgttagtatggacaatcatgtttcaaaaatcataataccgaataaatttttacgaattgtatttttaaaaaataaaatcccatggcctagtttacaaagaaaaattcaggccttcagcgcctttaaaaaaaaaaaagattattccctgatcagtcattaaatcgaataatttttgaacaattatttttcaaaaaagattaattatcccaaggcctatattaaaaaatatgtttaattttcccaagggctgtttttcaaaaaatatttttccagcttctggaggaacgtgaggttgtgcccgaatcgtttggctcggtgaccatttatttctcggacattgtcggcttcacgtccatctgcagtgaaagcacaccgcaccaggtgatcgccatgctcaacaagctgtacacactgtttgacggggtgcgtttgcatatttttgacaatgaaataataataaattaatttattaattatggatttatgcaaaaattgttaaatatacctttttttaattattttttgtttaaattaaataaaattacatattaatttattttatttttttaaatgtagaattctttaaaaaaaattttgctgtaatttttttaaacacagaataagattatgccaactttagtgtaaagtgtttttcatttcaaatgcgcatagaataaaaacttttttacaattaaaatatgttttttgtaaaaaaacaaataagttttacaatgccaactttaatgtaaagtgtttttcatttcaaatatgcatagaataataaacttttttacaattaaaatgtgttttttttatatacagaataagttttacaatgccaactttaatgtaaagtgtttttcatttcaaatgctcatagaataataaacttttttacaattaaaatgtgttttttttatatacagaataagttttacaatgccaactttaatgtaaagtgtttttcatttcaaatgctcatagaata

SEQ ID NO: 75793 - DNA, 169 bp, Heterodera glycines
  Genomic contig location: Contig_ID=SeqID_12217; Location=816..984; Strand=+
  SCN-specific regions: Sequence locations=1-55,80-169
atgttcgataaggaaacggaagagtacaaatgggaaatgttgaacgcgcggagcagggaggagcggaagaaggccaaggaatgtgtgaggggctcagtgttactcaagatggcccaggatagagcgttctcggatgaaagaacaacggagcaactggcaaagtcaatgg

SEQ ID NO: 75794 - DNA, 1144 bp, Heterodera glycines
  misc_feature (46)..(46): n is a, c, g, or t
  Genomic contig location: Contig_ID=SeqID_12218; Location=49..1192; Strand=+
  SCN-specific regions: Sequence locations=1-475,497-664,686-746,777 -797,819-1144
atgaagagttcaccgaaagcaattggcggcggcggcatttctttgnatccgtcaacattctctgctgctggcacatcaaccggcggtccctttgatgttgccgaaaacgttcatggcatcgatcatgttacgcataaaccatttaattttttgcgcacgaactctgagcgtgaagcggaggaaaagcggcagcaacaaagacagcaacgtgaagcgattgtgcgccataatgagttcataatgatgggaggaaatggatttgatgatgaagacgaatccgatgtggactcggacatggactcgccaagaaatgtccaacaacaaagttacaacgacggtggtcatcgccgccttggcaaaagcgaaagcaaaaaaaggttggcagaaaagaagcagcagctcgcggaagctaaagctgaattaaaaatgcaactgagtgggctcaaacaaatacgacagtaaaatttttaaggcttttgcatttgggaaaaagaaatacaaattttgcccaaaaaatgggtgcgcgggtcctttcgcaaaatcatccgcgtcacctttggacattttgtaaaatgcgccattttaggctatttgttaatactgtagtttgtccccaccccattttagaaaaaaaatttcaaaaatttttttgtcataaaaacaagtttccaggggttttgggggtcattggtcacgaatatgatatccatttcggccaattccgaaccccggacccgatttcgaacaaaaagtcgaaaattcaaattttctaatttctgatttttagtctaactatttaattgttcttttattgcaaaattggtagcttttagaatgtatccatgtatttaaaccgattttgagccaaaaatgcgaaattcgaaaatttgaatttccgactttttgtttgaattcgggtccggggttcggaattgttaatgttgctaaaagcaatcaaaatttgcattcttgtcatcttttcgatagccacggtttttctttattagcctgcacaatttcgaatcaaattaacaaatttattataagttatgggctttttcaaaattcgaacaaaattttgaaattttgcaggctaattgagaaaaacctgggatatgcacctcagaggcgttggtttaaaaaa

SEQ ID NO: 75795 - DNA, 1998 bp, Heterodera glycines
  misc_feature (1847)..(1847): n is a, c, g, or t
  Genomic contig location: Contig_ID=SeqID_12220; Location=1565..3562; Strand=+
  SCN-specific regions: Sequence locations=1-68,90-204,226-618,642 -849,874-1176,1220-1344,1367-1399,1484-1646,1670-1878,1901-1998
atgaaagccatcaatttggaaaggtgggcatttggaggaagaggcaacctttattaggaccagggttgccagattaaaattttaaaaagcctcattttgggtcaaaaagcctcatttttacaaaatattcaaaaaacgtataaattgttcaaatgttatatttttgattgtccatgatcgatttgagtaattttttgttagaaataagcattttgtgaaattctgagcacgagaaatcggagttgattttttgctgtgttttttccgaaaaattttttggtgaaccagggggtccggcgagtgccagataggcgccgcccgggagaaaaattttcgtaatttttaatgagatttgttaacagatttgtccacaaaaatggccaaattttaggattttgatcaaatttttaaggaaataaaggacttttaggggctggcggttccgataggcgccgccaggggaaaattgagaattttgacaatatttttagctgattttcattaaaaaattattaatttagtggttttttggaaaaaattggttcttttctggtttttataaaaaattttagcaaaccaaattattaaataattgtaaaacattatgccaatttatcaaaatttaaaatattctgaggattttccccaaaagcctcaaaaatcctcaaaatttctaaaaagccacaaaaatcctcaaatcctcattttccaaaaaaatcctcattgacctatcaaaaagccacaaaatgaggataaatcctcagacctggcaaccctgattaggacgtattattcatcatttaagggaataaatgtaaaaaatcatttctttgcgtaatttttgaattctttattaatttataataattttaacagttttgccgcgattggattcgccacgaaggaagtgccattggacggttcaattggccaaattttgaacagttacggataccgaagcgatggctcatttggctgtaatggcatcaatcggccgtgcaaaatgccatttggccaagtgccaatgtcattatttgacgtttcaatgcaatcggcggacgtggcaatggcatataaatcatcggagttttccactggtgacgtggtcggatgtggccttttcttggacactcaactgatctttttgacaaaaaatggccaacgaatgggtgggccaattaaaattaaaaaacaaattaatgaataatttaatttttaagatgactcatcgtttttcatttcttctcccgccaattctctcaattctctgtttccgtgcgtttctttgtgggcgggcgacaaaaccgaggcgaactttgggcccaatttcaaattcaatttggccactctttgaagaaaacagaaacaatggaagaaggcgataattttgaattaattatttattattatttttgctctttgtttatttttaatttttgttttgtaactgaaatattattttatttgtttttaattttattttattaaaaaatgctcttgaattttttgtgtgttttatatatctgagaattttgtccattaatatagtgaatacaaatatgattcaacaaatttctgttatccaagcctctacatctttcagtccaagtttttggactataactttttttattctcaacgaaatcaaacaaaaattcaaaaatttcaacttttttgcaatttttacgttatacttttttggtaattatttagtcgcgaatcaatagcttagaaacagcttaaaacagtaagcttttgaatgatatcaagattgttggatttggttgagaatgataaaagttatatccaaaaactttggctggcgcctaaatggcccctactccttnctatgtattcttgagggagtgatcctgaatgtgatcccaatgaaattcctgatagattctgatgaatttaaaaaaggacagggatggacttagaggacgggaccccgaaatttaatccctttgatcccgtccggtctttattacaaaaaaa

SEQ ID NO: 75796 - DNA, 1005 bp, Heterodera glycines
  Genomic contig location: Contig_ID=SeqID_12221; Location=198..1202; Strand=+
  SCN-specific regions: Sequence locations=1-38,60-415,488-491,565 -624,648-648,672-891,915-1005
  Gene Ontology: Mol. function=receptor signaling protein activity; Cellular component=plasma membrane; Biological process=oviposition
gatgtgactgcgatcatcttttgtgtggcaatgtccgaatatgaccaagttcttcacgaggacgaaacgacggtggcattttaggattaaattcaatgccaaaatattaggatcaaaaggaatttagttaaaatttaattttcttcgtgtggaggaaaaaactcaaaaattcttaatggtaattacagaaagactgaattttttcataaagattcaatattttttaagtttttgttgacaatttcatattttatttaatttgttgcgaattattttaaacggttaaccgttaaacgtgggcaatttgagaagaagaaatagagaaatagtgtgtggaaagaaaaaaggagtgaagggcagacgcagaagggaaatttattctctcaaataaaaaaataatgcaagcattcacatctcccatgtggtctagtggttaggatttgtggttttcacccacacggcccgggttcgattcccggcatgggaagagatttttttcaattcttttttgtatttttagcaattattatttatattttatttttttatatatattttaaatttaaatattcgcctttttctcttaagaatcgaatgcacgagtcgctgaagctgttcgactccatttgcaacaacaaatggttcaccgacacttccatcattctcttcctgaacaaaaaggaccttttcgaggagaaaatcaaaaagtctccgctcaccgtttgcttccccgaatataatggtaaatcaccaattaatgattaattgccctaattaattaattgttgcctaattacctgtgttttctctgcctttttaggccgttccgattaccacgaggcgtccgcatacattcaggcccaatttgaggcgaagaatcggtcgaccaaaaaggagatttactgccacatgacctgcgccaccgacaccaccaacatccaatttgtgttcgacgcggtcaccgacgtaattatcgccaataatttgcgcgggtgcggcctttac

SEQ ID NO: 75797 - DNA, 777 bp, Heterodera glycines
  Genomic contig location: Contig_ID=SeqID_12223; Location=1..777; Strand=-
  SCN-specific regions: Sequence locations=1-55,95-248,271-349,373-777
atggagcattttccttctaaatttgttctctgcttgctcattgcattcatcggtgaattaatttaaaaaaaaataacaattttagttaataattgaaatgtcaaaaaattagcggataatagaaaaatgaggagttgttggtgcggtaaaagagaatcgggaaattaggaatgaaggcaaaaatttaatattggaagaaaaataaataaaaaaccaaaatttcatattagatcagggctcggatcaaaaattttccaaaatcagaaacatcgggccgaaaaaaacagattttggggtcgaaaaccagaaccttttgcaaattgctttaaatcggcttgtgtaacaattgatcatttaaatataatatcacattttgattttgcacctcacattatcggttttaataattttttagggattagattagcaaattgtatatttcggtgcaatcgggatcaaaaaaaaatcagatttttcattcgctacatgaaatttcccgggctctagggccccaaaaaaaccgaaaattctcgactcaaaactctgtactccgactgctgaatatttttacataattcctttccattcaattaaacactaataatataatcttcaaattcgcagccgttccatgctctgttttggcactttctgctggcagccgcgtgtcgatgctcgcgtgccacaacaattaccgctcacaactggcaaaaggcactgcggacaacaaatcgggcaaaatgccggctggcagcaatttgatccaacaaaaatatg

SEQ ID NO: 75798 - DNA, 799 bp, Heterodera glycines
  misc_feature (797)..(797): n is a, c, g, or t
  Genomic contig location: Contig_ID=SeqID_12224; Location=399..1197; Strand=+
  SCN-specific regions: Sequence locations=1-429,451-799
atggaaacccatgaaacagaaaatagccatttacaatatatgaaatatcgaaagatggtaagtgacagaaattataccaggcaatttgcaatttgcatctgaccggacatttggacagggcagcgcggacgtacgagtattttgttttcagtaaaatccgaaaaaattgctatcgtttgagctcacatgcttagaagctaacttttgattttggagccgaattaaaaattgtttctaatcatgtaaagctaccgattgatatgataccaagattgtcggatttgattgataaagaatatccaaatgccacttcttttgaataatcgtatcacttcatttttttgtttgcccgagcaaatcactgtctacctacagaaatgatgttacattagtggtgcccatcaaggttacagtatcccagtggaagttacagtcacagtatcccttttccaggtttggttcctcgtctttcctctgctccaatgatcagtacggcttcgtgttgtacggatcgctgaggtgggtgacgtcactggtgaattccatgcgcaatttgtccataattttatcggcataattagcagcagcatccttttcgccaccatttttgtcataatatcgcacaaattttgtgacacttgactgcccaacaattgtccattcgcccgtcaaaatttcgtgaagataagcagtgaatgcgccatgagtggacagaacaatgtgctcagcttggaaaagcaattaaaaaaaccaacgaaaacaaacaaaaaatgtcagtcaattaaatttaagaccanaa

SEQ ID NO: 75799 - DNA, 1237 bp, Heterodera glycines
  Genomic contig location: Contig_ID=SeqID_12225; Location=53..1289; Strand=-
  SCN-specific regions: Sequence locations=1-78,107-121,155-169,191 -225,249-422,499-850,881-1110,1148-1213
atggtgctcgatttggtcagatacgaaaacaaattgagccattataacaatgttcttgtaaacatcgtaatacagctgaagcaaaaattggaatttttaaaaaattcatgcaaagaaaatgtaattttattataatcaaatatttaaatataaagtgggattagctttgttaattagttagtttatttttataaaataactctctaataagtttaaaaatcacaacatttggttttcttagggaattgtcaaaaatagtttttatttttttttagtcaattaacatttacggtgatcatgaatatattttggacttgattgagctcaatttaagcaaagttaaagtcaaatatatggaaagtgatattacaaatgcagctcaactgtggacattaggttaaattatttatgtgtgaaaattgttttaattgataattaaataaagaaaaaattattttaaaatacatatgtacaaataaattgattttaattttttttccagataaacgtcccactgttatccaatcgttgtgggtcatcaggcatggccatcgacaggacaatattgacaaaaaattatgtactgaagacgaattggccagggatgacatcccattgtccccgctgggcattcaacaatcccaggaattgggaaagcggtgaattgcagaaaattttgaaaaatacaattttgaatttaattagctttgaaaatgttacgatcagcaaagttttttcctctccattttcacgttccgtccaaacagccattggacttttgggcggcgctgaagcaaaaagtcatgcaattagcataaatattgagccaggattggccgaggtcgtcaactttaattaaattttcatttattttatttatgttttgcctttttttagcttcttgtgccttgctcatttttgcaattttgggcagcattttggcaaaaatttattcatcaataaattcagaactgtatcggcacttgaatctgtgaagcaagtggaagaagacgattgtaaatgggtcattaaaaaaacaattggccaaatattggcagacaataaaaatggtaatttattttagaatttatgagtaggcccaatttttccatataaaaagttaattagtaaatttttattaaatttagaccaaatatccctaattatgcaaataagccgttttatctaattatctttttgacaaatttacattaagtgcatataaattaaaaataaa

SEQ ID NO: 75800 - DNA, 1239 bp, Heterodera glycines
  Genomic contig location: Contig_ID=SeqID_12226; Location=161..1399; Strand=+
  SCN-specific regions: Sequence locations=1-108,151-335,380-718,748 -865,887-1142,1175-1239
atgaagaatattctatccaagtggggaattgaacccaggcgaaaaattatgaaaggtagaaagtttaaccactacaccacatgtgcatgtgtgtaatcccatgactaaatgaaataaaatttaattttttctcaaaaatttctccttcttcaccaatttcctactcttttctcgaccagacccccattcttaccagtgcaaatttttaccggcggtaccggtactagacaaaccggtaacggtaatttcatttttgaaaaaaccggtaccggtaccaaaaaaaccggtaattaccggccagtaccggtaccggtaccggtaccgctcaaccctagatataatataattttattggaaattaaatttaaaataaattattcttagtcttagaaggaaatgattaagcattatgaattaataaatcacatgcttactgatttttgtctgaaaattttatcatgatctcttcactattttggcattttcttcactatttagttaatggcatttttcttcactatttagttaattatttgagattttttttcactaaaatttccaatccctagtcgtaaaacaaaaacaaaaaatgcttaattgttagaatattcattaaatttatccgaaatttttgaatttctgaaatagatctttaaaataatggaaaaatgggctttataaaaatcatagatacatatttgctttgccttttattctgataattttttttatattaaatcaatttttcactacatttatgcattaaaaagatttaatttctaattcctacttttaccatccatgggtttttactattcttatttattcatattaaagtaaaatcattgttttaaatcaatgcttaattttataatctatattttacgcatttcaaataaatgatgattgtatctattgtacaaaatgttgtaaattctatacaattgcgtaaattttggctaagaaattttcaaaattatgcaacatatttgaatgacattcaggaatattgaataaactaccggacgggaccgagatttcgcgtgattcttgtggggttccgaccacacggaatccgtctcgaatcttttttaattcatcgggattaagaaggacagggatttgatcgggctacgagtcggaattaaaaaaattatatatattattaaaatttctagatcaggaagaaagctgaatttatatttccaaaaaatttcgtgtccttttatgttaaagcaa

SEQ ID NO: 75801 - DNA, 421 bp, Heterodera glycines
  Genomic contig location: Contig_ID=SeqID_12226; Location=1476..1896; Strand=-
  SCN-specific regions: Sequence locations=1-28,50-52,100-162,184 -199,221-421
gtccagggcctgaatccagatcccgaagagcctgggtttttcctggacctggatttttttcttaattttttttatttagacatattttaatataaaaaagatttcctaatatttttcacagatttcaattttgctgaacagcatttcgcccatcattctgttctctttcaacatcgatgttcgccgaatcgttcggcaactttttgtgccctttttcctctctttccgttgcccgttttgtgccgccgaccgttcgccgcccgccggcgttgtccaagtacggcatttgccagctgcacgctttgttgcggcacggcatcatcgaaaagtgcagcagtgcccatctcaattttttgttacttaatttcgataaatattcgataatcttttgttggaaaattaacaaatttaatttaataaa

SEQ ID NO: 75802 - DNA, 1310 bp, Heterodera glycines
  Genomic contig location: Contig_ID=SeqID_12229; Location=62..1371; Strand=-
  SCN-specific regions: Sequence locations=1-77,267-396,422-476,498 -581,608-711,747-788,810-1310
  Gene Ontology: Mol. function=structural constituent of cuticle; Cellular component=extracellular; Biological process=cuticle biosynthesis (sensu Nematoda)
atgcatgtgagtaagggatttcccctcggggcctatcgcttcgtgaaaaccatgcaaaagttttttgttagaagccgataaaaaaattataatagcaaaatttaaatttcaaaataaatttattaattcaaaatatttttaattctcactagatacaatatttttaaaaaaattttgaatttacaaattttaaaatttgagtcgtctaaaaataaataattatatgttatttaaaaaccttttcatttatattttaaaaattataaccgtatttaatgaaatagaaccctcgggggcttaatttttcaaccccccctcaaaagaaaggttttctggggggagggagtgggttctaattcagtatatattgtatactttttccatatttttctaaacatataatttaattttaaattatttaggcaccgtgccgaccgtgcccaggcggtgcgcctggcgaaccgggcccgtccggtccacccggcgtacctggccagccaggcctgcccggcagatcaagcggtgaagcattgcccggttaccctgggccaccaggcgaacccggcgcaccagggcaagacggaccaccaggaccaccgggaccgcccggcttctcaccgcccgaaatcccggatggcgcttcaggctacgaaccaggaccaccgggtaattttttttttttttgggaaaaaaataaaaatatggtttatctaaattttactgtatatatatatcaatacatttttgattttaggtgatgctggtctacccggtccccccggacagccaggactgcccggtccgcaaggcttggacggtcaggccggtgcacgcggacagcgcggcatggacggtccgcccggtgagccgggcaagatcgggctgccgggcagccagggtgcccaaggccagggccaggcggtgaaatgtccgaaacaatgcgggccgagcggtgccgtgtacgagcaaccaacggcggccatggagtactatcgcagaaggatgcggaaaatgatgaagagtcgaatgatgacgaagaagcgcgtttgaaatgggagcggaagacaaaatgtcttcaggaaaagtgatcggaatggcggatgaaagcgaaaagtgattgatcagatccgttgacggcatagatatttggcggcgtaattttccccaaatttatcaagcaaaatgtttttctttcttttttcttataactgccacagtacctaaaaattagtgtgccctaacccagtgaaatttgttctcaatccaatgtccgccctttgctcgtctcaaatgatgccatcaaaaataaa

SEQ ID NO: 75803 - DNA, 1005 bp, Heterodera glycines
  Genomic contig location: Contig_ID=SeqID_12230; Location=198..1202; Strand=-
  SCN-specific regions: Sequence locations=1-26,58-168,239-308,392 -413,437-492,515-730,752-772,978-1005
atggggagagcattggaccaaattgcattcagttattttgttgttttcttcatttttgttcagtcagtcagccccaccaccaaaaatgattatggccaacattttattaaatttgtggtggcgtcggtggcgcctaaaatttttgtataaaagcatcaaagggttgcgaataaaataataatcataattaatattcaaaataaaaaatgttataatttatttcattatataaataaatgttcctcaagtttaatgcaattacacaaagtctgaataaaatgttccgggttcaaacacattgcaaagacaatttaaaaattttaaatatatttaaataacataaatataaattatttaattaattaataactttattgaatagtaaaattatccatatttttaacgctatttggtttaaaatttaattatttttaatgcttttcttttttatttgacttcgtacatcgctataaatttatgtaataaatacccaaattaaaaatttaaaaaaattcagaatttcagatttacaatagctttttggccttcaaacaatggattttcaaccgaaaatcaaggcctacaaatttgtctgccacatttcgctgctttttgcacttgtttcactgctgtccctttctgtaacgctgccgatgatgagaaattatattgccaatttgagaatggaaatgtacagagagattggccaatgccaagtcagttctcatttaaacattaattttcttgttattttaatgatattcaatgaaacttaatatttcaaaaatattttatttttaaatttaaattgaaaatttttttgaaattgaaaatgtatttattagtttgactaagtaaattccttttcatttaatttttttttttgatcatattattttaacgagattaattaattttatttaaaattgaagaatgaacatttattttatttttataacaaaaatttattttaattagaaaacattttgattatacaaaaataaa

SEQ ID NO: 75804 - DNA, 418 bp, Heterodera glycines
  Genomic contig location: Contig_ID=SeqID_1765; Location=46..463; Strand=+
  SCN-specific regions: Sequence locations=1-270,297-387,413-418
atgttttcgagtgttgccgaagagtttttgggaatgaaagctgctgaattgctcgccaaggagaaggagccggagagccttgcgaaacatttggacgatttgattgctgtgaagataattgcgaaagtcaacattaaggttgtttttttttgcaatttattacatatttgacaaaccacaacataggcgaacagtcagacgtacactggatttgattggattgtcaatttgttcaagaagtgccctggaaaaaatgacagtgatgtgccaaaagaaaaagatgatgatgatggtgacgttgatgagattgctaccaaaaaaacaaagaaaaattgagagagagagagagaaatgattcatttgttgtgagcttcaaaaaaaaaggatttaatgtgtcctttacttttttaaaaatcca

SEQ ID NO: 75805 - DNA, 2488 bp, Heterodera glycines
  Genomic contig location: Contig_ID=SeqID_12232; Location=317..2804; Strand=-
  SCN-specific regions: Sequence locations=1-81,107-145,168-193,241 -632,667-1725,1748-1880,1902-2122,2145-2488
atgataattcgttcgccgccattgacacgacaaagagcgttgaatttgcgaacctttgcgcaaaaccaaaacgcagcggttgaagagcagcagcaacaacaacaggttgaaggagttcatgctgaaaatgaaccattggttaacgctccgatctcgccaggacttaaccgaaatttgagtttgtcggcggaggaaaacgaacaccattttagtgaaatggcagcagcagcagcaaatgacgatgaaattcggcggcgccttttgcatgtgtccatccaatcgaatttaccgccgcgagcaaacggtggtggcaacaatggcgccgagcagcagcaaattcgcaatgaaaatgttggtcacgaggactttgttgaaggtttgcgtgaagttttgcgaccaaattttggaagctttttggtgcgtgaagaaggagtaaggatgagattcgttgagagtggcaccgaaaataggcgtttcgagcaaattaacagaaatttggttcgggaaacggcgccaaattcgcgtcatgtttcgcaaagcgaactcattgggcgtacatcgacgccaataaattttaatggcgaattgcacaactttccaattgtaagcaaccaaatccggcaccgagaaatttatgaggattttggcccctaccgggagcacgaaaattttcgctccagccaaattcaaattcgccaacaacctgcgttagcgcggcaacaacaaaacacaaacttcggctttttgccattcgaacggcaacacaacgaattcgttggacgacatctttttgaggatggacgtcaaatgatgcacccaacggagattccgaggcaaatgcatcaacagccaccaagagaagagcgtggatggcagcaacaaaacagtgttttgtaccgtccagtggcgcgacagcagcaaaattttccggtttacgaaaaccaaatgatgccaccccaaagccaaaaattcgacgcttacaccgacagttggccggatgaaaaaagaattaagggactagaaagcaaagcgtatggccgagctgaaagagctcttgaagcggcgaaagcagtcattccgataaagtatgaactgcttcggggtgaaatgatgcgacagttggaggaaacggactcaaaaaacttgaatgcttttgatgagctgatgttagaggtccgacgaaaacccaacgaatcgattgatgatttggcaggtcgaatttcggggttggtgaagagagcctaccatggtctttctttccaattgtcagacgaattctccatcaaatatttgatccgatcaattggtgacccaactttgtcacttaatttggaactcattcgaacgcctcgaatgtctttggaccattttgtttcgctagcagcgcgtgcggaatcgacacagcgcgcaacgcaacgttttgtggctgcggaaaagtcaaagactgatcggaatgaaactcagtttcaagaaccctaattttaatcgggaatatcaacggcagcacgaattccaaccaatttttcgtgatcggcagcccggatttcaaccaaataatggaccgatcagacaaaacaatccaagttttgagcaaaaactgtggaagtgctacaattgtaatgaagtcgggcacatttcgcggaactgtccaaggcccaaacaatttgaggcaaacgcccaaaataaggcccaaacccaacccgtaaacgtttcgaacaaaacttttgaaaattcaaatagaaattttggttcaacgaaaccaaattcttcgaattttcttcgacaaaattgcatcgtcgagcaacaagaaagcgtgacaacggatctttgccttggcaaaatcgaaattgcgccagaagtcgatgattttttggaaatacttgttgttggtcgtgaaaatgaggcagttcctcccatcggaaaagtgatggtcgtgaaaacctcgacgtttggagtggaaacggactcaatgcttgatggtggtgcccaaatatcactgataagtgccaattttctttaccaattggtaaaagagaaaaatttggatttcgactcccttgaaccgtcgcaaacaaacgtgcgcgttctctatgtcaacggcaaaatggtgccatgtttgttcaaagtgaatttgccaattcatagtcgtggtctcaaatcagaagttaaaatcgctgtgcatgtgacaaaagcttcgatcggttttgacatgctgatcggcacaaatggacttggaaaattgggctttaagctttatgacgaggcaaatgattcgatggttgaatttgagaattcagtactgaattccaaaaatcttcttactgtaatttacggtacaaccatcgagccacggtcaacgaagattttggaaatgggagtcaatgaaaactatgaagctagtgagcttctgatttcatcggataattcaaatgatctgcacgtcgagccgacagttgctattgccaatgagggcaaaatgattgtccct

SEQ ID NO: 75806 - DNA, 1116 bp, Heterodera glycines
  Genomic contig location: Contig_ID=SeqID_12234; Location=3102..4217; Strand=+
  SCN-specific regions: Sequence locations=1-546,568-569,593-628,650 -652,721-1048,1081-1085,1107-1116
atggcattttcactctcatttaaggtcatcggtgcaccggcgcagttcctattgggagccggaccaacgagtgcagcaacggtatgccggcagtggcacaacgccaacaacggcaccactggtgaacgcggcaacaaaatcggtggatgacagcggcggaaatggtgaaacaattttttgatttttgatcttttatcagggctaaagccactcataataatatctggcctagtttttgcattgtctctctgatcactcacgaatgcctttgatcagatttaatcattatatctcgacattcgaccaaatttttgccaatcggcaaatcttttaatcatatctgatcactagggagtaaaattatatggaaatccatatttttttcctggactgtgggggcctgaaaggcacgaaaaacatgtttttagcttggtttgaagcttctaggatggatttctatatccatatttttccatatttcgcgatttatgtccatatttccatatttgtccatattatggcatttttatccatattttatgtccatattttggcatttttccaaaaaacctctattaaaactgcccccaacagataaattggctttttgaccccgaaaaaccggaaaatttttcaaaaaccagtttttagcaaaatttttttgaaaaattgaatgaattgaaattttattaaaaattgttaaatttatatcaaaaataagcaaaaaaaatggaaactttcggttttttggttgatgttctcttaaaatgttttttttcttctaaaacgagttcttatacaatattcagcgattttagatgtattttacttgaatttaatgaatttaaagaatttaaaaatttccacactcaaattggaaaaatttatgtccatattttgccattttatgtccatattttcgatttttggtccatattttatggccatatttcgtgattttatgtccatataattttattccctactgatcacaaatgctataccgattgttagtaagggtttgaatttttataggaagatgattgtgaaaaaaatattttattttgaaaaaaataatttgccattattcataaatcccttttttctatatttaaa

SEQ ID NO: 75807 - DNA, 291 bp, Heterodera glycines
  Genomic contig location: Contig_ID=SeqID_12235; Location=498..788; Strand=+
  SCN-specific regions: Sequence locations=1-25,62-82,127-175,213-291
atggcaataggtatttctacaccacattatattttttgtacaaaaatttttaaaattttaagggtgggattaaataagatccaaaataaaaatatttaaataaattttaaaaaatgaaaatttttaggatttaaacaaaaagttaacgagcagagaatgtatttcattagaaaactatttattgtttaatctaaataattaataataattttcaatttagcttcttaaaaattaagggaataatggtctaagaaagtaaaaaaaaaagtcaataagtaaagaatattatta

SEQ ID NO: 75808 - DNA, 374 bp, Heterodera glycines
  misc_feature (224)..(224): n is a, c, g, or t
  misc_feature (227)..(227): n is a, c, g, or t
  misc_feature (230)..(230): n is a, c, g, or t
  misc_feature (304)..(304): n is a, c, g, or t
  misc_feature (323)..(323): n is a, c, g, or t
  Genomic contig location: Contig_ID=SeqID_12237; Location=42..415; Strand=-
  SCN-specific regions: Sequence locations=1-54,76-101,123-136,174 -250,284-374
atgtcaatttcgaccaattcaacaaatggcgatttcacaccaacagatggaggtaatgagaaaaagagaaagaaaccgtagaaagtaaattgagttttggtaggtgtgaaaataaatattaatttaagtttacgaattaaattttgtatgattttcagaagttaattgtgaatcaattagtttggacaacgatggacaatctgatggaaaagtttttgttgagnagnagngaaaagtgaggaattaggggtatattaatatattaatttaaaaaaattaaaaaggaatttggtgaaaagtgtgngaagatggaaatgaaattnaaaattattaaattggaaattgagaagggtggttttatataaatgaataaa

SEQ ID NO: 75809 - DNA, 386 bp, Heterodera glycines
  Genomic contig location: Contig_ID=SeqID_12237; Location=2094..2479; Strand=-
  SCN-specific regions: Sequence locations=1-118,158-307,329-386
atggccattgagcagacccaagcttattatgtacgaaatattattaaaattttcgcggatgaatttaaatcttaaaaattgtcggatttaacttttgacattcacttttcctcgtccctaattaaaatttaattttttaaaattaatttctttttaagggctggggtggttacggctacggctatccctacggattttatggcaaacggcaagccggctttggcccatccgcaaatgttggcacttttggtcgcaacgaaggcgaaaatgccaacggaggaggaggaggaccattttcactaaacaatttttgagagaaaaaggaaatacaaaagcaaaattgactatctcttttttgtgaacgaatttttcgtcaatacaataaa

SEQ ID NO: 75810 - DNA, 1036 bp, Heterodera glycines
  Genomic contig location: Contig_ID=SeqID_12240; Location=648..1683; Strand=-
  SCN-specific regions: Sequence locations=1-347,369-749,771-1036
atgtgggagaagttggaattcgctttggtcaaattccgcgaaaaaattgacgagctaaacgagcaattgacccgcaaacaggaggaggtcagtggtctttagtttttaaattataatcagaaggcacttgtgcacgggcccctattcagaaaataattttgggggatggtgcaccaacggacgaaaagaaaagttcttctgctcttaggcctcaaaaatctttaccaaataatgtgtttaaaaatgttagtgccacggagaaatttttttaagcagatttattgaaaaaatgtccatttacaattagtatttaaacggattaaagtcgtccgacggtgcgggtagccttacaattaaaaaattttttcctcagaatgtaaatttattttttgggaggtgtggcagagcttcccccccccccccgcccctcactccatctgatcatttgaagcccaataacctacatagtcattggttaagctcgacaatcaaatgagtgcggcagaaatgatcgaccggttaaccagcaaaactttggaccttgaagaacagataaaatatgtttcaccgtcttttctgttataataattatttttttctttctttaggctatataaattggacatttccgatttggaggaaatgcatcagttgaacgaagcaatcattgagggaaaagaagatacggaaaaggcgctgaaacagcagctggacgaacagatgatcgccatttccaatgtgattttttaagaaacaattttatttatagggaaattaaaaaatatattccttcatttgaaaaaaatctgtttcccttatttttcagttgaaacatcaaatttccgactgggaagaccgtgcggttgactatgaacgggtaatcgtcaaatttcgacaaaaaactgccgaactcaacgaacgggtgcaaaatttgcacgacgaattggccacgatgcacgcgcgggacgaggaaaagtcgcggaatgcgggcgcggaaatgtcactgctggccaatgttaacagaacattttcggag

SEQ ID NO: 75811 - DNA, 201 bp, Heterodera glycines
  Genomic contig location: Contig_ID=SeqID_12241; Location=89..289; Strand=-
  SCN-specific regions: Sequence locations=1-201
atgtcaaatcagcagacggccacagcctcaaaagatgagggcattgggtcaacggacaaaaagcaattggacactgctcattgtcagcaacagctgcaacaagccttggaacaaatcacacaattgggagtaaggaaatggagggattgtgaagaacgattcaaaaagaaagtcagcaaagttcttttggaattgcgttaa

SEQ ID NO: 75812 - DNA, 861 bp, Heterodera glycines
  Genomic contig location: Contig_ID=SeqID_12241; Location=474..1334; Strand=+
  SCN-specific regions: Sequence locations=1-151,174-207,248-508,548 -640,711-861
atgacgtcattcactggttgttctccgcgaagcccataaggtcgagcagtgccgctttcagatttccttcgtgctgtatcagcttcttctcggcgattattctggacacttccaagtcgtcaacctaaaaaaatgcttaatgaagagagtctaaaaatgatcttaaaaatttacaagacacaaaataaggcgctatattaaaagtgaccagttttgaaaattttttcaaaaggggggaccctttgttttgcaaaatttttttgtgataaaaaaccatgataatttgttatccggggttttaaaggtcgctaatcacgaatctgacatgtattttgactaatttctaatccctaacccgaactcgaataaaaatcgaaattttgaatttttcaaattatgattttttgttcaaatttagattaggaaatcggaattgatcaaaataattgaaagaatcgtgatcggggaccccaaaaacctaagatgaataaatttttatgactatcacaaaaaattttgcaaaacaaaagggtcccccctttgaaaaaattttcaaaatcggtaacttttacagtagcgccaattaaacctttcatcgccaagaaaattgacaaaaatttttgggatggtaaagccggccaagtgaagagcatcggacggaagaatgaggaggagggaaaagaagacggagaggagaagaaagaagagaaagtcactggggaatatgcccaattccatcggaaaatgaattgatatattaggtaccttttatttgcatgatcaaactaactacctaattacatctcaattagcattaatcagtaagtgaaaagcatcgagcaattggcatttagcaatcga

SEQ ID NO: 75813 - DNA, 115 bp, Heterodera glycines
  Genomic contig location: Contig_ID=SeqID_12241; Location=1063..1177; Strand=-
  SCN-specific regions: Sequence locations=1-115
tctttcttctcctctccgtcttcttttccctcctcctcattcttccgtccgatgctcttcacttggccggctttaccatcccaaaaatttttgtcaattttcttggcgatgaaag

SEQ ID NO: 75814 - DNA, 1006 bp, Heterodera glycines
  misc_feature (996)..(996): n is a, c, g, or t
  Genomic contig location: Contig_ID=SeqID_12242; Location=1239..2244; Strand=+
  SCN-specific regions: Sequence locations=1-185,211-492,514-655,693 -702,724-844,880-1006
atgagaccaggcgaatatttgagcgcattctttggctttcttgaattgatgttacaacatgtgttggaacaagaaaaattgacaaatcggcgatcatgggccgtctgtatattcgacatgcaaaatgtgtcaattttacagtgggttaacccgttggggccaatgactcgatgttttgaggtcagaaatataatttttaatttatttattcattagcaaccattaatacttgcctgacccagacctggcttttttagacctgatttttaaggattttttgcctagatacaggttttggaaacccttgttttcttgatatatttgagaatgggtatttcaggtaacaaaatgtttttttcatgttacttcgacctaggccagcctagtttatattctagcctaattttcaaggtttttttgcttaaaatccaagtccatgttttaacaaatttttattttttagtaaaagtttgagaatttgttattttggtgacaaatattttatttcaaattatcgtaagaagattaactagattaaatattattatcattctaaaatgatttggtgaaggtttttgtgagcataaaaggcagactattaaagaatattttgagtatcaaaataataacaaagttatttgatttagttgctaactaaatataatattattatttaattgttaaatattattgcttgtttcaattaaaataactgttatttaattaatgaaattaaaggcacgcgttgcgcttgccatggcctattatgctgaaatgctctctaaagttgttattgtaaatccacctcatcttcttaatgtgttgtttaaggtaaatttgaaacaaaaaataaataataaaattttttcaattaattaagattatgtcatttctgttgccaaaaagtatttcaaaccgattccatgtggcgacaaattttgcggaaattcaaaatggatttccccagacgctgtcccggttggatatggtggacanaaataattaa

SEQ ID NO: 75815 - DNA, 1551 bp, Heterodera glycines
  Genomic contig location: Contig_ID=SeqID_12243; Location=1355..2905; Strand=-
  SCN-specific regions: Sequence locations=1-19,41-105,162-170,201 -219,241-397,419-455,505-510,532-575,613-630,653-802,824-847,874 -986,1025-1333,1355-1374,1400-1435,1457-1551
atggagagaaataatttaatcagaaactttttcacatttttctccataattcttggatgcgtatcatcatttgtcaatgaaccaaggagggggtaattagcaaagattatttttaattaaattttaaaaaatgccaataattgtattatattattatatttctttggagcaataaattaaatgttaaaatttaaattttagcagcggatgggaacgtttagaaacttttaaaaaagaattggcaaaaagcgatttctcaattgatcacccattcaaatttgatggccagagttacttttgggatggtttttcaaaggtgggacaataatttattatttttcattaaacatttagtgctatatgaatttcaacaaaatttatgcttacaattttgcaaatgatcaacaaaatgaagaaattgttcgtttattatatttcaacaatgattttcattgttttatttaataagaaattcaattttactaaattaaataataatataaagtgttgaaatattgcatttaaaagttattttttttagccaaatttcattggaaaacgcccagaaaaggtacattaaattaaattgtaaaaataaaatattcaataaaacaactttttacaatacaatctcataaaaaagacaaaataatactggtcaacaacctcttttaattaatttttttgactaatttcttttctaaatattaatttcttgtcagattacttgggaatgtgcaaccaatgaaaaatgttgtggcattgattgttgtccaaaaaattcatcagcagataatattggcatcattattatgattattatgtaagttttatatcttgcatgtattttttatttttattttcattttcattaattttatatggcttatagcaattattctcataaaagtcattaaattcataattcaacattattttgtctttcttcaacaaaaattgttgttaaattttattcaagtctatactaattaattataattaactttttttttagattatttatgtacatttcatttttgtgtgccattctgtgcacttgcacaaaatctgatgttcaacaaaccaaatggagttattgttgtgatgtcggcatggtttgttttgatgcaaattgttttgactgcggtcagttggattgtggaggatcatgttgttgactaaagaaggcaacatgcaaaatttgatcatcctatgcatttttaaacaattctcaccatgttgattcagcctgcccttcgacttattaatttaaatttggatttttttttgccctgatcatacaaaagatctgaaaaaaagtttggtacgattgaaagatgagccaagaaattaaacatcaaacaaaataatttaatggtcaatttttaaattagtttaaattaatttctaattacagagcgaaaaagattagtgaaaaaatggaaaacatagcaatattttcaagtgaagaaacaaactgagctcagcgatcgcaaaatttgtgaacaaatgacggttccatttttttcatttcgcaaatacaaaaataaa

SEQ ID NO: 75816 - DNA, 2023 bp, Heterodera glycines
  Genomic contig location: Contig_ID=SeqID_12244; Location=1..2023; Strand=-
  SCN-specific regions: Sequence locations=1-51,73-322,344-700,722 -1390,1413-1531,1553-1596,1618-1904,1927-1938,1961-2023
  Gene Ontology: Mol. function=cation-transporting ATPase activity; Cellular component=integral to membrane; Biological process =aminophospholipid transport
ttttgaattttaactctaaaaatgaatagggaaacccattacttcgggcaatttgtctcatgtcctggatcgttcaggcttgttaaatttgaggcccaataacactaatagaaccatgagctttctttctagtaataggtcataaaacgacatttaaatggttgggaaagtggaaagtttctcttccaaaccaaagatgtctttgtcccattttaaactctgccttcttttcgtcaggtcattacacaacagcagtgccttttctcttcattttgtctgggtcggcgttaaaagagattttcgaggacattgtcagtgctcaatgtatcacttttgtgcaattttttgtttccagaaacggcgacgcatggacagtgaggtgaacaactacgaggtggaactgctggactctttcggttcggtttgcgccggtggccaaatacgaatagccaaatggaaggaggtcagagcaatttgtcggtgttaattatgtactggtatctttcttaattagtgaccctctaatcttttccctttaccatgctaattttatattaagcttaatcaaacctttctcgagtttctcattcattacgaaatgttcagttgcgtgtcggtcaaatcattcgcgtaagcgaaggacagtttttccctgccgacattgtgctcctttcgtccagcgaagcgttgggaatgggtgaaaataaaatgatttaattttctaccttaccaaaattgccccaaaaaattagcgaaattttccacaaaattatttattttttggtgaaagtctttttaaaaagtcgatttgaaaatatactaaatttccagccgttccaaaaaatccttaattctttttttttaaatttgttcaaaatcgtaaatttcgtctttttttacaaaatctttcagcaaattatactcaatttttcctaacggtcccgaacaaaactcaattttttactatatcaatcattgtattttaccgtcattttttctttcaaaattaaccattgtgccatttttagcttacattgagacggcacagctggacggggagacaaatttgaagatccgacaggttctctctttctaaacaaccagttttctcgttagttcatctccgttcctttaggccgtccctctcaccgcccaactcactgacattgcccaactgtccgcgttgcgtgcgcacatcgaatgcgaaccgcccaaccgacgggtgcacgaattcagcggcaccatgtgtgccggagacgacgaaaaagtgccactttgtgagtgcgatttcccattccccgtacattaattggttgtacaacgaaactcagtttcccaattaatatattttcccgcagcgattgaccaatttttgctgcgcggtgccaaactgaagaattgccgctgggtgtttggcgtcgtcgtctacacagggcacgactcgcgacttctgatgaactcgaccagcgccccgctgaaaacgtcgcgcattgacgtgatgaccaaccaacgcagtgtcatcctttttctcatgctggtgctggtcaccatcgtcaggtgagcggacatttaaaatgagagtgccgaatgggactatccgattgtgccaacaaatgtctacggaaaaaacgcaccttctgattggaagtaattaaaacgcagaatttcggcttatgtctggcattaaaacctagtttcgaataagcatttaaaacagaaattatggcccattgtttggatcatacgtggacaagggggggggggagtcaatttcgtaaatcgtacgagggtccgaggcaatttcgtaaaattttcggccaaaatcgaaaaagcactggtaaagatggaaaaattttacgaaattgaaaaaaatcaaacttttttgccaataacccaaaatttttacgattttgaattgcatttcgttaaaattttcacgaaattctatttcatcttttcctatatcgtaaatttttacgaaattgaatttcgttttcccatttcgtatatttttaacgaaatt

SEQ ID NO: 75817 - DNA, 3941 bp, Heterodera glycines
  misc_feature (3810)..(3810): n is a, c, g, or t
  misc_feature (3844)..(3844): n is a, c, g, or t
  misc_feature (3870)..(3870): n is a, c, g, or t
  misc_feature (3879)..(3879): n is a, c, g, or t
  misc_feature (3884)..(3884): n is a, c, g, or t
  misc_feature (3894)..(3894): n is a, c, g, or t
  Genomic contig location: Contig_ID=SeqID_12246; Location=1..3941; Strand=-
  SCN-specific regions: Sequence locations=1-304,334-442,464-467,489 -890,912-2111,2133-2164,2186-2324,2640-2642,2664-2953,2975-3085,3111 -3111,3133-3281,3454-3941
  Gene Ontology: Mol. function=structural constituent of chorion (sensu Insecta); Cellular component=chorion; Biological process=regulation of protein activity, epigenetic
atgattactcttcctaatgatcagattggtcactcccaatcaatgcgtatgaatatcctttaatcggattcatcctcctttttttgctaatttcttggtgtaccatgccccattttccgatttccgtttgctaattggtgccttccgttcagttgtgctcctccgcgtcatcctccgcttgtccccggtccgtcgtccgtcgctcgcgcccattgtcctcccgtggacattcagttgtgcgtcgagccgtgcattgtcttcttgaataggttcgactttcggcttaattagtatttttccatccattttttaatttttttaaattgtttttaacctttccctccgataattaattaaatattccagaattaattaatcgctcctaattatatccccctctcgcaactttgtcagcaaaagctgccaggagtgcgtttgtccgcttcttccaccccctcagccgtcctccggcgaaggcgcgcagccgcccgcggcgccggctctccccgaaggggatgagtccgtttcggtgccgaatcggcacgctccgcggccccgttgacccctccgtttcctcaccgccttcgcctccgtcgccgccggcaccaaaattaatcggcgagtttggcacaatttattagcatttcggctttttttttaataatcactgtcaatgtacagaagtcatccaacatggcgtgccttctcttttgggctcttccctcgccccgccgactgccgccactcccgcggcatcggatgagtcaccggtgccttcttcggactcggcttctccaccgacaccggaattggccttgccaagcagcacagcgtccgcaccggtgccaattgtgccaattgatggccatcaacggcaccaaagccaacacgaaaagcagcaacagcagcaagtggtcgcattcggaaacaacgaaatttgctcgcaaattttggtaagtcattcatcattgacaatttttggggacggattatgcggcacttttttgaatttacggagtgaccctttccaaagtgagaaatatggcaccagccgtaactcattcgccaaatttggcaaattccactttattttttgtccgttcatttctcttttttctcgttgtactgctccaactttaggaccccggtgctcccacctgcacgcgttttgtgcagcggtggtttttcaacgtcgaacgtgcgcagtgcgaatcgttcacttacacaggtaacttaaagcacacagcagcgataaataattcagtaatggggcacatttttggcactaatttgccgttttaggttgtgccggcaaccgaaatcacttcttttcacagaaggaatgccaaatttattgcggtcgttttttgcgtaagtttttttttgacatttttccgttcattccaccattataattaattaataatgcactcacagcttaaacacaaaaaagaaaaaagaaaagcttataaaaaattgttttctgaatgaaaacagcgaatggaatttgaaagcattgcacaaattggcacaaaaatgatcgaacggtcactgctctgatcatcactgatcacctggaatgatcaattgatcacactttctggccattctttggctcccctcccgcctttgattgcttcacatttggcacaatgttcaggcaccggcacaacgcactcagacggcgccaatccctccctccccacggtggccgtccctcaacaaccgcccccggcactttccccgtccctcacggcactctccgtccccgaaatcgcaccgtcgtccccccgggcggtgccaccttcaccaaatgatgttgagggtgagaagcaggcatttgatcaacagcagcaaagaactgacgaagaaaaacagcagatgaaaagagtgtcattgaaattggcggaagagaaaaggaacaaatggaatcagagcaaacagaaggagagcaacgggacagacagagagcgacaggaagagcacggattggacgtaggaaaagaaaaaaagacggaagatacattgggacgaagaggggagagtaacagagaagtggagattggacatagagtggagggaggagaagactccatggaaagcattaatacagtgagagagggaaaagaagacaatgagcagagagtggaggatggaaaagaaacagagaggggagagagagtggacaaatcacgagaatgactaacagaagtgcgtgattctgaaaaagaagtgccaaacattgtcattcaatcggttcctatgcaatcgccggtataaggcttttcatttgtatcatcagcaacagaagaagcagtgacaccaaaagaggaggaattggtggaagagagagggaaagttgaagagagagtgggggaaacggaagggaaaggaggaaaagaggagggacacagaaaaagagcaaaggaagaggaagaagaaaacacgaaacgaactctgaaggagggggaagaaaggaagagagaggaggaagagcgaagaagggccaaagaagaggaagagagacggaaaggggaagagagagaagggagaggaggagggaaagagaaagaacaggaaaaaagagaggaggacgaagacaaagaggagagagaaaaaggagcagagagtggagagaggaacgaagtggtggagacggaacagaaccacccgatgcaacaccaacaagtggaagggcaggaagaagtggtggcgctgtcggaacaaaggccggacgaaatggagcggacgacgaacggtgagtcactgatcagtgtgatggatcagtaccgatagccaatcgcaaactctgatcagctgatcggcggggagggaagagcaaagtgccagcaatttttttttcgagtgatttgtccattttattcttggcaaattttggcacagttcgttttctcttaattatattccgttttttcttttttgtgggcgtaggccaaccaaacaaaacacaaaataagcacatcattaattggttaatggcacccactttttgcacttttattagcacccgccgcttctgtcacaccgccacaaatgccaccggcggaacccctggggaaaaaacagcagaaagagcaagagaaagaaaggaccagcccccggggaaagcaaagtcaagaagaagtggaagagaatggagcaaaaagtggggaagagatgcaaaacagagaaacagagggaccagaagagcaagcagtacaacaagggcagggggaagaaggacaacatgccatgccgaatcagcaaggacatgaagcagtacaacaaggacaccagcatctagcaggacaacaagaacaacaacatcaagcagtacatctaggacataaacagcaccaagcaggacagcaagaacaagcagttttacaacaagggcatcaacaacatcaagctgttcaacaaagacagcaacaaatacgacatggacaacaaggcttgcaagggcaactacaactagggttgaaaaacgagaaacaagggcaacaccaagctgtactagtgcagcaacaagttgtacaagaaatgcagaatcaggctgtacaaagacagcaaagggttggacagaatcaccaacaccaaactgttccagtacaacaagttgaacaaggacagctgcccctgacaaatttcttacaaggacagcaacaaccacagcagagcatgcaggaacagcaacataaaatagtacaaggacgacaagatgtacaggggcagcaaattgttcaaacacaagaacagcaaccccaagccataaatggacgacaatttgcacaaccaactcaagtacancaagttcagtcttcccacgtacatcaaaaccaanctgtacaaggacaccaacaaggctcnccactaaancacanccaaaccaanccgccatgtaaaacaacatgttggacaaaatcagaaacaccaaatag

SEQ ID NO: 75818 - DNA, 1465 bp, Heterodera glycines
  Genomic contig location: Contig_ID=SeqID_12247; Location=1190..2654; Strand=-
  SCN-specific regions: Sequence locations=1-281,310-318,349-561,585 -624,646-1207,1229-1465
  Gene Ontology: Mol. function=protein tyrosine kinase activity; Cellular component=cytoplasm; Biological process=protein amino acid phosphorylation
atggaagcgtcgagaagggaatttggcgacgattgcgatgacctcgtcagaagcagtttgccccctgtaagtcgaaattccaacatttaaatatatttatacacatagtaaatttggcgctacttaaaaagtcacttttgaaaaaattttcaaacttttttttggtaaatttttttttaaagtcatgaaaccaagtacccggggattttagaggtcgctgatcatgaatatgacaattagttggcctattaagaaatttggcgctagttataaagtgacagatttttaattttatcaaaaaccaaaggggggacccttttgttttacaaaattttttaagataaaaaatcgtgaatatactttttattcaccataattgtgatggtaatgctttatatacatcattatatgtaaataaacaaaaaaaaaatttaccaaaaaaagtgaaaaatttttcaaaagtggtcactttttaactagcgccgtaaatttttatttatgccatgtgaatttaccaggaatatgcgccgccacaattgccctcaaaagacgacgacgacggagaagaaggggagggagaagcaccgcccatcccggaaaggccgaagaaaacactttcgatcgtaaggaaaacaccgaacagaaaagggtggaggggggggggggggaagacaaaagtgccaatcggaaaacgctaaaacgaaatgccattggacgaagcagtcgatcgctttggcatttgccatcgatcaactgatgaattttaaaaagattggctttttcagtacacaaaacccatcgaacacgaagaaaccagcaaaattgtgcctgattatttgcttaaaaatggcaattttggtggacgcgcaaatggacgtcgaagaaggctaaccgattcagaagtattggcacgactgaggacggtaattgcaatatgaacaaatcaaggtttattgtaagtaattttaaagattgttagcattggaaaccccgatcggaagtacagaaaagtggagaagatcggctcggggtgagcacttttcactgggataaaactaaagactgaagcggacgcgccattctttcttaaagggcttccgggtctgtgttcacggcaatcgaagtaaacaccggtgccgaaggtaaaaacaaaaaacattggcgatttgtctgtgccgccgttttagtggcgattaagcaaatgaatctcagccaacagcccaaaaaggagctgatcatcaacgaaatcctcgtcatgcgagagaacaagtgcccactgtcctttcccttttcttttattccaatttcccttagacatcgaaacattgtcaattatttggactcctatttggtcggagaggacttatgggtggtgatggaatatttggccggtggttctctgacggacgttgtgacagagtgccaaatggaagaggcatttgctatttatgcactttttcgctaa

SEQ ID NO: 75819 - DNA, 662 bp, Heterodera glycines
  Genomic contig location: Contig_ID=SeqID_12248; Location=1128..1789; Strand=-
  SCN-specific regions: Sequence locations=1-91,113-412,461-471,494-662
atgaccccgagaagcgagacccaaaaacccaaaaaatttcatgagtcgaaaatcgagaaccgagaatctcgcacatccctactgcctaatgaaaaggaaaaggaatttaaggtaaaattgcggaatgtgaagagaaattaaaaggatgggaatttttaagtaagaacctaagaattaggaaatgcctatgagttacccaaccaaaattttactgtttttttattttacgacttccccagttttgagacaacgaaattttttgaaattttacaggaaaatagaagacacttagggctatcaaatgatacaagaatgatgcttctaggaaaaagttatggagcattaaatttgtcaaattattatatggtcgtatcttttttatggcatataaacttaaatagagccaaataatttattattattattattattattaaattattattattattcattattacttaaataattaattattttctggataacttttccgtgctgaaatgacccgcctcttccgatcaccccgcacccatgcttttttcgcttcgtcagttcatttttttaatacgtttgattatttgagtaacattcacgctcattaagctccttttatggaacattttcatttatttcaatttgttcagataaggacaaataaa

SEQ ID NO: 75820 - DNA, 1956 bp, Heterodera glycines
  Genomic contig location: Contig_ID=SeqID_167; Location=108..2063; Strand=-
  SCN-specific regions: Sequence locations=1-252,274-602,624-969,992 -1956
atggtatgctgggacacagagactcgattggaacagctgcaacaggcgggacaacagcgacacaaggtcaactacctgtcagcacgaattacctgtacggagtgctgtgattctgaaaatggcctgcgactcaattgtaaaatttgtttgacaacatacggagcgatggaacgaacgaaggattggagcgaatcggaaggacatgagccaatttcggcatttgtcgagtggattttgaaggcttgggacaacaaatatcaaacatttatttgggtgagtttgtgatcttttttaacatcattgttatgcaaaaacaattttaggcacacaatgcctcgaggtttgatggccattttgtgctaaaatacctcggccagacaaagcgacgacctgaggtcatcatgaatgggctcaaaatttttgagtttcgtcttcaacattctcggcgccactcaaaactcacatggcgagactcgtgcctactgatgccaattcgtctggaagaaatgccgaaaacattcaatctcaactgtgccgataaaccattctttccctacgctttcaaccgaaggttagtatgtccaaatgagggtaatttaaatgattatatttctaagagaaaattacaacgtgcatcttcaacatttgccggacaaggaggattactgccctggatcaatgaagcaggacaaatatgagaaattcataaaatggtattcatacgatttggtatttttaatgttatgttttttaggtatgacgtgaacaaaaacacaccgttttatttaccggacgagctaaagacgtattgtcggaacgatacggagattcttctcgctgctgttgtccaatttcgccaaattctgatgcgtgatatcactgaaggctttgatgtgcttccgctgagtgctactattgccaggtcgttataccaatcggtcttctaatttaatttctattcagcgtttgcatgaccatctttaaagggaaattccttaacgaaaaagagcttgccatcgtgcctgaaggcggttacgagcggaacgacagggctagcgtcttcgccatcaaatatttggactggcgctccaagcgagacggtgttcgcatacagcacgctggaaatggtctcgaaaagagatggcggcagttcaaacttgatgggtggattgcggagcagaacaagtgcatagaagttctcggctgctactggcacggatgtgagagttgcttcaaacctgacgacgaactggttgacggaaaaacatgccgagaactcaacgatgctaccaaactgcgtttgctaaaactgcaggagcctgttccggctgaggatgcttacggtggagaagatgaacaaggccttgacgtggaagagatttgggagtgtcagatccgagaacagctcaaaagagatgatgaaatgcgagcttttttcgacgacttggggaccgaccgggggcccatcgacccacgtcaaacattctacggaggcagaactgggccgcttcagctgattgcagagccaaaggaggatgagaagatttctgtcttcgatatcgtcagcctctacccgtgggtcaactatgccaccgactacccgatcggaatacccgctgtcatccaccccaccgttgaggagatgatcgtcgactggactcgacctgagcatttacaataccaaggaatttatcgtgtgcgggttattcctccaaaagggctccgaattccggttcttccactaaaaatcgacgaacgcctactgttctgctgctgccatcgttgtgctgccaaatttcggaagttaaacacacgacgagtgcacaagtgcccacacacggatgagcagcgggcttttacaggaaacttcacacatattgagctggcaagagccttggaaactggctaccgagtggacagattctggagagcttggcactacgatgaatggtatga

SEQ ID NO: 75821 - DNA, 1231 bp, Heterodera glycines
  Genomic contig location: Contig_ID=SeqID_167; Location=2734..3964; Strand=-
  SCN-specific regions: Sequence locations=1-63,102-115,138-255,277 -331,354-497,519-1231
atgaaacgaacgggagacgaaccatcaacctcatcatcagctacccttgaggactacaccacagcggcggcagcggcggcggcggcggcggtggcggcggcctctttctcgcctacaatctccaattctgatggagttgcgaaacgacaacgccgccaaagttgggattttaaaaccatggcccattttgaggagcatcatctacggcaacagcagcagaagcaagagtcccacgcaattccgatggatggagaaggccgccttcatcaaagggggattgatggagcgcaaactgttgtagcagcagcagacaatgccgaagaccacaatgagcagacggagaaacctttgtttgagcaactgcagtactacgtgcacagggtggagcgttttgcactacatcgacacgtgacagaatttgtgctcaatggacaacatgatgagccggaagaggcacttcttaacgcatttgagcacatcatcggacaagcgatacggaacgcagaggagaacacagatcaggatggaggtggaacagctggccatcggcgacgcgtccttaaactaggtgttttgctcaatggaaaaggtacctaacaagggaattttaattaattgggcacctccctacgcaggactgaccgacccaatcgtcttgccggttcgtccacctgagcaaaacaccgctgaagttctgatggccgagctcgacaaattgggtcaatcggacggcgatgaggatgtgcatggtggcgggatcagcaaacgctcgctgttgctcagtgagccgatcgaaattatcgtgacttgcattgcgcctcctgttggagcagcgccacgcttccacccataccaacactggggctatgatgagcggcatatgatccgtatttttaatacgggcaacaatttctgcttattctacgcattgattgccacacgtgcctacactgacgctgagtttttgaagtctaccgtccatctgcaaacagcagagggaggacaaagttcaaacagcaatcacgtgtcttctgaagttatacaacgtgtgaagagacgagctgatttttgctccgaccacaaggcactgaaccgttttgtgtccaatcgggaccggctgagaattgcggtccaagagctgatgcgtgcagcagagattgcaccggatcaagatgcttatggaatggaacatcttattctaattcaacaactatgggtacaaataatttaa

SEQ ID NO: 75822 - DNA, 774 bp, Heterodera glycines
  Genomic contig location: Contig_ID=SeqID_167; Location=4071..4844; Strand=-
  SCN-specific regions: Sequence locations=1-166,227-523,547-774
atgagcggactgaaacgcttccaactcacatcttcatccaacaaacgacccgcagacgaatttccatcccatccaaaacagctgagcgaagtggcgaagttcaatgcgccgggaatattttttgtacgtgcaaaggtggcagacctgcagttttcgttgtataaggttattaattttgaaaatttttaataattttctttatttgcaggcctgtccgcttaaatcctccggcagtgtgccatgtaagaaaaagctcgacgatgagatgttctgccgcggatgtgaccatcgtgccaacagcccactccaatgtctcttcttgagactcgaccttcaagactgcgaagaccttgaaatcagccaaaaagtgaccgtcttctccaacgttgcagaggactacctggccatgagggtcaatcagtttgccgacatggtcgaaaagtgctccgaaaaattggaagctttgcttcagtcaaagttgggacagactttgaccttcaaactcaatctgaaggttaggaaatttttttttttttttttttttttgttgactctgagccagttaaaatcattaattcaaggcaaagggcggcggcgagttcaccacaatggattggattgctgcggcgatacttgtggacaaaaagaatgaagcggacaacgaagatggagaaatcatcgaacttgacattgggaagaagcgtgccaaaaagaactgatttcggccgttattgggctgaagccaatgttgattaactgttgcataggaataaa

SEQ ID NO: 75823 - DNA, 769 bp, Heterodera glycines
  misc_feature (721)..(721): n is a, c, g, or t
  misc_feature (749)..(749): n is a, c, g, or t
  Genomic contig location: Contig_ID=SeqID_168; Location=32..800; Strand=-
  SCN-specific regions: Sequence locations=1-166,227-519,541-769
atgagcggactgaagcgcttccaactctcatcaacgtctaacaaacgacccgccgaagaatttccggcccatccaaaaaagttgagtgaagttgttaagttcaactcatctggaaccttttttgtgcgtgcaaaagtggcagatctgcagttctcattgtacaaggtttttttaaaattaaatttttaataattttctttatttgcaggcctgtccgcttaaatcctccggcagtgtgccatgtaagaaaaagctcgacgatgagatgttctgccgcggatgtgaccatcgtgccaacagcccactccaatgtctcttcttgagactcgaccttcaagactgcgaagaccttgaaatcagccaaaaagtgaccgtcttctccaacgttgcagaggactacctggccatgagggtcaatcagtttgccgacatggtcgaaaagtgctccgaaaaattggaagctttgcttcagtcaaagttgggacagactttgaccttcaaactcaatctgaaggttagaaaatttttttttttttttttgttgactctgagccagttaaaatcattaattcaaggcaaagggcggcggcgagttcaccacaatggattggattgctgcggcgatacttgtggacaaaaagaatgaagcggacaacgaagatggagaaatcatcgaacttgacattgggaagaagcgtgccaaaaagaactgattttcgcncgtattgggctgaagccaatggtgattnaactgtgcataggaaataaa

SEQ ID NO: 75824 - DNA, 83 bp, Heterodera glycines; identical to SEQ ID NO: 69364
  Genomic contig location: Contig_ID=SeqID_168; Location=5876..5958; Strand=+
  SCN-specific regions: Sequence locations=1-83

SEQ ID NO: 75825 - DNA, 2147 bp, Heterodera glycines
  Genomic contig location: Contig_ID=SeqID_168; Location=5009..7155; Strand=-
  SCN-specific regions: Sequence locations=1-436,480-490,513-598,621 -650,688-818,880-979,1021-1036,1062-1334,1356-2147
  Gene Ontology: Mol. function=ornithine-oxo-acid aminotransferase activity; Cellular component=mitochondrial matrix; Biological process=ornithine metabolism
ctcatacggtattcctattgtaaaataaagttttctgtaatcatttaggcgtcgaggcgtgtgacacggccgtaaaattggcccgtcgttgggcgtatgagtgagcgcaatttaaaaattcgaagagttgactaattaaaaatttcaccgtcaccacagtgtcaaaatggtgccaaaaaatgaagccaaagttgtttttgccgaaaacaatttccatggccgatctctggctgcctgttctgcatccactgaccccgactgttacggcggctttggcccatttgtgccgaattttgtcaaagtgccattcgacgatctcacagcgcttgaggcattcgcatttattactttttaccgaagcgaagcacaaatgtttttccctaagaaataagaaaaacttcaaaacttaagacttttttttttgaaaaaaagaccgaaattttttctaatataaaaaaaaattgaaaaactaataaattctttgcaatgctaaaaaataattatttatttttggatttgttttttgcttacaaagggaggtggccaagtgtccgtgggatttcggaatgagattttttgggtagatagagcacccatgggttcttaagaaaaatgttttcaatttctgccaaatggacccctgtgccaagataaaaaaggccaaagtttttaatgattaaataaaagaaatacctatttgcacaagagcacggtgtccagtggtgtagcggtagtgcgctagtcagcatcttttagcccagggttcggatcccctatgtataaattagtttttttatttttgtcttttacgccaagtcaattataaaaatttattttatgaaaaaatttttatttttaattttttttaaattttttaatgcgcaaaatattcaataaaaatattcgccaaaaaaatattttttaatttgacagaatatgtattacatttatgtttaatgcaatttttgatttttaatggaataaaattaaaataaatattttgataaagaaataaaatttgataattgaattgctcacaaaaagcaaaacaaaatgaatttacacataggggattcgaacttttgacccaaaaaaaattttgactaacgaattacctatacactaacaatttctttgaagaaaggaaatagttgttccttttctttaattataaaaaactaaaaactttggcacgtcataactcggcactcgtgctcatttggcagaaaataaaaccatttttcttaagaacccattggtgctctatccacctaaccaagtttcattttgaaatcccacggacacttggccacctccctttgttagagttgcttttgcacttctcttttatatgcaaccacgcgaaaacgtcctggcccgccaaaaacttacagaaaaatattttttcgtaaatatttctggcttttttatcaaaatatttgtcccagccctagtgattagtagggcttccaaaaatatggatataaaatctcggaatatggcaataaaacctaggaaaaatcgcaaaatatggacataaaatagcaaaaatatggacataaattttccgaattgaggggtaaattttcaaaaatattcttcaaattcattaaattcaattaaaatacatctaaaatggctaacaaaatatggacataatcgcgaaatatggatatagaagaaatccatcctagaagcttcaaaccaagctaaaaacatgtttttcttgcgtgtccaggaaaaaaatatggatttccatataattggaagccctagtgatcagtgatcccggaaatccctgcctgtatgcacaataaaaacaaaaatttttttttgaaaatatgttcgaatttgggttaggggtttagaatttgtcaaaaataatgccggattcgtgctcagcaccataaaatagccctagaaaaatttttccaggcttttcaaattaaaaaaaaacgggaccagtaaaatatacctttgccccatttgcacacgaacagaaaaaagaatttggtaactgacggaagaaatggcattggcacggagaaattgctaaacaatttggaaaacaaaaatcagtgacttgtcgagattatggccacacctccttgaaattgttgatccaatcagtgttccattggaaacaa

SEQ ID NO: 75826 - DNA, 303 bp, Heterodera glycines
  Genomic contig location: Contig_ID=SeqID_168; Location=4727..5029; Strand=+
  SCN-specific regions: Sequence locations=1-45,70-303
atgaaccgacggtaaaagaattttaatagtcacacaaattcgtcatttatttagctaaactgttttccataatttcagttggatttccgaccgtccgttgcccagcaaaattcgctttgattccattcagattaggtaagtaaaatcagagatttatagcaataaaagcattcattccctttttgcagttacatcgaggccaaattcaacaacttcggctggccaagcgttgtccaaatggttgcactctccgagaaaagatggccaacccaagcgattgcgttgtttccaatggaacactga

SEQ ID NO: 75827 - DNA, 451 bp, Heterodera glycines
  Genomic contig location: Contig_ID=SeqID_169; Location=336..786; Strand=+
  SCN-specific regions: Sequence locations=1-193,215-364,387-451
atggtgccatttgaattggtgaacgaatggacgaaggaaaagctgacattggccaaggcaaacgaaaatgaattggacaattggataatgaaacgatgcaaaattattggggagaaagaggaaaattgggacaacaattgcaacaatgtgttcttttggcttgttggtggcattgattgcattgggtgagcaatttaaaaaaggcatttaattttgtttaaataattcaaattgcgcttaattaaggccattgtctccgccaccggcagaagaaacgggacaaggcatcacaaaagtggcgtcttctgctgacgatgaatgagtgacggacaaaagaacgaaacaatggtgattagtggaagaagaaatgaattatttaagaatggccaaccgatcataattcatcagtgatcaaatgcaatttatgatgaaaacctctcaatttcggtaa

SEQ ID NO: 75828 - DNA, 179 bp, Heterodera glycines
  Genomic contig location: Contig_ID=SeqID_169; Location=1669..1847; Strand=+
  SCN-specific regions: Sequence locations=1-179
atgggacgcgtaaaatgtcatgggacgcgtaaagtgttgttgggacgcgtaaaatgtcatgggacgcgtaaaatgtcatgggacgcgtaaaatgttgttgggacgcgtaaaatgtcatgggacgcgtaaaatgttatgggacgcgtaaaatgtcatgggacgcgtaaaatgtcatggga

SEQ ID NO: 75829 - DNA, 554 bp, Heterodera glycines
  Genomic contig location: Contig_ID=SeqID_169; Location=1175..1728; Strand=-
  SCN-specific regions: Sequence locations=1-196,218-306,328-379,401-554
atgacattttacgcgtcccaacaacactttacgcgtcccatgacattttacgcgtcccatgacattttgtgtccatggcagggatggcattccgaggccccaaaaattttcggaaatcgaaattccgtgccatccctggtctcatggtattatagttgtcttaataactaagagaaaaacttttttttgttaggtattcaataaagtttttaactataaatttcgttgttaaacctaaggttatcatgacaactcatacacaggcaactcgaacaatggcttattgttagactaggcctaagtttaggcttttgtaaattttcttttcttatattagttgaatttctgttgacatcaataagtgtgcttagagttgcttttgcacttctcttttatatgcaaccacgcgaaaacgtcctggcccgccaaaaacttacagaaaaatattttttcgtaaatatttctggcttttttatcaaaatatttgtcccagccctagtgattagtaggacttccaaaaatatggatataaaatctcggaatatggcaataaa

SEQ ID NO: 75830 - DNA, 632 bp, Heterodera glycines
  Genomic contig location: Contig_ID=SeqID_1766; Location=867..1498; Strand=+
  SCN-specific regions: Sequence locations=1-58,109-207,230-486,534-632
atgaatttgttggacaaaatttgccttgttgccgaaccaagtgtcactgaaccggttgttttattataataataaattacaaaaaataaaattaaattatgtaaatttccaaaatacaatcactaatcactagcttaatccttttgaaaattttttacgatattttatgagaatttacccccccccccccacgacgaggatattgctccccgacatttttaaatttctcaagccatttcctacaaattttttccgagaatttcctctccgatccccgtcttttctcttcccaaagatcagagaccaacttcaaaataaataaaacaaaaaaacgtttatttatttttttaaagggcgacagtggcagtccgttgctaagcaaaattggtgacaagaattgggtccaagttggtgttttatttggtggcagcggatgttctgaaaagcatcccttttccacaactcggcgtcgctgtaagaaaagccaattaataataaattaaatttaaaataccaattttatttatttaatagcattatatacaccgatcgattgcgattggatttcgcgggtgacaaatgatgaagtgaaatgtaaaggatggtgaattgaaatgaaaaaattgatgaaa

SEQ ID NO: 75831 - DNA, 82 bp, Heterodera glycines
  Genomic contig location: Contig_ID=SeqID_1766; Location=3361..3442; Strand=-
  SCN-specific regions: Sequence locations=1-82
aaattaggaggaaaatacatagcacagaaaatcattttgttgacatgtccaacacttatttaaagtaatacatatttgataa

SEQ ID NO: 75832 - DNA, 1038 bp, Heterodera glycines
  Genomic contig location: Contig_ID=SeqID_1766; Location=1676..2713; Strand=-
  SCN-specific regions: Sequence locations=1-21,65-101,129-329,352 -513,535-598,636-1014,1036-1038
atgggactgccactgtcaccctttaaaaaaaataaaatttttattttattttatttattttaaagttggtctctgaccctcggcgagagaaaaagttggggaaaaaatttttttttttttttaatttagctttgctcaaaagtaccaattttttaattcttcatatcattcgatagctctaagaattctctattagcttacgaaaatttcaaaaaaagcttcgttatgtctcataaaattatgaccaaaaatgtcgaaaaaacattggtttttttagcttctcatataagatttgattcattttgttcgatgttatgaataattttctgtcaaaaattttcattttgatggttttttaagtaacgacccggcaccaatgggaccaattggtcccggagataaagatgggccttaatttgagttaagacatattggaaaatcttaagcgttgtaccattaaatttatcgaagagtgcgtgtaatttttttcagaaacattttaccaaccacctacaaattttttctaaatttccaccgattttcactgaacattggtggggcatcgaatgcatccattttgtacttcacaatgtattcgaataattatttaaattaattaaatttttatttttttagtacggaatatcggcaggcattccaaacggtgtttccatttgtgttcaaacgtttttcaaatgctaatcaagtaattccactacaaaatgggcatccattaggtaaaggatcatgcgttttttagtctattatttgtccttaaatctcataaatttcgctaatttttttgatttttagagacgaatcttttgtaaaattcgaatttaaaaaaatggcatttaaattgctgtgttcatttgttcattcttcttgtattgtaattcgtaaaacgcagaaaaacaatcatttaattattaaacgaaaatgagtaatttcgttattagtattgaattgacaggtgatttgtcggcattcttcaaaatgttttcattgtcattatttgcattaaatttaattaataaa

SEQ ID NO: 75833 - DNA, 1535 bp, Heterodera glycines
  Genomic contig location: Contig_ID=SeqID_1767; Location=608..2142; Strand=-
  SCN-specific regions: Sequence locations=1-76,98-609,631-666,689 -1358,1445-1535
atgattttttggaaaattttcaagtttttgggtcaaaaaggtcaatttttctgtttaggaccgttctaatagagttctttggaaaaatgccaaaatatggatataaatcgcgaaatatggaaaatatggatatagaaatccatcctagaagcttaaatccaagctaaaaacatgtttttcgtgcgtttcaggccttccccacagtccaagaaagaaaaaatgaatttccataattccgagccctcgttattagtgcttctattttttaaatttacatgaatttcttcttttaattattacaacaaccgcttcagtggcacttggttcggcagcaaggcaaattttgtccaacacatttatttcatttaattcgtttgcaatggaaacaattggatcaaccacaggtgatgagcctgaattggcgttaaaacattttgaagaaagtttggacctggattcctttgttggaccttggaccgggaatctcacagacaaaaaaaatccagaaaaaccaagaaaaaaattggaacattgactcattcaaggaaaaaaaaatgcatctgaacatatttttgacagacctggtaattaccaatgtaaattttaaataagtgagaaaatttttatgaattttagtttgaactacctgggtcatttcaaatccgctaaattttacactgaagattttagatcaaaagtaagcaaattttgtaaaacataaaaaccaaaaaatgttaatggaaaaaccctcaaaattgtcattgtttgttcaaaatatgttagaaaaatatcatccacggctgtgctaggttttttataaattgattctcaaatcttcaaaattttggataaattttcttattaaaattcacgctagttttatgcaaagaattttcccaacggagcctatcggcaccacaattgccctaataagcacattttctatttccatggtcccctttgtctctttaaaataagtacaaacgcgatccctacagtaacccattcttgcacttaaatattattatgccataccataagtaattggacattcgttcttggaaaccatgcgcattgtaccgtacatcagctggtcacttgtactgtgctgttcacgtgaacactttggttttgttatgccccatccggcaataacaaatggccgtgaattattgatgtgttgggcagaaattttttcggaaaatgaatttttaaaatttgaggaaccttaagttttacaggaaatgcgtaggttagcgtaaatataaaaaaattaatcgcaaattaattttaaccatttttgcatataattccgaaaattcctttacaagattttaaaaaaattgaatttttcactgtttttaatttataaaacttttttaaattttttaagattattaataacatttaaagataaatgtaaattcacaaaaaattataaatacttacctatgccaaacaaacaaattggtctaacacgagatgaaaattgtattggctccacgctcttaaaaaacatttaattaaaaaataaa

SEQ ID NO: 75834 - DNA, 427 bp, Heterodera glycines
  Genomic contig location: Contig_ID=SeqID_1767; Location=2681..3107; Strand=+
  SCN-specific regions: Sequence locations=1-60,82-86,109-184,221 -233,321-427
atggatggaccacctcttcccgattcgcagtcgggacagagactgattgtggggagaagtggggaaggggaaaagagttggattaaagggaccgcccccaaggcaacaattggtatgtcatatgtgattaggggggggggggtggcgattgggacaatgggttacaaaatgattatgatgtcactttaaaaaattattaatttttcatattcaaatttatgttactgctgatgaaaaaataataaatttaccactgataattatttcttagataaaataaagatgataaaaatttatttgataataaatttaaattatatcaaaataggaaaacataaaaattattatggaaatcgcataatttttcaactaatatctaatttaaaaatagttgaaccattatatttttaaagaattttgaatcaaa

SEQ ID NO: 75835 - DNA, 789 bp, Heterodera glycines
  Genomic contig location: Contig_ID=SeqID_1768; Location=568..1356; Strand=+
  SCN-specific regions: Sequence locations=1-106,133-168,190-392,418 -460,482-494,519-656,678-789
atgtcgccccaacccgaaaatccgccagctaaacgacgaatgtcattttttgaacgtctgaaacacattacaggcgcaaacacaagtgaacagggtgatttttggtctctaaaaattaaatttataatgaaattaaggcttccaaacgtcgcaagatgatgacattgaaaaagaaattaaggaatttctcgcgctggaaattgcgaacccagaagcggacccgttggacgaatggaagaaaattgctccccgattttcaatccttgccaaatttgcggaaaaatatctttcagcacctgccaccagtgtcccaagtgaacaaacattcaaagtcgcccgagatgtctttgattatcgccgttccaaattatcacccgaaactgcagaacagcttatttttctgaacaaatctcttccccagatgaattacaattattgaatcaatttttctgtttattttattaaaattgttaaatttctacatataattgatgaaattttgtgggttttttcccaaattaacatgcgaaaatttaaatttttaccaacccggaaaccggtgccaggcccggcaatttgaaaatccggtttgatcggttttccggtttgaccggtttttgagagaccgggcccggaaaccggttgcttctgaaaaagtcagcccggcccggcccggcagatttggaaaatccggtctctagtgttttatttggtagcagcggatgtgatgaaaaacatcccttttccacaagacggcgtcgatgtacgacgataagccaattattaata

SEQ ID NO: 75836 - DNA, 1322 bp, Heterodera glycines
  Genomic contig location: Contig_ID=SeqID_1768; Location=2807..4128; Strand=-
  SCN-specific regions: Sequence locations=1-24,46-73,95-119,141 -214,239-349,371-583,614-614,636-1041,1063-1322
atgaagggattcaaagaatggaattatgaatgtggcttttgtttttatggtgccgatggagaaatgaagcgcgttcacaagaataagaagaatttgccgttattgttgatgtacgccttgtcaaaagacaaaaaattggacgtttatctttgtgattagccatttgctaacttttattagggttttatcaaatattagcgttaataaattgttgaaaattaaaaaaaaaattttttttgcggcgcaaatgtcgatttggctgggcggcgcaagtgtctgcggcgcaagtgtcgcggcgcaagtgtctgcggcgcaaatgtccgcggcgcaaatgtcggcgttccctttgaaatacctaatctaatttatgaaaataaatgctatcataacagtgctgagaaatgtgaattatttgccaccttatttgccaattcatttaataatagtgaaaccgacccaagcaatccatgcttgggtaatattatagaaattgatcaatgctttatatcggatataaattttaacatcatcgagacccaaaatcttctgaaaaaacttccgaataaaaatggcacttctcccgataatattagttataaaattttaaaaatttgccattcttctctgtcaactgttattactgacttgcttaggatctcattagacactggctcacatccagacatctgcaaggaatcaattgtttttccgctttttaagaagggtgacaaaaataatctcgaaaactataggccaatttcattaacctgctcactctgcagggtaatggaaagaattttaagcaaaaatatttacaaatttctattaaaaaacaaaaaaatttcggaatttcaatttggttttgttagaaataggtctacaacgagtcaactaataacagttgtggaagattggtacgaggcaataataaatggaaaaaatgttgactgtatttatattgattttcagaaagcttttgactcagtgccccatgaattacttttatacaaattggaaaaaataggtataaggagcaaactttaatatggataaaggattttttgagtaataggacttttcgcgttaaaataggggatgatttatcctccagtaaaaaagttggctctggcgtcccccagggctctgtccttggacctttattatttttgatttatattaacgatcttcctgatgcttggccatcaggagtaagaattaaattatatgctgatgatgttaaattgtatatttgttataaagcaaggaccgaaacagaaattttgcataaagcattgcataatttatcagaatgggcaaataaa

SEQ ID NO: 75837 - DNA, 558 bp, Heterodera glycines
  Genomic contig location: Contig_ID=SeqID_12250; Location=92..649; Strand=+
  SCN-specific regions: Sequence locations=1-301,323-364,397-534,556-558
atgcccgtaaatgtgaacagcaaagagtggagtggacagcagaagatggcacgagaacacagagatttgtgttcggtttgaatatgacgcaacgttgcacgaatgaaatgaacaagacaaccaaatacctttttttctccaaatactttattaaatgcattaatttcggcccgctcataacaatatgaattctctcgattacttcaactgtttcagttccccattgtcgatgaagctcatttaaaacagttttcgaaaaaagataaagtgcaatcaatagaattgataaaaggagattgtgggttcatttatttcataataattgtttggagaataaaaaattattttaatgtgctcaaatctcaattaaaattacaaaataaaatttattaaaatctttcccgtactgaaattactcgcctcttctgatcacccctcacccatacttttgacacttcggctccccacggacccaaattaaaaatcactattttggcattttgtcactattttttcactatttcgacattttttggaaaattccttaacaaaaatgca

SEQ ID NO: 75838 - DNA, 435 bp, Heterodera glycines
  Genomic contig location: Contig_ID=SeqID_12251; Location=3..437; Strand=-
  SCN-specific regions: Sequence locations=1-435
atgaagacatttgtggaagagaaggttgccgaagcaaaagaattggcagaatttgccatcgctgatgcggagcgcaaaatgaaacaaagtttgaacaacgcaatacacgctgaacgtgaaagaggccaacaacagttacgctctgtagtggaggagcaacatatgcgctgccgacacctcgcactgcaaatctaccgctccgcaacaatgacaaaaccaacatcagttcgcacctccgatgtgtctcccaaatgggagccacattgcatgttttgtttgatcgacgaaccgatgtttggaagtgaatggtgcgcacatgtgaatgtgtgcgctgaatgctcgatcgtatggtcaggggatgatcagttcaaatgtttgacttgtcaaactacatgtaataagtttgtctattttgggcctaatccatccccctaa

SEQ ID NO: 75839 - DNA, 1155 bp, Heterodera glycines
  Genomic contig location: Contig_ID=SeqID_12252; Location=221..1375; Strand=+
  SCN-specific regions: Sequence locations=1-452,474-623,645-1065,1110 -1125,1147-1155
atgatgaatttaagaattggagtgttgaagcgattcccattattggggagacggcggcggttcagcagaagaagaaagcgaaaagttgggccatttacacagagtctttcagtattggtgatgccattgggtgagcagaaaggaggccttatttttgttataaagcacggacggacaggacagtatccactgtacagtacttgctcagaatcttggcaggcccaggggttcctattaaaacaggaattaagtgcttgtcttgtccatgccgttctggtccatctcggaaaccctggtcctctagttcgaatttttttttttaaactccgggctttacttttacaaaagtgttttcatccgacgattcaaattttgcttaatttaggccgctgtctgaaaaagtgttctcttttcccgggcccagtgatcagcggaagaaaaagtgatcatttgagaaatgtccgaccaaaaaagagctaatgaattgtgttaattgatactgtcaaatttaacgctgggtattaaaaataggaatttaagttgggctaataattcaaaaattaattaaattcagcgctttttttacttcaagtaatttgcaaataaggattagaaaatttatttgtgttcagcaaccctacctcggaaaatgaacaatgtcctaaatagttattggaacataataattttgtcttatggcaaaaatggcggattttgggtagtttatttttgtgggttacttttacggtttataatttttctgataaacaaagaaagctctaaacattcttctagagttggtattttgaaaaagcctggattcaaagttgggaggaagaaaagtcgcgggggtcgaagaaaaacaaatttttttatgagagcgttgttaatcttggtataaaatttattttaatccagcatttcgattttccgggatcccgtgcgagattgtgagctttttaaaaatcgcatattttcattgtccccgattcggagacaatgtcaggaagtgtggttggtgaccatgtatggatgggacgggacttaaacccttatagaaagttgttatttataaatttatatgatattttattaaattcaatttaataccgaatttcgaactcaacgttataaaaattcattaaatccgataaa

SEQ ID NO: 75840 - DNA, 865 bp, Heterodera glycines
  Genomic contig location: Contig_ID=SeqID_12253; Location=1108..1972; Strand=+
  SCN-specific regions: Sequence locations=1-259,283-434,456-491,534 -634,730-865
cgatcaaatcagtccgatcatcgaccagtgacggagattacgttcttaacaatggtgatcagcagcattgttcaattaacgaagaactgcgcaatttgacgctgtcgcacaatttgctgcggcagcaacaatcatcagccgtactgatttcgccgcgctgtcagccccgacgactttcgtccgtgccgcttcagcgccagcgctcgtcggcacagacgcgctgtgccaaaatgtcgacttcgttgggtaaatttcgaagttttttaaaattattttgaaaaatagatgtttgcgaactgttgcacattgtaacgcatgaatacatcggtgctgactgcgcactgcgcccgggcgaacgtttggtggtggtggacaacggggacaagaattggaagcacgggtttaaggtggaaaacgaaaaatttttagagttttttaataaattctgggggaaaaggactattatgagaaatttgaagaaaaattgtctcaattatttttagaattgataagaaattataaattaaaaaaaacatgctataacggattttattgtatttttttcaaaattttaagattaatttcagaatattttatttctttgttcttaaatttgtgtttttgttgttctctgaaatttaaaaaaaaaacaaaaaattattttagttatttttcattaattaattagtaattttgaataaaaaattttattaataaacaattattttagctgtcggattatatggaacggatggtcaccttcccaagttcatgcgtagcagcttatcggcctgaagaacgtccaatgcgtttggtgcgcaattgtaatttgttggaccagaaaatccgattgtaccgcgaccag

SEQ ID NO: 75841 - DNA, 836 bp, Heterodera glycines
  Genomic contig location: Contig_ID=SeqID_12253; Location=2630..3465; Strand=-
  SCN-specific regions: Sequence locations=1-61,102-288,340-636,665-836
atgcgattgatccaaacatgcaatttaatggagcaaaaaatgcgtctttatcgtgaccaggtaaaaaaatttttttttaaattagaaatttcaaattttaaggttgtctttgtgcagcccaattcgctgggtgaggacggacgggtgacagtgcggaatgaacacgacaaatttgtgaagtgccctctgcaatttttgacattggcatagcaacgaaacgccaacaggcaaatcgttttaaaaattgcacaatatttatgagaaatttgtaactaactatatggattgatttttaaattaatttttttttgaaagtattaataattttctttaaaaattcctccaaaatttttttaaattttcctggcggcatttgtcttggctaaggaccattctccctttgaatcttttaaaatttgagcaaaaatccttaaaattgttttctttccaaatctgttactaaattatgggctaaaaacaaattttcagtgatttaacttgagtgaatggacatgcatgcgctcataaattagcatagtaaacattgaaattaaataaattgaaattttgacaaattttctaaaacctcaatttaagactatgacaatattttcaatatgtttagcactcacctagaaaaatattatatatttttaaatatttagaaattccaaaaagcatgggagatgatgcattcggactgcttatgtacaccttgactcaaacatatgatgccaattagtttatgggtattgattaagttgatacggcattttttgtctttttctactgtatttctttttgttcgatatataccaaatgattttttaaataaa

SEQ ID NO: 75842 - DNA, 222 bp, Heterodera glycines
  Genomic contig location: Contig_ID=SeqID_12254; Location=188..409; Strand=-
  SCN-specific regions: Sequence locations=1-183,205-222
  Gene Ontology: Mol. function=protein binding; Cellular component =filopodium; Biological process=cell-matrix adhesion
atgagcaacagcaacgacatgagtggttatgaaaaattggggaaaattggtgaaggcacatatggaacggtaaaaaaagtgacacataaaatttcaaagttatattataaagaatttgttaatttaaggttttcaaggcaagaaacaaggacaccgagcaaattgttgctcttaagatagtgcgactggatgatgaagatgaagtgaattattaacaataaa

SEQ ID NO: 75843 - DNA, 1885 bp, Heterodera glycines
  Genomic contig location: Contig_ID=SeqID_12255; Location=588..2472; Strand=+
  SCN-specific regions: Sequence locations=1-263,285-465,494-760,791 -834,869-877,902-983,1005-1237,1259-1412,1448-1474,1499-1597,1619-1885
  Gene Ontology: Mol. function=protein transporter activity; Cellular component=cytosol; Biological process=retrograde (endosome to Golgi) transport
atgactttctgtatatgtccaaagaattggcacggcctggtgaattgttacaaaattccaaatttccattcaattttaccaatgtcagcaagccggtgagttctgctaattgagccggtggtaacatattttaaactgcattttagtacgaaagttatatgggttccaatgttaaattgcgctattttcttcgcgtcactgtttttcgtcgtcttaccgacattgtgcaagaattggaggtataacaaaaaccggaaaatgcgttaatagtttggtttgtcttccccctcccccatattacgcaaaaattttttatggcattgaaaaaatgttcccaagtttttggttgttgattacaatacatttgatacccttttcggcgaattccagaccataactcgaacaacaagtagaagtagagtttttaagtgcactttgaatgttcatcctttgcattattggtgctttttattttaatgtatttaaaaattttggcccctaaagaattttttaaaaatttccgacctttttgaattccgaaattgacagaatgaatatttttcgttgttatcgactaagaaacgaacctaaatatattttatgacagataataagtaatttgcataaaagaaaaaaggggtgagggggcgggggacaagccaaagtattatagtaccaaaaatacacgctgtgttcacggtttttgttttaacagttcgctgtccatacattagctgtctatcctgagaatgattgcaacatcaaaatggaagtgggcattgaggattgtttgcacatcgagttcgagtacaacaagtcgaggcgagcaagcacaaaaaatatttaaaaaaaaaattttttttttttaggtatcacctaaaggatgtgattgttgggaaaatttatttccttttagtccgcatcaaaattaaggtctgtagagctgttgtttgacacttggtaaaatgaatcaaaaaatggagtttgctttgagtctgtgttttagcaaataagtttttgctaaaaaaatattcggtaaattaaaaaatgaaaaaaaatccgagaagagggggaagagagttgcgcacccccctatctcctcaccaaaatttttaaagcgaaaaaggatttttttggtaaattctaaattcgacatttatattgttttaaaataaagcggcaaaactttggtggccgtgaagagcaaaaaagggtcgtcatctttatctccaagtcggaacttcctggaccttccctgcaaattatttgcacatttttttttctattacagcacatggaaattgcaattctgaagcgtgaatccgtgggcaatgggccaaatttgttcaacgaaaatgaaacaattgccaaatacgaaatcatggacggagcgccagtgaagggtaggattgttttttattatttaaattgtgaaaaaaaaaaatttcctttggtactttttgtccatacgcccaaaaattttaaaaaaaaaaattaacaaaggatgcaccgtgttttttttttgatggcataaaaggaataatttgccccaagacaattctgaggttttttttcctttttggggtaacttattcctttttatgccatcaaaaaactcagtgcattctaacatatttttaacatttgggggtgtatgtacaaaaccgaaaagtatctttcttctttttttattaaaggagaatccattccaattcgtttgtttttggccggttacgatttgacgccaacaatgcgcgacgttggaaaacgtttctcagtaaaagtacgttgttgaattcatcatgcatgggtcgggagatcactttttgcgccgattcatttactagctggttttttgtgacttttaaaaaaatgttatatcata

SEQ ID NO: 75844 - DNA, 919 bp, Heterodera glycines
  Genomic contig location: Contig_ID=SeqID_12256; Location=341..1259; Strand=-
  SCN-specific regions: Sequence locations=1-285,307-450,473-742,772-919
tggtgttcgcgcagcggggaacgctaatgcaggagtgattgaagtgccggcactgacaaatgcccggacggcttcacatgtgttgcaaataaaaactgttgtccaggttcgaaaggttccaaacaaataattttggaaatggcgcatcatgcaaaattgttttcaaaattcatgaaactatattttgaccatttcttaatatcagatccaaattcgaagaaagtcgaaaattcaaattcatatcgaaattcgcttttttggctcaagtccggattaaatacaaagaaacaaactaaaaagccaacaaaaagatcatttaaataattctaaactaaaaagaaatttcgactttttgttcggtcccggtccagggttcagaatttgcacaagtgaatgcttgattcatgatcaaatgaccaagaaaacactcggaaaacataattgcaactgaattttttaattattattttttcttttgaaaatggggagagaccaaacgatgcgcgctttaagcaaaaattaattgtatcttacaaaattaacaccctaaaagaaattgtctgcggtattgaatatgatacgggacgatacgccttccaggggtcgcatacgccggtaaattttggacagaaattgaaaacactgcactgaaaatttacagcgttacttctacaagaaagacattgacaattgccttctgttcacttattacggtgcactcggaaatggcaacaatttcgagtaataataaataattattattttaaatttgattctccaaaacacaaatatttaggacatacaatgaatgcatcaaatactgcaagaagacttaataatttatgtagttataaatatttcatgacgtgaagtcaattggcgttgagaaaaaaattatgtcatttcataaaaatgatcc

SEQ ID NO: 75845 - DNA, 89 bp, Heterodera glycines
  Genomic contig location: Contig_ID=SeqID_12257; Location=2392..2480; Strand=+
  SCN-specific regions: Sequence locations=1-57,81-89
ggcaaattttatatgaataaattggactgatttcggggaaatgaagcgatttaattcaattaaaaatgccaaaacaaaaatgggggagg

SEQ ID NO: 75846 - DNA, 1276 bp, Heterodera glycines
  Genomic contig location: Contig_ID=SeqID_12258; Location=184..1459; Strand=+
  SCN-specific regions: Sequence locations=1-123,147-158,182-403,425 -471,493-773,799-1026,1057-1276
atggcatttttttgtatgtgactacaatttgagtctcctcattttgctgaattgtattgttggataggcaaattttatatgaataaattggactgatttcggggaaatgaagcgatttaattcaattaaaaatgccaaaacaaaaatgggggagggcatcatggccttaaatggaatttttccatttttttgtcgcttggtttgtgcccaccatttttctttgaaatttcagcgcggattaacggagtcgcaaagcgtgccgccatttcaaatgcggcggacacaccgtcggcgccgaggcgttcaatggtggccagacatcaccggatcagtctgaagccgtcgccagccgaaggtattttttggcttggccatgtcacaatttgttttatttttggagtggaaaataaaaaaatattttattcttgatttcgaattagccaatgcatacctaaaacatttgatgggtcaatattgaattttttaaaatttacaataatttcctcaaattttagcggaaaaaatggggatttttttatatagtaaatctaccctcccaaaacgtcataaaacggggattttttgtcaaatttttttataaataattcatcaaatgttcaaattggtccgttaaaatcaggcccacattatatgtcaaccaatttttcagttttttgtcactttttaatgaaatattttgaatttgttgctctttttaaggcactgttgacattcaattcgatgacaatcagcagcaaatgccaacagcaacaattggtggtgctgctggtggtgatcagaataagcaaagctgtgccaacggttcttccaacacttctcctccggcacggcatggacatcaaactcagagccaacaacaaaaaatgacgacgacgagtcgaagcagtacaacgccaacgccaccttccacggcgccgtcgttgtgcccattgaatggcgtcggttgtgacggagaagcggcgcaacaaaaacaggacacaattcagccagcaaattgtgttgctggtgcatcttcatcatcatcatcctcgtctttttcagttccgaatgaggtaaaacaaagaaaaaatggggccctaaattatggacgattttacttggttttgtgagcaattttttgcgtcttaatccggctcaaattgtttttttttattaccctaatggttcagacttcttaatgaaaaaaaagcattaaaattttagcatttcgcttaaaaagcctcaaaattttgccaatctttgtccaaatttgtta

SEQ ID NO: 75847 - DNA, 1087 bp, Heterodera glycines
  Genomic contig location: Contig_ID=SeqID_12259; Location=496..1582; Strand=+
  SCN-specific regions: Sequence locations=1-448,489-1087
atgcaatttgaggtggaattccaggagactgtgtatcaggtggggaaaaaattgcatttttttcccggaaaatgcaaattttttggatggtttttttgcaggtgttcgttagagtccgtccccatcttcacgagttcctcgaacgcttgtccaaccattttgaaatcattttgtttaccgccagcaaaagagtgtacgcggacaaattgctggtataataccgtatatttttttgtgctttttaatgtctgacggtgtgattttttaggattttctcgaaattttttaaaatttttggtttgcttttattttgggatgccgttgaaattcattgttaattactaatagtatcctttttcaaaataacatccaatatgttttcggggttaataaattcattaaaatcatttgttttccattttttgctcgaatttgccctgatttttttggaaaataaatgagaaaacaaacttttagtggcaaaaacacgaaaaaacaatccattggattaccctaaatatggagaaaatggacaaattaatttgttgtactgtttgtttgttgttataattggacagtttcacttttgaaaatcattcataccctccctaattataaaaatgctcaaattaaatgtttttttttgaatttttcagaatttgttggaccccggcaaacggttcattcgccatcgcctgttccgtgaacattgcgtgttcgtctacggcaattacatcaaagacttgaacattctcggccgggacttgtcccgcacagtgatcattgacaactgtctccaatcatttgcatatcaggcaaatacaaatatttaaacttttgtcaacaaatgttttggatttgaaacatttttcaaaaaaaaagggccacaatttttctcactttttttgtcgaaaatctgtcaaattttgtgtcttgataataccgccgccttttttgtgcagcttgacaacggcattctcatcgagagttggttctcggaacagagtgacaccgaattgctgaaactgatcccgttcttggaagcgcttagtcgtgaggtcagtttcaaatgatttaattgttaata

SEQ ID NO: 75848 - DNA, 1481 bp, Heterodera glycines
  Genomic contig location: Contig_ID=SeqID_12261; Location=52..1532; Strand=-
  SCN-specific regions: Sequence locations=1-55,77-145,167-533,555 -584,607-1108,1138-1256,1287-1443,1467-1481
atggctttttcaattattttcgtgaccgtttttagagcattttttcaacaaagtgccattttccgcccatataaaataccgtattcctactggccccagaaaatttgatattttttttttactgaatgacctattgatattatttttgtgactattttgggttttttacacttaaaatgccttttttttttgccagttccttctggtctgctcaccgagtgtgaggtgtccagcattttgcaatggcaccgttctcgtcccaagcccacgtgccgtactcttccggccgcgctgtgccgtcccctccaatttgtggcccaatttcccaccaccaaacgcaattacgaatgccgggcaacgcttcggcagaaaatcgacaattttgccgaattggcgagacaaattgctggcgacagtaaacggagctttgacagcgttgaaatcaggggcgtaatcggaggctaaaaaggatttacaaaaacagggaaatcccagacccttaaaatatttttttgacctgaaattttgaaaaattctaaaatttaatttcaaaccgtttttaagcatatttctttgtcctaaagtttatttttttaaatttttttagtggacttaaatggcaactgaattcatgtgtgttaattgatcatatggtgaaagatggtgaaaaactaatcagttttcgtttcgatattgattgtgacacggacagcaaaatttgtgagtaaaaaaaagacaaaaatttaaaatttcatggtttagttcaaggggtacgtaatttcgtaaattttggatggaaatcggaattttgatcgaaaccgaaaattggaaaaccaaaattccgacccctctccctcccaaaaagttatgtcgaaaaccgtaagtccgcgttatttagcaaatgccaaaattttctaaatttttggcaagtgaataatgaaaaaataattattttcatccatttgcctaatttttcaaataaaatttagtttccgaccgagaaatgttctttgaaacaacatttcgaatttgttcgcaacaagatgaaaagaattatcgcgtggaaaagtgttccagcatattctacaataataattttttaagttggaatatttaattaattaaaatgaaatatttcatattccactggggaattgaacccaagcgaaaataataaaaagcagaagggctatccactgaaccacacatgctcacggataaatgttttaaaaagatagacgggatccgggctctcgtaaaaataaaaataaattaaattaaaatttcagtttagttataggggtacataatttcgtaaaattttaggtgaaaataggaactcttcgatacctgaaaaaaatttctgaaatcgaaaatcggaatttcgacctctcatctctcacaaaaatatgtcggaaatcggaaatacgtcacttaacaaatggccaaaatttttaaatttttggcgaattaataataaa

SEQ ID NO: 75849 - DNA, 1278 bp, Heterodera glycines
  Genomic contig location: Contig_ID=SeqID_12261; Location=1597..2874; Strand=-
  SCN-specific regions: Sequence locations=1-83,136-346,369-438,460 -575,613-789,833-1111,1134-1235,1259-1278
atgcttcgctttatttattcggctgatctgagccaattgaatggtcaaaatgccattgctgtgctttatgcgggtaaaaaagcattataaaataaatttaaaattatttaaaatttgtcattttaaataaatttagccaaaaaatataatgtgatcggactgatcagagcatgtttggactttcccattggtcagctgcaaaatgtgttcttcgcatttgcggagacgcactttcttggtgaaaatgtgtgtaggaaaaagttgggatcacaaaacttgggaaggaatcggacgaggacagaagaattttagggataaaataggagttttcgggattcggatcacaagtttagggttagggtttcgatcaggattagaaattcttgaatggggaaacaggacaatatctctgggattaagcagcagaattcaaatttacccttattttttcacattttaccgattaatttccaaaaaaacaattaaagccaaatccaaatttaaaaaatttgaaatatttaagaaactgttaaataattatcttatcattggccagtgatactctacattttcccaatattttttaattcaaattcttttaaatttatatttgacatttcccattttggcatttcgccgaccaatgtttggcttacattgatcaaaacgcggacgcattgtttcaatcggacgcatttttgcaaattgatcagagcttattgtgcgacattctttcgcgtgatcaactgctgattgctggagaatttgtcatttgggaggctgtaattgtttaatttagttttttattatttccttttaaattaattaaaaaggctctccgttgggccgacgaaaaatgccgtcaaaatgatactgaatgttcggcacagaatcgtcgtgcaatgcttggcccggcactgtacaaaatccgcttcccgtgcatctttgaaacggatttttcgactcaaattggtcaatactgtagccagcattttaaaattatactcaaataccgtacacctagctagtgttgatactcattttttcaattagatgcaattacggtatgctttttcaaaatcacttatacgatctacatttttacaataacacaaaaatactgtctcctccaaaaacaccgtattcttacccttcccactaaaaatactatttttggagtttttatcaacgaaagtgccgtatccgcccacataaataccgtatttttacggacctaaagaattttattttactaaattggactgtttatcaattaaa

SEQ ID NO: 75850 - DNA, 113 bp, Heterodera glycines
  Genomic contig location: Contig_ID=SeqID_12264; Location=444..556; Strand=-
  SCN-specific regions: Sequence locations=1-113
atgcttcagacggtgtccggtgttctgctgcgctcaaaaatgttctacgtaccatttctgatctgcaagcagccggagccaattgtggacgaaaagtcgcaacaaatcggaag

SEQ ID NO: 75851 - DNA, 572 bp, Heterodera glycines
  Genomic contig location: Contig_ID=SeqID_12265; Location=256..827; Strand=-
  SCN-specific regions: Sequence locations=1-129,166-378,400-572
atggcaaacagtgccatggaacaacagttgggcatgctttgtccaattaccgcactgacattgccacaaaaaaggctgattctggcacggtggcgacaattgtccgccgcggacattttacggtaggaaaatgttactgtacataaaaataaaataaaatttgttttagcattttcactctctttttcagactcagtgaaaacattttcgaacggacctttcgccgcaatgaatcattcgctcggacagtcctccgacaaaacgacagaaattggaaaaatttaccccaatttcgagttcttacaatggtaaattgaaaactgttttccgatcgaaatttggctgaatttcccattcattttcagcgcttttcctacgctttgtccgccctttgcgcctctttggcggatgacgcggcgcccggcgccgaattgctggccgaatttggggcacagcacgcgattgggctggacaatggccaagtggtaccgcccagctattgggacgtgcttttgttggccatttgcgaggcggccggggccggcgaaggccaacagcaaattgaggtataa

SEQ ID NO: 75852 - DNA, 766 bp, Heterodera glycines
  Genomic contig location: Contig_ID=SeqID_12265; Location=942..1707; Strand=+
  SCN-specific regions: Sequence locations=1-347,369-620,642-766
atggagaagctaatcaacggaccatctgccgtttatgtgttggagtcggaaggattttgcgcgacgtccgtcgaaggaacgccccgcggggcgttggcggcgaatgccatcgcccaaacggccgccagtgggtgcgacggcacaactgctgaaggcactaccgcttgtcaaatttgcctcgtcaagcgaagcgttgtcgctcatggcatcggccaaaactatcgctaccgcgtcgggacggtccgcggcacagccaaaagcgacggatggacgcccatccgaccgagcggaactgaacgaggccaaacgaatggatgagaggaatgtcaaactgatcaactgatgaccaacaactgatcagatcagatgccacaccggtcgcttttggttgagccgccatttcgttgggcgccgctccgaccgctgccgccgcgccgctttgactttgccgtgccggccaccgcggcggaaagcaccgcccccgcggttgccaaactggccccgttcatgtcatgccaccggacctccaaaagcggaaattgtttcatttcttgctttcaaatcataaaggcgtacggacgctgcgactggggcgacaggacggagaggagtcagtctggtcaactgatcgctgtccaccgccgcggagcggatcttcacaagcaacaagggatcagcctggtcaactgatcacctcacagattttacgattaaccaaaatcaaccgcccgcctttctcagcacagacaacccggaatgaggcata

SEQ ID NO: 75853 - DNA, 184 bp, Heterodera glycines
  Genomic contig location: Contig_ID=SeqID_12265; Location=2118..2301; Strand=+
  SCN-specific regions: Sequence locations=1-16,51-63,97-184
cgactcacgtcacgagaaataaaatggaaatgataaattttataagcatgatgcaatttcattaaaaatgggaaaaaccttaatttaattagaaatgttccccctcttcgtcgttctattcaaaaaatatttgtttgtttacagtcaattcttattcatttctcacacaaaaatgtattaatca

SEQ ID NO: 75854 - DNA, 748 bp, Heterodera glycines
  misc_feature (748)..(748): n is a, c, g, or t
  Genomic contig location: Contig_ID=SeqID_12266; Location=60..807; Strand=-
  SCN-specific regions: Sequence locations=1-108,131-145,534-748
atgggaaatgccgagtcaaatgccgcgggacggcacgtgggcagtggaaaattgcgacagtcgaaaaaggcgaaaaaggaaaagcgaagttgcagcgaacacttggaacagctgcaaataaagcagaggaacacgagcatggaacaggagaagcaaaagatgaagcagaagcaggaaaagggggacaaaaaggaaaaggaagaggtgaaagagaaagagaggaaagaagaaagaagaaaaatatggggaaaaagagagaggaaaaagaagaggtgaagagaaagagaaaggaggagagagaaagagagagggaaagagaggaagagaaaagggaggggaaaggagagaaggggggggaaagagagaggaaaaggaacaggtgaaagagaaagagagaagggaagaggtgaaagagaaagagagaggggaagagagaaaaggagaaaaagagagagggaaagaaaggaagagaaatgggagggggaaagagaaaattcgagggaaagagaaaaggggaagagatggaagggagataagaaatgattaagaccaatgacatccgtataaattttcctcattttcagtcaatttccgccaaattcattcgaatgccgcgtcgactaacacaaaaatcgtccgaaggcaccgccgcttccgcttgctgctgcacacgcttggccgcccagcggatgccccgcatggccgaggaaacggtggcgatgagccgcaccaccgtacttccgcatcn

SEQ ID NO: 75855 - DNA, 486 bp, Heterodera glycines
  Genomic contig location: Contig_ID=SeqID_12269; Location=116..601; Strand=-
  SCN-specific regions: Sequence locations=1-146,168-449,471-486
atggcaaaatatgcaaaaaatcggaaaatatttgaagaaaaatgtcaaaatatgcaaaaaatcggaaaatatgcacaaaaaatggtaaaatatgcatgagaatgtaaaacaagcaaaaatatgcaaataaaagtcccgatttttatacgcaaacacaaaaaagaaagtgtttttcgtactatttagagcatggagaagccaggaaaaaaatatgcatttgcatacttttggcagccctgatgattaattatgaaaacggttttcccttcaattcaagggccacaaatgtgctgcggtccgcggtgtatttgctgcagtgaataaaatgggaggttcgccctccataacacgtaaccattttttactatattaaactttcttaagcctttctcacaaattgccatattttcaggtttttgggattattaagctcaattggtaggatttgcatttaaaaaatgataaaaatgtgtcaattaaaataaa

SEQ ID NO: 75856 - DNA, 3419 bp, Heterodera glycines; identical to SEQ ID NO: 12269
  Genomic contig location: Contig_ID=SeqID_12269; Location=1..3419; Strand=+
  SCN-specific regions: Sequence locations=23-434,456-677,699-729,751 -1208,1232-1747,1769-1795,1838-1869,1916-1932,1969-2191,2213 -2638,2660-2666,2704-2850,2974-3005,3051-3079,3173-3341,3393-3419
  Gene Ontology: Cellular component=lysosome; Biological process =receptor mediated endocytosis

SEQ ID NO: 75857 - DNA, 2726 bp, Heterodera glycines
  Genomic contig location: Contig_ID=SeqID_1769; Location=419..3144; Strand=-
  SCN-specific regions: Sequence locations=1-137,159-297,351-391,413 -522,544-558,580-1284,1306-2007,2029-2726
  Gene Ontology: Mol. function=pre-mRNA splicing factor activity; Cellular component=nuclear matrix; Biological process=mRNA splicing
atggcaaataaatttgtgcttgtaccacaagaaatttaccggggtctcacctctgcgacggacacgggtgacatcaatttggatgctgtacgacacgatttgacgcgtgccagggctgaacgaacaaacccttcagctaaaaatgtcagctacaatcaacagcttaggcgatacttgcaaatgagacgggaggtcgcggacaaaccagcacgggttgagctagtcaagggattgagtgttctgatgaggcgaggcggtgctgatgatgaagcagaagttgtagatacaccaccccgccctcctcctcctccaccaccgcctcctggtcagcatcctcctcgtcgtccaccaagccctccaggcccaggtccgtccccgccggggagtcctccgccgcgtccacagcgtcctccgagaccacctagagctgctgcgccgccctctcggagagatgggcgtgtggaggaatggcgaaaaaagagaaacgacatacaacaacggcagccggttgtgcgggaccttcttgctgaagcagctgctgctccgctacccgaaagtgacgaagaggatgactacatgttggagagcggattcgctctgccagcaccatcacaatattatggcgaattgcctgtactgccagacaacgcggacgcaattgaggagatggacactgcacagcacaggattgcagccagaagaaagttaaagaaagcagatgacgatgatggcaatgacgatttgcatcgcaaaaaataccgggtctattaccctcctcccccttctcgccacccccgtctcgtccacagccaaaaattgaaacacctcgacctccaccgcgtcctagcctcaagaaacaaccacaaccactgctcgatcctcagccatccacatcacaacaagttgagcgcaaacctaaaagggagccaaagttcgatctggatccgcgaccatccacatcacggcaagccgggtacaacccccctgcggaaccaaaacatgaacagaaaccgtcaaaaaagccacctcctcgtgccacaccctatcatattccgaaaagagagccaaaaattgaagaaacactgccgcggcagcaacctcctcctgctgccccacaagtgccgcctgttcccccacctaggagagggaccaaacgtcgccaccccccggaaaatggtgatgagagtggtgagctgcgcatacgtaaacgagtgaggcaagcgcgaagagtacgagtgtattactcaccagagccgggtccatcaacatcagcacaaagcgatgaacaacaacaacaacaacaacgtgaactgtttgccattccgtcaaatcagctgaccatggcacagagaattgagctaatatacatcaaatgcaaccgttatgccgatcgtatgggtgtccggggaaacgcaattatcaacactcaaaatgctcaaccattggtgcgaagcaatttgcgaacagccatcaggtatataattgacagaagagcgggtcgacctaccattagaccaccgggagcggaccaattggaggagcggcttaggcaggacccaattttgtattcattgacggctccaccaaagagaccatcgcagagcacaagcagcaggacgtcaataaagaaggaatttcagccgaaaaaatggaaatgatcaacaccactcttgacaagctgtacaacgatccatcctctcctactgcgtttgccggtgttagtgcactgtggaaggaggcgcggaaaaagcttaaaacaattacggaaaaaggatgtacaacactatttggagggacaccgcacgtacaccctgatgcgccccaggcgggtacgatttccgagagcaaaaactgtagctgctggcttcatgaccgacgtccaagtggatttggctgactttcaagcgctttctcgtcacaatcgcggtcaccgatacctgctggttgcggttgatgttctctcaaaacgcctgtttgtcgttccactcaaaaataagaaggccgaggagatgctggatgcattcaaagagcttgtcaagcaaatgccaatggtcccacaccgcattttctccgacaaaggcaccgaattcaaaaacaaattgctgaaggaattctttgaggagcaggagattgagaaacatgagcccgtgcattcgtcagtgaaagcgtcagttgctgagcgggcaatccgaaatgtgaaacagcgactgtacagatactttgccgaaagggagacgctgaattgggttgatgttgtacaacaaatagtggatggaattaacagcactccgtcacgggttcacggaatgcgaccaattgatgtcaattttgaaaatgctcagaaggtgtggaagcgaatttatgaatcaccgcaaaaacgcaagaagccacgtttccgtaaagatgaatttgtacgcatgagcagagagaagggacagttcgagaaggggtatttgccaaactatggagacgaaatcttggaaattgacgaggtgctgaaggcggtgcgccccatcagatacaagctccgggatgatcgtggtgaaaaattccggggcaccttttatgagcaggagttggcccgcgtgagaaaagatgccggcaccagttacagaattgaaaaagtgtacagaaagcgaagaaaaccggatggaaccacagagatgctcgtaaagttcattgggtatcccgaacgagaatggattgacgagtctcagattgtataa

SEQ ID NO: 75858 - DNA, 565 bp, Heterodera glycines
  Genomic contig location: Contig_ID=SeqID_1769; Location=5541..6105; Strand=-
  SCN-specific regions: Sequence locations=1-442,467-505,539-565
atgtgcgtcatttgtgaatatttaaggggtaccgatggcttagcaggattcatttcaagccaacaatcccttcccacgctcaatacccttaaggtaaaggggatgatgcttttcattttattttgtcttatttgtttttaattttaaagaaaatgccaccacgtgaaggacagagcaacaacgcggggaatgacgcccccggacacagacaaccaccgtttgctgaacaactggtcaatgatgctcaactgcgagacatcatgaacgtactccaacaacatggcgtcctggtaatttgctcattataatttacaagacatttccataacaatttcttcacaggttggcttgaacggcacgccgcaacaaattgtggaagcattgcgtcaattggcgcaaggacagctggatgatcgccgtcgtcaaacctgatgcttctgcggatgatgatgatgattattgtaaaacggaaaagactgctgattgggaagatgaaagaaaaatgaatttatttaaatttatttttttactaaattttccgattgattgaatttaaaaaaataaa

SEQ ID NO: 75859 - DNA, 1501 bp, Heterodera glycines
  Genomic contig location: Contig_ID=SeqID_1770; Location=2239..3739; Strand=+
  SCN-specific regions: Sequence locations=1-269,292-386,482-512,560 -624,667-751,773-1305,1328-1501
  Gene Ontology: Mol. function=structural constituent of epidermis; Cellular component=intermediate filament; Biological process =epidermal differentiation
atgaaatttttccttacttttttgcttctcgccatttcatttttggctataaaaacggctgccgatggctctgacgacagaaacggagacaaaagtttgccaaatccattagcagttgagggaaaggcgagcaaaaggtcagagagacggagtaaaaactgaccgggccaaagccttaaaagccgaaaattctcggctagtcccaaattacccgaaatcccgactttaaatttggattatttttcgttttttcctaatttaaatgtacttcttgtacttttctctttagtaatcgccataagcgccattatggctacggttacggcggttacggtggcggaagttggggcggttatgagtcgtcgagatggggcggttggaacaacggcggatttggaggaggaggcatgggcggtggcatgggcggcggcatgggcatgggcatgggaatgggcatgggcggaggaatgggaggaggaggatggtgatgagagggcatttttattcattcgaaattaattgttattttatgacaaaaaaatattatttattttaaaaaccaatttacaaaatacgttcaatctcttggcatttgtcacttctttactcaaaaagcaatgactcataaattaatattttattcatttattttatctttttttataagtgaacagcagaaaaactggtcgtcccctgctggtgtggttccttttctcgtatcactttgtgtttattgcgggaattttatgactgttttgtgtgtaattaattagtgtgttaattggtcacgcaccgccgatcaatttcccaaattatccaatttatttcaatggtaaaaagtggaaaagaattggcccaaaattcgttgcattatttggactttgccggggctgctttaccatcgcctcaatttttacaacggatcgccaatttgttgtacgacccgcgggaatgccttttggcaaacccacacagtgaccatatgatgggacggaggacgcgggacaaagtgcaaaacgcacgggcaaagtgagggagggcaattaacggaagtattcaattaattaattgggtacatatcacaaaagaatcctcgcccattttggtggcaataatttggaagaattcgctgtgattttcacttcaaatgcaacaaacgcattgaaactgctcgccgaaaactttggagacgaaactcgcaaaagtcgcacgacgaaaaaacacttttcaagtgatgtgaattgtctgtcggatggtaattagttctttccgtttaattaattggctttttcagtcagtttcgctttggcactttctttttctggttttcccatttctctcaaattgcccccccccccctttcagttgctcctttgagcacccttctgatgctgcgcgattcccacacgtccgtcgtcggaatgcgaagtgctgaaagcttcgaacgattgttgtggtcacttacgaagagttaagacaatttttgccgaaaccgagggca

SEQ ID NO: 75860 - DNA, 2606 bp, Heterodera glycines
  Genomic contig location: Contig_ID=SeqID_12270; Location=49..2654; Strand=-
  SCN-specific regions: Sequence locations=1-347,369-420,442-1008,1039 -1216,1238-1405,1438-1521,1565-1571,1593-1794,1824-2113,2144 -2168,2191-2222,2244-2265,2288-2363,2395-2404,2428-2606
  Gene Ontology: Mol. function=ATP dependent RNA helicase activity; Biological process=regulation of translation
atgctttggcaggtggttgtccattacgcaccgttgtccattgtcggcagattggctgttgttttaaaggttggtgtttgcttttagagtttgataatattttcttttttttgaaatattttcatttcctccacaaaatataggcccgtttcactgacaccggtggtcacttcctgctgacgctgttcgtgccgaacagtggcgacaaattttccgagtttggccaacggcacaaagcgtacgacgcgttgagcgaagaggtgaagggggggggggggggtgaagaatggcttaaggattaacgggaaagggatttacttaaacaaaaatttgtaaaaaattctcatggaatttttaccctttttccaagaataaaaaaattcagaaaaccgaaaactccgccataaaaatgacttaaatttgattttctaaaagaaaaattggatggggtccagaaatttgggcatttcggggtcgctgaccataaatccctacatccattcaaccgatttccgaatgtctaaccctccaaattcgaacaaaatggtcataaaaaaacaaatttttggatttttaagaatgcgagaagccacaaaatttctttttatgtgtgtttaggacaaaaaatggcaccgcaatggcctcctgttgagccatgccgcgctgcatggccccgagggcgttgtgccggcccacgcatttgcacgcgaggcacctttcaccatactggaggacgtcggcctggacaggtacatactgaaaacggaaaaaacaaaaatttttggaaattttccgattttttaaaaattttctacggctgtaagaatgtccaaatactccctgaaaattcattttttgcagtctcaccgccgtgtgccgtcgcagcattgccaagctgagcgtggacacggtgctggaggagcacaggcgcatcagcggaccgtaccgtgcccagtcgccggaccgcgcggtgcggcgactgctcgtcgagttggagacgctcagcgaccgcttcgagcagcagcagcaacagctcaaaaggcgaggtaggcagtcttggcggcgacggacgacacagaaattgttggaaaactgtcaaaaaaaaattttgaaacattttttgaattcctaattgtacaaatcgtcccttggaatagtcttgggttctctctcgggattgggagtcccaagtctcggggcttcaagactctgtatcgaaaaaacaaaattttcatcagacatgtccgagctggtctacgtgcttggccaggacaccgaccggcgtgacgtggacctggtggaccggctgcgcgaagtgagttatcgtaaaataaataactgtgccgaaatgggggggggagtaatttcaattttcaatcgcattgcgagagactgcccctccgttttagcgctcactctctctcgcctcgagccgaacaaattaacattttttaattttggaattgttcgtccccaaatttttttaattttggaattgttcgcccccccccccctccaccgaaattatttttttaattgaaaattttttcagttttaattttttctacaataataaaacatctaatttctttacatgtaattgtgttgcacaggtgcgcgaactccgtgcccaattggtggtggagcccgaggcgctgttcccctgcctaaagtgtccactaattggccaacatgtgagaaatcacataatttagacggtccaatcatttccttttcgaggaataaatactatctatataaattacgttttcaaatgcaattttgttaggggggaaaaattaaattaaaatcaaataaattttgaaaaacttcaattcttacgaggcggataaattttatttcatttttttcaaaatttgtgcttcagctccgtctgatggcccatcggtgcaaattggaggagcaaaagcggcggttagccttcgagacgtcctccaacaacctgcagttctccaaggagtacgtggaccggctgaaggtgctccaagcgttgcattacattgaccggcacaacatggtcggcctcaagggcaaagtggcgtgcgaaatcagcaaccaagtgaggagggggggggggggaaattgttggcactaaatttttaaattttaaatgttttttaaacaaattacattttcttagatggaaatttttaaattttaaacatttttccccttatgattctgtagaattttccaaatttgtagttattattttaatcaaaattgttggactaacaataagatgaagaaaataaattgttaaaaattaaattcctggcataaaatttttaaatgtttttttgtgagaaataaattattgtgggccccaaaatggagtgaaatttaaagttattttttaaaaattgaattcatttcacaggtgtttttaaataaattttaaaaattcaaatgtttatcaaattttctttgtccactttttgattttgaattaattcattttttttaaagtatcttcccttttccaggaacttctgatcaccgaactgatcctggacaacaaatttgagcagcgcacggctgcccaaattgcggcaattctttcctcaattacgtgccaatttgag

SEQ ID NO: 75861 - DNA, 1599 bp, Heterodera glycines
  Genomic contig location: Contig_ID=SeqID_12271; Location=1..1599; Strand=-
  SCN-specific regions: Sequence locations=1-193,216-802,824-1222,1244 -1385,1423-1599
  Gene Ontology: Mol. function=translation repressor activity; Cellular component=cytoplasm; Biological process=regulation of translation
tgataagaaaatttccacaatgtgcggccccccacctcgctgcgaaccctctcacgccacctctttcaccccgcccccccttcgctgctaacccccccctaaaaaatgtatgtttgtgaaatttcaattttttatatgattttggtgtggtgggaccactaagagcggagaggggggggggggaggctgaggcgtggaaaataaaaatcccaaaaatccgttacaaattcgcggattctgatgccggattccccccttcctcccccctaaggttgtgttcgttttttcgcgccaacgctgtgacgacaccgcgcaactgctccaatcggtggacttgaccacggagaaggagaagtcggccatccaccgcttcttcaccaaatgcattgaccggctgaagggcaccgacaaaatgttgccgcaggttattatcacccgtcgttttttatgggcaaaaatttgttttgcaaatatcgttaaaatcctaaaaaataaattgtccgctcatcggtacccaccggcggagggaggtatgtatcagggatgggccaaattgaaaaataaaaagcgaaatgcgaaacgctaaaaaatgcgaataatgcgaaatgcgaaacctcgccccatccctggtatgtatcaggtgtccttgattttttgaaaaatatgcccaagggcgtaaccagccaaacccttggcttcgcgggaggggggggggtggaaggctgaaagcgaaaattcgatagggctgtattttttttttttttttgctgaaatcctaaaaaagcttcataaggaaacattctaaaaattgtgatttttccaacaaaaaaaaatgctggctcaattttttatgatggaggaaatgcgctcgcggcattttatccacgcttttaccggccaatttcaaaattttccatgcttttgatgccggttttgggccagttaccttttcactctaatcttggcattaaactttggtttttttcgggtttcctacccaccaattattgaaaagcgccattattaatcgtttttgtgtgcctttaggtgttgctgatgcaggagctgtgcaagcgtggctttgccgtccaccactccggcattttgcccattgtcaaggaggtcgttgagctgctcttccagcggggctacgtcaaaattttgttcgccaccgaaacatttgcaatgggcgtggtcagtcaaacaaaaaaccattattaataaatgggtaatgaaaatgggacacacagataaatttccagaaaaccgaaaaaatttaccgataaaaatggcacagtttttacaattttttttggcaaagccaaaagaagagcatattttttaaaattttccggcaatattttctggaaacgaaaaaattttccaatatttttacatttttttttgaaatatttaaattttgctacttttgtaaattgaaaatttaaccaaaatttttttttgcgcagaatatgccggccagaactgtcgcgtttgaaaccatcgaaaaatttgacggcaaccagaagcggtttctgaacccgacggagtatgtgcaggtagaaaaacaccaccaaatgcttgaaaatttcaaaaaaa

SEQ ID NO: 75862 - DNA, 1504 bp, Heterodera glycines
  Genomic contig location: Contig_ID=SeqID_12272; Location=305..1808; Strand=+
  SCN-specific regions: Sequence locations=1-82,108-204,242-320,342 -371,393-765,787-818,849-980,1004-1086,1135-1209,1237-1399,1451-1504
  Gene Ontology: Biological process=regulation of cell shape
atgaccggtctgccgccaaacgccaaatcaaagtgcaaaaaccgaatgagcaacagcagcgccagcacaacatggatgccgaccgccagtggtggtggtggtggcacgcaatttggtggaccaatcgcaatgccaacgacgacgacgatgacagtcggtgacggcgcacctccaccaacaaaaattcggcgtaaagaaaatgatgggggagcgacggctgcagcaacagaaacagaaaacatattgtaattagacaattagtgggttctattagcacgaatattttgtggtgatcccggatttggtggctctttattgggttttaaattgttgtaattttttgattttcggttctacgaatttcgttcatattctctgatatttacaaaaatgtaaatcgggatcataaaattcccgttcacctatgcgaaaaatggggtacaattctttaaaatgccacttttttctctgaaaaattcttgtctttgtgtaatgaatggatgctaaatttttaagtttcgtttccagcggaactcagcagcatgctcaaccgtctgctgcaaagaatgtgatcatcactctgaatgatgatgacatctttccgatcaaccgttcacatttcaccaaacaacatttttcaaatgctcaaaaaacgctggcatctccacgacaaaaggcgccgcaaaaacacactcataccccacagacgacgacaaatactgctgctggtacaggctgtcaaccaagcagcgatacttctccaatgcctccacgaccaccaccaccttcattcactggcacttcatcatcatcattgtctgcttctgttgctgctgcagttcaccatgatccgtgtgccggcttgccacggtccgctctctccacaatgatcgctgcattatcctcacaattaagccatcattatcctcatcaacctcaacaaccgtctctcgctgtcattaattcgcatcagttacataaacaacagcagcaacaccagcaatcgtcgtcaatgacgagaatgacgacggcggtgacacagccaacctgttcttccccctccattgcttcttccactctcttccgacaacaagcacaacaacaacaacaacagcatcatcagcagcagcaacatggaattcctccgcttcaaggccaacaacaacatgttgttaacccgcaaatattgtcgtcacaacggaataatgctgaacagcaacaacaacagcagcagccggatttgttgcttagtcatctggtgaatatgcaaacagttgaacagcttcgactgcttggtgaacgttttgggcttaactggagcaatggcggaaaacagcgcaaatgagaaaggaagctggacaaaagccataattgtaagcactgaatgaattcaaatgactttttatatttgtattgtttatttatttattttttttcatataaaaatattcaggtcgaacaaactctttttttctttgtatttgacacagcgtccggaaactga

SEQ ID NO: 75863 - DNA, 338 bp, Heterodera glycines
  Genomic contig location: Contig_ID=SeqID_12273; Location=385..722; Strand=+
  SCN-specific regions: Sequence locations=1-101,123-338
gcacattctttatctatgcgggtgttactgctgttgcatttgctatattttattttgtggttcccgaaacaaaaggattaaatctcgatgaagtgaatttctatttaatttttctttaaaaacttttttttaagatcattttataatttcttatatgtagggctaggaatttaagtcaaatgacttttttttgctgatttataaatggccttagaatgacttaaaaagggttttctacgctttgtttgaaacttctaacgtgcatttttatttgacttttttttactttagggtttttatgaaaaatttgaatttttgcaaaaaaaaaatgccgaaaa

SEQ ID NO: 75864 - DNA, 644 bp, Heterodera glycines
  Genomic contig location: Contig_ID=SeqID_12274; Location=158..801; Strand=-
  SCN-specific regions: Sequence locations=1-202,242-332,354-505,529 -598,635-644
atgatcagcaattttggctgctttttcctccagtttttgccaaactttggcctgttctcctccggttggatcgttttctttgttggcgttgatcgactgatttctgtccttctcccattaaggtaatgtacgagaaaaaccctgccgatatttagagattattttagtggaattttacgaatttaatcatagaatatttcactaaaataattgttttaaaaatataaatctataaataaatctttggacttcagaaagctgcaaaatggccactttttgtataccccgactggtaaataaagctcatttttgaaaatttaaaatttcattcgttttttaaatatttaattttaggccagttttatgcacaaattctgacatgttcagttttggcatgaccacaatgctcctgagaaatggtctggtcattaatgggatgtcaatcatttgttatttgtttgttggactgtcactgttttggtcatggcaaaaaagttagttggactaaaatttaattatttttaatttcttccactatttctttctgtgccctgcctcggcctttcaaaggggctaaatattttacatgggaatacaattaaaaaacataaagctaaaattttcattaaaatatgacaaataaa

SEQ ID NO: 75865 - DNA, 255 bp, Heterodera glycines
  Genomic contig location: Contig_ID=SeqID_12274; Location=1159..1413; Strand=-
  SCN-specific regions: Sequence locations=1-50,106-255
atggcttttcaaaactactccatggttaatttggtgaggacaattgtttcataattttcattttaaaataatttttattttttcaatttaatattatatatttttggtatttaaggcattcaatcgtttcggtgttgacaccttttcaatggaattggttttgtcaaattcctgccgttggctcattacgcttcccggcttagtgttcaattctgcacttttgtacacaatcataagcgaaaagtaataaataaa

SEQ ID NO: 75866 - DNA, 772 bp, Heterodera glycines
  Genomic contig location: Contig_ID=SeqID_12274; Location=2273..3044; Strand=-
  SCN-specific regions: Sequence locations=1-108,141-308,378-743,765-772
atggttacgagttgtaaagccaggtcaaaattgttttataaccaacttcaagtaattattcttataaaggtggcttcgtctatatggacatcccacacaaagagcgggtaattaattttaatttttagttttttttttttgagaacggctattattcttgtgcttgggaattggcctttagttttggaaaggctattttctgcatctccaagtccactgataagtagggccctggcgggaacagaattcccgcgggaaaacccacgaatcccgttcccgtttcccgacaaaaaatttgggcaaatgacaaatttaattaaaaaaattaaattaatttaacttttcatattttccttttaattattaaaatttaattactagcaaaatttttcagcttcaaaattagttttaatccagcattctgttttaaccgttttccagacttttgatcagggccgaaatcgaaccgctttgtccgaactgctcgaacggcacagtcggccaacgaatggcaatgcaaatgcggcccatgcccatgtgtctttttggattacggaagatttgctggaactttgccgacattttaattggacagtggccgaatggcgggacattgacgacaaagtcggcaacggattcacaattgtgctcaaaaagacgacaagaggaagctgatccgataattggactatgcacatttttttgcccttcgccaatgaaagtatctgattcatttattgtaataaaaattctaaaaattgtttagaataaa

SEQ ID NO: 75867 - DNA, 291 bp, Heterodera glycines
  Genomic contig location: Contig_ID=SeqID_12274; Location=3072..3362; Strand=+
  SCN-specific regions: Sequence locations=1-184,206-219,263-291
atgtgttccaacagatgcgcgctgatcacaaaatcgacagaatcatttgcaaatggtaatttgtcacccggggctattatgtgaacttttgcaggatttccttaaaataattgtcatacataaatgttttttactaattaaaatttctatggggttgaattgatgaacaaatattgtccggtcataactgttttgtttttcttaactattttatttgccataaatataatattttctttaaaataaataaaattaaaaatatcaggcggaaaagatacttttgaaaaataa

SEQ ID NO: 75868 - DNA, 2992 bp, Heterodera glycines
  Genomic contig location: Contig_ID=SeqID_12278; Location=277..3268; Strand=+
  SCN-specific regions: Sequence locations=1-13,40-369,414-431,453 -544,566-612,652-659,681-830,853-864,915-1001,1035-1419,1441 -1501,1540-1681,1709-1757,1835-1957,2011-2234,2309-2348,2370 -2428,2453-2546,2568-2744,2788-2992
  Gene Ontology: Mol. function=ATP binding; Cellular component=integral to membrane; Biological process=glucose transport
aaataaaagtccgaaaattttatttttatttgttttcgtgctgcgcattttattgtcaataacaacattttactacaacatacaatacaatgtttgaatgatgtgaatgaatgcaaaaatcatttaatggagacttatcaaactcatgaattttcgtagaaaattcctcaaaatttggccaccattttttttatcaaatttttactttccccacctcgtgagctttagggaacagcagattgaagtgataaaaatttaattttggtcaaattggactttacatgctcatcaaattttttatttgtcacttaattaatggcttaattttattttttaattcttttctctttagttttacataatttgatgtaaataaatgtttatttattctttttaaataattaaataaaaaagaatgtttttttttgttcaaaaaatggccaaaaatttttgtccttcaaaaatcgtaccattttgttttgttttttattctttacgcagcattttcctggtgataacaacaattaggaatgttaattccaggaaatttcacaataattatattttatcacataaaattaatttcattggccttcatttagaaattcattgaaaaaaaaattttgtataaaaaatatttgtaaaaaattaggcaccaaacattttgccaatcaaaatttaatgcctttttaggcatcggaatgcctttttcatatttatataaataaggcgattaattggcgggtttattcacattgcaatgaatgaaaatgataagaaatcaaaaatcataatagctttaacaaatacattttattgctttattccatataaataacttgtgcatttttcgcatttttcatcaaattaaaatgaatttttaatcatttaaatttaaatttctaattaaataactttgagctcaacgccaaattaaatgattccaaaatgtccatccacaccttcttcaatttcaacgtcacagaatgggcacgcatttcaaaataaagtaattattaaattaaattaatttaccgtattccttaaaatagtgcgagccctcgggggatttatttcagggagagagggaggctctaatttaaggagtgaggggggcttattttttttcaatccccctcaacaacaagggaggggggggggctttattttaagggggggggggctctaattattagggagggggctctattttgcaacccccttcaaaaggggggctttatttcagaagggctttaatttagggggggggctgtattttaggaaatacggaaatttataattttatttttgcaggatggccgactcaccggcattttggcattttctgtttttatggcggctttcggcagttcattccaaatgggctatcacattggctgcatcaatattccaggctcggattttattgcattttatgatgcattgacaaattaagaccattttgaaatttttgtttttgtttttttttaacattgtccggaaatatttaatcaaaattttatttttttttaaattttagtgaaaaaccgggaatttttcacccatttctacaatattttttaaattttccagccgacttaatcaaagaatggttcactgaatcgtacaagcacatgaaaggggttccgatatcagtggaagagatggaatcgacatggtgaaatttttattatttatttaatattttccagaaaattatttggcgctaaaatttctgtttgggggttttccacttgaaattttttgattatttaaatattttttatttccaactctattatatatatttttttgaattttaaattttttttaaccaattttttttcgaatttctgaatagggtatatcaattgcccagggcatttgccgtcggcatttttgccgttggcggaatgtttgtggcataaattttttaatgaactgtactaattctttgaaaaattatcattattattcaataaattcatttcattaatttattaattaattgcccagggcatttgcggtcggcatttttgccattggcggaatgtttggtggcattatggttggcactgttgcggacagattagggcgccgtaaatcacttctgtacaacaatatattggcgataattgctgcggcactgatgacactggcaaaatatatgaatgtttattatttgatcatcattggacgattcattattggactgaatgttggtaagtcaagcgaatattaattaattttttaataatttaaaaactgaaatttaaaacaatattaaatgaatttttatgaaatttttgtccaattttttgtccgcttttggtcatacataatacgcttaaacataatttaaaaaacaatcttaatataaataattgatagctcttgatttgctatactagcatgaaaaatttcaggaaatttcattcatttttcagaaagtcgaaaccaaaaatgttgataaaattgacataactttttgaaaaattgaataaaattttatgaaattttcaggttagtagagcaaacgaaaagctatcatatgataccaaaattatttaagaaaagttatgagaactttttcgcaaaatctgtaaaaattggcacttttacaaaatgccacgtgtgcctaaatttttaaaattaactctccaaaaaataaataaaagactgaacaaatgcatgcttttacttcgattctgtatttgtattaatttgtttcaatcggatctaacttttttaaatttagattttaattataattaaatcattaaatttcgttttaaaatttgaagggctcaacagcggactgtccccaatgtatttgattgaaatttcaccaaacaatttgcgtggctccatcggctcgcttcatcaactgtttattacaatttcaattctggcttcacaaattattgggcttccccaaatttttggcaccacaaatcggtggccactgatttttgcatttactctggtaaat

SEQ ID NO: 75869 - DNA, 941 bp, Heterodera glycines
  Genomic contig location: Contig_ID=SeqID_12279; Location=1036..1976; Strand=+
  SCN-specific regions: Sequence locations=1-155,177-865,890-941
atgagaaatgaaaaaaatgcaaaaatgggcccatcaccggggaaaatatcacagaattgggaaaagcacagcatagagggacagaaccaggagaaaatggaccagaaatatcacataaaatgggcacgcaatttaccgggaccggggcaattttcacaaaagaaatggaaaatgaagggccgatcacagatcactgatcacatttgggggaagggatcggggcaagagagctcccagaaattggggaaatacatttgatcggatgggaacaggggcggagtaataacggtggacgaaacaaagaacccgagcctcggtatcgctatacttccttttcttttggggagcggtttcgtccatgaaacaaggcgccagccagcatcaatcaccttctgatcacatattgtcaatgaagcaccaaatagtgggatgagtacaattcattgccgcagttgtcgattcgatcggcattgtccaagatgcgctgatgaacattctattcgttagggtcgatgtgaggcaacgtcagtgcattattgaaactattgagccacggtctttctcatatatttttttttataagcatttttaaagaactatttatttacaatagacacataaaattactcacttattgtctcggagtggaagcatgtgaatggggtcaaatcaaaagaattacaaaaccctaacaaaaactatgtttcaacactaaaacgaaaactcgactttttgcatgactaaatagcgcgtattcgattgaatcttgcaatgacgtctgtcgggtggcaaatgtgtttgaagatgtttcaatttccttgaacatatttttttttacaaaagcatccaatatttttctattgttatatgtaggctcatcatattttgacgaataatttgattaaattcattgaatttatattattttgtactatggaaaa

SEQ ID NO: 75870 - DNA, 776 bp, Heterodera glycines
  Genomic contig location: Contig_ID=SeqID_12279; Location=2057..2832; Strand=-
  SCN-specific regions: Sequence locations=1-110,132-205,228-649,671 -698,720-776
atgaagagagaaaactactgggaatttaagccggaaagtgagaacttttatgcactggggcgacaaatcccgagggctgccgacacaattgaaggggctttagaactttcgaatctggggaagcaatccttcaaccgaaccaggccagcaagcacaagttgtgcatacgcgtcatttacgacgcgagtgctcacaccagagggacaaacagtctcttgcctggttgtatagaggcccgataataatttgtcgataacactctactttagtgtgaatccgcagaagaggctttacataaatatgccgagtctaaagtcatcctttaagaacggcgttttaattcgagggaatttgttaaaatccccggaggtaatgatggcgatccttgaggaggatcgcttaaaaaaagcgaaagatagtacgccaaagtgagataaatttaaaaaaacaaatattgtagattttctaggcttttctttaaatcgtgaaggttgaccctactgtaacaaggttaattattttggaacaatgctaatgaatcggtttggtgccgaattcctcgtctagcatcttaaattggcatgcttgctatctgttgatattaagaaggtatgaacaattttcgcacttaaacgactttacatttttgtataaacataaaaattactatcttcatactttatcaaagttttcttaacattttgtttttcaaatttactttattatcaataatttcttcatttttggcatttatttctccgataatgataaataaa

SEQ ID NO: 75871 - DNA, 335 bp, Heterodera glycines
  Genomic contig location: Contig_ID=SeqID_12279; Location=2865..3199; Strand=+
  SCN-specific regions: Sequence locations=1-302,331-335
atggcttgccatttttctggaaaatgtctaggcatcaccattgatgcaatggaatgcgtaagagcttactcattgctcttacgctttaggaaaatgcaatatatcccttagggttgcgttttatccaagcgctacggccccgcttttttttttgttgtattatccaattaaatttccgtatcgtcatctaaaatttcggcaatcggagttttgactgccaaaaaaaattcggcaataagaaataagaacacaaaaatgtctgtaattggcataccgatacatccctatttaattcattgacaatatatttaattttttagaattctaaaaattaa

SEQ ID NO: 75872 - DNA, 1257 bp, Heterodera glycines
  misc_feature (1225)..(1225): n is a, c, g, or t
  Genomic contig location: Contig_ID=SeqID_12279; Location=3397..4653; Strand=+
  SCN-specific regions: Sequence locations=1-4,30-228,252-469,491 -493,516-532,554-621,691-840,910-915,937-945,968-1043,1065-1081,1119 -1257
atgctaaaaattaattttataataattttcttcttatttctattcgtaataattgatggaactgatgaagatttaattgatgatttatggaaaaacctaaaatcaccgaccccaaaaaacttcaaaaatcaaaaattcggagaaaataataccataaagcaagaaattgttgaaaaaaacgatgaacaagaaaatgccaataaaatcgaaatggaagacataaagccaataaaaataaaagaacccaaaattgaattaggacaattgaacgaagaatcatttggaaatcaatttgatcagcaggctgatcagaatgtttcgtttgcggatctgagcaattctgcaaatgataaggattacaataatatggtaatataacagataaaacagcattattcctgaaaaaaatattttacaaatacactaaattcttagattttttttcttaaaagtgaattatttctttagaatacagaagaaataaatgaaatggaaattttaaataaatttaatttgatgaaaaaggaattgcgaaaagaaaatgcttataaaaatttgacaaatgttcaatttgagtgcgaaattgcgaaaaagttgggcacaaatcgaaacaaaatttatgaaatgaaaaaaaaattaggacaaaaaagagagaagagaacagaggaaaatgaagaaacaaaaaggaaactgatcagaaaatttgatcaattgagaaaagaaaaaatttgtgggtataaatatgacaggttgaaaagaaataaaattgagcacgaaattgccaatgaattgggagttacattcaataaattttaccaatggaagagggaattaggtaagaaaatattaacaaaataaaatttataattattgtatcaatttaaggtataataaagaaatttttatttacaaacgaagaaaaaatagaaaaacttgagcaatttgaaagaataaaagaagaattttcaaaaaaattcaatttcaaacccaatagaaaaattgaatcaaaaatagctgaaaaaattgggattgtgtggaacacaatttataaatggaagagaaaattcggtttaatcactcgtaatattttaattattaaataaaaaataaattaatttgcttttcttttaaggagaaagaaaaatttattccgttaatgaaaaattggaatatgtgaaaaaaagtgaggaaatggctgaaagaaatttaacgatatgtgagaaanaaaattgccgaaactttgggcattccaaatga

SEQ ID NO: 75873 - DNA, 1044 bp, Heterodera glycines
  Genomic contig location: Contig_ID=SeqID_12280; Location=220..1263; Strand=+
  SCN-specific regions: Sequence locations=1-164,186-259,281-348,370 -431,454-487,509-1044
atggccaactgtgcattggactgtaccgtctgcatgaccaggcttcgttggaatccaataaacgctatgtgagttaagcgagcacaaaattttcagcgatttttggaaaaaattttttttatactatttcctttttgatataatgtcccaacacaaactgatccggggtgggggaaacgagttgctcacacacagcaggaatatcataactgtcaattaaaatcattttaaaaccacttttatcatgtagagcatggtcgatttaatattgccaactttgggctttttttgctccggcgccaaaaatgatcagaaaaaatcgatcaaaatttcgaaaaaagggttattttttaaattcataaaaaatttccagactcatgctggagccctaagctttttttaaaagttcagcgaaatttctttacaaaataatatgataaaatcaaataaaataactaagtcaagtagactcacgagtaggatcattacaaattttgttttctttctagttgagtaaatttttgcaggtgatcaccaatccgccagcggagcttcgcctactaagcagtgacaatgtcggcaattattcaatttatcgcaaaaaaaaaatcataccaaccaaatcagaccgacatttccatatatatatggtattatatattcaggtgtatgtgctggagcagttcgactttggctactcaaaattcgacacatttggcagtgaagcggggggcgctgggggtggcacaagcattggctccgatcgtttgttcgcgtaattgtcgaacaaagtggtagaatgcatttgggatatatgtgcttttcccagtcagttccctgactctatggaatttcccgctcttttcgtatcgcgcgttctcggtttcccgtacatctctcgaattcatccgggctgttagtgatctgaaaattttcaacactcgagaaccgggatcgagaattgactcacaaggagtcgagactgaaagcagaaaaccctgggaatttttgactcaagaaccgagactctcggacatcccatag

SEQ ID NO: 75874 - DNA, 558 bp, Heterodera glycines
  Genomic contig location: Contig_ID=SeqID_12280; Location=918..1475; Strand=-
  SCN-specific regions: Sequence locations=1-125,151-558
atgagttttaaaatcaggtaagaacaaattttgttgcttaaaatgtgtgaaatttaaaaaagaaatttttttgcataactgaatattaatttaaaacataaattcgcggtttggttgagcccaacatcaatcaattgatcaatcaatcaaaaaaaatgaaacaggcacgccaaaagtaaacagtaacaaaacaatcgaaatgtggtgaaatgctatgggatgtccgagagtctcggttcttgagtcaaaaattcccagggttttctgctttcagtctcgactccttgtgagtcaattctcgatcccggttctcgagtgttgaaaattttcagatcactaacagcccggatgaattcgagagatgtacgggaaaccgagaacgcgcgatacgaaaagagcgggaaattccatagagtcagggaactgactgggaaaagcacatatatcccaaatgcattctaccactttgttcgacaattacgcgaacaaacgatcggagccaatgcttgtgccacccccagcgccccccgcttcactgccaaatgtgtcgaattttga

SEQ ID NO: 75875 - DNA, 891 bp, Heterodera glycines
  Genomic contig location: Contig_ID=SeqID_12282; Location=43..933; Strand=+
  SCN-specific regions: Sequence locations=1-268,290-546,568-832,854-891
atgtgcatttccgctatttgcattaaaattgtaaaacacaatctaaaagtgggtatttttcagtatttgtattacaattgtaagaaactaaaaatgtgtatttttcggtatttgtattacaattgtaaaacacaaactaaaaatatgcattttcaggtatttgcattaaaattgtaaaacacaaactaaaattgtgcatttttcagtatttgtattacaattgtaagaaactaaaaatgtgcatttttcagtatttgtattacaattgtaagaaactaaaaatatgcattttcaggtatttgcattaaaattgtaaaacacaaactaaaattgtgtatttttcagtatttgtattacaattgtaagaaactaaaaatgtgtattttccggtatttgcattaaaattgtaaaacacaaactaaaagtgggtatttttcagtatttgtattacaattgtaagaaactaaaaatgtgtatttttcggtatttgtattacaattgtaagaaactaaaaatgtgtatttttcggtatttgtattataattgtaaaacacaaactaaaaatgtgcattttccgctatttgcattaaaattgtaaaacacaaactaaaagtgggtatttttcagtatttgtattacaattgtaagaaactaaaaatgtgtatttttcggtatttgtattacaattgtaaaacacaaactaaaaatatgcattttcaggtatttgcattaaaattgtaaaacacaaactaaaattgtgcatttttcagtatttgtattacaattgtaagaaactaaaaatgtgcatttttcagtatttgtattacaattgtaagaaactaaaaatatgcattttcaggtatttgcattaaaattgtaaaacaagactaa

SEQ ID NO: 75876 - DNA, 1263 bp, Heterodera glycines
  Genomic contig location: Contig_ID=SeqID_12283; Location=158..1420; Strand=+
  SCN-specific regions: Sequence locations=1-297,319-1034,1057 -1178,1204-1263
atgcttaacccgcatcctgatgagctcaaacagctgattgtggggaataagcaatcccgtgaagggaaagaatttgtgcgacacatgtcgcgttataacaacctgttccaatttgcgagcgtttctgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggaaaaaatcacaaacgaagatgagtttgtgcagggtcaccagctaaatgagcagactcttgagatcttagaacaaatgatccaagtgcatcatcctgctgcgcaggcatataagcaggcgcgtgagcagctcactgagcttctccaacaacaaaatcaggaagagcttcgtttcttccgcatgactttgttggatagccgcagggctccagctggtcttaaagacccaaaattgcacccacaccaaataatcaccccatctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgctcagaatgcatctggcctatttgactcggaagccgagtcagataatgagtcgtgcgagactcagtcaattgcatcatctgatgcggggtcagtcgcagattcagatgctgaatctgtagcatctgtttcatcgcagcaccggcggattgacaaatccaaacaatttatctccctgcgagattattgcaagtattatctcgcaataagggatgaaaatgtggagttgcaataccaccacattctttcatgtggtggaggacttggtcagcgctggatccttgaccaggctgcaaaaattgattggcaaatagcaacatttttgcgtagacctgacatggatctgcggatcagcactccaaaaaatctgctgcagtatttggtcaaccaatacaacaggcagcaagcacggcaaaaccccaatgcccaacagaaaactgttgatgacattggcagtgttgttcggctttccgaacacaac

SEQ ID NO: 75877 - DNA, 82 bp, Heterodera glycines
  Genomic contig location: Contig_ID=SeqID_12284; Location=1036..1117; Strand=-
  SCN-specific regions: Sequence locations=1-59,81-82
taaaaaattattaggggtttttagtccacatcgaggctcaagacgggcgcttcgcgcccgcttttcaaattttgttggcctt

SEQ ID NO: 75878 - DNA, 2278 bp, Heterodera glycines
  Genomic contig location: Contig_ID=SeqID_12286; Location=442..2719; Strand=+
  SCN-specific regions: Sequence locations=1-197,219-226,260-412,434 -686,708-1169,1191-1424,1452-1453,1486-1738,1764-1791,1864-1964,1992 -2119,2150-2278
atgatagggcgatcagtcgctgaatttggtgcagacgcacacagcggacagctgagaagggtcggaggtcggttgccgatcagtagcgacagctccgcagccaacacccaagtgatcgtcactccatcaagcaggtcagccaaaggtatccccctaaagttgctcgagagtctcgagcatagtgaagtgagtaaaattcatttattttttatgtttttgccttaactgattgaaaattaataaaaataaaagttcattaaggccttcttcacgacaggaaaacaaattgaaaatgaatcataagaatcagaaccgaagtgagggggacgacttggaattctgtggccacagaaagggcgagcggcagggcagcatgaccaattcaatcgcttctctgtcaatgtcgcccacagcaaagcgcaaattctcctccaaagccttcggccttaaagtgattaacaattcggattaataaaccaattagggaaatattccgtcgtcccctttttattctcctgccttttttggtccatcatttaccaaatttcgtccataaattccctccccctttcactcatttcgtcccattaattttcatcttggactctctctccgttaaagagtccgctgaaggcactccgttccgccgttctgtccaaaaagtcaaccgcctcggcgggcagcggcatttccacggaggagcctttgtcggcactgccaaaccatattcagcagttccaccagtcgtctcccactttgccatcctcggcaccagcccaataccggcgaaagatcagttttctagacaccgccgaagagggaggcgcactggcggaggaagaggagaacagacggtcccctgttgatcagaatgccaaagtgccgcccgacaaatgaccgaccgaccgatcagttggaatgccattgatgcttttcatttcactgtcaaagcataatgatttatttgctgtttaaattgttgttttgctctatctgtttgctttatcatccttttgataacattttattcgctgtacttttccagaattttaccgggaaattggtcctttgattttgcaaattatcttttcggctttattatttatttactttcaacggttcagagtccgtgcaaaacgattcgggtcaaaaacaaattgactttacccgcccctcccccattttttgttaattttgctaaatgagtgtagcaccttttaacggccatccctttttgtcgcttacaattaattaccttttgacacctgcacaacaaaacaagtttcgtttcactaattgaacaatcgatgcttttcgtggattcagctaaaatggattcttctatttaattatgggtcgtttcttcaaatctcccaaaataaatttgcaatggtgtgggcttttcgcgcactttttttcgtaagttttattattattaaaaaaaataatatccttttgtgttatttttagcttttcatttttctcttagccgtgccatcgttcgcatttgcaaaggcactttttccgcttgggcttgatgtctgcggcaaaagtcgcgcgtgttggtccacgccgccggggtgcgactcggctgccaattgccaagcggtaaatgccgcgatttaagggccgaattatttgtccattaatagctcatcgtttccagttcagattgtgagatggcgttatgagaaaagcaaattgcgagttgaaatgcaggtcaatctctccccaaaactaattattattaattattaattaatcggcagtttctcctttcgcttaaaataattttttttcattttgcattcttattttttattattatatttttattttaataaattcttttttgtttctattcgctttttactaaaggccaaaggcattggttctttgggtgcggcagcgcctgtcgccgcccaatggatggcacttggattcagtgacgacgcgcacatggcaaatattaattaaattattaattaattcattacacttttaagggaaatgatactgttttttcgtgtctttttggcaccgaaggtggcaatcgcgccgaaatttcgtacaatcaatggactgataatattccgttggtcgaagtgagtgaatttggaaaattaatatttataaatttaaataaattggcaatttattttaggcatcaaaacaaatgattagcgaacagacattttcaacgggaaaagaaacgaacggatgcgcaattagcataaattatgcttataaactcacatcaaaagatgagcagaaaatg

SEQ ID NO: 75879 - DNA, 415 bp, Heterodera glycines
  Genomic contig location: Contig_ID=SeqID_12288; Location=1165..1579; Strand=+
  SCN-specific regions: Sequence locations=1-79,103-415
atgtccgctaattgttatatgggcagccgtgtgctgatcagtgtttccatcggcgggacggcactgatcacttttgttacactgatcacactggtcacactgtgccgggacatcaactcgctgtacgacgagatcatttctgatcttgacgagttcaaggacattgccaaccatgcatggaaaacgatgatggacgaacgattagtgaagggcggcgtcgctgaacagtttgggagcggtgacgcggagttcgttcggcgtcagccgcgtcagtcgtacgcggacggagacgctgccgcaactgccactggcggcagtgcggcacgagtgagcagtgcgagtgccggtatttgcaaatgtgccagacagccgaacaactgccctaaaggaccgcaggggcccaagggacagccgg

SEQ ID NO: 75880 - DNA, 1472 bp, Heterodera glycines
  Genomic contig location: Contig_ID=SeqID_12289; Location=182..1653; Strand=+
  SCN-specific regions: Sequence locations=1-349,385-432,454-532,568 -626,648-652,675-732,824-976,1000-1329,1365-1472
ctcctcacccggccctccggggtcccaagacccgccgggccctccgggtctgttggccaacccggccacagagggcagcccgggaaggctggccaagcgggacccccctgggccggatgccgcctactgtccgtgcccaccgcgcaccggcgaagtggcgggcaagcagcaacaatccgccggtgccggtggataccgtcgcttcttccgcgcattccattcacgtcattgagaaatgggcgcttgtgccacaatttgatcaaataaatgtccgtccattaattttgcatttgtttcactaaaaattgtgataaaatggaaacaaatttttagtgattagtagggcatcaaaaaaaaaattaattaaataaaaattaaaaaattggatttatttttatcactaatcaataaaacatattatgtaattccattttccaccatatattttttgcatcatttgtatgaataaaacatattctcattcatattcgccaaatcaatgtaataaaatgaatatttctcaaatccaatgaaattaataataataatttttattattatataattgaaattccattattttagattatcgaaggtattttatttacaatatattcttgtatcataaaaaatgcaattgctaaatatgaaattatgtgctttttacataattattttctttttaaaaaatgaaaaagtccgcacaaaaactactgaagaaaaagttttcggtataaataataaaataatttaaaatatttttaaacattatttaattaacaaaaatttttacattttttgtatagtaataacaaatttaaatgtttgaaggaatccgtccaagcaatcttgaacaccattatgagcaacttctgttcaatgccgaactgagttcttcggaccgggaattgttggcccgtcggatcattgccgttcatttccatttgtcaattatggccaaattagcgctgcccaacgagtccagcagcagcagcagttcaaaaatgaaaaacaaaaaaagtcgaaaacccgaaaaatcggacggtggccctgttgattatgcacatgcatatcaaactatcagacaaacaattgagctcgtaagtgccaaagattttgtgccaatggaacacctatgccatttgtggcagttggaacgtttgtttaatcgccgatcggacaccgaagacaaggccagagacgaactgataaagtacattaattatcaccaagaagcactcgcttcgaaaaggctcaggcactgaatgccccggggggtcgggcatattgagcgtgctttcgtcttcccgtcaaacccgaaaatgagtgttttttaataaaacaaaaaataaacataatttttagagcctgtaattttgtaaaagtcgtgctcctgattggggaatcaggccaggataggattacggggattaaaacaccggttttaacgggatttataccacgacatcggg

SEQ ID NO: 75881 - DNA, 138 bp, Heterodera glycines
  Genomic contig location: Contig_ID=SeqID_1771; Location=509..646; Strand=+
  SCN-specific regions: Sequence locations=1-41,64-138
gtaattttacgcgctatttcaaaaattacacaggtaaatggcttttttgtatggtttatttcgagcctccataactcgcctgcatttccaactaatccgaacattttgttatctaaaaaaagattttgaaaaggagaa

SEQ ID NO: 75882 - DNA, 453 bp, Heterodera glycines
  Genomic contig location: Contig_ID=SeqID_1774; Location=2504..2956; Strand=+
  SCN-specific regions: Sequence locations=1-16,57-76,99-195,222-453
  Gene Ontology: Mol. function=transcriptional repressor activity; Biological process=negative regulation of transcription
atgcaaaacagtcaagagcagcaacaacggcatcagcagcagcagcagcagcaacactcccaaaaagagcaaccaaaacagcagcagcaaaaacaacagcggaaacgcaagtgcgaggacggggaggagcactcggcacgggcggactccgttgccaccaccaacaaaatcgttgccgttgagcaaccgacgaaacccgtcgctgccgctgctgctgttgccgtcccttcgacaagaacaactcggtccagcaaccgaattgccaagcagtacacgcagaacaccagtaaaaccagtcaatctcctcaccaacagtccgcgaactcgaccgattgtcaatacgacaatttccaccatcagcagagggggggaggaggaacacaaaggagaagcggtggaaagagtcagcagcaggtgaaaggggaaaggaagagttgggacggcaaaaagtga

SEQ ID NO: 75883 - DNA, 260 bp, Heterodera glycines
  Genomic contig location: Contig_ID=SeqID_12290; Location=759..1018; Strand=+
  SCN-specific regions: Sequence locations=1-260
caattataaatatggacacaaccatggaacaaccggctgaagatgttgaggacgtacagttggatttggggaagaaaaagaagaagaaaaaggcgaagaccacagaactcaaattgtcagaagatgagcatgaggaggaaaaggtggcgaaaagccgttaaatattgaaagtgatagtgaaatccaaattttaggaagtcactgcactcgccgaaggcgttggccgtacaaatttgctcgacgcaaaaaacccccgacgc

SEQ ID NO: 75884 - DNA, 243 bp, Heterodera glycines
  Genomic contig location: Contig_ID=SeqID_12292; Location=372..614; Strand=+
  SCN-specific regions: Sequence locations=1-124,146-243
atggtcttctcccacgacgaatggtttgtccaatgtgtgcccgccctgtgcgaacagcttgacaaacttttgctcctgtcccaacaccagcgggaagaggaaggaaactcatgcctccaacaacgacggaatacggacgacgacggggagtgtcatgtgcgacgggtgctgcgccatttgctcgcgttgaccacccgaattccgatgcggacacggcccaggactgaaatgggacttttcatt

SEQ ID NO: 75885 - DNA, 865 bp, Heterodera glycines
  Genomic contig location: Contig_ID=SeqID_12293; Location=147..1011; Strand=-
  SCN-specific regions: Sequence locations=1-457,527-865
atggccaatcgaaatgcgtcggcagtttcaaaaatgctctgctgcaaaagctgggcaaattcgctcagctctccgctcattgtcaaggcaactttcgaatcgtcgattaattgtaacgcattaaccgcacattctgtggccgcgtcgtgcaaatgctgcgaagtgttgggttggctgagcacggaaagaaccgaacggaagaaaggggaacgagtgagctgaaaagagaaggaaatgccattcggagggggggagaggcgaaccacggcaacaggacaacgggggttcagcagccaagaagccaagcagtcgacggcctttattgaaaatgctaaaggagaaaaaaaaagaaaccttcgttcgaaatccattttcttcagacaaagaagtatccaaagagcacaaatgaaactaaataaattgtaaaaaacaactgacaaatttaaaaaaatgtaatcgctcctgggtggattcgaaccaccaacctttcggttaacagccgaacgcgctaaccgattgcgccacaagagcaacgatgaaacgtttttgtaaagtcgtaaaatgattaccaatttagagagcagtgtttccatatgcctcgccaattcttcttcgatttcagttcgtctgttttcgccaattttaagtttatgactgtataattcttcggggagtgctttaaacagtgcgacaagaacagtggagtttgaagatgaagtgggggaatcgaattggacgagtatttgagcgacgaggcctttccagtggaccacatggatgtacaagtcacagagggcggcactgagctgagtgataattgctgttgagtttcggcctaagccagcctcgatggagctaaaataaa

SEQ ID NO: 75886 - DNA, 1388 bp, Heterodera glycines
  Genomic contig location: Contig_ID=SeqID_12293; Location=157..1544; Strand=+
  SCN-specific regions: Sequence locations=1-329,399-901,923-1388
  Gene Ontology: Mol. function=nuclear localization sequence binding; Cellular component=cytoplasm; Biological process=embryogenesis and morphogenesis
ctccatcgaggctggcttaggccgaaactcaacagcaattatcactcagctcagtgccgccctctgtgacttgtacatccatgtggtccactggaaaggcctcgtcgctcaaatactcgtccaattcgattcccccacttcatcttcaaactccactgttcttgtcgcactgtttaaagcactccccgaagaattatacagtcataaacttaaaattggcgaaaacagacgaactgaaatcgaagaagaattggcgaggcatatggaaacactgctctctaaattggtaatcattttacgactttacaaaaacgtttcatcgttgctcttgtggcgcaatcggttagcgcgttcggctgttaaccgaaaggttggtggttcgaatccacccaggagcgattacatttttttaaatttgtcagttgttttttacaatttatttagtttcatttgtgctctttggatacttctttgtctgaagaaaatggatttcgaacgaaggtttctttttttttctcctttagcattttcaataaaggccgtcgactgcttggcttcttggctgctgaacccccgttgtcctgttgccgtggttcgcctctccccccctccgaatggcatttccttctcttttcagctcactcgttcccctttcttccgttcggttctttccgtgctcagccaacccaacacttcgcagcatttgcacgacgcggccacagaatgtgcggttaatgcgttacaattaatcgacgattcgaaagttgccttgacaatgagcggagagctgagcgaatttgcccagcttttgcagcagagcatttttgaaactgccgacgcatttcgattggccatgcgggaagaagactcagaaaagtgtgtcaattatgcgatttaattatttgtttttctgattcaggctacaaaatttcactcgcctttacgctgaacagtccaacgcatttctttctgcgatggccaataatccccgcaagggatttggcgatttgcgaatgttggatatgcttttgatggccaacgattaccatgattacacggtgattagagggcaatgggatggcgtgataaacagcgcattgcttttttcagctgtgtgaaatgagtttcaatgtgtggtaccaattgtccgaacatttgtatcagtgcaacgaagccgagttcgatgaactccaaggcattttcacgccatatgtggaaaagtacccctattttcttcatttatcccacggctgcctttctttcctttcagacatattctttcgctctgcaaacattgtcgggtggagcccgattcccaagatttgcttgacaaaaattcggaacatgccgattttcggtcaaaggcacaagaaagtgttaaggacgtg

SEQ ID NO: 75887 - DNA, 744 bp, Heterodera glycines
  Genomic contig location: Contig_ID=SeqID_12297; Location=512..1255; Strand=+
  SCN-specific regions: Sequence locations=1-135,156-265,288-712,734-744
atgtcccccctccgtttcttcgtcgccctttttctgatcactttggcaattttggccgggacccacggcactgttgagaactcagtggatggtgggccaaacatggcatcgccgattatccgtgaacgccgtaagttttattttattttattttaattgttgaatttaattaaaggttggggccatggcggcggaggccattggggctgaagaaaatggtggaagagataatggaaaatggagaacggaagaagcgataaacgatgaaaaacaagaaaaaataatttgtggtagaagaaaaaatgctgaactcttgttcgaataaagtttaaaagaatttcttattttttactcaaaatcgtcaaaaaatttgggctttgacgcaatttaaaatttaaatagtatttaagtcgctgatttctaataaatatgtaaaaaattcgataatgtaaaatatttttatcaccgatcatcaatcattaattatgatcatggttttagccaaatcgttgttgttggtgctgatcatgctgtaaaatcatggccacaagctccgcttcgtcaattccgctgatggcaatgcgcgcagcggccggtccgttgacgaaccgtcgcggcaattgcactcgcgcaccagcagcagccgaattgcgccggtgccgacgcccattggcaacaaatttgaagacgcgacgctttccctgaaaactgaaaaaattttaattttggttttgaatttttaga

SEQ ID NO: 75888 - DNA, 1709 bp, Heterodera glycines
  Genomic contig location: Contig_ID=SeqID_12298; Location=333..2041; Strand=-
  SCN-specific regions: Sequence locations=1-123,206-257,298-352,415 -536,559-567,589-974,1117-1428,1467-1502,1526-1665,1689-1709
atgttcgcctccgtgttcatgattttgttggccacttctgaacgtctgctacaaacattttcgggccgtaaaattgtcaaaacacgaaggtcagtcagtggctggcagaatctcgcgaatttgataaaattatttaattaatattaaaaaataattaaaaaggaaaaaatatgaattatctattttgaaaattaaactaaaattacaaatttctctgttattcatcagcagtagggacggacgcaaattttgtggttattttaaaataccaaaatgttattttaaaccttattaggattttttttatgtctttttgtccaatatttcacgtttttccaagaatttttagtccaaaaaaacatatttatttaaaaaaatcttatttacatattttggatatatatatataatattggagttttatattacatactttgtaacatttccggattttttaccgtattttaagtatatattttttgcgatttttcaataaaatttgcgtctctattcatcagtcgagcaaatcactaacaaaaaccagttgaaataaaaattataactaagaaaatctatggccataaattttcagaattttgcaaaggcatcggccacaagtgacccttctggtgatgtgcgtgtcatttgcctacaaaatgagcatttatttcgagattgaggtgatcgagattgccaactgtacagattttgaacggtgaatttattcggggaaaacaaattaataataaataaccaatgttatttttactatttctgaactaagtttacccattttagttggttttattttaaattttgggatttgaaattttttttagttttccaatgattcaaactttagaatacctataataaaatccacaggttcgaagtccgttcagcagtggaaggagaagaatggaaattctataggttttggtggatgttcgtcttcaggaatgtggtaggttaaatatgtatttttttaaatacaaattatatttaaattaaatatttatttataaaattcttaaatttttcaatttattattttatttatttattttttcatatttctttttaaattttcaatttatcatttttcaattttattttctcctctttgcttcacagattgatcacattgtgcccttctttttgctgatcatcctcaactttttcatcatccgtgcgctcaaccgcgagcacatccgtgccacccattcatttgccaccgctgccgcatccgcgtccgccctcacattgcgcggcagcagcgcatccagtgatgacggacgcgcgagtgccgccgcagcggcggcgacacggcgcgaaagtttgtgccaaaaaggcagtggtcgccgactgcaacggcacgcgctaaccttggcggaggacaacgcgcagaagaaaaatttgcgggtgaggaaatttaaaaaaaatcaattaaaaatttttttttattagaaaagtttccagaaaatttgaaaaattttcagcgattttttggaaaatttgaaaaaacttaataattgatcataaaattgtcaaaaagtttgatagaaaaatttgaaaaaaattttccttaaaatttagaaaaaaattttctgaggtttttctaaaattccgaattttgtacccagtgttcgggacgcattgaaaatttatatatatatatatatatatatttttaaactttttttattaaa

SEQ ID NO: 75889 - DNA, 858 bp, Heterodera glycines
  Genomic contig location: Contig_ID=SeqID_12299; Location=2196..3053; Strand=+
  SCN-specific regions: Sequence locations=1-101,148-232,254-596,624 -643,665-696,720-858
atgttcacattcatttgcttctttatgcttttgatttcgccaattatttcagcacaaaactccaaatgccaagtgagcaaaaaaactaacaaattatttggttaattaatataattaagatatttttatttttaatgaaaaattttagttggatttttagtggcaaaaaattaaattaggtaaaaaattgccaaaattgcgacacaatggaaaaacttttctgtacataaagtaaagcaacagaaaaataaatgattttattacttcaacaaatcgctttttaattaattaaagatgagtttattttttaatttatcttttgtttcagtgtcctaaaaatgagcagcccggccaactgaagtgcaccggatgtgagccgagttgtgacaatcggaaccccgacggcgcgattttgcaattgctcatgtgactgtgtgaaaggatatttgcgcaacaaacagggaaaatgcgtgccgaaagaacaatgcccgcacaaaaagaattgaaagtggggaaatgatggagaactgatggaacttcaattttccaagtaaaaaaaattcaacatttaagtttttggggggttcatttgtcgagatacatttctttgtttttcattttataatagctttttttgatattcattttgataaaaaagtttttgggtgttcgttttgcatttaagaatatataaaaagttcaaatttaattacaaatatgaattttgtttaattgatttgaatttgaaaaaaaatattgataaaagatttttttgtccagtaacatcaaaaatcagcaaaatccgttctttccagcaaaatagaaacccttaggaaaatccattttaaagctttcata

SEQ ID NO: 75890 - DNA, 1762 bp, Heterodera glycines
  Genomic contig location: Contig_ID=SeqID_12300; Location=384..2145; Strand=-
  SCN-specific regions: Sequence locations=1-77,103-133,189-298,325 -390,412-487,531-586,608-631,678-946,979-1154,1228-1464,1487 -1730,1753-1762
  Gene Ontology: Mol. function=transcription factor activity; Cellular component=nucleus; Biological process=transcription from Pol II promoter
gaaggacatccagccccagtgccgtgacactttcgtgcagtccatcgccgacccgtgcccacagcggcgggcactgtgctgtgtgctgtccaacccggaccaaaagggcaaaatgcgccgaattgactgtttgcggcaggcggacaaagtgtggcgcttggacctggtcatggtcatcctgttcaaggcaaacaaaatccttcgggaaaattgagaatggaaatgccaaggagaaaaaagccagaaatggggaaaaattggcaaaaaaaaacgaaaaaatcgggggcgaggggttaaattgggcaaagaaaatgggggaaaatccaaaaatgacggaatatttggcaactccccccccccccaaaaaaagaggattagatgagttaaatcaaaaataaaagggccggaaaatgagttaaaccccaaaaaaaggaagaaataatttggcataaacccccaaaaattgaggaaaatttttctccgagcgatttatacaaaattaaaaaaaaaaaattttttttgaatttttagggcattccattggagagcactgacggcgaacggctagaaaaatgcggcacatgcaatgtgagtgagaagagaggagggcattaaaattagaaaaatttgcaaaaaaaaaaatttttaatttaatttaattttttacaaaaatttttccgcagtttcccaccctttgcgtcaacccctaccacatcagcatcgccatccgcgagctggacctgtggttggccaactacattttcaccacggacccggacaagccggagacgcggcgcaggcccaggggtacgtcgcgtcggtcgcaaacacacacctccgaccgaattggaactcacaaattttttttggcatttttcaaaaaaaaaaattcattttgtttccagatggcttccaagtcggagcagcaaaattttttttgtatataataagataaaaatttcccaaaacaaaaacaaattttttttttgtacttttttgaaactttctgaaattttgccgaataaaaattgtaaacccaaacacatacaactaactatcggtcgaactttcccaataatgtttaaattttgttgacaaatataaaaaattttttgtttcaaaaatcgtcaaaaattttttggggcccctttcccaaaaatttaaaaaaaactaaattaaatttaaaaaaatatttttttttacactaaaaaaatcatataaaattttcctaagttttttttgttgaaaaatttacatttttcttttttctaaacatttcctgctgatgcggagggggacttgcattattcccctcataaacaaaattaacttttcataaaacaccgagagtctcgagacccgggatcgatctgatccgatggcgatatccgtccatttttcagacaaagacgacgacaatgatgacatcgatgatggcaccgtctccgacgacagcagcgagggcatctggggcaccggcgtgttcagcgcgtatgagctgaagaagttgcacaagccgtccatcatgtgcagcagcagcgggcgcggtgccaagaccgccgtgccgttgttgccgaacgccgtcgccaccacgacgacggcatcgtcgtcgtcgatgacggcaccctctgtcggcgccaccgtctttgttggtggcggcagaaaagcgtcattgacagccgccggtggcacaactgttgctaccaccatcgtgccgctcggtagcatttgggggaaaacccagccccaaaaatgggtgtga

SEQ ID NO: 75891 - DNA, 662 bp, Heterodera glycines
  Genomic contig location: Contig_ID=SeqID_12303; Location=679..1340; Strand=-
  SCN-specific regions: Sequence locations=1-662
atgggcaaagccgtcgcagaagtagcggagccgatcgacgcactttcgggcggaaaacaaagcgaagaaaaagcggacaaacgccaaccgatgcttctccctttggacgctctgtttggcgttttaagcgcattggacccccaaatgatcggacggcactgtgccattttggaccgattggagtcagtgatcggtcgccaaacactcacttcagtcgcaaatttgcagaaacgaattggtacctctgatcatttggcagttacgtggcagtgcgaaacgctcggaaatgaatgaaaactactcaaaaagaattggcatgcaactgatcggcactctgaaaagggcgggcactccctctgcgaccgattgtcgtccatcgggcattgttcctgtgtcaatggcactggaggggccagaaagtgcccactccttctatcagtttgtgccgttcttcaccccttcccaattaatcccatctcacaaatcagagtcattgaccaattgctgcgtcttttgtctccattggcactttcattgcctcaactttcgtcagactctgctgttgaacttcttccactgcttgaagaattgtggcgttgtgctttgctttcgccaaccctctcaaagcgttcggaagcgcttcgattagccaaacgaataaa

SEQ ID NO: 75892 - DNA, 1049 bp, Heterodera glycines
  Genomic contig location: Contig_ID=SeqID_12304; Location=1843..2891; Strand=+
  SCN-specific regions: Sequence locations=1-263,285-401,423-661,684 -981,1013-1049
atgccaaaccatcgcaccgtcgaagatggcactggagttttcgcctcttccctcgcattgttggcattggcacttagacggaaggtaaagcaaatggcgtcccgaacctccaacagaacggaacggtcatttgccatgaacacaaaacacttgcgcactctttcacccttttctgacactttggcaacgaaacagaaaaaggaggccatttcttaattcgaaaatattacggggcaagcgaaggggggggggaattagaaattggggaatggggaaggagggaaatgaacaaatcgcctcaaaaaggaaaggacaaaaaagggaaaaaagaaggacaaaaaaggaaggacctgcctcggagccaagggacagcacagaaacatccgggatgagaaaacggtgcaaaacgcgggaggaggaggcgtcgatgagaagaatattgcgagtggacacattaagcataacatcggcattttgtacgcgcacggggccacgcaaatactaaaggaaacgagcggagaaagggaaggcacgggaagggccaactgagcaaatgccgtcaccagccaatttggcacggcttggccccgcctcgtcaacgaccagtcgaataaagtctctgaaaattgcatttgttgtgccattgttgcaattacgtgccttgtcacttcggtttgtcgttcgattggcagcgaattcagtgatttttcgaccacaacaaatccgacaaactgtcaaaaatcggagggattgaaaacgaaattgtttctgctgatcacccgaatgtaaaaagtgatgccacttttctgcagctctttctccgtctctcttaaacacttcgaatcgatcggaagagaatccatcggcggaagaacgcttttttgagctttgaaattagattttgcagtggcaaactcagcctttcatcacattaaatgtgcaaaaagagagaagggacgcaaagaaggaaaaggcaaattgattattaaataagtaataataataatatttagatagaaaagaagaagcttccccgagaggaagattaa

SEQ ID NO: 75893 - DNA, 742 bp, Heterodera glycines
  Genomic contig location: Contig_ID=SeqID_12305; Location=610..1351; Strand=-
  SCN-specific regions: Sequence locations=1-57,79-234,273-345,408-742
atgcgtccgaaaatgcggaggtaatttgacacacaaattgccacctttttaataaaattgacaaaattaaatttcaaatacgtttaattattatatcatttaatagcatttccattcgaccaccgccgatttttgggtcaaattttggccctattttatcactgccattgccttttatggccttctctccgtggcgtggattttatggaatatttacgcttatcgaaggcttggaattttaatttataaaatatatttaattacatatttttgcgattttagggacctctcaagcgcacggaaagggcaatttgtcggccgattgcacgaaaaatggtggaaaacaattttaattaattttaattttagttagttgaatttaaaataaaaaaaaaatatttattttacaaaattcaggcgtcttctgagcgtttacgaccaaatcccacacaattcgaaaagtgtcgcctccgatgccccgctaattagcgtcgaatgaccaaaaaaaaacaaacaaaataatggtaaaattaaaattaaaaaatggtttaaatgattaatttttcagttttggtgcaccacaatttcgtttcgtacggacatgtgaaaattattttgtggagaaaattgtgcaaattttgtttttgtttttcttgtcaacaaccgatgaaaatgatgagcttcatttgtaataattaataatgattcattcaaattatttaatgttgaaataacaaataaa

SEQ ID NO: 75894 - DNA, 237 bp, Heterodera glycines
  Genomic contig location: Contig_ID=SeqID_12305; Location=1795..2031; Strand=-
  SCN-specific regions: Sequence locations=1-21,43-148,169-237
gttttacacagtccccacaaaatttagtttaattttggggggttaaaaataaatttccaaaaataaaaatgaaattgaaaatgctcttcaaattttttatttttgaatgagtcgccgaaagggaaaacatttgatcaatcagaagcaattatttatttatttatttatatttgttaatgggttggccattgccatcggacaatcggagaagcatttgaacagcagcagaagaaaagg

SEQ ID NO: 75895 - DNA, 698 bp, Heterodera glycines
  Genomic contig location: Contig_ID=SeqID_12308; Location=1993..2690; Strand=+
  SCN-specific regions: Sequence locations=1-698
atggctcgaggccaacagcgcgggtgcattcgcttgcgcggcgcggcgcttggcattgacgaggaaaacaatgcccaattcacaattgcagtggacggcaaagtgtttcatttgcaggttttcttatttatataaaaaaattactaaatctctcctttttgatcgttcgtttgaggtttaaaaagttctctttttccaatgaaaatccccattttaatggagttttttggcaccgtaaaatttgaatttgcattcatttaccctgtttcatccatactcattttctgaaatgtgtctaacattcagtttgacagtctcataaatattggccttttcgcaaaccgttgaaattaatatacaagcgtggaatcattttaaagtttgaaattttgcccatcacttcctgttttgctaacccaattgcaaattgagtttttattacctatctaatctggaaaccacgatgttttcagaattcctgaattttggcgaaatgcagtatcactggttagaaaccacggcataatgttttttttcagggcaaaaaccgggccgagcgtgacacatgggtgcgcgtgttggagcgcgtcattcacgagaagtgcggctactacaaaccgccccaagaggacccgttggaggaattgcgcaagcgagtgattatcgcggaaaaccagtcgcaaacgctgatggaacag

SEQ ID NO: 75896 - DNA, 1991 bp, Heterodera glycines
  Genomic contig location: Contig_ID=SeqID_12309; Location=110..2100; Strand=+
  SCN-specific regions: Sequence locations=1-483,505-660,689-723,745 -1238,1260-1905,1927-1991
acgcgcaatttggagcaaatcaccgcccgcgagacggacaaaacggaccaaaagcgtaagaaaatgctgacggaaatcattgcgaccgccaagcgactgcagagcagcgtcgaccattcgtccgttctgttgcggcaagtgcaacgcgacattggcacatcgctgacaatgagcactgatcagcagcagaagagacggactgctgccgataaagcaattcgatcaccgacgacaatggcgacgacgacgggcacagcaaaagcggcaatgacggaggaggacaatttgaatgggaatgaggacggagagggcggcaaaatggggggcggtgctggtggaggaggaccaccacaattgcaacaacatcaacgggaacggcaggagtcggaggatgaagaaatgtgcccaattggcggcgggagcaacggcaaggaggtcggttagcggagcggatatgtacattgtttgggtcataatttcaataaaagtatagggaaatgggtgggacacctacagccccatttgatcgacatctcttgggtttccattgggattcgtttccacgctcttgagtcttggtcttgactcggtttggtattccgagtctcggaaatctttcattctcgagcagatcaatacctcttcatttcctttttctagcttttgattaaaaaattttcctttttcgtgtacagttctaggcataattacagtcatgttaaaaaactgctttaaaatccttcaaaattccatgtgctttgtctgcacgattttccgcatttccaaccaaaaatgtcctttttttttgtctggctaactctctgaagtctttattgtcgtgtcgttgtacaggacgtgttaaacctggacgaggtggtcagctactccagctcggatgacgaattctacgacgccgccgaggaggacgagcagcaacagttgcgccaccattgtcgttctattggctcggctgctgcccttggcctgagtggacaaaaggggggaggtgaacagcagcgcaaaacgtcgaccgactcgcccaccgtcagcggtcagagcaatgccgcacttcggcgcagcagcaaagacttatttaggtgaacggactgaacatggtttttgcagagagggggggcacaggcccgtagccagggggaagggctggggaatttcactttgtttggggggagaaactatataaaaatggatgcaaattcaaattttgggccttcggaccgccaaaaagtgatattttttccttgatttcatatttttccgggttctcacgggtcgatttttcagaacagcggcgcgctcccacggtggccctgcacaccttcggccctcctcgcttgttttacagcatcaacagcagtcggaactgtccgattggggccaattcgatgccaagggcaccgactacgacgcaatttacaacaacacgcatgacgaacaggacattggggacatcaacaagcaacatggcagtgtgctcatgcatttgttgtcccaggtgagagaattttttgtgaatttttgggccgaattttcaaaaaagtcccggaaattttcaatatatatccatccatttttaaaaaaattttacatttcgcatgtatgggaaattttctcctcctcattggttacaatatgaaatttatctttagtattgggaatcccgaatttactaggtttttggtctattgtaggttgtacaacaagactacaaaaaccttatttatttgacattgtcttcatttcccttcgctttttaggtcagtgtcggcatggacttgacaaaagtgacgctgccaactttcattttggagcggcgctctctgctcgaaatgtacgccgactttttcggtaagtatttgaattttctgttggcttttcatttctaagcctttttatcgaaaaataaaaatttagcgcatccggacgattttatcagcgcggtggacgaggattctcccgaaattaggcgataa

SEQ ID NO: 75897 - DNA, 490 bp, Heterodera glycines
  Genomic contig location: Contig_ID=SeqID_12310; Location=108..597; Strand=+
  SCN-specific regions: Sequence locations=1-90,112-490
atggataaatttgtgatttttcggcgcaatgccgctattaattcctgctttttggttccggcgctgaaggtttcaaaaataacacaggtgccacaaaatttttttggcccggagcaaaaaaaaacttcgggtgccctcacgaaatttttttctgtatacgggcctgaactcactcgaccacccagaaaagtgtgttcattgtcagatggatgttgcgttgcttttggcacgttccggggccagcatcgaaaagaagaatcgccagaacaaaacgccgattgatttggtcgacggcaaagaacagaaactgaaactgatcaaagcgagtgaatcggtgaagccaactgccggaacatagccgaattcctttgttaaatcaattctattgtttttcaatgtaattgtaatgaatcttttgatttcacttgaccaattaaaaattctgaattattgttgagttgcatttttcgctgacattaaataacgccaa

SEQ ID NO: 75898 - DNA, 1153 bp, Heterodera glycines
  Genomic contig location: Contig_ID=SeqID_12311; Location=389..1541; Strand=+
  SCN-specific regions: Sequence locations=1-198,223-556,578-788,815 -1153
agtgccaccgatatcttcagtcttctggatgccattgacaaattaaaacatttaaagcggactggtttgtttgatttgtattgcattcatctcttaaacgttttgcctagccttggattttgtgacatgcccctaaagtaaaaaagtgccaatttttagaaaacgctcacattaatcatttcaaacaaaaatggcaatttaaattttcatcatttaaaagttttaagaaaactgcctttgtaccaaatcatttctcatttgttaaaggttgggttctcgtcggcatttcggagcccgagacagtcgcttcccatatgtatcggatggcaactttgggtttgaaaaattatcgtcgatcaaccaaacggaaaagatacgttaagcaatgactttgtcggcgcaccgaactgatttggacgtcaacaaatgcattcgaatggcattggtccacgacataggcgaagcgattattgggggttattcagtccattttcattttttgaccttcgccccccccccacagatattaccccccactgcggcgtatcgaatgaagaaaaattcaaaattgaaaaagaggtatgtgcagcaattgtaacaacaacattatttaacagatccctaatttgaggctgttgagactatttcgaattggttgcccgaaacggtgggcgacgaatggaaaaacctatggagagaatacgacgagggaaaaagtgcggaagcaaaggcagtgaaacaattggacaaattggtaaatggtgcgcgaatgcgacgaattcaatctgaaaataaaatatattttgaaaacaaatccaccaaaataaaatcattttcccgggtgatggcaattaacaccgttgcgtcctgacaaattagcctaaaattgaaaatgtagcgaaaaagctgcgacgggttgccggataaattttgagcattttcatctgcgaacccatttcggagagaataatcatttcaagtatttctgaattttgattttgaggatatgttggcccaagccttttcctacgaaaaaaggctctccatcgatttgactgagttttttgatgcgacttcgaatgccttctccgaagagccctttgcgagttgggcagctcaaattaggctgggacgcgaacaaaaaacgatgaca

SEQ ID NO: 75899 - DNA, 1485 bp, Heterodera glycines
  Genomic contig location: Contig_ID=SeqID_12312; Location=53..1537; Strand=-
  SCN-specific regions: Sequence locations=1-1,58-514,537-540,562 -1120,1142-1485
  Gene Ontology: Mol. function=calmodulin binding; Cellular component =integral to membrane; Biological process=potassium ion transport
cccccccccccccccctttctcccttactgtgacccttcccccctccacctctccctgtattcctttcatcgtttctcatttctcagccctttgcccggcaccggcaccatccgttgggccttttttgagccctcccgcgtgtggtcgcaggccgacgagcgaagtgtttataatgtgcgaaaggttccggttgatgtggtattgtccctgctgatgctctcgcgcgtttaccttgtctgccgttggcaagtgctgcacagcaaacagtttcaggtgccgttgtgtcccaaattaggctctttggcattccatccctttgcttttggcattttatccttttgctttgacatttcgtccatctttttcaggatgcctccacacggactttggctgccctgaaccgtatccaagtcaacttcgcgttcgtcctcaaaaccggtccgtctccgttcgtccgttgccttttcccctggtcattccccaaatttcgtagtgctcgaccagcgtccgatgtttttcctgtccatttttctgttcgtcttttggctgatcactgcttggtccttcgcccaatgcgaacgctttggccgtgacgtggacgaccctttcattctgtacaccaacgccctgtggttcatcgccatcactttcaacggcaacggatatggcgacattgtgccaaagtcattggccggtcgactcatcgccattctcgtcggcattagtgtaagtggcacatttttcctctctgttgtcagggatactttattaatgttagacactctcatactgtatcggatttaaagtggcagcataatttcccttcctttcggtcgaaatacttatttgctaattaaataccttaccgtatcagttctaatgagagcaacaaacattcctttccttccgggatggatactgtatgtgtttgttccggctaccgtttcttacagtgccatcattttcctcgtcctctttagggtgccgtcatttcgtccattctgatcgcagtgatttcgcgcaaaatccttctttcccaaggccaaaagaatgtcaacaatttcatgaacgattctcgactgacattggcacataaacacgcggcggcacgcgttttgcagaagacgtggcacatttaccgctgtttgaggagcagtgacgcggccgaccatcagctgagacggcaccagcggaagtttctcaacgccatccatcagttcagacgcatcaaaaacaaaatacgctctttcggggagaacggttcggcaacggtgcagcaactcagtcgggtgggcaatggcacaaaacggggcttggcaaaacgtacacaaaaaaaggaatttgatttaaaaagtatgtccctttgcttcctctcgtccttcccgagaattgcgatgctttttcttcagctaatgaccgaaatgcattcgcacactcagcgccttgcgctggcccaagaggaaatgcgtgtccaaattgagctg

SEQ ID NO: 75900 - DNA, 1353 bp, Heterodera glycines
  misc_feature (1034)..(1034): n is a, c, g, or t
  misc_feature (1036)..(1036): n is a, c, g, or t
  misc_feature (1039)..(1039): n is a, c, g, or t
  misc_feature (1043)..(1043): n is a, c, g, or t
  misc_feature (1046)..(1046): n is a, c, g, or t
  misc_feature (1049)..(1049): n is a, c, g, or t
  misc_feature (1056)..(1057): n is a, c, g, or t
  misc_feature (1067)..(1067): n is a, c, g, or t
  misc_feature (1070)..(1070): n is a, c, g, or t
  misc_feature (1072)..(1073): n is a, c, g, or t
  misc_feature (1087)..(1087): n is a, c, g, or t
  misc_feature (1090)..(1090): n is a, c, g, or t
  misc_feature (1104)..(1104): n is a, c, g, or t
  misc_feature (1109)..(1109): n is a, c, g, or t
  misc_feature (1113)..(1113): n is a, c, g, or t
  misc_feature (1116)..(1116): n is a, c, g, or t
  misc_feature (1121)..(1121): n is a, c, g, or t
  misc_feature (1124)..(1124): n is a, c, g, or t
  misc_feature (1150)..(1150): n is a, c, g, or t
  misc_feature (1222)..(1222): n is a, c, g, or t
  misc_feature (1227)..(1227): n is a, c, g, or t
  misc_feature (1231)..(1231): n is a, c, g, or t
  misc_feature (1234)..(1234): n is a, c, g, or t
  misc_feature (1243)..(1243): n is a, c, g, or t
  misc_feature (1250)..(1250): n is a, c, g, or t
  misc_feature (1254)..(1254): n is a, c, g, or t
  misc_feature (1257)..(1257): n is a, c, g, or t
  misc_feature (1259)..(1259): n is a, c, g, or t
  misc_feature (1262)..(1262): n is a, c, g, or t
  Genomic contig location: Contig_ID=SeqID_1775; Location=1..1353; Strand=-
  SCN-specific regions: Sequence locations=1-160,216-733,840-860,982 -1139,1188-1353
aaaaggactctctgttggatgcccgttccgcgatgccaaccggcaaaagacccctcttttatttccatgtccgtgccgaattcttctcattcgccggcactctttccaccgcgcacactctgtcaatgcctttcacaatcgctacacggcggaatcaggcaattaattaattcattattatactaattaattattaattgactaattaatttattctaccgtaattcctaaaatagaaactccggggcttctatttttcaatcccctcctccctcgaaaggagacttcttttcaggggggggcttttattttaggaaatacggtacactattttttctaacgatttttcaaaaacttttttctttgcaagattttttcctttaaaaattttctttaaaaaagtttaaagatttttttttggaattcccatttcctgggattttgttgtttttcataagaaataggccgccaaatggttcatatcgcacacataatttgttcttacctcttgaaaacatgtggatttcgccgtgcccttgcctattccgtgtacttaaatttcgcaaaactcatgccgagactcttgacacttcaattagtcacggtttgggttccctgattttccaggattgccaagtgcagcggatgatgtcctcctacacggccacctgtttctggctttacggcaccaatgtgttggatggtttgctcatccaatggtttgatggaggtcaattgattagttattaattaattgatcaattatcgtaattattaatggaccaattatcgtaattaattgttaattggtcaattaattatccctaatgaattaattattttcaaaaaattgattggagatttattggttaatatttgtttaatcaattaattttcacgattagtttaattaattattgatttcattatttaaataataataattttttcagttcattaattatcctcaattaattaattgttttcagaaattgattggaaacatttcaagctgctctattcactttactttncnatnaatnccnaantcaaacnnacattcactnacnannacttcaccattttncancacaaaatccactnccccnaatncantcaanctncccttaaaaatacccaattatttttnaatttttccattttttttttaaataaaaaataattttccctaatttggagacaataactattttaaaaaatnatctnaatnaancccaccaancaattcnccancananatnctccctttaaagaggactaatttaccctcaaaattattcctaatccttgttagaaaaaaaaattttttttgaaatttcaaattttttcgat

SEQ ID NO: 75901 - DNA, 65 bp, Heterodera glycines
  Genomic contig location: Contig_ID=SeqID_1776; Location=393..457; Strand=+
  SCN-specific regions: Sequence locations=1-17,40-65
atgaattctagtcttatcggtggatcactcggctcgtggatcgatgaagaacgcagccaactgcg

SEQ ID NO: 75902 - DNA, 2533 bp, Heterodera glycines
  Genomic contig location: Contig_ID=SeqID_1777; Location=494..3026; Strand=-
  SCN-specific regions: Sequence locations=22-95,131-258,285-374,418 -529,552-805,829-971,993-1210,1232-1268,1293-1582,1604-1615,1637 -1840,1897-2374,2396-2533
tttcagtatccctgcaaattttgctgcgcttctgatcagtttctgaaaaaaaagttaagcttaacatcggttcagggggactgccccgaaaacccaaaaaaaaattgttttgaataaaaattatttaaatgaactgactagataatatttaaaataggttatttctcttcctttcaatatctttgcaaagtttgctgcgcttctgatcagtttctgaaaaaaaagttaagcctaaactttttggcctgtttaaaaaggaattaaaaatttttaaaaattttattcatctcccttttcaatagaaaaagcatcagagtgcctaaactaacatgtaaataaaatttggtgcgtttcagagcattttctggaaaaaatatttatgaattaattatgcaaaaaataaacaaataatgaactctcttccttaataattttcctgcaccgaaggtactcactcggccgcttcgcggcctcgtggtgggccttccccccccccccctcccacgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatattaaagcatcagagtgctaaaattaagttgtaaataaaatttggtgcgctttagagcactttctgaaaaaaatatttatgaaacaaaaaaatcgattttttcaagtgtccatttggggtactcaaacatttatggggagcaaaaatccaacgcagaaattaaagttcaggctatagggaagctactcctgaaggtttccgtctccccataaatctgggcgcatcagctcggggggcatgcccagaaaatattaaactcaatttcttcaagtgtccgtttgcgatactcgtacatttatgatgaataaggctccattgcaaaaccatataagtttagatgcggaagataatctagttgtaatcgatttaaaaacttattaaaaagtcgcagcattaatattgcacaaaagttagaatgtttgcatattttaatttataacatttttacatgtcggtatatctttgcgatttttgggaagctgatagagcttgttaagagctttcgaatgatatcaactttgttggatttggtcagtaaagaaaaaagttaggatgctctaaacttggctcagactataacgaccagactatagtgtcccagtccgaacctcacaacaattgaataactagagctgtcccagcagaacaaatgcccaaccggtcgggactgatctcgaattttaccagcggctttttcagacccggaggacctatacctcttgtcctggttttctccttttttcctaaaaatttctcaaaatgcaatgcaaaagctaattttttaaatttgcaaatttaaattatctttttagttttccaatgaaaattgtgtcgttgtgccgtttttgctttttccgcgacttttccttgcaaattgtcagtgaggaggtggcgcaacaaattcagcaggaaatgcgccatcgcaaaacatttgatccgccgtcgccagttcgaaagtgggcaaattattctcagaaaaaatgttttaattccaattaattaaattatttttttagcaattaataattattattttgtaaattattttagaaccccttcggccgcacttttggcaatgaagccggccactggggttaagcgcaacaatgccaaagcatcggagggtaattaaaagtctgaacttatacgagactcggacggaaccgatacccttgcaaagaattccgagatttttctcgagtcatgagtcgcgcgactcgagagtttctcgaaaccggtttcctgagagcgagacagactccggacaagactcctaacaaattccggtgctcgagcctcaagtagagccatttctcgactcgagaccaacattgagactctagtcacgggtcgtgatacgagagtctcgagaccgtttaaacctgagagtgagactcaagacaagactccagaaaaatttcttttctcgaacctcaagtcgagccatttctcgactcgagaccaaaaatgctgagattcccggacctaattttgcgactcgtgaccaaaactaataatttatgttcgaaattttttttttttttttttgcagagggtggtaacacagcgcacaaaaagtcggatgtgaactcgcgcgagtgcatttccattccgccactatttgacgctgaacacaacggatggtgcgccacttatcctcatcttttgtgtacgacgcgccaaaaa

SEQ ID NO: 75903 - DNA, 1339 bp, Heterodera glycines
  Genomic contig location: Contig_ID=SeqID_1778; Location=614..1952; Strand=-
  SCN-specific regions: Sequence locations=1-28,63-421,444-511,533 -807,829-881,906-1339
atggcaataaatttactatttttcaaggtaaaaaatttttttttttttttagaaaaattaatggcaaattttaggaaaagcatgtcctttttaatgtcttttttttaaattttcaagtgcttctgacttttttagtaaagagttttttcggaaaaaagaaattttaaaaaatctatttaacagttgaaaattcgtcattttttttcttgaatttccaatcaaaagcgaaatttttcggttttcaggaaaaaatccacgctcgcctggttgagctggtgaacaaagcgcatcggatgcaaccgcctccgacggttcagccaaatgatcaacaatttgagcgattttatcaggtagaagaaaaacagataaaatgttacaaaaatactttcgaaaaaaatgaaaatttctaaatttttattgctaaaaattctcaaaatttcaaagtccggcctggctttcttgatgcgattcgatttttttttacaaattcaattttttcggatacatgccggattttagaaaaaagtttcccttgaggctgggatttcttgggttttatttcaaggggcggcactaattcagataagggccaaatttcaggaaatttacggcattttaacaagaaaccattcaaggtttaagaagagtgtccatgtaattacggtctctaattaccgtactatttatacggtaaaaatgcaaattgaatttttcttttttgtccaggcttatgtaaccgcgttgatttcgctacacgaattgtacacattgtgccaacaaaaatgcttaaccagtgccgaatttgaagcccatttggccaatttcaagaagcaattagtcgccgcgctggcgcttcaacgcgatttctccaattgcgtaagtttaaaaaataattatttatttttgcatttttaaattgtttgtacagcacggcaatttgttgtggcgaaagttgcgcgaacaccaaatccaccgtatgacgcattacggttatgacaaccgtaccttcatggactcggccctgtccttctatgcccacatgctgtacaatttgggcgtgttggctgcacggatacaggtaaaaaaagaagaaggatggcatgccaattggtcataggtctcccggacaaatgcatttgtcaattagtgatatagtatcccaaaaacctattaccgtatcttattctccacatggaaatttcttttttttctactaaattagcgcacaaataagggtagaattgaaatctcattgggatgtgatcaccaatgtttatttgatcactaagtcatatatttcaaattgaattatgcgccaattcaaaaatgaacaattaaa

SEQ ID NO: 75904 - DNA, 258 bp, Heterodera glycines
  Genomic contig location: Contig_ID=SeqID_1779; Location=315..572; Strand=+
  SCN-specific regions: Sequence locations=1-68,90-258
gtccaggcctggatccaggtctcgaggagcctggatttttcctggacctggatttttgtccaggaaatccaggtccaggtccaacatggaatccaggtccaggtccaggcttttttcaaaatgtcgatctctagtaaaaacccaatttccttaattacctgtctcggaaaaattttttcggcatccgatcataatataacaagagcagaagagaaacacgtacaaccaaagtacaaaaatcgttctgagacaagaaaa

SEQ ID NO: 75905 - DNA, 289 bp, Heterodera glycines
  Genomic contig location: Contig_ID=SeqID_1779; Location=1765..2053; Strand=+
  SCN-specific regions: Sequence locations=1-126,151-289
attttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctgct

SEQ ID NO: 75906 - DNA, 2316 bp, Heterodera glycines
  misc_feature (1388)..(1388): n is a, c, g, or t
  Genomic contig location: Contig_ID=SeqID_1779; Location=700..3015; Strand=-
  SCN-specific regions: Sequence locations=1-59,101-118,141-239,263 -544,657-1101,1126-1389,1439-1544,1577-1773,1795-1821,1872-1880,1902 -2288,2310-2316
atggcatcgtcactaatcattggccaaatgcaacaaccaacaaatataaatgccaatgccaacaataacaatttcaataataataacagtaataacaacagtgaatttgcaccacttcacatggaaatgtttgattttgtgagtaaatttggttttatggcgtcagtcaaaaaccatgaaaagtcaaaaaaatcatcaaatgaataacatttttcatataactttgctcaaaatcaaccaaatttttaattctttatatcattcgaaagcgctaagcattttctattagcctgcaaaatttcaaaaagtttcattaaagttcaaaaaagttatgaccaaaattaaaaaaaaaagttggtttttcgagttcctctggtcataactagagctcgcaaaaaaaaaggcaccaaaaatcgcgaaaaaggcactataaggcaccaaaaaattgaaaaaaaggcataaaaaaggcatttaaaattctttattaaggatttttagggagccaaaacacgtaaaactttaacaaaaaaacttaattttggtcatttaaatgattattaaatattttataatgttttcgaaaaaggaaaatttttaaaataaaattttttatcaagaaaaaaaattaaattattttttgagaaaatttttaaattcttaggggtgtattttcccaattttattgcattttaatggaatttttcgataaaaaacgctaaaaaaggcaccaaaacggcaaaatgccaaaaaggcatttaaggcacgaaaatcccgaaaaaaggcaaaaaaaaggcataataaaagtcaacgtagaagcctcaaaccaagtggaaaatgcgttatttatgcttaatataccgaaactagtgcgcagaaaaaaaggcttatgcctcaaaatgcgagctctagtcataactttttgaaactgaatgattttttttgttcaaattttgaaggccaatagcagggatgggccgaggtttcgcttttcgcatttcgcctttcgcattattcgcattttttggcgtttcgcatttcgcttttcgcatttcgctttttggcgcgaaatgcgacttttacacccctaagaattggattaaattcccataaaatttttcaaaattttacctataaattggctaattttcagtgaaaaactgtttataaatgatcaaaatttccaatttttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatgataaaaatcacgaaaatttgatcattttttagtgaaaatctgtcaacaaattntaatcaaattttcaaaaattttcccggcgggcgcctgccgggcgccgcgcttgcttggcgcccctgctccctcttcccaaaaagtttttttggaaaaagcgcgcctcaaaaaagcgttttattgatttttaaatttggaataaaatttaaaaaaatgatttttgctttatgattttaactattaaaaagttgtagaaaaaatttcgcttttcgcatttcgcattttcgcaaatttcgcttttcgcatttcgctttttatttttcaatttggcccatccctgttatataccgcataaaaacagtcagagttgcttttttgctatttttgtgggtttgcctcctttttgagggtctttccccaatttgactcattttaattgcccacaatttgaccatttaaaaaatttcccttcaacatataatcaagaggcgcatttttattatataatgattattaaattattttttaaaatatattttaatgagaaatgctttaatatttttatttcttaagggtcattatcagttccgtcgaatggcattcttcacaattgcatggcaaatggtcatctgtgatttgatgactcaaactgtacaaatcattgtggctgtaccgataacttttacgggagaagcagtgagtttctgttatgacaataattaatggctgattgattaccattggtaccgttttttcaggtatacggtcatccgttttggtattatgccgtgcttttctttgatactgtagcgtacaatgccacattacatttttccgcgcttctcacatccaatcgcctttgcgtgttctttgtgccgcggcttaacgcttttctcttctcataccctaacattttcgggtacagtaagacgttcggaatacgaaatcaataaaactagaaaaatcctcaaaatttttaaaattaaa

SEQ ID NO: 75907 - DNA, 367 bp, Heterodera glycines
  Genomic contig location: Contig_ID=SeqID_1780; Location=471..837; Strand=+
  SCN-specific regions: Sequence locations=1-238,270-320,347-367
atgatcccaactatttttggttacatcgccaatgattgtgagtacataatgaatgtgattaagtgatgacgcatctgatcgctgatcaaaaagtgaccgaatttataaaaaaacaaatgcccaaaaagacggcggcaaaacatttgatggtattttaatgtgccaaaaattgaaccgacaagaatttgattttcctggataggctcattatctcaatactgtaataatttacagttagttattatttaaatatttttttattataatttgtctatatcggaaaattgttttacgttttaaattaaagctaaaattaacagttaaatattaaaatttatttattttagtaaatcttctacagaattaa

SEQ ID NO: 75908 - DNA, 380 bp, Heterodera glycines
  Genomic contig location: Contig_ID=SeqID_12313; Location=584..963; Strand=+
  SCN-specific regions: Sequence locations=1-170,222-380
atgaagaaatccgttaccgtcgctgttcccgaacaaaaagaaatcaatcaaccaaacgcggaagtggagccaccaaaatcagacactacaaagaagcgcaaggtggaggaccaggaactgtggaaattggcaaaagggaaattcatgctcgcgacgtacttatgcgcaggttaaattgaaatattaaatttaaattttattaatttaataaaatttatttagacgactgggaccgactgttccataatcaacagaaagtcgcgcgcttggaagatggccgttttgcggtgtgctttgagctctgtgaagaatgcgtgtggcgcaattgtcgcgcaaacgatctcattgcctctatgaagaaaaaacagaacaatgcatga

SEQ ID NO: 75909 - DNA, 2489 bp, Heterodera glycines
  Genomic contig location: Contig_ID=SeqID_12313; Location=1307..3795; Strand=-
  SCN-specific regions: Sequence locations=1-356,382-888,910-1159,1191 -1303,1326-1359,1392-2162,2186-2278,2315-2489
  Gene Ontology: Mol. function=zinc ion binding; Cellular component =nucleus; Biological process=chromatin-mediated maintenance of transcription
atggcaaataaatttttacttgtcccacaagaaatttatcgtggtctcacttccatgtccaacacgggtgacctaaatctggatgctgttcgacatgatttagaccgtgcaagggccgagcgaacacatcccagtacaaaaaatgtccattacaatcaacagcttaggcgatacttgaaaatgaggagggaacttgaagataggccagccaaagttgagctgacgaaaggaataagtgtactgctaaggaaaggcggcgaagatgaaaatggagaggttgtggacataccaccacgacctcccgctccaccgccaccaccgcctgggagacgtcctcgacgtggtcctagtcctcccgctcctcctccaccaccaccgccggctgggagacgttctcggcccccacccattcctccagctcccgctccgtacccaccaagtcctccacctcgtccagaacgtcctcccagaccgagtagagctgctgcgccttctcggagaggagatagtcgtttggagcaatggcataaaaggcgatctgatatacaacgacaacggccaattgtgcgggaccttcttgcggaagcagctgctgctccattgcccgaaagtgatgatgaatatgattatatgcttgagagtgggcgctgccagcgccatcacagtattatggcgatttgcctgcgctgcccgacaacgcggacgaaattgaggagatggacactgctcagcgcaggattgctaccagaagaaaattaaaaaaggacgagacagattatgccgatttacaaggtaaaagacaaaggatctatcgcccttcacctcctcgactcccacttcctcctcgtttgaaaacaaaagctggaccaaggcctgcaccccctcctccatctccacgacgtccttccgtcaagttagaaaaaaaagaaccaaagttgatggaagttaagccttctacgttaaagcaagccgaccaccctactccagcgcctcgggcgaatcgagagccaatgtccgggctcgaccctcgaccatccacatctagagaagccggttacttccctcccgcgacatacaaaatcgagccaaaacatgaaccgacaaagaggcccatgccttaccgtatcccgaaaaaagagccaaaaagtaaagaaaagccaccacagacgcagcagcagcagcctcctcctgctgctgtcgtcgaagaaatgccctatgttcctccgcctaggagggggaccaaacgccactaccctgtaaatggtgatgatgaggtgcgcgtaagaaaacgagttaggcaaccgaggagggtaagagtacagtactcgcccgaaccgggtccatcaacatctgcacaaagtgatgaacaacagcaacaacaacaacgtgaactgtttgccattccatcaaatcagctgaccatgcctcagcgttcggaacgactgtacatcaaatgcaaccgttacgcggatcgtatgggtgttcggggaaatacaattaacactgcaaacggtaagccgttggcgcatagcaatttgcgaatggccatcaggtatataattgaccggagagcgggccgccccaccattagaccacctggagcggccattttggaggagaggcttaggcaggacccaattttgtattcatggacggctccgtcaaagagaccgtcaaagagcacgaccaccaggacggcaccgaaaatcaagaaggaatttcgtccgaaaaaatggagctgatcaacaccactcttgacaagctgtacaatagtccatcttccccggcggcgttcgcaggcgttacagcgttgtggaaagaggcgcgaaaaaagttgaaacacttacggaaaagggacgtgcagaattatttggagggtcaccgtacatacactctgatgcggccccggagggtacgctttccaagggcaaaaactgtagcagtgggattcatgaccgatgtccaggtggatttagccgattttcaagctctttcgcgtcacaatcggggtcaccgctacctgctcgttgcggttgacgtcctatccaaacgtttgtttgttgtaccgctgaaaaacaagagagccgaggagatgttggatgcatttgtcaaagatgcggcatgtatacgatcaatcattacataacaaaaatgaacaaatgtttatttataaataataataaatgagcattacagtacctctgtccacttccgataagccgtttggcacagaagatgacaacaatttccgcttgtttgatggtgaattatcaggtagtggtgatgatgatgatgataatgatgatgatgatgaaatggtccgttttaatgattggagggcagtttccacaacagccagccacctctacatgccgtggcgtagaatccgatcggccatgacgtcgtgcactttttcttgttgtttcagcaaatcgaaccatttgcgcagaactgctagtgaaatcgacgaagtcgtgtcgaacggataa

SEQ ID NO: 75910 - DNA, 1519 bp, Heterodera glycines
  Genomic contig location: Contig_ID=SeqID_12314; Location=1..1519; Strand=-
  SCN-specific regions: Sequence locations=1-84,106-403,425-522,544 -776,822-897,931-933,955-981,1015-1208,1292-1333,1516-1519
  Gene Ontology: Mol. function=protein binding; Cellular component =axoneme; Biological process=N-linked glycosylation
atgcctattttccataatcccgaatttgctcaacacgacatgtatttggatgacacatgtaaaaaagcacctgatcttgttgtaatataattaatgaattaatttacaaattatagtatgggatgaggaaaatgccgccgacgatgaccaccaacaaaagccggaaaaaatacaacacttatggctcattgcgctcgttttcgtttgtgtcctagcgattgggctccattttttggttggttttgaattttaattatttgtttaataaaatgcatataaatttttgaacttttactcattttcttcaaaaataataaatttttagctttattttgttttcttttttctaaaattattttgcataccatatttggctaaatttagtgaatgtaaagaattttttcccattttctaacctgtttttggggtttttaggacctaaaatatacctattttggcagtttttagcacctaaaatattatcactaattattagtttattacatttgcgccatgtccgtttcaattttatttattttcaatctcacatattaaaaacggtattagtcaatgataccgtttacaatttgggattgaaaataattaaattcgatttttggcataggtgcgaatgtctgaacacacttttggggaaatgcctacttaaaaagagagattttcgtctaaaaattgtaaaaaaaaatttcagtttatgagtgacaaaatgaacaaattccaattggcaatgctcgacaaattggaacagaaagttagtcttaatttttttttgtttacaaaatatttatattaattttaaatttctgattcagctgatcagcgaacgccagcccaaagtgaatgagaatttccgtgaaattgaggtacagttgtttcttgaaaattaaaatatttttattagaaaaattaaatgcatttcaataaagttttctaaaattagcctatatgaggctttcaaattttgaaaaatagcttgctttttctaaaaatgggaattccggttatcacaaaaaaattttcaggcgattatcagcgaagcgattgatgcaaaaatcaaaacagccatatattatgtaattggattggccatcgccgcttttcttctcttaatgcgcttaaaagctaatcatgaagaagagagaagacgagaaatggaagagaatgaggaagaggagggaacacatcaaatggaagagaatgaggaagaggaggaaagaggagaaatggaagcgaatgaggaggaagagcagggaagagaagaaatggaagagaatgaggatgaggaggaatcacaagaaatggaagagaatgaggaagaggaggaaagaggagaaatggaagcgaatgaggaggaagagcagggaagagaagaaatggaagagaatgaggaagaggaggaaacacaagaaatggaagagaatgaggaagaggaggaaagaggagaaacggaagcgaatgaggaggaagagcagggaagagaagaaatgaagagaagaggaag

SEQ ID NO: 75911 - DNA, 331 bp, Heterodera glycines
  misc_feature (317)..(317): n is a, c, g, or t
  Genomic contig location: Contig_ID=SeqID_12315; Location=2371..2701; Strand=+
  SCN-specific regions: Sequence locations=1-113,203-331
atgcattatttttttacattttatttcatggttgttctttttcaacggattgatgcaattgcgcgtcccgcgacattcaatcgaaatattttgaagaataacagttttgagggtataataatttcaaaattcaaaaattattttaaataattatttaattttaaattttttaataatttaataaattattttttattttatagcaaaattgtcatccattctccacaatcatccagataaggaaggaacattgagtaaaaaagaagtcttttcaaacggtgttatcagaaaatgcctgaatatttttccgatttttntattcattttttaa

SEQ ID NO: 75912 - DNA, 5198 bp, Heterodera glycines; identical to SEQ ID NO: 12316
  Genomic contig location: Contig_ID=SeqID_12316; Location=1..5198; Strand=+
  SCN-specific regions: Sequence locations=1-872,910-1446,1469 -1810,1832-1954,1977-2143,2178-2341,2363-2378,2416-2422,2447 -3007,3043-3152,3174-3403,3425-3427,3451-3465,3505-3517,3539 -3722,3777-3822,3844-3886,3940-4502,...
  SCN-specific regions: Sequence locations=...4528-4622,4649-4788,4888 -4917,4940-4981,5036-5198
  Gene Ontology: Mol. function=protein binding; Cellular component =integral to plasma membrane; Biological process=regulation of myogenesis

SEQ ID NO: 75913 - DNA, 502 bp, Heterodera glycines
  Genomic contig location: Contig_ID=SeqID_12317; Location=74..575; Strand=-
  SCN-specific regions: Sequence locations=1-73,105-159,181-345,368 -379,401-502
atggctgatttaaagaaaatgaaaagagatacagaggcagagaaaaagtgagtaaatagagcaaagttaggactataaaaaattataagaaaaaaattttattacttcaaaaatgaattattggagggccgagtctaaaaatggtctccaaaaacggcatttttcaagaccatcaaataacaaaatgttttaaaagtggttttggaaattccgaatttaattaaactaagtaaattgaccacgctgagtccgaatatggctttagatttggtctctgggttctcaacaaacctgtagagcagtacaagctcagggttaaaagataggtcagatttaaggccatattcggagtctactggtctaatttgtacagaaaaccttcttttttgttatatcaggttacttttttgaccataaaaaaatcgagaaaaattagtgggctaattttcaatttttgcatggtcgggaaagcaaatactaaaaaattgcctaagcaaataaa

SEQ ID NO: 75914 - DNA, 1679 bp, Heterodera glycines; identical to SEQ ID NO: 12317
  misc_feature (1584)..(1584): n is a, c, g, or t
  Genomic contig location: Contig_ID=SeqID_12317; Location=1..1679; Strand=+
  SCN-specific regions: Sequence locations=1-175,197-208,231-395,417 -471,503-720,761-975,997-1470,1492-1534,1557-1679

SEQ ID NO: 75915 - DNA, 321 bp, Heterodera glycines
  Genomic contig location: Contig_ID=SeqID_12319; Location=535..855; Strand=-
  SCN-specific regions: Sequence locations=1-321
atgggtcttgtgcttagtgggaagcaatgttttacacatggtcaagtttacgtcgccatgtcaagggttacgcaaatggaaggcattcgtgttttttcaccgaatacctgcatgggcgataactgctatatccacaatgtggtctttcaagaattactcggattgccattaaatgcgtctacgcctactgaacaatttttcgacgtaaatggaaacaatgcaggggcgctaaatgaaattttgaatgatgagacagaagaattggttagtgtgcctgactttggttctgtgatggctgagggttcgagtcccattgctgat

SEQ ID NO: 75916 - DNA, 196 bp, Heterodera glycines
  Genomic contig location: Contig_ID=SeqID_12320; Location=182..377; Strand=-
  SCN-specific regions: Sequence locations=1-196
atgccatccgcttccgctgggacggttagcgtcagcaatggcaccaaggccaatggaaaccaaccgaacaaacacatgcaaatgttggctatggccggcccggctccgttcagcgactcgccggaggcgattgccattcgcgacgcggtcgactacacgcaaaagatcacgctggaaatggcatataacaacacgg

SEQ ID NO: 75917 - DNA, 489 bp, Heterodera glycines
  Genomic contig location: Contig_ID=SeqID_12321; Location=478..966; Strand=-
  SCN-specific regions: Sequence locations=1-27,49-365,388-489
atggacgccacaaattggcagccatctcaggaagagctcaatcaggttatttttttaacttggggaccacaaaacccatacaaaaaaaaacgatttagttgttaattatgaaggtggtatttatttgattctttttgtttttttcgcggaaaattttctttttgcaaatcaaaagggccaccctttttgttttgcaacaaaaaaactcaattttcggcccctaattattgtgattttatactcattatcgcgatttttccccatttttcagattgtctcacttttgcaacattctcagtctcctgacaaccaaatgcaacaacgagtccaacaagtgggttctgctggttttgtgtgtcgtttggtctttgattttgtcatttttaattttagcatttggaccaaatgaatgcacaccccgagttctgttgctatttgctctacattctcagcgaactcaccgaacaagacgtaattcattggatttaa

SEQ ID NO: 75918 - DNA, 230 bp, Heterodera glycines
  Genomic contig location: Contig_ID=SeqID_12321; Location=1844..2073; Strand=-
  SCN-specific regions: Sequence locations=1-77,102-195,217-230
atggactgctgctgcgtaagtgtaaagataattcacacccaattcaaactgtatttaattgtaggccttgtcaccagcagcggaagaagaaaaagaagcgcgtcaaagcaacgaaatggcgtctggcgcggaagtgaattaattatatctgagaaatggtcgatcacaccaattgaaatttgatttgatgctctcagaaatgcttttgttgactctttcattcgaataaa

SEQ ID NO: 75919 - DNA, 387 bp, Heterodera glycines
  Genomic contig location: Contig_ID=SeqID_12322; Location=60..446; Strand=-
  SCN-specific regions: Sequence locations=1-195,217-387
atgccgaaacgatccaaagcaggaaaagcgcagaaaaggcgttggaggaaatggagcaattttaaaaagggtattgaagaagcccgcagaacaggtgaaacgacacccgcattggtcgctgcgcacgaagcggcacattcaatagtggtcaaattgaatgaggacattgcggagagcttcatcagcaccaccatcattggccagaatggtcttgatggccaaacattgtcaacacggaggccgaatgaagactgcacgccagcgcaattgagagcagcattaatggcaacgatggccggcaaggccgtggaaatcaaattggtcggtgttagcactggccatgctgatgacctagccgacgctagagcagccgccagagaagtatga

SEQ ID NO: 75920 - DNA, 1653 bp, Heterodera glycines
  Genomic contig location: Contig_ID=SeqID_12325; Location=513..2165; Strand=+
  SCN-specific regions: Sequence locations=1-56,78-159,239-287,324 -425,448-463,485-1413,1435-1479,1501-1561,1585-1653
  Gene Ontology: Mol. function=furin activity; Cellular component =plasma membrane; Biological process=cell-cell signaling
gttctttggttggagcaacaagtggtgaagaagcgggtaaagcgcgactttcgcccggtcattcaccggcgacgccggcaccggcgcgagtcgtcctcctctttgacttccactgacgcgtcgacagagcagcagcaacagtcgctgtcggcgtcccttgcggcgacgctggcgtcagcagtgagtgaaggcggcagctacagtgccgttgttggcggcggcgacaacaccagcgacgcggtcgccgtgttacgtccacgcgctcgccaccacaccacgacgctgttgcagcgacagcagcaacgacagcgacaacagcagcacccattccgaccgccggtcattcagaacagcgacgacgaatatgagggggaggggacagcggcgggcgacgggccggacgactttttgaacatgaacaggtgggcgatgcgatgtgattggacgaatggaggaaaaccgggaaaaaatgtttaaattttattcaagtttttaaatttgacacgaaaatcccccaaaatggcacctattgcaaattaacgaattttttttagatctttatggaaaattttttaaaaaatggaaattttaaaacttgaaaaaacctacaaaaatggccatttttgagttaaaaatataacaattcaaaaaatttattctcgtgctccactggcgcctaatttttgaaaataatattggaaaaaaaaattaagactaggattgaattaaaatctatgtattgctgatttaatgatttttcttttagattttcttgaaaatttgaaaaaatagcattttaaaatttgaaaaatgaatttaaaaattcaaagaactaaccgttaaacaacaggatcagtcacaatgatcagcaccggacacagtgggcacgtcttcggtacggcgtgccaaacgacccgtactggaaggacttgtggtatttgcatcgacgggacgaacagccggacgaaatggatcacaacgtgaaggaggcatggtacctgggctacaccggcaagggcattgtggtgaccattttggacgacggattggagcgcacccatccggacattgggccaaactatgtgagtgttggttggcatggcacacactcatcatttaactaaatatttgccatacttttatagaaaaatttgtctgacaggagggatggaatttagtcgatctaaaaaaaatttttttttcgaaattgggtaattccgaggcctaaaaaatgcataaaaaattttctcgcagccctgtcaaaaagacaccgagttcgctacaataagttgagttttttttttaaagaaaagacgttcaaattttgcatcaaatgaatctgaaaaacaatggatttaacgcaaaaaatgatgaggcgcttcggatggggctcgaacccgcgactccttgtcccatagctcagttggtaaagtgggtgtgtatgtgcatgatgcgcacgggttcgattccttcccaccgtttttttttaaattattttttgcttttgtcataattgtcaattgttcatgtattctaatttatctctcctttttttcaggatccggatgcctcctacgatgtcaatgatcgggacgaagacccgaccccgcgctacgagtacacggacgagaatcggcacggcactcgttgtgc

SEQ ID NO: 75921 - DNA, 1886 bp, Heterodera glycines
  Genomic contig location: Contig_ID=SeqID_12326; Location=1003..2888; Strand=+
  SCN-specific regions: Sequence locations=1-6,29-89,121-138,160 -797,819-991,1013-1190,1212-1324,1349-1886
atggaccaaattttggcagaatttgaattcgccacagcttacttggatgatgtgatcatcgtaagccaaagcgtcaaagagcacgctgatcacttgaagaaagttttggaaaaattccaagaatggggattccggatcaaattggaaaagtgttcgtttttccgagaagagattaaatatctcggacaaatcatcgacagaaacggacggagaccggacccagagaaaatctcggcaattagtaaaatgcccgcacccacagatgtgccatcgctgcgttcatacctcggaatggtgaaccactacgagcaattcgtcaaaaacatgcgttttgtacgaaaaccgctagacgatctgctgaagcaggacagcgaatggagtggagtgaaaaatgcaaacaagcatttgacaaaataaaggaaattttgtcatctgaacttctgctcacgcattacgacccaacaaaggaaatcgtggttgcagcagatgcatccgaactcgggattggagcggtaatctcccacaaatttcccgacggaacaataaaggcaattgcacatgcttcatcagctctaacaccggctgagaaaaactattctcaaatcgagaaagaaggattggcactgattttcgccgtgcaaaaattccataaaatgatttatggacggaaattcacgctgctaacggaccacaaaccacttcttgccatcttcggaagcaaaaagggggtgcgtcaatgtagtgccaaccgactcctccgatggtcgctgatcctcctcgcatacgatttcagcattgagtacatcagcaccaatgattttggtcaagccgatgtgctttcaaggctgatcgcaaatggaaaaagcgacgaagaccgagtgattgcatctctccgatcagattcggaaattgacgacattttgatcggatcaattgaagcactgccaattaaatttaaggaaattatcgcagctgctgaagccgacaaaaccattcaaaaagtcaagaaatttttgacgaatggttggccaaggaacgtcggagacgaaagtgccgaaataaagctttttcatcggatcaaagaacagctttgcatcacgagaaattgcctgatgtacgccgaccgagttgtcatccccgaaaaacttcggcagaaaactcttcatgcattccacaagggacacccgggaatcaaaagaatgaagcagttggcgagaaattatgcctattggccaaatatggacgccgacatccaacagatggtagaaaactgccaaccatgccaaatggaagcaaaggcaccagttaaaagtaatcttcaaccatggccaaaaccatctgcaccatggcaaagagtccacatcgactatgccggaccatttttcggcaaggaatatttaatcattgtcgatgctttttcgaaatacccggaggtattcgaaatggccaccaaatcgacagcggcaacaatcgaaaaacttcgatatttgttcagccgacacggcatcccggaaattttagtgtctgacaatggcacccaatttacgagcaacgaatttgccaaatttatggccgtcaacggtgttaaccacctgttttcagcgccgtataatccaatgtcaaacggccaggccgaacggttcgtggacgcgtttaagagaacgtttcgaaaattgaaaggggagggagccccaagcaaggaaatcatcgaaactttccttgtaagttaccggactacgccaaatgattcgttgccgaacagcaaaacacctgctgaaatgtttctgggaagaaaaccccgcacaactttggatttgttgcggccgccaccagcacaaccgatcgaaagagacgtagaaatggcgagacgcttcaataagcgatag

SEQ ID NO: 75922 - DNA, 807 bp, Heterodera glycines
  Genomic contig location: Contig_ID=SeqID_12328; Location=384..1190; Strand=-
  SCN-specific regions: Sequence locations=1-340,371-400,422-471,495 -554,577-807
atgaaaataaatattgaatgttctgaaaagcaacggattggagattttatggtagggtaggatttggtggtctggcgctgatggaaagtatcgacgaggaaattttttggaatatgttcaatttattaacagatttggccaaaaaatagctaatttttttaatttaaacatttcaaaaaggcacaaaatttgaataaatcacagataccgaaaacccaagaatttttaatcccgtcttttgctcagtagaattgcgaagaattaccatttttaatacatttttgggaatacattcccaacaaataaaattaatgcactattattttgaaattgtcgactcttaaaattatatttatttatttttaatattctttcttcagcttagtttcactgagaaatgaaatgtctaaaatttttaccactttaacgttgaaaaaacgggtttggagtttctagtatgattttttttaatgactatttctgtgtttattttgacttttttttttttgcattttcaagagtttataaaaagccattccaatgaatttttgtaaaatttcaaatttctcatcatcagttgttaatttgtagcttttatgaatttgtttttgaagaacaaattcattaatacattcataaattttgtttcgaatatttttgaattatttcccgtttcttcttttcattttgcattttttgcactttttcttcccatttttctccaaatattttgccaaatgacttttgttgtaattttttattttctgattcaattggactaattagggcaattataattaaaataaa

SEQ ID NO: 75923 - DNA, 179 bp, Heterodera glycines
  Genomic contig location: Contig_ID=SeqID_12328; Location=1315..1493; Strand=+
  SCN-specific regions: Sequence locations=1-179
atgatttctatggtaagcaatcaatgatgttcggcaaaaacattttcaaacgcccttcaattaaaattaattcaggcccaaaattattttttccaagtttatgttgaatattatgcgacattcggattttggtcatattgcacgctttaacatccccttttacagatttaacacaacta

SEQ ID NO: 75924 - DNA, 328 bp, Heterodera glycines
  Genomic contig location: Contig_ID=SeqID_12329; Location=889..1216; Strand=+
  SCN-specific regions: Sequence locations=1-41,63-97,152-159,181-328
atgattgcaattccaattattcttatattctttgttcaaccggttatttgtttaaaaattttatgcttcatacacagcaaaatggtaatcattgagctattataattaaaaaaatttaaaagtatttttaataaataataattttaaaaatgcaaaagcatttttgtttagtttgaagcaaattcttttcttcaacaacaaccaaactgttcacatttggtcattaaagatttcgcaaaaattggattaaaggaattcaaagcggatttgaatgcacgttataaggcacaatatctgaagtgaaaattatacaataagaattaattga

SEQ ID NO: 75925 - DNA, 683 bp, Heterodera glycines
  Genomic contig location: Contig_ID=SeqID_12329; Location=1541..2223; Strand=+
  SCN-specific regions: Sequence locations=1-67,89-205,234-394,431 -475,497-619,641-683
atgtcaccaaaaaatggcaacacactggtctttcccattggcattgaagggcagaaaaattttgttcaaaaattaaaaagaaatttacggcatctccgttctttgaacccattgactggaaagccaatttttagcggactattttttcgtgccggttcgttttcaattttttttttagaatcatgaattaaacttgagtgacgagtttattttaacaattatatattatttaagctatttttcaaacaaaaaaaattgcgaaaatttattactagagattttaagaaatatttaacccattggttatgcttaaaattagcgaatttatctatattttggggcggagttcattttccattttttttttgagtgtttcgaatgatgaaaaatttcgattttattaattgattttaaatttaaaaaaattattccgttttttgcacctcctttagctgcattccaaaaagaaggcgaattttttggctttttccctttattggccaaattacgtgaagaaaagttgcgcaaaaagaatacaccgtcgtttggtgaatttatgcttggcattgattcccattttaatccgtacaccatcggtttccctgctaataagtcaattgccaatctcattgacattttctacctttccatgatgtcagacggtttgatcaaggtataaaaca

SEQ ID NO: 75926 - DNA, 682 bp, Heterodera glycines
  misc_feature (21)..(21): n is a, c, g, or t
  misc_feature (85)..(85): n is a, c, g, or t
  Genomic contig location: Contig_ID=SeqID_12330; Location=17..698; Strand=+
  SCN-specific regions: Sequence locations=1-204,259-393,430-474,496 -618,640-682
atgtcaccaaaaaatggcacnacactggtctttcccattggcatgaaggggcagaaaaatttgtttcaaaaattaaaaagaaatntacggcatctccgttctttgaacccattgactggaaagccaatttttagcggactattttttcgtgccggttcgttttcaatttttttttagaatcatgaattaaacttgagtgacgagtttattttaacaattatatattatttaatctatttttcaaacaaaaaaaaaattgcgaaaatttattactagaaattttaagaaatatttaacccattggttatgcttaaaattagcgaatttatctatgttttggggcggagttgattttccattttttttgagcgtttcgaatgatgaaaaatttcgattttattaattgattttaaatttaaaaaaattattccgtttttttcacctcctttagctgcattccaaaaagaaggcgaattttttggctttttccctttattggccaaattacgtgaagaaaagttgcgcaaaaagaatacaccgtcgtttggtgaatttatgcttggcattgattcccattttaatccgtacaccatcggtttccctgctaataagtcaattgccaatctcattgacattttctacctttccatgatgtcagacggtttgatcaaggtatagaaca

SEQ ID NO: 75927 - DNA, 2161 bp, Heterodera glycines
  Genomic contig location: Contig_ID=SeqID_1781; Location=4838..6998; Strand=-
  SCN-specific regions: Sequence locations=1-38,67-108,131-144,176 -245,267-464,486-489,521-730,752-800,828-915,949-1004,1033-1319,1380 -1783,1867-1877,1944-1972,1994-2161
atgaaaaacaatttggtaaattaaccttaaacttctaactgttttataacaaattactaaatttgtgccttgaggcaattttaaaattgccgaaatttttcttaaatccccattaattcattaattaattgtcatctgttgcagaacaacaacaacggcaacaacaacaataacactaatcaaacacaaccggagaaaacatcgccaattttgctaccaccatttttggcgtctacagtaatgccaccagctggtgaagaaacgagtacggtggtggatcagcatactgtagatggactgacattgacagaggaaaagcctactgtggacgggagaggaccaatgaacagtacaccggcagaggaaaatcatcatacagtggcaatggaaaatcatacggtagacggaggaccaacgcatactgtagtggacggatcgtcgagtcatcaacagaaaggtgatcaggaagaccaggatgaagctgatcaccagcagcagggggaggaggaggaggactatgccattgatgatgatgatgatgaggacggcggttttggcactttgatcggactggctaacagtgaaacaacagtttcggtgtgtgctttttttgtgccgtacaaacaaatttcctacttactgtactcaaaccattttatttgtttttgtaggggtacggtattttgttgcttttgtggagcacagttaataatcccttcaaaatttcaagcatgaaatctatgggaacaattaaaaaaaaattcaaaattgagtgagtaatttcaaaaaaaaatttcgccattttatttttatatttttaaaaaattctctaattatgatgggtttattggtattagagaagacgggatttcaatacttaatcatttttcgcactaactcaaaaacttcttaatcaaaaatttagaaaaatatataaaaaaaaaaaatccgaaaaaaatcctgacttacctaactcagcgccaaacgggattttcaaaatcaggattttataataaataatttgtttaaattgttggattctctttaacattttgaaaaagccctaatgatatagggaaatcccgagcttccgggcaaatttggcagaaaaaaattaaaaagcattgcgtcactccttaattgcttcaggcggtgcccaattgttcggaatgtgccaacggggccaaatgtgtgcgcgttggccaacgaattcggtgcctttgtggcgctgactttgccggcactctgtgcaacatcaaaaagccggtgggtcagattaataactaataaattcttctcatatttttttcggtaatttctttttttaaataatttttttacaatttaaaattttgcattttttaagaaatttattaaaagcaaaaaaactatttttgtgcctatttaatgcctatttcgcgattttttgtgcctaaaaatgaagcactattaatcagacttatttttaggtaaaatccgattttttttaaacaatgtcagattatttgccttaattaggcctttctttgataaatgccacagccgtcgcactttcatgtacattttcagctttgtgccgcgctgaagtgccacaggccgggcgagttgtgccagccgatccggggacagccgggcggcaaaaaggacatggcacattgtgaatgtcagctggggatgggcggcaaacggtaggcacagaacacaaaaataacactactactgtatttttaatctttttatcgtatttttcatatcttttatttagtgccaattttttaaggcgtattaatttaatttaaaaattaaattaatcattaatatttacaaatttttttctaattagtgtttttcttttttaaaattattgaaaaaagaaatgccacgacccgggattgaaccggggacctttagatcttcagtctaacgctctcccaactgagctaccatggcgacagtaaatgttgtcttacagttttctaaaccattttctttttaagaatatcaacaagcacaattggagaaggaaattgaggaattgtcttggaaggtggagcgtgccgagcacacggacagagccgagttggagaaccaaatgcatgttgcggagctgaaacggcgcactttgctgcaggactttttcagttagccgcagagcaataaa

SEQ ID NO: 75928 - DNA, 2457 bp, Heterodera glycines
  Genomic contig location: Contig_ID=SeqID_1781; Location=2004..4460; Strand=+
  SCN-specific regions: Sequence locations=1-59,82-101,132-353,383 -633,655-714,736-747,776-790,814-843,910-919,942-989,1028-1207,1280 -1330,1375-1401,1423-2206,2228-2457
  Gene Ontology: Mol. function=transcription factor activity; Cellular component=nucleus; Biological process=chromatin modeling
cccggcggccgttaggaccgccatggagatttgggtctagtttgttaggtatttttctgaaaaattttaatttttcatttcgagggggtagcaactgccctccctggttgggcctggagatgtcccccttcgacccaacgcaaatagtcaaaatgttttcccaaaaagttgcgacacggacattctgttcggccgtctcaacgggctgtccacgctgttggtgctgagcggcgtccattcgttggccgacgcggaacattttcgtggccagggccagtctcagcttgtgcccgagttttacgccgcttcgcttgccgaacttttgccaccgctgtcagtgcctttggggtggcattaatttttgtaatttttttaaaattttgcttttccctttagcaccgaacaaaatgggccagcaaatgctgtgaattgaaagaataaatgccatccatattttatcgggtcactattttcttcatctccctgaactttttttgttgtgtttacttttaatatatgtaaactttcgcgcaaattgttttgttattgtttttgattaaacacttggtaaagataaagaggctgacttctgaacttatggaggggtggaagctttgtaaaaagcaataaaaatttatttcttgaatattacaattttgtacagaaaattcttttaaaaaagcaaaagttactgcaaagtctgggttcgattgatgttgtttgcctcttttgttttagctttcactcgtttgtacattgtttgtttttcttgaatattttaattttactcgctttaaattacatttctttgttatgataaatggcaataatttgtcgccatggtagctcagtcgggagagcgttagactgaagatctaaaggtccccggttcaatcccgggtcgtggcatttctttttcaaaaattttaaaataaaaaatagtctttttttacaagatcatcaaaatgagcttctcttctcttcctgtgaaataatttatttttttaaaacgataattaaaatttttctcaaaacaaaaaaaaagaatgaacaatataatttgtaaacgcacttttcgcatttctccaaatttgtttgttcagtcataatctgctgatttgttaatgacaaataaaaaatgcgttttcccttcgtgtgttctcaaaattttcttcttttcagcaggcataagggcgcgtctctcatcggtcctatggtgtagtggctatcactctggactttgaatccagcaaccccggttcgaatccgggtaggacctattcttttttgttttttaactaatttgctttgaattaaatgtgtgtcttatttgttagtaaattaaataaaatgaataagcattttaatttgaaatttttacttctaaaacaaaaatcgaagagaaataaaagaacattttgaatcactaaaaaaagagttgccttttcgtctctatcccaaagtaatttacaatttctctttttcattggaattgttgccggttttctcccgtttctctctcattttcctcagtttttctttcctttttgtccatactttttgaattcttttgtgtgatatttttatttgtcaggtgtcaaattcgcttttcatttccgtttttgctataaaaatgaccgttgaaactgtcccggccgatttgcgcaatttgcgtgcgtgtctcgtgtgttctttggtgagttttttcgcttttttaatcaaattattatcctacggttcgcgaatggcattttcttcaaaagtcgacaaataattcggtggtaaatttttaaggtcaaatcggaggaccaattcatggcagatggctgcgacaattgcgaacgctttttgaatatcaaaggcgacattgacaagtgctacgagtgcacgaggtttgaagaaaacagccaaccctttttagattaataatttaccaaaaatggattttgctcgaaatttttgggtttttttttgttcggtcatacttaaaaatagggtttatttatcaggcctttagtttgtttctaatcaccactattgttttcaatttggttttcagtgccaactttgacggaataatcgccgtttgtgagccgaacgactcgtgggtgtgcaaatggcaggtcaacgaacagggagagggcgagggtcaatttgcaacaaagcaaaatcatctcttttattgggaatggatccaaaataatccaatttgaattttgtggaaattttccaaaataatgcattatttttggacggtttttgaattcgaaaaatgggataaacagcagtttttatgcttaaaaatccaattacaaaatacgaatatttaagaaaatcaaccgaaaatgccctggcatttatgctgtatccgtgtcggggaatctgccaaaacacgtggtggccgagttaagccacatgggcatcaagtacaagtcgggccaacgcgacaaatcggcg

SEQ ID NO: 75929 - DNA, 433 bp, Heterodera glycines
  Genomic contig location: Contig_ID=SeqID_1782; Location=2339..2771; Strand=+
  SCN-specific regions: Sequence locations=1-33,55-228,250-282,304-433
atgccattaaaaacaatgccattctcggcactctacccggttttggcaccccagaaccatatctacccaccttcaaaaccgggcgggcattggcactcaaaagtgccgggcaaattcacacatttgcccccattttggcacgggccgcgcaatagcgacaattcgcgtccaccaccgacatcatcaccaccaaaagcatgtgatgaagaagcatcgacggtttcggcacttcggcccacatttgccccttggcactcgtcgatgtcgtcggcacagtgccgtccgtcgaagccggccttgcactcgcagacaaagtcattcttgatcagaggaacattgggatgggtgtttttttagtaacttagaactaaaattctcgcatgccccggggctaaatttctcttgcactcgaaaattcatgtgagagtcaaga

SEQ ID NO: 75930 - DNA, 1003 bp, Heterodera glycines
  Genomic contig location: Contig_ID=SeqID_1782; Location=779..1781; Strand=-
  SCN-specific regions: Sequence locations=1-177,208-353,380-483,508 -630,655-818,840-1003
atggcaagtgcaaagacatggacaaccgcggcaactaccgctgcatttgccatgccaatttcaccggcacacattgcgagacagaatgccaaccaccgcgcattgtggcgccgccaaatgcatcgtccggcgctggcggtgcggaatgcgtttgccctgcggggaaaatggtggcgcatttaaaataattttaaataaaattttattgcattttttatttggattaattggggcatataactaataagtggcttaaagtgctcatagccgtgtattaaatattaaagagataatagaggagggcttaaaatgccaaaaaagcgtcgtaaaccaatgaatttcaattgttttagattttttaaattattatttttttttactttggcaaatttaatatttcttaattcttcttataataatgatctgaaacttaccaaaaattaagtcaattattaaaaaaaagcagcgaagataatgaatatctattttttaattaattattttttaccggctttttttaaacaaatttgaatcccacaaaattaaagtctcagaaattcaccaatcttcggagggcttatactacataaaaggaagaggataattaatgtttgggccccagagtttttgttttaatattttaaattatttttaccctctttttacaactttaatccctcaaaatttaggccttttttaaattcatctttgatcattcataactcttccgaaaaatggtcaaatgttgttccgaatttttggaaaattgtttctctcccaatgaattggtgttcaaaaaattgacatttttttctggcatggcattttgccaaaattatgcaaataacaaaaagtgcgttttaagggtgatcactgtgagttggatgtgatggcagcagcaccgtgtgccggagaagatggcagcgcaaatggccagtgccaaaatgggggccaatgtgtgccggccggcacaaaagcattttgtatatgcccgacggggtaa

SEQ ID NO: 75931 - DNA, 868 bp, Heterodera glycines
  Genomic contig location: Contig_ID=SeqID_1782; Location=2798..3665; Strand=-
  SCN-specific regions: Sequence locations=1-465,487-627,649-675,697 -697,721-758,811-868
atgtggcgaaaaattagtggaagacgtggtcgcagaagtggacgattgtcgtcagagttcgcgtggatgtccatttgcgcatgtttgcctccaggacccggagagcggcgagttccattgcgagtgcgtattttacaataattgactactcgagagtcttgacatggtgaaattctcgagtgtttttttttgtggcagctcgagtcttgacacgagagatttcttgaatttttttggggttgtcttagtcttgagaatctaggggacgactctcggtcttgaatctagaaaattttgactctcgactatcccttattaattaatattatcccgctgaggggattgattgatcgagaccataaacatttgttttggttggtcggaaattagctggaatctcgaacctaatctagcctgaccaaatcgttttccgggatcactggcatttggctccactaattagccaaattttaatttatttttattgccttggtaatgaatggttaatcaaacaatacaaaacaacaatacactaacaatttccctgcttaatagaaggaatttgtgcttgcgctggggacagtcgccgtgtgccaacaacgcaacgtgccggccaattaaggtggattgattgagatgaagaggagtgggaattactaagaaaagtttctcgatggtaaatttggttttgtttttcaaattttttattaaattatttaagatttaggtttgaatttagtttttttaaatttcttggctattttattattaattagaaaaaattaaatagaaattaataaatattttttagggtttgccaattaataggaggatcatccattttaccttcttctttttttggttttaa

SEQ ID NO: 75932 - DNA, 643 bp, Heterodera glycines
  Genomic contig location: Contig_ID=SeqID_1783; Location=1039..1681; Strand=+
  SCN-specific regions: Sequence locations=1-206,259-308,343-354,435 -494,528-643
atgcagaagcgattgatcagttttgttgtttggttgttgatcagcccagccatcacatttttgtgagttttgggagggcgacgaacaaaaaaaaaaaagaatttatgcgaaacaaatttttgtgcataaaaatgcgacaaatttttattgggttggtggcggacgaccgacggacggacgaacgaacggaacgacctttacgcggcaataaaatttttgtgtttaattaatttaattaaatattgtatatataattttggaacaaaaatgcggcccaggaaaaaaatggaataatttttcaattatttaaaatgcaacaaattaatttttaaatgagttcataaatttatacgcaatttttacaataaattttatttttaaggaaaattaatcatgtttaaaaattatatttaattaaaaattattaatttttaggttttgttttcgagttttgtaattatgaagtcgtttatcccttggtactaaacaataggattttttgaaaaaataattaaaatattttatttgaaacatatttttgaggataaaaaggaaacgaattcgcttggataaagcaaaagcaaatatttggttgggttgtgccatattaattacgccccacggtgggcaattagaaaaatta

SEQ ID NO: 75933 - DNA, 237 bp, Heterodera glycines
  Genomic contig location: Contig_ID=SeqID_12333; Location=159..395; Strand=-
  SCN-specific regions: Sequence locations=1-13,63-237
atgccagtaagtgatttattattaaatttattattttaatttaaatatttttataaattttagctgcgggacactcgtctaatgacaaagacattgaatgtccagaatggcaaattcgcgaagtgaatgtgagtgccgaatttggaggtgacccgctgacagacgaaccgccgttaattcgagctgaatatccgccaattttagcaaaaaatcgcagattattgaggcaaaaataaa

SEQ ID NO: 75934 - DNA, 316 bp, Heterodera glycines
  Genomic contig location: Contig_ID=SeqID_12334; Location=599..914; Strand=+
  SCN-specific regions: Sequence locations=1-31,77-288,310-316
atgggccggtgtgcgcggaaaatttgccaacttttaaatattttagaataaaaatttttcaataaaaattattaaagatcggtaattttaaatttgcagatcccgctgcggtattggaattcaaaatttttgcgggattactggtggacaagccgtgctggacacgcggacacgttcaaccacaaagtttggccatttatcatcggcggagatttgaattcgaagtttggagtgcggggggaaaaattggatggaatggacgaacggatcggccataattcggcctaattaattgaaattaaaaattgatttggta

SEQ ID NO: 75935 - DNA, 511 bp, Heterodera glycines
  Genomic contig location: Contig_ID=SeqID_12334; Location=1479..1989; Strand=-
  SCN-specific regions: Sequence locations=1-82,106-511
atgacttgcaaaaagttgacaaactttgaaatggcatggtcaatggacgaattgccgaaatgcgaaggtcaaaaaagaaaacattttttaaattatttaattttagccaaaacagaaagtaacggcatttgtgatatgtccaaattcacagcaaattccaccattttgctgagtccgtcccgcgaaagtgtacctgaggggcaggaagtgtcctttgaatgtgtccaaccaaattacactctgagcgatcggaaagcgcggaaatgtgtaaaaagttaggttttaaatcattttgaatttaatgtcatgcgcccagtttttagattttgtcaggagggcagtgagagaagcgatggccgatggacagacgcagccgatcactgctgctgatcaaacatccgaatatggccaattagacgcactggtcagagcagcaaagcccgagaaaggcgagtcgattgaaaagcgagaaaaacaacagccgattggtgctgatcagtgccttctttag

SEQ ID NO: 75936 - DNA, 1626 bp, Heterodera glycines
  Genomic contig location: Contig_ID=SeqID_12335; Location=52..1677; Strand=-
  SCN-specific regions: Sequence locations=1-332,358-606,628-1100,1147 -1205,1232-1626
atgcaaaactttcccgctgcttctgctccagcttcgtcctcttcctccacaggctttggcataagcggcggtggttgtgttgcagttactgctccatctccaacattttcctccactacagcgatcacatccgtgccgcagcagcagttcatccacccaccatacacaactgcgaattctgtcaccaccgtctcgccattgtcgccggccaagcaccagcaacatttggttgttgaccagtcggcacaacagccgcaaaaacattaccaccatcagcaacggcaccccaatgtgccctttgcgacgccacgtggagatggcacaacaatggttcatcagcaccaccaccaccatcgtttggctgctcatcatcatcagtacagttctcatgggatgggaatgggccagccgctggcgcgccattcggcatcacttttgccctcgacggctggtcagagtttggaggatttggccgacttggcccaggccagctccagcttgttgcaacatgcgacctcttctttgatgcggtcaacttcgaccgcctctgggccaccatcaccgccgtcacaatcatcatcagctgctggtgctgtaaatcatcaacaacagctacaacaagttcagccagtacaaacgcaccaacagcagcagcaaccaacaatgcatttcaaagtggtggcaaccaatgacaatggcagcggcactcacaatcggccagaaatattataccacccgaaagaatatcgacaacaagttttcactgtccagcagcaacgggaggaagaaggtccgtgacaaatcggatagaaaataaacatttcaatagaaaagtttgaaaaaaacatatggcatttttatattgatggtttttttttcaatttagcttattgttagctatttaaaattgttccttctcccaaaaacactcactttttggcaaatagagagcaaccacttggtttgaatggggaagcctatcactctctctgtgccttgcttatggggtatttgtcgtatgatttactcattaggccacattcatttttaattttccacgctttcagcaaatataagaattgaacagcagcggcagcactatccgctgcaacaccaccgtcctccggtggccaaaaagctgaccaagaagcaaatggcgaccatacagcgcgagttcaacgaactgcttccgtttggtagcaccagtggcggtggtggtgcggcagcagcaaatgcttcaactctgtgccagcaaatggaaaaagcggtgaccatcgatggtgacactaaactgcttcaacaacagcaaccgaagaagcgagggcgagcatccaaagagacgatcggagtgagccaaaccaatccaaaaaattctttagcattttgttttatgggaaatatgtattagttttttagtataaagtctcccatttttaggtaattccaacaaaaaatgatggaactgacaatgatgggcttgctgctgcggaccgacccgcacgcaggtcggcatctaccgttggagctaaaagaagtgccgaagctgatggtggacaaaaattgagcaacgaaggaacgaccagcaaaaagaagcgcatttgggagggggcagactatgtgacgtaa

SEQ ID NO: 75937 - DNA, 388 bp, Heterodera glycines
  Genomic contig location: Contig_ID=SeqID_12338; Location=259..646; Strand=+
  SCN-specific regions: Sequence locations=1-5,69-388
atgtgtttgcttattattttgtgcttttgcctctttttctttcttttcttttttttctttgcctttttcgaaaagtgccaaaaacgaatttttgaattccctggggacaaaaaaagcaatgaaagaatggcaaaagaagaaaaagcattaaaaagcgaaaggaaagaaacaaatggaaatccgccgaaagaaaaactcaatttcagaacgaaagtcggaatgacagcagggcattttgagtctgagctgattggagtgtgctgtgagctgtgagcgataagaaaagtgggcgatggacgcaaaagaaatgggcaaatttaattgcccatttattaatggacggattcttactaatgatcgaattaattaattaattggacaaaaagaa

SEQ ID NO: 75938 - DNA, 2360 bp, Heterodera glycines
  Genomic contig location: Contig_ID=SeqID_12342; Location=341..2700; Strand=+
  SCN-specific regions: Sequence locations=1-94,116-171,193-251,274 -274,299-429,461-634,657-804,843-1087,1109-1214,1236-1267,1315 -1710,1760-1864,1886-1911,1938-1964,2006-2238,2272-2360
atgcgcattactgatcgcattcggacatttgagcaaattgtgaccgaaattgacgtaagcgtttgcaaaaataggaaaattggttgctaatgccaataaaaattgaaaattttttgcgggtggcgggaaattggtgcaatagcaaaaattcaccatttgccaaatttcttgccccaccccctaacaaaaaatggtcatttttttaattttcacccttttccgtatttttaaaaattaattacgaactctccattatttttcgctaccctaccccaaaaaataaatatatatatttttacttttttcaaaattctcaccctcccccctccacagtttttagagcgtccaattttgtatttcaccctcccccctttaattttttttttctataacctgcctcaaatattttcacccccccccctccatccgttttttcaaattttcttttaaaatttgccaaccccttcctaatttttttaaaaatttcctaccccctctgattttcagtttctttacactgtgtccacggaagtgccgtcggcactctctgatgagcattgggtccaattgttggacacggtcagcgctgctgaacgtgaacatttgctgcgcaccattcactacgcccagctggtggagaaggcggcggccgcggaacgccaaacactgaaaaatggcacaaaaacggtaaaaaatggaaattttttgaaaaatttttttttgaggacgaccaccatatagaaggtcacgggattatctgggtcagttcaggaacgattctcgaattttggatagcaaataacgaaaaaaaaatttttttaaatttaaatacaaaaaattttccgccgttttttttttcgtttttgagtccttggcttggcgttggctgtccggttctggcaaaatgtacaaaaaaaaaggctcccttttccattgattggcatttccgggggagggggccttgaaaaatttccagtaagaattttttttttttggtcgacttgaaggaaaaaggactaaaaaattgccaaaaaaaatacgggcgccaaattttttttacattttttttctgttttttttttacctaatttaaactcatttaaaaaatgcgcatttttttaaagttggacgtcattgctggagttaatgatgatgatgatgatggttgtgttgctcattcttcctcctccgccacaacagcaacaaactctccaaattatcagcaaatgtttggcgacgaattctgtgaccaaagcgcactgaaaagtataaaatttattttcaaaaaaatttttttttttttttataaattttggccaaaaaagtaatttttttttaatttatccccaaaaagtgcgataaaaacgcatttttgtgcctggaaataaattttaaaatcgaaatttattttcccacaataaaatttagcatgaaaaagttctaaattcaaacaaatttttaccgtttatattagtaaaatgggaaaattcttgcaaaattttattgtttcagcagactttttttgcgtgcatttttcaaatctaaaaaatcgctttttttaggccgaatggacacacatttcgggttggcattgtgccgcaattttttgctggagccctccgatcgaatgcccaatttattcgtggactgtcgctttatgtacgcgcacaaaacggcgcacattctcagcgcggcaaagtgagcgatagcaaaaaaataattaattaattatccaataaaaataatataattaatttttgtgccggaaaaaaattttggaaggaaaaaatttcaaaattttttcaaaaccaaaaaatgttgcaaaatttttcataaaaaagtgcatcactttttttaagttagcatgtgtttctttatttaaatagcatatgatttttttactttctcgactttattaatttttttaaaaattttaagagttttttcctttggatcaaaaatttgtctgtcattatctttattttcaaaattaattaccataattaatttgttaattgcttttaacggcgtgtcaaccaattgcacatgacaaattggacgagttcagcaccatttcccgttaatattgtcaacttttttgcggacgacacagtgaatcgaattgtcaaaaagtttatttgtttttatgccaattaaattttatttttccaaattttagccaatggcactttttgcacggcacgccaaatgaacagtcaaaggaaatgggcggcggggtaattaattaatttttattatttttgtaaatatgtttcagcatttcgtgccccacccattcgcaccgcaagtgaccacgcgggggctaagcgaaatttgtgaacgcaattccatcccaaaag

SEQ ID NO: 75939 - DNA, 214 bp, Heterodera glycines
  Genomic contig location: Contig_ID=SeqID_12343; Location=62..275; Strand=-
  SCN-specific regions: Sequence locations=1-69,91-214
atgaaaaatttaacttatttttttgtttctattctctttatgctgcttttgaagcaccaaatttttgtcgatgggacaaaaacagggaaatccgtagaagcgaagaaacgaggagaaacattgggccaactgaaggccaaggaaggcaaagataaagcggagaatttacaagcagaggaaaagcaaaaaaagaaaaatttgggggatttaataa

SEQ ID NO: 75940 - DNA, 2369 bp, Heterodera glycines
  Genomic contig location: Contig_ID=SeqID_12343; Location=382..2750; Strand=-
  SCN-specific regions: Sequence locations=1-84,116-255,291-1088,1122 -1186,1208-1263,1286-1369,1395-1502,1530-1583,1750-1761,1784 -1879,1908-2039,2096-2369
atgttttcaaataagcgcaaatgttctttcaatcccgattgggaaaattccgattggctgttccgattatttttaaattgtttgttcttcttatttaaaaatttcagcccatattttgcataatgcagcaaaaaagggtgccgaacaattgcaatttgacattgagtccgtcgtttacaaattaacttcatatttcaaaggatcaacgcaaagacacaccgaatttcatgaaatttgtgaccaatatgaggtgctcaattttcaaattttaaaattaattttgttttaaagacgacttttgtaccattgccaactcatgcacccacacgttggactaccctatcaaaagtggtcagccggatgttagagaaatggcaccaattaaaagagctttttgcaatgccgaacaagccgcgtgttttacatgaattttttcaatcggaaaattctgaaccaatttgttactttttacaaaatgtgttgaagacgtttgatgagcccattttggcattacaagttaacaattatttttttaattaaggtcacaatgtttttacagaaatcaaatttgatgctgccggatttaatcagtattatggaacaatttcgtgccaaaattaaaggtcgtttgcacggcactggaaattcgggaaggccattttttggaggacattttgcgttgcgccgtgcatcaacggaacttgaaaaagatttttgcgtaaaattttttggtatttttgttttattaatgcatttttttaaagaatttttacaaaattgtgctcaaatacattgatcgctggttccaactccaattactaccaaaaaatatttcatggacaaatttacaaaatcatcctttgaattctgcagaagttgtgcaacttgctgagcaaatttgtcccgaaatagcgcaattggatgaactgtttgatgaagtgtctgcggtgaaccaaacattggccgacattcccgaagaattttggctcaaatcagccgaagataaatggaagggcatttttgaggcggatggtgcaacagaggcctatgcaaatttgtatcgaatcgtcagtgcagctttctcggtcattaaaaaataatggataaatgaaaatttattttaaagattccgacatccaacgcattcgtggaacgagttttttcactggcaagcagtcaatggaccaaagaaagaaatctattggaagttgaatcagtcaaagcgttgctactggtgcaggtgaactttgatctcacgtgcgcggaaatgaggaaaatgatcaatggaaacaaaaaaatattggaaaaaatccattccggtgaaaaatacaagccatttgaattaatattaaccattttcattgcatataataaaaattttaaatgtcctttgaatttcatgaattttccccactatgtccttgcaaatcggcatacccgtccttggaaaccgacattgggcgatcccatccctgaattagcacaatcatcatcccattctctaatatttttaattaaattattattttgtgccctttgtctgtgggtcctttgcctttgtgggtcctttgtcgtgggtctggaaaaaaaatttaaaaaaacagatttttttattttttttttaaataatttttttttacacctgaaacttcaaaaaaaataaaaattaaattaaaaaaaacgattttttttttaatattttttaaaattaaaaataaaataacaaaaaaaaatttactttaaaataaagaatttcctttgactgtgggtcctttgtcactgcggcgctctatccacccacaaaatttcattcagaaatcccacggacaattgaggcccttcctttgtaagtttgctccatttataaattcacttttaatgactaaattatttttatttttcaaataaactttcttaaggttgcacctttaaaaaatctttaacctaataaagcattgaaaatcaattcatgtcaatcacatatcacatgtgcaattttttatgaattgacatttataaattttccacattcattcttcaatttaatctaaattaataatttaaaaatttattatatgaaaattagtaataaaaaccctattctttgttatttaaaaaactggtaagaatagatagaagcgaaattttgtgattaaagggcataattgcagcatcaacccctgacttgggtcatgaatccaaataaatgaaaaaattgaaaagaatttttgattttttataaaaacaatttaaggaaagtgaacaaatttttttttgtggggatttcctagcagttgtattctccatattagcaccatccaatgataatcctaaatcaaatctatgaaggataattcaaaatcaataaa

SEQ ID NO: 75941 - DNA, 417 bp, Heterodera glycines
  Genomic contig location: Contig_ID=SeqID_12343; Location=3736..4152; Strand=+
  SCN-specific regions: Sequence locations=1-209,248-417
atgctttttgtccgggatccttcgggttcagtttggaatacggatcctggcccaagtccggattttcaactccaggttctacgtatccttaccaataacgaccagtgttgcgaatccatatttttttttcacgtcccgcggcaaccccttgaaaattatctcacttacatacttttgttgataagaagaaaaatgtaattccaatatagaaattaaaaataaaaccaaatttttagctttcgtttttaaacctgctatttttgttacaagcatcaaaattatattaagctattacgaacaattaaggaaatctgtaatccttcgctatggaacacatgatatgatcgtttttttcttctatcgtttgaaaaatttttgatttgaaatatcatagccttttctgcagcaaatcaatta

SEQ ID NO: 75942 - DNA, 1705 bp, Heterodera glycines
  Genomic contig location: Contig_ID=SeqID_12347; Location=1..1705; Strand=+
  SCN-specific regions: Sequence locations=1-79,102-174,235-370,392 -440,469-661,686-708,737-755,779-849,931-931,954-1065,1092-1176,1199 -1252,1276-1291,1314-1423,1493-1552,1575-1599,1622-1630,1652-1705
tttctacaaaaaatcattaaaatgactaattattaaacaaatatatttttttggaattcataattattattagtccatgtttattgaaaagatggaatttgcttatacaaaattttgaaaatttttaatcatgaaaattgaatcaatttttatatttagtcattaatcacttcctaattaatattttttgaattaattttatatttttgacatttttaaattaataataatttagcttaattacatgttcgaggtgttaatgccaaaatatggcctaaatgacaaatttttgattttactcgaagaggaccatattgtggcaccggattttttgcatacacttcaattgattgtcaaaaatcgtaaaaagtaaataaaaatattttttaatcctaacaattttttttgtaatttttgaattttgggcaattattttatggtataaattaaaataaaaaattaatttaagcatttgctccaattgtgaaatgctttgtcttggaacatatccaagcacatttgccaattatgcggagaatataaataaattgggtgtcgaagtgtggttcagcagcaagaacaatttgggccttgcaatggaccggcaattatggcgacaaattcaaaattgtgcaaaggttttaaaataaattttgacttttacatgaatatttttaaatattttgtgagaaatttttgtaaaaaaggttaaataatatatatataaaaataaattgatactaattggaaattcttaatttgtttaatcaaaatattaagtaaagagtttaaataaaatattgcttaattctaaacttttttttcattctgttcaccgctttttcatactttttattaaatttttaatttttaatcaaattaacaaataaattaattaaaattagaaataaaatttaaatcattataattcgctgcttttcctgtttttctgtacatgggacgattacaattgggattggaccttgttgcagttgagcattcaatgtttgcccaaaaggtttgaagtgatctacaccgaggcaccacggtcggatttaatgacacattttaaaatatataaaaataaaaatgtcattaattaaaggcttggtcctaattaaacattaattaattgggttacaatttattttactattaattaagggtaattcatgtcggtgactgtggcgtgcattggcacaaatgtgagaacgatcgccgatcattggaccaggcattgtcagcttgatcaattaattgactaattaattaatgtaaatggtaattatcatttatttttgaagggatttgttcgatagagttaacgattcatttttcccgtcaaaattggaagtgtctcatgtcaatgggcatatgaaaggtgttccgtccggaccaaatggtggttgggcggatccaaggcaaattttttttaaataaatttccgaaaaaatgagatatttaataaaaaataaatttaattataaattttgggtacttttccgttatggggccgcactttcaacttttaaaagtgcggcctcataactggaaattgccaattttgtaaaattagaccagaattcttgacaaaaaggcaaaatttcaaaataatatgacaaaaggaattttactcttttttaattgtttagggaccacagattatgtgaattgaacactcatccatcagctgatgataatcccg

SEQ ID NO: 75943 - DNA, 752 bp, Heterodera glycines
  Genomic contig location: Contig_ID=SeqID_12347; Location=1770..2521; Strand=-
  SCN-specific regions: Sequence locations=1-382,412-598,620-752
atgcgatacattggtgagagcgcaaaagcaatttcaagcgtggttggttcgacagttccatttggtggcggtcttggcttcccatttggcagtggtgggaccacttccggcacgccattaaggcgaacggccagcagcggcgcaaatcgtcataatggcctggatgatggggcgatttctggcacgccattaaggcgaacggccagcagcggcgcagggttgactaggccaaatcgccataatgatttgatggcattggaaccgctcagagaagcaatgtatgtgccagcatcattagtaaatggggataacgaaattatgaaggaggttaaagaagcgagagcagaggcgaaatgcaaacacaaatgtaatgccaaaattgtaattttaatttttttattaaatttaaatcctttcaggatttggccaactgttgggcaaaagagaacagcagatgaactgatgaacactttttttcccattttcaaccttgtatttcctagggattattggatttggaaactttcatatgtttattctcctaaattgtttattttttttgttgaaaattctcttttacaaaaattttttgtattctaaaaaatgtttttcgtgattttctcaatttattcggttcaagtctaattaaggaaaatatatcaattataatttttacatttatacaacccaaaaacaacaaaagcataaaatttaaaacaaatttaaaaatgattagaaatatcaaaaataaa

SEQ ID NO: 75944 - DNA, 632 bp, Heterodera glycines
  Genomic contig location: Contig_ID=SeqID_12348; Location=1094..1725; Strand=-
  SCN-specific regions: Sequence locations=1-187,252-632
atgagctgcttattcacggagctaacggaagtgaggctttagtcccattttttggttttttgaagaccgataaagcgcaattttcaaaaatgagaagattttgaggttttttagtggttttttgcgattatctaaggcatttgtggggttttttgtggaaaaaaaaattaaatctgatcaagcattgattatttttttttttgatttttacatttgaaaattaatcgttaaaaatgattttttttttttttgccagccaaatgaggcttttcaaaatttccatcttccagactggctcctttccaccaaaccgcacgcgacacttcgaacaaataaccgacaacaaaatgttggcaatggcaagcaagcggcggaaagcaaggctaagcagctcgagaaaatgcgaatggaagatgaggtgaaaaaaaagaaaaacaatttttaaagaatattgagggccgcagggcatcatctggatttcaattgatttcaaatcggattaaatttcacaattagggaagcaacttttagttacgaaaaatctcgaaatatttaactaaaataatgagcaaaaatgccaaaataatgacaaatagcgacataattttcagccaaaatcgagcaaaaataaa

SEQ ID NO: 75945 - DNA, 218 bp, Heterodera glycines
  Genomic contig location: Contig_ID=SeqID_12349; Location=2601..2818; Strand=+
  SCN-specific regions: Sequence locations=1-59,87-117,154-218
atgctgatatttttgattgtcatcagcgctgtcctcattaattcagcattgggaaacggtaattaattaattataaaaattaatatcgaaaattaccgatgattaatcagcaattaaacttcattttttaataaaatatatacatattcatttcagtagatcaccctaaaacggctgtggataaatcaactaatgaaggtatagtaactattttttaa

SEQ ID NO: 75946 - DNA, 689 bp, Heterodera glycines
  Genomic contig location: Contig_ID=SeqID_12350; Location=278..966; Strand=+
  SCN-specific regions: Sequence locations=1-255,277-525,548-689
atggtttggcttcttgcggcttcatcggggttcaacggtgccaatgccgtgggcgacaacggtgtagtacaagttaatccgaccattccaccggcgaacgcacctctcccaccaaaacatttcgtcaatttgcgtgacttaaaacctcatacacaactggtgccaaatgtaccacgaaaatttggcaaaaatgccaacaatgggaaggtcagttcttgggttaaatatggaaatttaaaaataataattgggctaatttttcaaattttagaagaacggtggtcaatgatcgcatggatagaaacgaatatatatccgatatcgcccagcccaatacttgcattatggcatatgaaaggaccgaacctatagataggagtttgaattattttctattcatttttttcatatttggttgcgaaaattgtttttgtaaaattcattttcctttttccattatggataaattttttcggtaaaaatatatttttgtgattcttgaataagttattcgtttaatccttcaaaaaattatatataaaatttacggtaattaatgtatgccgtgaaagacttttacccggcgctcgaataatctaacgttgtcccgttgattggaatactatttgttacaccgttaattagtaaaaaaaattctcaatttaatgaatcaaattgtttcgataaaa

SEQ ID NO: 75947 - DNA, 155 bp, Heterodera glycines
  Genomic contig location: Contig_ID=SeqID_12352; Location=282..436; Strand=-
  SCN-specific regions: Sequence locations=1-57,79-89,111-116,138-155
atgtgtagagctcgacctggacctgggtccaagcctggatttttcctgggtccaggcctgaatttttcctggattcctggatccagttccaggtccaggtcattttttgtcaacatggattttcctggatttttgtccaggaaatccagccccag

SEQ ID NO: 75948 - DNA, 1478 bp, Heterodera glycines
  Genomic contig location: Contig_ID=SeqID_12352; Location=909..2386; Strand=+
  SCN-specific regions: Sequence locations=1-143,165-172,299-417,465 -523,588-637,675-1010,1032-1478
tgaagaacaaatagtcggctgggagcccgacgactacgaaaaggagttggtgaagcgcacatggagcgacgacttcgactttttgtacgaattgggcgcttcgatttacgacgtaaggccaagttttattttaaaaattttgaaattggtaaaaaataaacaaattattgtttttaatgttatcaaatttaaaaatttgacttaaatttttcgtcttttttaatttaatattgaattaaattaatttaaaaaattatttaataaatatattaaattttttatataaattataatttttcagtatatttttgagcacaatcctcaagcaaagcaattattccccaaaattcatcggcatggcgacgagtggcgccaatcggccgactttcgctcccaggccctcaaatttgtccaggcaataattaattaatttaatttaattaattaaaactaaaatttatttaggctaaagaaaaaagaaggaaaccatttggaatatcagctgaaaaaatagaatatttcgaaaataaaaatttaaaacttttcaatttttctcataaataaatgaatttaaaaattaattaaaacatttgtttgtatatttttttggcttttccctacattaaaattcacttgctattaaatgataaattaattattaattagtattatatccaattaaccttttaattgggtgtccgccttcccatcagcagacaatcgcttatgctgctaaaaatctctaccacatggaggagtgtttgaagccgtctctgctcgccatcggtgaacggcacgtgcagtacgcggcacgcggctttcggcccgaacattggaacatatttttggcgagaatttcaacaaaaattatattggatgggtgtgcgtgcattatgcccccgccccttagtgctactcgagagtctcgatcgagtctcgactcgagaaaagtcttgggttttttcggtctcgagtctcgatctcggatttttcacattattagcttttgctaaaaaatttaatatatttaagaaattgttttttctctaatttttcaaaacaattttttttcaatggaaaattcaaaataataatatgattgatcgccatttggtcgggatcccgactcgggattggtctggatcctgactcgggatccgttccgatcgtttttccaaaataatcgggatttggtcgggatttggtctggaccctgactcgggatccgttccgatcgtttttccaaaataatcgggatttggtcgggatttggtctggaccctgactcgggatccgttccgatcatttttccaaaatcatcgggattgatcggcacttggtctggatcccgactcgggatacaatccgagggtctttccaaaatcatcgggatttggtagggatttggtctggaccctgactagggatccgttcctgtgggatccaaaatcatcgggattgatcaccatttggtctgg

SEQ ID NO: 75949 - DNA, 355 bp, Heterodera glycines
  Genomic contig location: Contig_ID=SeqID_12352; Location=1963..2317; Strand=-
  SCN-specific regions: Sequence locations=1-355
accaaatccctaccaaatcccgatgattttggaaagaccctcggattgtatcccgagtcgggatccagaccaagtgccgatcaatcccgatgattttggaaaaatgatcggaacggatcccgagtcagggtccagaccaaatcccgaccaaatcccgattattttggaaaaacgatcggaacggatcccgagtcagggtccagaccaaatcccgaccaaatcccgattattttggaaaaacgatcggaacggatcccgagtcaggatccagaccaatcccgagtcgggatcccgaccaaatggcgatcaatcatattattattttgaattttccattgaaaaaaaattgttttga

SEQ ID NO: 75950 - DNA, 677 bp, Heterodera glycines
  Genomic contig location: Contig_ID=SeqID_12353; Location=53..729; Strand=-
  SCN-specific regions: Sequence locations=1-677
ttggatttgcaacgacgtttggatggacattttcccctcttttgaccgtgctcaactcggcctcaaattggcacttctttcgccacgtttcaatgcgttggtggacaaacatttcaatggcaaaagcgaattgacaatttggagaacgatcgaaattcagaagggcaaaggaccagaaccgaagctgtctgtacaaatggatgacaaatttgtgccatttccattgccggaccgtccgttgcccagcaaaatccgttttaagcgccttcggatgtggtaattaaaaatcagagctatcgcaataaaagcattcatcccatttttaggtacatcggtcactccgtcatcgcttttcttcgttcaaatcaccaaattttcaacaaaagaggcaccaatttaaaattgtggcttccttcttcacataccacgaatggccagcggatttgggacatttttacccgtgaaatttggcactttttttcgacaaacattcgccacttgggcttttacaatggtgatcatttggaccatttgcttcgtcaaatttcgccgacaattctcatcgatctcaaccaattggtttcaatccattcatttgatttgttgcccgaggcgattggtgatgattttgatgtgccaaatgcaacaatttctactggtcaagcattgtccaaatg

SEQ ID NO: 75951 - DNA, 1002 bp, Heterodera glycines
  Genomic contig location: Contig_ID=SeqID_12354; Location=655..1656; Strand=-
  SCN-specific regions: Sequence locations=1-31,62-681,704-941,985-1002
atgaaccgacggtaaaagaattttaatagtcacacaaattcatcatttatttagctaacaaaaaactgttttctataatttcagttggatttgcaacgacgtttggatggacattttcccctcttttgaccgtcctcaactcggcctcaaattggcacttctttcgccacgtttcgatgcgttggtggacaaacatttcgatggcaaaagcgaattgacaatttggagaccaatcgaaattcgtcgcaaggacaaaggaccagaaccgaagctgtctgtacgaatcgatgacaaatttgtgccatttctattgccggaccgtccgttgcccagcaaaatccgttttaattaccttcggattgagtacttaaaaaacagttttatggcaataaaagcattcattccattttcaggtacatcgatcactccgtcatcgcttttcttcgttccaatcaccaaattttcgacaaaagaggcacctatttacacttgcggattccatcaccacacaccacggaagagcagccaatttgggatgttttcaacaatttctgctggccaagcattgtccaaatggttgcactctccgagaaaagatggccaacccaagcgattgcgttgcgatggttacaacgaacaaacggacttagattggatcaacaatttcaaggaggtgtggcctaacatttttgtgatttttagtttccaaattgtctagcattttctccgtgccaatgccatttcttccgtcagttacgaaattcattttcatgttcatgtgccgtcaatacaaatggtgccatttgaattggtgaacgaatcgacaaaggaaaagctgacattggccaaagcaatggaaaatgaattggacaaccgatggataatgaaacgatgcaaaattgggaataagaccgcggcggttcagcagcacaaagagggcgattggaacaatgtgttattttggcttttcagtaccactaattgcattgggtgagcaataaa

SEQ ID NO: 75952 - DNA, 560 bp, Heterodera glycines
  Genomic contig location: Contig_ID=SeqID_12354; Location=2177..2736; Strand=-
  SCN-specific regions: Sequence locations=1-192,232-472,494-560
atgtacggttttgttttgaaatggacagaattatggtaaagtacaaaaaatcaaggaaagttagaattgattggactcataaactctcataaaatgccaatgatgagttataattgcaattgaatcatcgtttttcagtcttctcgacgccgcttctcccgggccgagtgatcagcagaagaaagatgcatgaattaattaatcaattaattaatcgattgattgattgatgcgattatgtgaccgaaaatgatgtgatgttacattgtgttattgttattacttaattaccgtatatgctctaattatagcccagtctctattaatcccccattctctaattatccccccttttctgaggaggttgaaaaataatcccccatgggctataattagagcatatacggtatgttattgtttggatgtgtttgacctttgcttgctcaccgcaaattcgtccatttcctttgtattttatttatatgtaattacataactcattaattgtgattaatcgttgataaaattgctgatgataaaatgtgacgcaacacaataaa

SEQ ID NO: 75953 - DNA, 811 bp, Heterodera glycines
  Genomic contig location: Contig_ID=SeqID_1784; Location=288..1098; Strand=+
  SCN-specific regions: Sequence locations=1-163,186-787,810-811
atggcaaatcgactgacaaacttttatcattgtggcccagtgccgaagtgagtttatgccgttttgcagtgtgcttttcaccaaaagatgcccgactaatgccgcaggtgccgccgatgcgcattttgttgccctttcacgacgattctcttttggttcggctggccattcttcccgcttcttccgtcctcatttccaaaatgtttttgcagccgaatttgtcagcgtccgagttgcccttggaactttggccaaatttggcccaactttcgcatttcacattgtaaatcgactctttcccattactttgcctcttccttcagattcattcgttcgttcttttgcgacgctttcgtttgtgaacattttaacgaattggaacttttttattatggtcagcgccttattttccgcatcactgacatggaatttgcgaatgaatccgagggaaaaacgaaaggggagaagaaaaagactgacgaaaaaggccaagccgcggacgaaggaagacaaaatgtcaagacgcatcgaatttcgccactgtgtgcgtttgacattcattggaacgaagtgcgggagaatgcacggcgagaagaggacgacgatcccgagaatctctgttgatttcatttactcgaaactgactttttttcttaaagaaagggaatatgtagtaagaaaatttgatgtctgatgaaatatattcatgcaaggtgatttcgacagtgagtgaattcgacagcatcagaaaaattgtgaattcgacaaggatttattttgaagtaccgataaatttttaaaaaatagaata

SEQ ID NO: 75954 - DNA, 376 bp, Heterodera glycines
  Genomic contig location: Contig_ID=SeqID_1784; Location=2498..2873; Strand=-
  SCN-specific regions: Sequence locations=22-376
gcatgcgcgtcgccttccccgccacccaacgcacgcgttgctgtgacgcgtttccttccatcgagaaaataccgcgagttcgctgtccaacgctggtcatccatggagtagacgacgatgtgggaaggattgggactgcttttctgacaattcttttcaggtaatcgaattcagccacggcatgaaaatttacgaaaattgtcccggctccgtggaaccgttgtgggtgcgcggcgctggccataacgacgtggaattgcacgccgcatacctggacaggttgagacagttcatcgactcggaggtgtgcaacccgcccacccacagagagcagttgaaaaatgcgaagcggccgcagacgaaccaacaggcgcag

SEQ ID NO: 75955 - DNA, 937 bp, Heterodera glycines
  Genomic contig location: Contig_ID=SeqID_1785; Location=54..990; Strand=-
  SCN-specific regions: Sequence locations=1-33,57-937
atgacggccacaaccattgcccaggatccgactccctcccctcggcgtgtttttctccgtgacctttgttccctcttttgttgcccgccgctcccttcggctattgttgccaaattggcttttatgccaccggaaccgagttaccgaattttgaccaacgactcgggacggtaatatttgtgctgagaagacttacagtcattgagttaggttaagttcgatggaatactgagacgaataattatgctcaatgtctttagtgcttaccaatttcgaatcatttaaaatactaacttttgcaggacgacgttggagctgatcgacggcaggacagagtggccacatgggcaaggttcgttttgggcgatacggcgatggccgttcaagcttcgctgttcagatgagctgaacaatgtcgaggtgttcttcacccgtactcaacgtcgcaataaaatcgcctgtatgttcgtccgacccttcgaactttcgcatttcacccttttgttttctcacggaaatgcggtggatattggccaaatgtgtaacttttaccttgggctcggctgtcgactgcggtgcaatgtgttcagctacgattactcgggttggtcattctctaatttttacaattttgggtttgattttaggttatggtcagtctacaggtcgtccttcggaaaagtaaccaattttatttcttacgaattcctttttttataattggctttctttgaattacattagttaactttttaattcaaattcgcatttttccattccttttctcattctacaaaacattttttgcctccagaaatctctacgcggatatcgctgcggcacttaaatctctcgaaagccgttatcaaattccaccggagcaggtcattttgtacggtcagagcattggaactgtgccttccatcgacttggccag

SEQ ID NO: 75956 - DNA, 80 bp, Heterodera glycines
  Genomic contig location: Contig_ID=SeqID_1786; Location=4002..4081; Strand=+
  SCN-specific regions: Sequence locations=1-80
tagagaaaaaaagataatgtttttctctggcactctctatttattggtacacatctcgttttttcggacggtgtgtgtat

SEQ ID NO: 75957 - DNA, 2420 bp, Heterodera glycines
  Genomic contig location: Contig_ID=SeqID_1786; Location=1084..3503; Strand=+
  SCN-specific regions: Sequence locations=1-2007,2077-2420
atgttgtcgggtgtaaattcctccactgacacagagaactcgtacgagttcaggacgaaggttatgggaaagaaatcttttaacagatcgccacatggcacatctttcggaaagcaaaggcgccggctgttttggcaaagtgaaaaacaaacggcgcgtgcggctggcacatccaatatttttgccaacaatttaccttttgggtactgttgacagcagatggctgctgacagccgacggcttttccaattgaatttaatttttcataaatttcatgtttattcatcaatgctaatatttatcgtcttctttttttttgttggaggggctgagtcaccacgcactaccaaaaaccgtgaattattgtttcacgacggttttgaatatcgccaaaaaagtgtatcaaaagacgggggaactcagttctggaattgtgtcaaaaaagactgcaatggacgtgcacacagcccttttggccggacagaacctcttaatattgtatccgcacataatcatgcaagaaaagctgccaaacatgaagtgaaaatttgatattgaaaggattctatattattttgcgacaagtgcaaaaatttgctttgtttgatttctgtggcaagacaccgtagtgatgaagccccgtctctttaggcgcgactttcgaaagaagcggtgaaagatattgccagacaacaacctgatgcacaacctcgcaatgtaattgcacaagaacgtgcacaactttctgatgaagcgcggatgaatttgccatctgcttcgtcattacaacgctcaattgagcgtcaacgagaaattcccgatcgagcacgaattgacgcaaatgaaattgcgaacgatgttattgaggtataaattaatatcgagtcggcaaagggtgatttaatgttcatttttagggaatattacttatatccgagttcttcaggtacttattgtttgtattttaatctgaccatgcaataattaacattcaattttaatttaaatttgctattaaaaataggccttggatgcttcacttggtattgcccctaacagtgttatgttagattttgaaagaggtaaataaagttttttgtttgacttataaagttatagccgcaaaaatgcttatctccacgtgtacggaaacgacgtgcaaattcgcttttgtctttttcatctcggccagagcattaacagaagagtatcaaaagacaaattaattcactattacacaacaaacaacgaatacaaaattctggttagaagcttggctgccctcgcatttcttcaagaatttcaagttgttcctggatttaatcttcttcgcttaaaagctcaagaattgaatgttcaagttattcaagatggaggccaaccaatctcagtttttgactattttggaaggtacataaatgggttaacaaatataatatttgttaacacagaacatatgtacatggtcatgctggccatggacccttgtttcctattgcaacttggaatcatcatgaaagtataattcaagatatgggacgtacaaacaacgcacaggaaggttttcacctggccttgcgaacacagttcactagtgtacacccgccattatcaaagtccaaatgttttgctccctttggtaatcctagtaaatgtaggctcgtcactgtattgaagaaggaggaacgtatagctgctgataaacttcgacaatacgagttggatcccacaaacggaattcggctccgtgaacgaaaaaaggtttacagggacaatgacgtggccctgcgaaacctagtcgaaggatttgatttgcttgcggatccaaacgatgacgaattccttactcatctgagatcgttgcaataccgtctgatgcgaaatgattttgaaaattgggatgggcccgatgtggagtaattaactacattttcccgttggcccttgggaaaggcattttctttttttcaaataaagaatcaacgactttgttgccttgaaaagtccatattaaattaatttaattaaaaaataatttttttttgaattcaaaaatgatttttctaattattttaacacgattttattaaaaaggtgattcccaagtgtcgagtccgcaaatgtcgggttccgcaaatgtcgggtccgcaaatgtcggggttatccgcaattgtcaggtccgcaagtgtcgagtccgcaaatgtcgggttccgcaaatgtcgggtccgcaaatgtcgggtccgcaaatgtcaaatccgcaaacgtcgcgccacgattttggcccattccgaaccccaaacccggattcgaacaaaaaagtcaaaatccatttttcaaaagattcacattttattttgatttttagatttgtttttgaagaattgatgcgagcctgggcgaagtattggcctctcgagtga

SEQ ID NO: 75958 - DNA, 1476 bp, Heterodera glycines
  Genomic contig location: Contig_ID=SeqID_12357; Location=1272..2747; Strand=-
  SCN-specific regions: Sequence locations=1-15,37-192,214-222,244 -668,690-1476
atgattcgtaataagcttgaaagtcaacaaaaaagtcggaagaagcgttatatttcagacatttcaaacacaaatgaggatgccgtgaatttgggagtggaatttggcgaaccgaatgccgtgataactttcgacaacgttgaacaacagactttgaacgaagctgaagtctcagtaatgacctttgagcgcggaaaaacaaattttgggggacattgcctatggttgaatggtacgtttgaagcgacgcaaaaaaatagactccaaatgttcaggatttcgttacacacaccactcaggggaccgttggagatgcacaattcgtagttgctcagcatatgcaaacatcacaaacaatgacgaaattggagctactggaaccttgggtcaaaaagaacacaaccacctcccagcgcctcagaaacaacaagtttgtttaaatttaaaaccaaataattaatgctgtgttaaaggcggaatcaaggcgacagaaaatcaaagaaagtgtcctggccgagccgtgtctgaagcccacgcgacttttggcaaaagtgaggcgatcagcaacagatgaagcatttgtggccatgagttcaaacaatgcgttgacccaaatgatgcggcgtgagaagagaaagttgctgggaaacgtcgacgtgcagaacccactggcctttgtcatcccagcaacgttacgcgaaaagggcggtgaggacatcgtcttgtatgacagtctaaatgtcaggcaaggcgaaaaggacgttgtccttattttcggcagtgttaaggtacattttttggctataaaattctgtttgttattggtattcctttagactggacattttgcgccaatgtggcacgtggcacctcgacggaactttcaaatgcgctccagcgatgtgggagcagtgcttcgtcattggtgcgtcagtgaatcagaaaatgtgcatctgtatgtggtgtcttctgcctgggaaacagcgacgctactacgaagaagcactgaactttctccgtgaacgcatctctccggaggtcccaagcaaaggtcaaccctttgaaatttacaaaaaaaacaaatcaaaaatgtgatttttagttttgtgtgactttgaaaaggccgaaattacttcggtccgtacggcatttcccacggcacagattaagtgctgcatgttccactacaggcaaagcctttacaggaacttcaaacgacttggtcttgtccatttgtacggtgagaagacagaacgtggggaggaagttcgcaacacattccggttaaaattttggtgaaattcaaattccttttcagaagtgttcttgctttgcctcttttgcctcccagcattgtcagaatggctttctcaattattttggcgtcagctcctgcaggaatgcatgagtttttcctttacttctctcgaacatacataggcttgacacagcgtcagttattgaatgtttaataaa

SEQ ID NO: 75959 - DNA, 1863 bp, Heterodera glycines
  Genomic contig location: Contig_ID=SeqID_12358; Location=1..1863; Strand=-
  SCN-specific regions: Sequence locations=1-215,289-569,591-595,618 -817,840-1166,1208-1220,1243-1305,1391-1828,1856-1863
atgataataattttatcaacaaaactgctaccgttatccgttctgctgcttccaattatgcttggcattaccaatgccgctggcatcggcgacagacaaaaaagggcggtggaggaggaagaacaaagaagcatgagcgaactgtgtgccatccatgaacagaagttcaaggagttattcaaggttaaaactggaaatgccgaagttttatggatggaaaacaaagagaagaaagcggaggaaaagcaggaggaaaaggaaaagcgggaagagaaagcggcagaagagacaatggatgctaaaaataaagcatggcttagcactttgttaggcaattatttgtgccaaaaattacggggcaaaggcggggagcaaagacacggaaaaaataatgagaaattggattatggcgtggagaagaatgtgtggtggaccacgcctgaaaagaattcaaatgaatttaaagttagggcggagaaaatttttggacgtatcagagtcaaaaatgggatcagtgacgagcaattgctggtatgggaaaagccagggattcggggaatgggttcgggtttttttttatttaaaaaaatccccattttatattttagaaattgttgttttaaattgaaaaattgattattgtgtttggtcaaaaaccgctaattaactacaatctaacataaattcttaaattttctccggcggatgtcttgttagggttggaatatcggattcgggaagccggaattctggatttaggactttgaatttttggcgactccggacccacccttattgaaaattatccttagtgcaagcttttttgaaaattgtttcgaacaggtgtcactgtccgagcttgtgccgttgaaagagcgcggaggcagcggaggtgtgtttttcagaaccaaggacgacaaattcattttaaagaatctgaaccctgagcatgatgagcccgcaaaaatggatgaagtgttagacaaatatgcggcttatgtaatcgacggagtgatcagcggtcaatccgagaagggcaagcagtccacgaagaaaaacagcaacactattcacaaatccatgatgaacaccatgttcatgtgcttcaaaatgaagctgtatgccaagcggaaggaggacgatggaaatgagaggaaaaaagtaagataattaaattttaatatataattttcaaacaatttaaattctgctggcaattgaattttttattttaatttatttggaatttattccaaaatttctaataatctaagaaaatattatctgcatcaattattttttcgctaaaatattttaaattgattttttaatgaaaaattttgaattgaaacgaataataatttttcaataaagttttaattttttttttctcgggagagattatgttcgccccttggtcatgccggtttattagtctgataaaaattcccgactctttgatttcggcattccccggctttccccgcccaactctttttcaacaatttcctaattttaaggtgattcgccttcacgaattacaatttgtggtgctgaacaacgcatttgaggggctcaaattagagtacgctacactcccccatgtcgtctctcttcccccgaaaaaaatgtaattttccaaattttttttttaatttcgaggaaaaaaagaaaaattttaatagccaatttgcgccgttatttgagcggctactgggagccataagagcatgcacaatgttcatgatatatgttaagttttcgcaatcgccgaaaaacgcgcgccgaactggccgtgccgaactaaccccgacccatttgtacggattttctttaaaaatgataaaatatgtatcaattaaa

SEQ ID NO: 75960 - DNA, 75 bp, Heterodera glycines; identical to SEQ ID NO: 52311
  Genomic contig location: Contig_ID=SeqID_12359; Location=1105..1179; Strand=+
  SCN-specific regions: Sequence locations=1-75

SEQ ID NO: 75961 - DNA, 170 bp, Heterodera glycines
  Genomic contig location: Contig_ID=SeqID_12359; Location=1556..1725; Strand=+
  SCN-specific regions: Sequence locations=1-5,28-147
agccctaaatgaatgaatgatgaatgagatgagtcggacggagaaagaatgtgctgcaacccaagaagagaattcaaagaaaaaaggagatggaaatgattgaaatttgtcaaaaaataaataaattcatagcggtagaaaatttttgataaataaatcatttttaaaaa

SEQ ID NO: 75962 - DNA, 1630 bp, Heterodera glycines
  Genomic contig location: Contig_ID=SeqID_12360; Location=182..1811; Strand=-
  SCN-specific regions: Sequence locations=1-71,106-215,407-418,445 -467,580-666,688-806,832-907,949-1309,1331-1335,1357-1426,1475-1630
atgtccaactttttgttccgtgccgaaacgcctcagctgaattttgctgaggttgaggtagaaaaaaactgaaaataaaaaaatactaatttattttaaattttaggaccgtctgaggcccaacccaaatttgttgaccgaaaatgtgacaattccggaattttttgaatatgcgccgattcgggaccgaattccggcgcgaatgagagaaatggtaaaaataatgaaattttaatattatatttaattttattaaaaatgttttttaaattatttaattcattttatctttttcaaatattattaaaattttatttaaattcataacgaaaaaattattttcctttttttattaatttgttttttgggattatacaaaaaaattttttctaatatttaaatatttgatatcaaactgtgttttattttgttttgttttctttttattaatttgttgggaattggacaattatttttttaatatcaaaaatatgttttaattttcttagttaatccctttttatatatatttattaaatattttacatatttaataattttgcaaaaaataaaataattcgaaaacttagaatttcgaaaaaatttctaaaagccaataagcgttgaaatatattcaggatatgggatgagaaggattaaaataagttaattctcttccttttagtttccctggcaaagtttggtaagcttctgatcactattcgaaaaacttttggggcaaaagtatttcaaaaattagaaaacattgaaaatccaaaaaattttaaggaaagcctatgggattgaaaaaaattaattttttataaataagtctttatctcagctgttatcctgcaaaatctggtgcacttctgatcactttttcgaaaaaattatgaggggattaaattttcactaaaatataacttttattttaaaatgttttatcgaacttacaattaggtctttctattagggttcctccccgagcctcggggagcaaaatgtcggggaacggggaggaaattccccgaaagaatttgtcggggatggctggagaaatttaaaaaatgtcggggagcaacaccttcgtcggggaggaaattttcataaaaagtctaaaaaatacaaaaagaaaaagtccagaacaaaaaagtcttaaaaactcatttaaagattcgtccatcttatttcaagtgcaatttacgactttcgtaattccccgaaacatgtcggggaggaaccctactttctataattaataaagtggctccaactttggtgggcacatctccggtatgggagtcatttatcttgaaaatatttccacgcttaatggttctaacattcttttgaaattctgagttttccatcttattttattttgttggaaattagacaatttatttttcaattgcaccctgtcaatttaattattaatattttattctttgttattcattttttattttttccccatttcacgagtcattttgttcgtggccataccgatcggttggcctcgtacctcatgagcaatcacagcgtccaccacttcgccaacacctccgtctccatgtacatgcaaagtcaattctctctggacgagccccttatatcggaggtgcag
